US006673910B1

(12) United States Patent
Breton

(10) Patent No.: US 6,673,910 B1
(45) Date of Patent: Jan. 6, 2004

(54) **NUCLEIC ACID AND AMINO ACID SEQUENCES RELATING TO *M. CATARRHALIS* FOR DIAGNOSTICS AND THERAPEUTICS**

(75) Inventor: Gary L. Breton, Marlboro, MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 09/540,236

(22) Filed: Apr. 4, 2000

Related U.S. Application Data

(60) Provisional application No. 60/128,416, filed on Apr. 8, 1999.

(51) Int. Cl.[7] ............... C07H 21/04; C12Q 1/68; C12N 15/63; C12N 15/85
(52) U.S. Cl. ............... 536/23.1; 536/24.1; 435/6; 435/320.1; 435/325
(58) Field of Search ............... 435/6, 252.3, 320.1, 435/325; 536/23.1, 24.1

(56) References Cited

U.S. PATENT DOCUMENTS

| | | | |
|---|---|---|---|
| 5,030,556 A | 7/1991 | Beaulieu et al. | 435/6 |
| 5,556,755 A | 9/1996 | Murphy | 435/6 |
| 5,607,846 A | 3/1997 | Murphy et al. | 435/69.3 |
| 5,712,118 A | 1/1998 | Murphy | 435/69.3 |
| 5,721,097 A | 2/1998 | Roussau et al. | 435/6 |
| 5,725,862 A | 3/1998 | Murphy | 424/251.1 |
| 5,808,024 A | 9/1998 | Sasaki et al. | 536/23.1 |
| 5,948,412 A | 9/1999 | Murphy | 424/251.1 |
| 5,972,657 A | 10/1999 | Murphy et al. | 435/69.3 |
| 5,981,213 A | 11/1999 | Hansen et al. | 435/69.1 |
| 6,001,564 A | 12/1999 | Bergeron et al. | 435/6 |
| 6,004,562 A | 12/1999 | Campagnari | 424/251.1 |
| 6,090,576 A | 7/2000 | Myers et al. | 435/69.1 |
| 6,184,371 B1 | 2/2001 | Loosmore et al. | 536/23.7 |
| 6,214,981 B1 | 4/2001 | Tucker et al. | 536/23.1 |

OTHER PUBLICATIONS

Ullrich, GenBank Accession: X70766, Aug. 3, 1994.*
Celnicker et al., GenBank Acc. No :AC005286, Jul. 15, 1998.*

Murphy, T.F., et al., "The major heat–modifiable outer membrane protein CD is highly conserved among strains of *Branhamella catarrhalis*," *Mol. Microbiol.*, 10 (1) :89–97 (1993).

Hsiao, C.B., et al., "Outer membrane protein CD of *Branhamella catarrhalis*: sequence conservation in strains recovered from the human respiratory tract," *Microb. Pathog.*, 19:215–25 (1995).

Bhushan, R., et al., "Molecular cloning and characterization of outer membrane protein E of *Moraxella (Branhamella) catarrhalis*," *J. Bacteriol.*, 176(21):6636–43 (1994).

Bootsma, H.J., "Molecular characterization of the BRO β–lactamase of *Moraxella (Branhamella) catarrhalis*," *Antimicrob Agents Chemother.*, 40(4):966–72 (1996).

Aebi, C., et al., "Mapping of a protective epitope of the CopB outer membrane protein of *Moraxella catarrhalis*," *Infect. & Immun.*, 66(2):540–8 (1998).

Myers, L.E., et al., "The transferring binding protein B of *Moraxella catarrhalis* elicits bactericidal antibodies and is a potential vaccine antigen," *Infect. & Immun.*, 66(9):4183–92 (1998).

Du, R.P., et al., "Cloning and expression of the *Moraxella catarrhalis* lactoferrin receptor genes," *Infec. & Immun.*, 66(8):3656–65 (1998).

Helminen, M.E., et al., "A Major Outer Membrane Protein of *Moraxella catarrhalis* Is a Target for Antibodies That Enhance Pulmonary Clearance of the Pathogen in an Animal Model," *Infec. & Immun.*, 61(5):2003–10 (1993).

* cited by examiner

Primary Examiner—Michael P. Woodward
Assistant Examiner—Shubo Zhou
(74) Attorney, Agent, or Firm—Genome Therapeutics Corporation

(57) ABSTRACT

The invention provides isolated polypeptide and nucleic acid sequences derived from *Moracella catarrhalis* that are useful in diagnosis and therapy of pathological conditions; antibodies against the polypeptides; and methods for the production of the polypeptides. The invention also provides methods for the detection, prevention and treatment of pathological conditions resulting from bacterial infection.

14 Claims, No Drawings

NUCLEIC ACID AND AMINO ACID SEQUENCES RELATING TO *M. CATARRHALIS* FOR DIAGNOSTICS AND THERAPEUTICS

RELATED APPLICATIONS

This application claims the benefit of U.S. Provisional Application Ser. No. 60/128,416, filed Apr. 8, 1999, the entire teachings of which are incorporated herein by reference.

BACKGROUND OF THE INVENTION

The genus Moraxella is a member of the family Neisseriaceae. The 10 species of this genus, are separated into 2 subgenera, Moraxella (rods) and Branhamella (cocci). Moraxella are gram-negative, aerobic, oxidase-positive, and usually catalase-postive. (Bovre, K. 1984. Genus II. Moraxella Lwoff .1939, 173 emend. Henriksen and Bovre 1968, 391, 105. Krieg and Holt (editors) In Bergey's Manual of Systematic Bacteriology, 1:296–303.). *Moraxella catarrhalis*, a member of the subgenera Branhamella, was previously called *Branhamella catarrhalis* and *Neisseria catarrhalis*.

*Moraxella catarrhalis* is frequently isolated from the nasal cavity of humans, and until recently, was considered a nonpathogenic commensal of the upper respiratory tract. Currently it is most important lower respiratory pathogen after *S.pneumoniae* and *H. influenzae* (Doren, G., et al, 1986. Diagn. Microbiol. Infect. Dis. 4:191–201.). It is a common cause of otitis media in children, acute bronchitis or pneumonia in adults, and sinusitis (Wood, G., et al, 1996. Clin. Infect. Dis. 22:632–636.). Bacteremia, meningitis, skeletal infections and endocarditis due to *M. catarrhalis* are rare, but are observed in immunocompromised individuals (Aebi, C., et al, 1998. Infect. Immun. 66:540–548.). Concern for *M. catarrhalis* infections of cystic fibrosis (CF) patients is growing. Damage to the respiratory tract by *M. catarrhalis* could promote invasion by other pathogens such as *P. aeruginosa* in CF patients. (Deneuville, E., et al, 1995. ACTA Paediatr. 84:1212.). *M. catarrhalis* is also associated with acute laryngitis. In one study, 50% of patients with acute laryngitis were colonized with *M. catarrhalis* (Hol, C., et al, 1996. Journal of Infectious Diseases. 174:636–638.), while isolates from healthy adults occur at the rate of 6% –11%. The colonization rates of children can be much higher, with average rates of 30%–35% (Sehgal, SC. et al, 1994. Infection 22:193–196.). In some hospitals, *M. catarrhalis* accounts for half of all the respiratory infections (Bluesone, C., et al, 1992. Pediatr. Infect. Dis. J. 11:S7–S11.).

Increasing levels of antibiotic resistance have been observed in clinical isolates of *M. catarrhalis* recently. Before 1980, less than 10% of *M. catarrhalis* isolates were β-lactamase-positive. Currently, most clinical isolates produce β-lactamase, making them resistant to β-lactam antibiotics such as penicillin. (Doern, G., et al, 1996. Antimicob. Agents Chemother. 40:2884–2886.). *M. catarrhalis* is intrinsically resistant to a small group of drugs that include vancomycin and trimethoprim (Wallace, R J. 1990. Am. J. Med. 88:46S–50S), and is becoming increasingly resistant to sulfamethoxazole, oral cephalosporins, and macrolides (Hoppe, H L. 1998. Am.J. Health. Syst. Pharm. 55:1881–97).

Although, *M. catarrhalis* was once considered only as part of the nonpathogenic flora of the upper respiratory tract, it is emerging as an important respiratory pathogen. Currently, it is the third leading cause of lower respiratory tract infections and otitis media. Sequencing and further analysis of this genome will aid in identification of essential genes for development of drug targets, and reduce the health threat this organism poses.

SUMMARY OF THE INVENTION

The present invention fulfills the need for diagnostic tools and therapeutics by providing bacterial-specific compositions and methods for detecting. Moraxella species including *M. catarrhalis*, as well as compositions and methods useful for treating and preventing Moraxella infection, in particular, *M. catarrhalis* infection, in vertebrates including mammals.

The present invention encompasses isolated nucleic acids and polypeptides derived from *M. catarrhalis* that are useful as reagents for diagnosis of bacterial disease, components of effective antibacterial vaccines, and/or as targets for antibacterial drugs including anti-*M. catarrhalis* drugs. They can also be used to detect the presence of *M. catarrhalis* and other Moraxella species in a sample; and in screening compounds for the ability to interfere with the *M. catarrhalis* life cycle or to inhibit *M. catarrhalis* infection. They also have use as biocontrol agents for plants.

In one aspect, the invention features compositions of nucleic acids corresponding to entire coding sequences of *M. catarrhalis* proteins (SEQ ID NO: 1–SEQ ID NO: 1920), including surface or secreted proteins or parts thereof, nucleic acids capable of binding mRNA from *M. catarrhalis* proteins to block protein translation, and methods for producing *M. catarrhalis* proteins or parts thereof using peptide synthesis and recombinant DNA techniques. This invention also features antibodies and nucleic acids useful as probes to detect *M. catarrhalis* infection. In addition, vaccine compositions and methods for the protection or treatment of infection by *M. catarrhalis* are within the scope of this invention.

The nucleotide sequences provided in SEQ ID NO: 1–SEQ ID NO: 1920, a fragment thereof, or a nucleotide sequence at least about 99.5% identical to a sequence contained within SEQ ID NO: 1–SEQ ID NO: 1920 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 1920, a fragment thereof, or a nucleotide sequence at least about 99.5% identical to a sequence contained within SEQ ID NO: 1–SEQ ID NO: 1920. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2,Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 1920, a fragment thereof, or a nucleotide sequence at least about 99.5% identical to SEQ ID NO: 1–SEQ ID NO: 1920 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing,* 2d Edition, Academic Press, San Diego, Calif. (1998); and Leonard F. Peruski, Jr., and Anne Harwood Peruski, *The Internet and the New Biology: Tools for Genomic and Molecular Research,* American Society for Microbiology, Washington, D.C. (1997).

Computer algorithms enable the identification of *M. catarrhalis* open reading frames (ORFs) within SEQ ID NO: 1–SEQ ID NO: 1920 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing,* 2d Edition, Academic Press, San Diego, Calif. (1998); and Leonard F. Peruski, Jr., and Anne Harwood Peruski, *The Internet and the New Biology: Tools for Genomic and Molecular Research,* American Society for Microbiology, Washington, D.C. (1997). Such algorithms are utilized on computer systems as exemplified below. The ORFs so identified represent protein encoding fragments within the *M. catarrhalis* genome and *M. catarrhalis* plasmidsand are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *M. catarrhalis* genome and plasmids. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently a available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *M. catarrhalis* genome and plasmids which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing,* 2d Edition, Academic Press, San Diego, Calif. (1998); and Leonard F. Peruski, Jr., and Anne Harwood Peruski, *The Internet and the New Biology: Tools for Genomic and Molecular Research,* American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *M. catarrhalis* genome and plasmids from *M. catarrhalis,* such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *M. catarrhalis* genome and plasmids possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *M. catarrhalis* genome and plasmids. In the present examples, implementing software which implement the BLASTP2 and bic_SW algorithms (Altschul et al., J Mol. Biol. 215:403–410 (1990); Compugen Biocellerator) was used to identify open reading frames within the *M. catarrhalis* genome and plasmids. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

The invention features *M. catarrhalis* polypeptides, preferably a substantially pure preparation of an *M. catarrhalis* polypeptide, or a recombinant *M. catarrhalis* polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with, an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, still more preferably at least about 50, 100, or 150 contiguous amino acid residues of the invention contained in the Sequence Listing. In yet another preferred embodiment, the amino acid sequence which differs in sequence identity by about 7% to about 8% from the *M. catarrhalis* amino acid sequences of the invention contained in the Sequence Listing is also encompassed by the invention.

In preferred embodiments: the *M. catarrhalis* polypeptide is encoded by a nucleic acid of the invention contained in the Sequence Listing, or by a nucleic acid having at least about 60%, 70%, 80%, 90%, 95%, 98%, or 99% sequence identify nucleic acid of the invention contained in the Sequence Listing.

In a preferred embodiment, the subject *M. catarrhalis* polypeptide differs in amino acid sequence at about 1, 2, 3, 5, 10 or more residues from a sequence of the invention contained in the Sequence Listing. The differences, however, are such that the *M. catarrhalis* polypeptide exhibits an *M. catarrhalis* biological activity, e.g., the *M. catarrhalis* polypeptide retains a biological activity of a naturally occurring *M. catarrhalis* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *M. catarrhalis* polypeptide is a recombinant fusion protein having a first *M. catarrhalis* polypeptide portion and a second polypeptide portion, e.g., a second polypeptide portion having an amino acid sequence unrelated to *M. catarrhalis*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and posttranslational events.

In a preferred embodiment, the encoded *M. catarrhalis* polypeptide differs (e.g., by amino acid substitution, addition or deletion of at least one amino acid residue) in amino acid sequence at about 1, 2, 3, 5, 10 or more residues, from a sequence of the invention contained in the Sequence Listing. The differences, however, are such that: the *M. catarrhalis* encoded polypeptide exhibits an *M. catarrhalis* biological activity, e.g., the encoded *M. catarrhalis* enzyme retains a biological activity of a naturally occurring *M. catarrhalis*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *M. catarrhalis* strain, 98-4362, from which genomic sequences have been sequenced, has been deposited on Jul. 20, 1998, in the American Type Culture Collection and assigned the ATCC designation # 202156.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to *M. catarrhalis* polypeptides, especially by antisera to an active site or binding domain of *M. catarrhalis* polypeptide. The invention also includes fragments, preferably biologically active fragments. These and other polypeptides are also referred to herein as *M. catarrhalis* polypeptide analogs or variants.

The invention further provides nucleic acids, e.g., RNA or DNA and their respective complements, encoding a polypeptide of the invention. This includes double stranded nucleic acids as well as coding and antisense single strands.

In preferred embodiments, the subject *M. catarrhalis* nucleic acid will include a transcriptional regulatory sequence, e.g., at least one of a transcriptional promoter or transcriptional enhancer sequence, operably linked to the *M. catarrhalis* gene sequence, e.g., to render the *M. catarrhalis* gene sequence suitable for expression in a recombinant host cell.

In yet a further preferred embodiment, the nucleic acid which encodes an *M. catarrhalis* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; still more preferably to at least about 20 consecutive nucleotides of the invention contained in the Sequence Listing; most preferably to at least about 40 consecutive nucleotides of the invention contained in the Sequence Listing.

In another aspect, the invention provides a substantially pure nucleic acid having a nucleotide sequence which encodes an *M. catarrhalis* polypeptide. In preferred embodiments: the encoded polypeptide has biological activity; the encoded polypeptide has an amino acid sequence at least about 60%, 70%, 80%, 90%, 95%, 98% or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes an *M. catarrhalis* polypeptide or an *M. catarrhalis* polypeptide variant as described herein; a host cell transfected with the vector; and a method of producing a recombinant *M. catarrhalis* polypeptide or *M. catarrhalis* polypeptide variant; including culturing the cell, e.g., in a cell culture medium, and isolating an *M. catarrhalis* or *M. catarrhalis* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 1920 or complements thereof. Alternatively, the nucleic acids comprise sequences contained within any ORF (open reading frame), including a complete protein-coding sequence, of which any of SEQ ID NO: 1–SEQ ID NO: 1920 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features a purified recombinant nucleic acid having at least about 50%, 60%, 70%, 80%, 90%, 95%, 98%, or 99% homology with a sequence of the invention contained in the Sequence Listing The invention also encompasses recombinant DNA (including DNA cloning and expression vectors) comprising these *M. catarrhalis*—derived sequences; host cells comprising such DNA, including fungal, bacterial, yeast, plant, insect, and mammalian host cells; and methods for producing expression products comprising RNA and polypeptides encoded by the *M. catarrhalis* sequences. These methods are carried out by incubating a host cell comprising an *M. catarrhalis*—derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *M. catarrhalis* polypeptide from the cell fraction, the medium fraction, or both. The polypeptides can also be made by in vitro translation.

In another aspect, the invention features nucleic acids capable of binding mRNA of *M. catarrhalis*. Such nucleic acid is capable of acting as antisense nucleic acid to control the translation of mRNA of *M. catarrhalis*. A further aspect features a nucleic acid which is capable of binding specifically to an *M. catarrhalis* nucleic acid. These nucleic acids are also referred to herein as complements and have utility as probes and as capture reagents.

In another aspect, the invention features an expression system comprising an open reading frame corresponding to *M. catarrhalis* nucleic acid. The nucleic acid further comprises a control sequence compatible with an intended host. The expression system is useful for making polypeptides corresponding to *M. catarrhalis* nucleic acid.

In another aspect, the invention encompasses: a vector including a nucleic acid which encodes an *M. catarrhalis* polypeptide or an *M. catarrhalis* polypeptide variant as described herein; a host cell transfected with the vector; and a method of producing a recombinant *M. catarrhalis* polypeptide or *M. catarrhalis* polypeptide variant; including culturing the cell, e.g., in a cell culture medium, and isolating the *M. catarrhalis* or *M. catarrhalis* polypeptide variant, e.g., from the cell or from the cell culture medium.

In yet another embodiment of the invention encompasses reagents for detecting bacterial infection, including *M. catarrhalis* infection, which comprise at least one *M. catarrhalis*—derived nucleic acid defined by any one of SEQ ID NO: 1–SEQ ID NO: 1920, or sequence-conservative or function-conservative variants thereof. Alternatively, the diagnostic reagents comprise nucleotide sequences that are contained within any open reading-frames (ORFs), including preferably complete protein-coding sequences, contained within any of SEQ ID NO: 1–SEQ ID NO: 1920, or polypeptide sequences contained within any of SEQ ID NO: 1921–SEQ ID NO: 3840, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *M. catarrhalis*—derived immunogenic component, wherein the immunogenic component comprises one or more of the polypeptides encoded by any one of SEQ ID NO: 1–SEQ ID NO: 1920 or sequence-conservative or function-conservative variants thereof; or polypeptides that are contained within any ORFs, including complete protein-coding sequences, of which any of SEQ ID NO: 1–SEQ ID NO: 1920 forms a part; or polypeptide sequences contained within any of SEQ ID NO: 1921–SEQ ID NO: 3840; or polypeptides of which any of SEQ ID NO: 1921–SEQ ID NO: 3840 forms a part. Host animals include any warm blooded animal, including without limitation mammals and birds. Such antibodies have utility as reagents for immunoassays to evaluate the abundance and distribution of *M. catarrhalis*—specific antigens.

In yet another aspect, the invention provides diagnostic methods for detecting *M. catarrhalis* antigenic components or anti-*M. catarrhalis* antibodies in a sample. *M. catarrhalis* antigenic components may be detected by known processes, including but not limited to detection by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 1920 or sequence-conservative or function-conservative variants thereof, or against a polypeptide sequence contained in any of SEQ ID NO: 1921–SEQ ID NO: 3840 or function-conservative variants thereof.

In yet another aspect, the invention provides a method for detecting antibacterial-specific antibodies in a sample, which comprises: (i) contacting a sample suspected to contain antibacterial-specific antibodies with an *M. catarrhalis* antigenic component, under conditions in which a stable antigen-antibody complex can form between the *M. catarrhalis* antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 1920 or sequence-conservative and function-conservative variants thereof, or is a polypeptide sequence contained in any of SEQ ID NO: 1921–SEQ ID NO: 3840 or function-conservative variants thereof.

In another aspect, the invention features a method of generating vaccines for immunizing an individual against *M. catarrhalis*. The method includes: immunizing a subject with an *M. catarrhalis* polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g., a polypeptide, e.g., a fragment of a host cell polypeptide, for the ability to bind an *M. catarrhalis* polypeptide. The method includes contacting the compound to be evaluated with an *M. catarrhalis* polypeptide and determining if the compound binds or otherwise interacts with the *M. catarrhalis* polypeptide. Compounds which bind or otherwise interact with *M. catarrhalis* polypeptides are candidates as modulators, including activators and inhibitors, of the bacterial life cycle. These assays can be performed in vitro or in vivo.

In another aspect, the invention features a method of evaluating a compound, e.g., a polypeptide, e.g., a fragment of a host cell polypeptide, for the ability to bind an *M. catarrhalis* nucleic acid, e.g., DNA or RNA. The method includes contacting the compound to be evaluated with an *M. catarrhalis* nucleic acid and determining if the compound binds or otherwise interacts with the *M. catarrhalis* nucleic acid. Compounds which bind *M. catarrhalis* are candidates as modulators, including activators and inhibitors, of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, such as, for example, the strain *M. catarrhalis*98-4362. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including *M. catarrhalis*, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 3840. Use of the terms "SEQ ID NO: 1–SEQ ID NO: 1920", "SEQ ID NO: 1921–SEQ ID NO: 3840, "the sequences depicted in Table 2", etc., is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

DEFINITIONS

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physicochemical properties (such as, for example, acidic, basic, hydrophobic, and the like). "Function-conservative" variants also include any polypeptides that have the ability to elicit antibodies specific to a designated polypeptide.

An "*M. catarrhalis*—derived" nucleic acid or polypeptide sequence may or may not be present in other bacterial species, and may or may not be present in all *M. catarrhalis* strains. This term is intended to refer to the source from which the sequence was originally isolated. Thus, an *M. catarrhalis*—derived polypeptide, as used herein, may be used, e.g., as a target to screen for a broad spectrum antibacterial agent, to search for homologous proteins in other species of bacteria or in eukaryotic organisms such as bacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least about 10, 20, 50 70, 80 or 95% dry weight of the purified preparation. Preferably, the preparation contains sufficient polypeptide to allow protein sequencing; at least about 1, 10, or preferably 100 mg of polypeptide.

A purified preparation of cells refers to, in the case of plant or animal cells, an in vitro preparation of cells and not an entire intact plant or animal. In the case of cultured cells or microbial cells, it consists of a preparation of at least about 10%, more preferably at least about 50%, of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome and plasmids of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant NA which is part of a hybrid gene encoding additional *M. catarrhalis* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared× 100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such. as, for example 2×SSC at 55° C.) require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has *M. catarrhalis* biological activity if it has one, two or preferably more of the following properties:

(1) if when expressed in the course of an *M. catarrhalis* infection, it can promote, or mediate the attachment of *M. catarrhalis* to a cell; (2) it has an enzymatic activity, structural or regulatory function characteristic of an *M. catarrhalis* protein; (3) the gene which encodes it can rescue a lethal mutation in an *M. catarrhalis* gene. A polypeptide has biological activity if it is an antagonist, agonist, or super-agonist of a polypeptide having one of the above-listed properties.

A biologically active fragment or analog is one having an in vivo or in vitro activity which is characteristic of the *M. catarrhalis* polypeptides of the invention contained in the Sequence Listing, or of other naturally occurring *M. catarrhalis* polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as *M. catarrhalis* polypeptides often exhibit a range of physiological properties and because such properties may be attributable to different portions of the molecule, a useful *M. catarrhalis* fragment or *M. catarrhalis* analog is one which exhibits a biological activity in any biological assay for *M. catarrhalis* activity. The fragment or analog possesses about 10%, preferably about 40%, more preferably about 60%, 70%, 80% or 90% or greater of the activity of *M. catarrhalis*, in any in vivo or in vitro assay.

Analogs can differ from naturally occurring *M. catarrhalis* polypeptides in amino acid sequence or in ways that do not involve sequence, or both. Non-sequence modifications include changes in acetylation, methylation, phosphorylation, carboxylation, or glycosylation. Preferred analogs include: *M. catarrhalis* polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the *M. catarrhalis* polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |

TABLE 1-continued

CONSERVATIVE AMINO ACID REPLACEMENTS

| For Amino Acid | Code | Replace with any of |
|---|---|---|
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an *M. catarrhalis* analog, will ordinarily be at least about 20 residues, more typically at least about 40 residues, preferably at least about 60 residues in length. Fragments of *M. catarrhalis* polypeptides can be generated by methods known to those skilled in the art. The ability of an Moraxella fragment to exhibit a biological activity of *M. catarrhalis* polypeptide can be assessed by methods known to those skilled in the art as described herein. Also included are *M. catarrhalis* polypeptides containing residues that are not required for biological activity of the peptide or that result from alternative mRNA splicing or alternative protein processing events.

An "immunogenic component" as used herein is a moiety, such as an *M. catarrhalis* polypeptide, analog or fragment thereof, that is capable of eliciting a humoral and/or cellular immune response in a host animal.

An "antigenic component" as used herein is a moiety, such as an *M. catarrhalis* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *M. catarrhalis* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); DNA Cloning, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymology* (Academic Press, Inc.), particularly Vol. 154 and Vol. 155 (Wu and Grossman, eds.); PCR-A *Practical Approach* (McPherson, Quirke, and Taylor, eds., 1991); *Immunology,* 2d Edition, 1989, Roitt et al., C. V. Mosby Company, and New York; *Advanced Immunology,* 2d Edition, 1991, Male et al., Grower Medical Publishing, New York.; *DNA Cloning: A Practical Approach,* Volumes I and II, 1985 (D. N. Glover ed.); *Oligonucleotide Synthesis,* 1984, (M. L. Gait ed); *Transcription and Translation,* 1984 (Hames and Higgins eds.); *Animal Cell Culture,* 1986 (R. I. Freshney ed.); *Immobilized Cells and Enzymes,* 1986 (IRL Press); Perbal, 1984, A *Practical Guide to Molecular Cloning; Gene Transfer Vectors for Mammalian Cells,* 1987 (J. H. Miller and M. P. Calos eds., Cold Spring Harbor Laboratory); Martin J. Bishop, ed., *Guide to Human Genome Computing,* 2d Edition, Academic Press, San Diego, Calif. (1998); and Leonard F. Peruski, Jr., and Anne Harwood Peruski, *The Internet and the New Biology: Tools for Genomic and Molecular Research,* American Society for Microbiology, Washington, D.C. (1997).

Any suitable materials and/or methods known to those of skill can be utilized in carrying out the present invention; however, preferred materials and/or methods are described. Materials, reagents and the like to which reference is made in the following description and examples are obtainable from commercial sources, unless otherwise noted.

*M. catarrhalis* Genomic Sequence

This invention provides nucleotide sequences of the genome of *M. catarrhalis* which thus comprises a DNA sequence library of *M. catarrhalis* genomic DNA. The detailed description that follows provides nucleotide sequences of *M. catarrhalis,* and also describes how the sequences were obtained and how ORFs and protein-coding sequences were identified. Also described are compositions and methods of using the disclosed *M. catarrhalis* sequences in methods including diagnostic and therapeutic applications. Furthermore, the library can be used as a database for identification and comparison of medically important sequences in this and other strains of *M. catarrhalis.*

To determine the genomic sequence of *M. catarrhalis,* DNA from strain 98-4362. of *M. catarrhalis* was isolated and a library of DNA fragments were transformed into DH5α cells. DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3–4 kb.

All subsequent steps were based on sequencing by ABI377 automated DNA sequencing methods. The cloning and sequencing procedures are described in more detail in the Exemplification.

A variety of approaches may be used to order the contigs so as to obtain a continuous sequence representing the entire

*M. catarrhalis* genome. Synthetic oligonucleotides are designed that are complementary to sequences at the end of each contig. These oligonucleotides may be hybridized, to libaries of *M. catarrhalis* genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The *M. catarrhalis* sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring *M. catarrhalis* polypeptide. These ORFs may contain start codons which indicate the initiation of protein synthesis of a naturally-occuring *M. catarrhalis* polypeptide. Such start codons within the ORFs provided herein were identified by those of ordinary skill in the relevant art, and the resulting ORF and the encoded *M. catarrhalis* polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring *M. catarrhalis* polypeptide was recognized. The predicted coding regions were defined by evaluating the coding potential of such sequences with the program GENEMARK™ (Borodovsky and McIninch, 1993, *Comp.* 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous probabilities greater than $10^{-5}$ by chance) but have good codon usage were identified. Both homologous, sequences and non-homologous sequences with good codon usage, are likely to encode proteins and are encompassed by the invention.

*M. catarrhalis* Nucleic Acids

The present invention provides a library of *M. catarrhalis*—derived nucleic acid sequences. The libraries provide probes, primers, and markers which are used as markers in epidemiological studies. The present invention also provides a library of *M. catarrhalis*—derived nucleic acid sequences which comprise or encode targets for therapeutic drugs.

The nucleic acids of this invention may be obtained directly from the DNA of the above reference *M. catarrhalis* strain by using the polymerase chain reaction (PCR). See *"PCR, A Practical Approach"* (McPherson, Quirke, and Taylor, eds., IRL Press, Oxford, UK, 1991) for details about the PCR. High fidelity PCR is used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, N.Y.).

It is also possible to obtain nucleic acids encoding *M. catarrhalis* polypeptides from a cDNA library in accordance with protocols herein described. A cDNA encoding an *M. catarrhalis* polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding *M. catarrhalis* polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *M. catarrhalis*. With the sequence information set forth in the present application, sequences of twenty or more nucleotides are identified which provide the desired inclusivity and exclusivity with respect to *M. catarrhalis,* and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other Moraxella species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate M. catarrhalis nucleic acid from one strain from the nucleic acid of other another strain as well as from other organisms. Nucleic acid having twenty or more nucleotides in a sequence of the invention contained in the Sequence Listing can also have utility to separate other Moraxella species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of M. catarrhalis nucleic acid. These nucleic acids may also have utility as primers for the amplification of nucleic acids in other Moraxella species. With respect to polymerase chain reaction (PCR) techniques, nucleic acid sequences of ≧10–15 nucleotides of the invention contained in the Sequence Listing have utility in conjunction with suitable enzymes and reagents to create copies of M. catarrhalis nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from M. catarrhalis and/or other Moraxella species. The copies can also be incorporated into cloning and expression vectors to generate polypeptides corresponding to the nucleic acid synthesized by PCR, as is described in greater detail herein.

The nucleic acids of the present invention find use as templates for the recombinant production of M. catarrhalis—derived peptides or polypeptides Antisense Nucleic acid or nucleic acid-hybridizing derivatives isolated or synthesized in accordance with the sequences described herein have utility as antisense agents to prevent the expression of M. catarrhalis genes. These sequences also have utility as antisense agents to prevent expression of genes of other Moraxella species.

In one embodiment, nucleic acid or derivatives corresponding to M. catarrhalis nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from M. catarrhalis that are useful as reagents for diagnosis of bacterial infection, components of effective anti-bacterial vaccines, and/or as targets for anti-bacterial drugs, including anti-M. catarrhalis drugs.

Expression of M. catarrhalis Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLASTP2 algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the ORF ("ORF Name"). The second and third columns list the SEQ ID numbers for the nucleic acid ("NT ID") and amino acid ("AA ID") sequences corresponding to each ORF, respectively. The fourth and fifth columns list the length of the nucleic acid ORF ("NT Length") and the length of the amino acid ORF ("AA Length"), respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the description frame ("Description") defined further below. These genes in the Description were identified when the designated ORF was compared against a comprehensive non-redundant protein database. Specifically, the sixth column represents the Blast Score ("Score") for the match (a higher score is a better match), and the seventh column represents the probability ("Probability") for the match (the probability that such a match can have occurred by chance; the lower the value, the more likely the match is valid). If a BLASTP2 score of less than 100 was obtained, no value is reported in the table. The remaining fields below the columns contain additional information relating to the potential function of the sequence based on the BLASTP2 analysis. Where a match was discovered, the field "Protein name" list the protein's name identified from the match. In addition, one skilled in the art would be able to identify the match and elucidate its function using the "Locus name" and where available the accession number, "Acc#" from the database. Lastly, one skilled in the art would appreciate the "Description" field to further describe the potential function of the protein based on this analysis. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 1920, SEQ ID NO: 1921–SEQ ID NO: 3840 and in Table 2 together with routine cloning and sequencing methods, one of ordinary skill in the art will be able to clone and sequence all the nucleic acid fragments of interest including open reading frames (ORFs) encoding a large variety of proteins of *M. catarrhalis*.

Nucleic acid isolated or synthesized in accordance with the sequences described herein have utility to generate polypeptides. The nucleic acid of the invention exemplified in SEQ ID NO: 1–SEQ ID NO: 1920 and in Table 2 or fragments of said nucleic acid encoding active portions of *M. catarrhalis* polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae*, Methanobacterium strains or other Archaea, and Eubacteria such as *E. coli, B. Subtilis, S. Aureus, S. Pneumonia* or *Pseudomonas putida*. In some cases the expression host will utilize the natural *M. catarrhalis* promoter whereas in others, it will be necessary to drive the gene with a promoter sequence derived from the expressing organism (e.g., an *E. coli* beta-galactosidase promoter for expression in *E. coli*).

To express a gene product using the natural *M. catarrhalis* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual*, 2nd Edition, Cold Spring Harbor Laboratory Press (1989)), and other laboratory textbooks.

For example, a host cell transfected with a nucleic acid vector directing expression of a nucleotide sequence encoding an *M. catarrhalis* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *M. catarrhalis* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding an *M. catarrhalis* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *M. catarrhalis*—derived nucleic acid sequences. The libraries provide probes, primers, and markers which can be used as markers in epidemiological studies. The present invention also provides a library of *M. catarrhalis* derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 1920. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 1921–SEQ ID NO: 3840 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *M. catarrhalis* regulatory sequences, or may be associated with heterologous sequences, including promoters, enhancers, response elements, signal sequences, polyadenylation sequences, introns, 5'- and 3'- noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *M. catarrhalis*—derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *M. catarrhalis* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *M. catarrhalis* coding sequences may be synthesized by standard methods, isolated from natural sources, or prepared as hybrids, etc. Ligation of the *M. catarrhalis* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are *M. catarrhalis E. coli, B. Subtilis, Saccharomyces cerevisiae, Saccharomyces carlsbergensis, Schizosaccharomyces pombi,* SF9 cells, C129 cells, 293 cells, *Neurospora,* and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *M. catarrhalis*—derived peptides and polypeptides.

Advantageously, vectors may also include a transcription regulatory element (i.e., a promoter) operably linked to the *M. catarrhalis* portion. The promoter may optionally contain operator portions and/or ribosome binding sites. Non-limiting examples of bacterial promoters compatible with *E. coli* include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant *M. catarrhalis*—derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of *M. catarrhalis*—derived peptides or polypeptides.

Identification and Use of *M. catarrhalis* Nucleic Acid Sequences

The disclosed *M. catarrhalis* polypeptide and nucleic acid sequences, or other sequences that are contained within ORFs, including complete protein-coding sequences, of which any of the disclosed *M. catarrhalis*—specific sequences forms a part, are useful as target components for diagnosis and/or treatment of *M. catarrhalis*—caused infection.

It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic *M. catarrhalis* DNA as template; this is followed by sequencing the amplified product. The isolated nucleic acid encoding the disclosed sequence, or fragments thereof, can also be hybridized to *M. catarrhalis* genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective against *M. catarrhalis*

The disclosed *M. catarrhalis* genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against *M. catarrhalis*. Identification of said immunogenic components involved in the determination of the function of the disclosed sequences, which can be achieved using a variety of approaches. Non-limiting examples of these approaches are described briefly below.

Homology to Known Sequences

Computer-assisted comparison of the disclosed *M. catarrhalis* sequences with previously reported sequences present in publicly available databases is useful for identifying functional *M. catarrhalis* nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein-:protein interactions, etc. These consensus sequences may be quite short and thus may represent only a fraction of the entire protein-coding sequence. Identification of such a feature in an *M. catarrhalis* sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. *M. catarrhalis* proteins identified as containing putative signal sequences and/or transmembrane domains are useful as immunogenic components of vaccines.

Targets for therapeutic drugs according to the invention include, but are not limited to, polypeptides of the invention, whether unique to *M. catarrhalis* or not, that are essential for growth and/or viability of *M. catarrhalis* under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, *Proc. Natl. Acad. Sci. USA* 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-Specific Sequences

Because of the evolutionary relationship between different *M. catarrhalis* strains, it is believed that the presently disclosed *M. catarrhalis* sequences are useful for identifying, and/or discriminating between, previously known and new *M. catarrhalis* strains. It is believed that other *M. catarrhalis* strains will exhibit at least about 70% sequence homology with the presently disclosed sequence. Systematic and routine analyses of DNA sequences derived from samples containing *M. catarrhalis* strains, and comparison with the present sequence allows for the identification of sequences that can be used to discriminate between strains, as well as those that are common to all *M. catarrhalis* strains. In one embodiment, the invention provides nucleic acids, including probes, and peptide and polypeptide sequences that discriminate between different strains of *M. catarrhalis*. Strain-specific components can also be identified functionally by their ability to elicit or react with antibodies that selectively recognize one or more *M. catarrhalis* strains.

In another embodiment, the invention provides nucleic acids, including probes, and peptide and polypeptide sequences that are common to all *M. catarrhalis* strains but are not found in other bacterial species.

*M. catarrhalis* Polypeptides

This invention encompasses isolated *M. catarrhalis* polypeptides encoded by the disclosed *M. catarrhalis* genomic sequences, including the polypeptides of the invention contained in the Sequence Listing. Polypeptides of the invention are preferably at least about 5 amino acid residues in length. Using the DNA sequence information provided herein, the amino acid sequences of the polypeptides encompassed by the invention can be deduced using methods well-known in the art. It wilt be understood that the sequence of an entire nucleic acid encoding an *M. catarrhalis* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *M. catarrhalis* DNA as template; this is followed by sequencing the amplified product.

The polypeptides of the present invention, including function-conservative variants of the disclosed ORFs, may be isolated from wild-type or mutant *M. catarrhalis* cells, or from heterologous organisms or cells (including, but not limited to, bacteria, fungi, insect, plant, and mammalian cells) including *M. catarrhalis* into which an *M. catarrhalis*—derived protein-coding sequence has been introduced and expressed. Furthermore, the polypeptides may be part of recombinant fusion proteins.

*M. catarrhalis* polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *M. catarrhalis* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against an *M. catarrhalis* protein or against peptides derived therefrom can be used as purification reagents. Other purification methods are possible.

The present invention also encompasses derivatives and homologues of *M. catarrhalis*—encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *M. catarrhalis*—derived polypeptides for use in the present invention, essentially the complete genomic sequence of a virulent, methicillin-resistant isolate of *M. catarrhalis* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *M. catarrhalis* polypeptide sequences that are contained within the open reading frames (ORFs), including complete protein-coding sequences, of which any of SEQ ID NO: 1–SEQ ID NO: 1920 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of *M. catarrhalis*—derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *M. catarrhalis*—derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose *M. catarrhalis* infection, including use as markers in epidemiological studies. Non-limiting examples of such sequences are listed by SEQ ID NO in Table 2, which is appended hereto and part hereof.

The present invention also provides a library of *M. catarrhalis*—derived polypeptide sequences, and a corresponding library of nucleic acid sequences encoding the polypeptides, wherein the polypeptides themselves, or polypeptides contained within ORFs of which they form a part, comprise targets for therapeutic drugs.

Specific Example: Determination of Moraxella Protein Antigens for Antibody and Vaccine Development The selection of Moraxella protein antigens for vaccine development can be derived from the nucleic acids encoding *M. catarrhalis* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to *M. catarrhalis* genes based on sequence homology to genes cloned in other organisms.

Discriminant analysis (Klein, et al. supra) can be used to examine the,ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *M. catarrhalis* Nucleic Acids and Polypeptides Based on the discovery of the *M. catarrhalis* gene products of the invention provided in the Sequence Listing, one skilled in the art can alter the disclosed structure of *M. catarrhalis* genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *M. catarrhalis* polypeptides. Such screens are useful for the identification of inhibitors of *M. catarrhalis*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, Technique 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, SA (1983) *Tetrahedron* 39:3; Itakura et al. (1981) *Recombinant DNA, Proc 3rd Cleveland Sympos. Macromolecules,* ed. A G Walton, Amsterdam: Elsevier pp273–289; Itakura et al. (1984) *Annu. Rev. Biochem.* 53:323; Itakura et al. (1984) *Science* 198:1056; Ike et al. (1983) *Nucleic Acid Res.* 11:477.Such techniques have been employed in the directed evolution of other proteins (see, for example, Scott et al. (1990) *Science* 249:386–390; Roberts et al. (1992) PNAS. 89:2429–2433; Devlin et al. (1990) *Science* 249: 404406; Cwirla et al. (1990) PNAS 87: 6378–6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art. such as that described by Crea et al. (*Proc. Natl. Acad. Sci. USA*, 75: 5765[1978]).

Cassette Mutagenesis

Another method for preparing variants, cassette mutagenesis, is based on the technique described by Wells et al. (*Gene,* 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *M. catarrhalis* Nucleic Acids and Polypeptides

It is possible to modify the structure of an *M. catarrhalis* polypeptide for such purposes as increasing solubility, enhancing stability (e.g., shelf life ex vivo and resistance to proteolytic degradation in vivo). A modified *M. catarrhalis* protein or peptide can be produced in which the amino acid sequence has been altered, such as by amino acid substitution, deletion, or addition as described herein.

An *M. catarrhalis* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *M. catarrhalis* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *M. catarrhalis* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *M. catarrhalis* proteins include reduction/alkylation (Tarr, *Methods of Protein Microcharacterization,* J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology,* WH Freeman, San Francisco, Calif. (1980), U.S. Pat. No. 4,939,239; or mild formalin treatment (Marsh, (1971) *Int. Arch. of Allergy and Appl. Immunol.,* 41: 199–215).

To facilitate purification and potentially increase solubility of an *M. catarrhalis* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology,* 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *M. catarrhalis* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *M. catarrhalis* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be. used to identify polypeptides, e.g., fragments or analogs of a naturally-occurring *M. catarrhalis* polypeptide, e.g., of cellular proteins, or of randomly generated polypeptides which bind to an *M. catarrhalis* protein. (The *M. catarrhalis* domain is used as the bait protein and the library of variants are expressed as prey fusion proteins.) In an analogous fashion, a two hybrid assay (as with the other screening methods described herein), can be used to find polypeptides which bind an *M. catarrhalis* polypeptide.

Display Libraries

In one approach to screening assays, the Moraxella peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and fl, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) PNAS 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the Moraxella protein A and the outer membrane IgA protease of Neisseria (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA,* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stablely associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89–1869).

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A.* 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are under-represented in the libraries (Gallop et al. (1994) *J. Med. Chem.* 37 (9):1233–1251). These particular biases are not a factor in display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37 (9):1233–1251), a molecular DNA library encoding 10 decapeptides was constructed and the library expressed in an *E. coli* S30 in vitro coupled transcription/translation system. Conditions were chosen to stall the ribosomes on the mRNA, causing the accumulation of a substantial. proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *M. catarrhalis* Polypeptides

The invention also provides for reduction of the protein binding domains of the subject *M. catarrhalis* polypeptides to generate mimetics, e.g. peptide or non-peptide agents. The peptide mimetics are able to disrupt binding of a polypeptide to its counter ligand, e.g., in the case of an *M. catarrhalis* polypeptide binding to a naturally occurring ligand. The critical residues of a subject *M. catarrhalis* polypeptide which are involved in molecular recognition of a polypeptide can be determined and used to generate *M. catarrhalis*—derived peptidomimetics which competitively or noncompetitively inhibit binding of the *M. catarrhalis* polypeptide with an interacting polypeptide (see, for example, European patent applications EP-412,762A and EP-B31,080A).

For example, scanning mutagenesis can be used to map the amino acid residues of a particular *M. catarrhalis* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an *M. catarrhalis* polypeptide to an interacting polypeptide and thereby interfere with the function of *M. catarrhalis* polypeptide. For instance, non-hydrolyzable peptide analogs of such residues can be generated using benzodiazepine (e.g., see Freidinger et al. in *Peptides: Chemistry and Biology,* G. R. Marshall ed., ESCOM Publisher: Leiden, Netherlands, 1988), azepine (e.g., see Huffman et al. in *Peptides: Chemistry and Biology,* G. R. Marshall ed., ESCOM Publisher: Leiden, Netherlands, 1988), substituted gama lactam rings (Garvey et al. in *Peptides: Chemistry and Biology,* G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *M. catarrhalis* Nucleic Acids and Polypeptides

This invention also features vaccine compositions for protection against infection by *M. catarrhalis* or for treatment of *M. catarrhalis* infection. In one embodiment, the vaccine compositions contain one or more immunogenic components such as a surface protein from *M. catarrhalis*, or portion thereof, and a pharmaceutically acceptable carrier. Nucleic acids within the scope of the invention are exemplified by the nucleic acids of the invention contained in the Sequence Listing which encode *M. catarrhalis* surface proteins. Any nucleic acid encoding an immunogenic *M. catarrhalis* protein, or portion thereof, which is capable of expression inca cell, can be used in the present invention. These vaccines have therapeutic and prophylactic utilities.

One aspect of the invention provides a vaccine composition for protection against infection by *M. catarrhalis* which contains at least one immunogenic fragment of an *M. catarrhalis* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by. screening polypeptides recombinantly produced from the corresponding fragment of the nucleic acid encoding the full-length *M. catarrhalis* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *M. catarrhalis* peptide in association with appropriate MHC molecules to T cells in conjunction with the necessary co-stimulation has the effect of transmitting a signal to the T cell that induces the production of increased levels of cytokines, particularly of interleukin-2 and interleukin4. The culture supernatant can be obtained and assayed for interleukin-2 or other known cytokines. For example, any one of several conventional assays for interleukin-2 can be employed, such as the assay described in *Proc. Natl. Acad. Sci USA,* 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *M. catarrhalis* polypeptide or fragment thereof or nucleic acid encoding an *M. catarrhalis* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *M. catarrhalis* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by *M. catarrhalis*. Cain et. al. (1993) *Vaccine* 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835 A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin.

Others which may be used are non-toxic derivatives of cholera toxin, including its B subunit, and/or conjugates or genetically engineered fusions of the *M. catarrhalis* polypeptide with cholera toxin or its B subunit, procholeragenoid, fungal polysaccharides, including schizophyllan, muramyl dipeptide, muramyl dipeptide derivatives, phorbol esters, labile toxin of *E. coli,* non-*M. catarrhalis* bacterial lysates, block polymers or saponins.

Other suitable delivery methods include biodegradable microcapsules or immuno-stimulating complexes (ISCOMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including *M. catarrhalis* polypeptide in an insoluble form as fusion proteins. Suitable carriers for the vaccines of the invention are enteric coated capsules and polylactide-glycolide microspheres. Suitable diluents are 0.2 N $NaHCO_3$ and/or saline.

Vaccines of the invention can be administered as a primary prophylactic agent in adults or in children, as a secondary prevention, after successful eradication of *M. catarrhalis* in an infected host, or as a therapeutic agent in the aim to induce an immune response in a susceptible host to prevent infection by *M. catarrhalis.* The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an *E. coli* lysate (6 mg dose daily up to total of 540 mg) and with an enterotoxigenic *E. coli* purified antigen (4 doses of 1 mg) (Schulman et al., *J. Urol.* 150:917–921 (1993); Boedeker et al., *American Gastroenterological Assoc.* 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of an *M. catarrhalis* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *M. catarrhalis* infection, some are useful only for treating *M. catarrhalis* infection, and some are useful for both preventing and treating *M. catarrhalis* infection. In a preferred embodiment, the vaccine composition of the invention provides protection against *M. catarrhalis* infection by stimulating humoral and/or cell-mediated immunity against *M. catarrhalis*. It should be understood that amelioration of any of the symptoms of *M. catarrhalis* infection is a desirable clinical goal, including a lessening of the dosage of medication used to treat *M. catarrhalis*—caused disease, or an increase in the production of antibodies in the serum or mucous of patients.

Antibodies Reactive with *M. catarrhalis* Polypeptides

The invention also includes antibodies specifically reactive with the subject *M. catarrhalis* polypeptide. Antiprotein/anti-peptide antisera or monoclonal antibodies can be made by standard protocols (See, for example, *Antibodies: A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *M. catarrhalis* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *M. catarrhalis* polypeptides of the invention, e.g. antigenic determinants of a polypeptide of the invention contained in the Sequence Listing, or a closely related human or non-human mammalian homolog (e.g., 90% homologous, more preferably at least about 95% homologous). In yet a further preferred embodiment of the invention, the anti-*M. catarrhalis* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *M. catarrhalis* polypeptides. Antibodies can be fragmented using conventional techniques and the fragments screened for utility in the same manner as described above for whole antibodies. For example, $F(ab')_2$ fragments can be generated by treating antibody with pepsin. The resulting $F(ab')_2$ fragment can be treated to reduce disulfide bridges to produce Fab' fragments. The antibody of the invention is further intended to include bispecific and chimeric molecules having an anti-*M. catarrhalis* portion.

Both monoclonal and polyclonal antibodies (Ab) directed against *M. catarrhalis* polypeptides or *M. catarrhalis* polypeptide variants, and antibody fragments such as Fab' and $F(ab')_2$, can be used to block the action of *M. catarrhalis* polypeptide and allow the study of the role of a particular *M. catarrhalis* polypeptide of the invention in aberrant or unwanted intracellular signaling, as well as the normal cellular function of the *M. catarrhalis* and by microinjection of anti-*M. catarrhalis* polypeptide antibodies of the present invention.

Antibodies which specifically bind *M. catarrhalis* epitopes can also be used in immunohistochemical staining of tissue samples in order to evaluate the abundance and pattern of expression of *M. catarrhalis* antigens. Anti-*M. catarrhalis* polypeptide antibodies can be used diagnostically in immuno-precipitation and immuno-blotting to detect and evaluate *M. catarrhalis* levels in tissue or bodily fluid as part of a clinical testing procedure. Likewise, the ability to monitor *M. catarrhalis* polypeptide levels in an individual can allow determination of the efficacy of a given treatment regimen for an individual afflicted with such a disorder. The level of an *M. catarrhalis* polypeptide can be measured in cells found in bodily fluid, such as in urine samples or can be measured in tissue, such as produced by gastric biopsy. Diagnostic assays using anti-*M. catarrhalis* antibodies can include, for example, immunoassays designed to aid in early diagnosis of *M. catarrhalis* infections. The present invention can also be used as a method of detecting antibodies contained in samples from individuals infected by this bacterium using specific *M. catarrhalis* antigens.

Another application of anti-*M. catarrhalis* polypeptide antibodies of the invention is in the immunological screening of cDNA libraries constructed in expression vectors such as λgt11, λgt18–23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *M. catarrhalis* polypeptide can then be detected with antibodies, as, for example, reacting nitrocellulose filters lifted from infected plates with anti-*M. catarrhalis* polypeptide antibodies. Phage, scored by this assay, can then be isolated from the infected plate. Thus, the presence of *M. catarrhalis* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chip Technology

The nucleic acid sequence of the present invention may be used to detect *M. catarrhalis* or other species of Moraxella acid sequence using bio chip technology. Bio chips containing arrays of nucleic acid sequence can also be used to measure expression of genes of *M. catarrhalis* or other species of Moraxella. For example, to diagnose a patient with a *M. catarrhalis* or other Moraxella infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467–470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science*, 283:83–87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, *Nature Biotechnology*, 16: 45–48. Patents teaching this technology include U.S. Pat. Nos. 5,445,934, 5,744,305, and 5,800,992.

Drug Screening Assays Using *M. catarrhalis* Polypeptides

By making available purified and recombinant *M. catarrhalis* polypeptides, the present invention provides assays which can be used to screen for drugs which are either agonists or antagonists of the normal cellular function, in this case, of the subject *M. catarrhalis* polypeptides, or of their role in intracellular signaling. Such inhibitors or potentiators may be useful as new therapeutic agents to combat *M. catarrhalis* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *M. catarrhalis* polypeptide.

Screening assays can be constructed in vitro with a purified *M. catarrhalis* polypeptide or fragment thereof, such as an *M. catarrhalis* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to. identify those which inhibit or potentiate the activity of the *M. catarrhalis* polypeptide. Some of these active compounds may directly, or with chemical alterations to promote membrane permeability or solubility, also inhibit or potentiate the same activity (e.g., enzymatic activity) in whole, live *M. catarrhalis* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-Binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061–2068; Eilers and Schatz, *Nature,* 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae.* The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant (s), lubricant(s), plasticizer(s), colorant(s), dosage vehicle (s), absorption enhancer(s), stabilizer(s), bactericide(s), or the like.

For general information concerning formulations, see, e.g., Gilman et al. (eds.), 1990, Goodman and Gilman's: *The Pharmacological Basis of Therapeutics,* 8th ed., Pergamon Press; and *Remington's Pharmaceutical Sciences,* 17th ed., 1990, Mack Publishing Co., Easton, Pa.; Avis et al. (eds.), 1993, *Pharmaceutical Dosage Forms: Parenteral Medications,* Dekker, New York; Lieberman et al (eds.), 1990, *Pharmaceutical Dosage Forms: Disperse Systems,* Dekker, New York.

The antibacterial agents and compositions of the present invention are useful for preventing or treating *M. catarrhalis* infections. Infection prevention methods incorporate a prophylactically effective amount of an antibacterial agent or composition. A prophylactically effective amount is an amount effective to prevent *M. catarrhalis* infection and will depend upon the specific bacterial strain, the agent, and the host. These amounts can be determined experimentally by methods known in the art and as described above.

*M. catarrhalis* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays-as described above. Systemic administration includes both oral and parental routes. Parental routes include, without limitation, subcutaneous, intramuscular, intraperitoneal, intravenous, transdermal, inhalation and intranasal administration.

EXEMPLIFICATION

Cloning and Sequencing *M. catarrhalis* Genomic Sequence

This invention provides nucleotide sequences of the genome of *M. catarrhalis* which thus comprises a DNA sequence library of *M. catarrhalis* genomic DNA. The invention also provides nucleotide sequences of two naturally occurring plasmids in *M. catarrhalis*. The detailed description that follows provides nucleotide sequences of *M. catarrhalis,* and also describes how the sequences were obtained and how ORFs (Open Reading Frames) and protein-coding sequences can be identified. Also described are methods of using the disclosed *M. catarrhalis* sequences in methods including diagnostic and therapeutic applications. Furthermore, the library can be used as a database for identification and comparison of medically important sequences in this and other strains of *M. catarrhalis* as well as other species of Moraxella.

Chromosomal DNA from strain 98-4362. of *M. catarrhalis,* was isolated using a protocol described by Storrs, et al.(*J. Bacteriol.* 173: 4347–4352 (1991). The only exception to this protocol was that lysostaphin (120 U/ml) was used instead of lysozyme. The genomic DNA prep involved a lysozyme:lysostaphin digestion, sodium dodecyl sulfate lysis, Proteinase K and RNase treatment, phenol:chloroform extraction, and sodium acetate precipitation, followed by the CsCl gradient to remove the plasmid.

In the construction of both libraries, genomic *M. catarrhalis* DNA was hydrodynamically sheared in an HPLC and then separated on a standard 1% agarose gel. A fraction corresponding to 2000–3000 bp in length was excised from the gel and purifed by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' and 5'-GTGGTGAAGAC-3' in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5á competent cells (Gibco/BRL, DH5α transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 µg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP:(P. Green, Abstracts of DOE Human Genome Program Contractor-Grantee Workshop V, January 1996, p.157) with default program parameters and quality scores.

Finishing followed the initial assembly. Missing mates (sequences from clones that only gave reads from one end of the Moraxella DNA inserted in the plasmid) were identified and sequenced with ABI technology to allow the identification of additional overlapping contigs.

End-sequencing of randomly picked genomic lambda was also performed. Sequencing of both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

Additional templates for the physical gaps were obtained through PCR using primers designed from the ends of the contigs. These templates were then used in sequencing reactions to close the gaps.

Contigs were ordered by aligning identified *M. catarrhalis* genes to the published physical maps. Order was confirmed by PCR. The final chromosomal assembly included 119 contigs.

To identify *M. catarrhalis* polypeptides the complete genomic sequence of *M. catarrhalis* were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GENEMARK™ (Borodovsky and McIninch, 1993, Comp. Chem. 17:123)

Identification, Cloning and Expression of *M. catarrhalis* Nucleic Acids

Expression and purification of the *M. catarrhalis* polypeptides of the invention can be performed essentially as outlined below.

To facilitate the cloning, expression and purification of membrane and secreted proteins from *M. catarrhalis,* a gene expression system, such as the pET System (Novagen), for cloning and expression of recombinant proteins in *E. coli,* is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplificaiton and Cloning of Nucleic Acids Containing ORF's Encoding Enzymes Nucleic acids chosen (for example, from the nucleic acids set forth in SEQ ID NO: 1 SEQ ID NO: 2501 for cloning from the 98-4362. strain of *M. catarrhalis* and plasmids are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *M. catarrhalis* DNA sequence. All reverse primers (specific for the 3' end of any *M. catarrhalis* ORF) include a EcoRI site at the extreme 5' terminus to permit cloning of each *M. catarrhalis* sequence into the reading frame of the pET-28 b. The pET-28 b vector provides sequence encoding an additional 20 carboxy-terminal amino acids including six histidine residues (at the extreme C-terminus), which comprise the His-Tag.

Genomic DNA or plasmid DNA prepared from the 98-4362. strain of *M. catarrhalis* is used as the source of template DNA for PCR amplification reactions (Current Protocols in Molecular Biology, John Wiley and Sons, Inc., F. Ausubel et al., eds., 1994). To amplify a DNA sequence containing an *M. catarrhalis* ORF, genomic DNA (50 nanograms) is introduced into a reaction vial containing 2 mM $MgCl_2$, 1 micromolar synthetic oligonucleotide primers (forward and reverse primers) complementary to and flanking a defined *M. catarrhalis* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of *M. catarrhalis* Nucleic Acids into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28 a vector, which encodes a His-Tag that can be fused to the 5 end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of *E. coli* (Current Protocols in Molecular Biology, John Wiley and Sons, Inc., F. Ausubel et al., eds., 1994) as described below.

Transformation of Competent Bacteria with Recombinant Plasmids

Competent bacteria, *E coli* strain BL21 or *E. coli* strain BL21 (DE3), are transformed with recombinant pET expression plasmids carrying the cloned *M. catarrhalis* sequences according to standard methods (Current Protocols in Molecular Biology, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl12, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with *M. Catarrhalis* Nucleic Acids Individual BL21 clones transformed with recombinant pET-28 b *M. catarrhalis* ORFs are analyzed by PCR amplification of the cloned inserts using the same forward and reverse primers, specific for each *M. catarrhalis* sequence, that were used in the original PCR amplification cloning reactions. Successful amplification verifies the integration of the *M. catarrhalis* sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned *M. catarrhalis* ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant *M. catarrhalis* Sequences in *E. coli*

The pET vector can be propagated in any *E. coli* K-12 strain e.g. HMS174, HB101, JM109, DH5, etc. for the purpose of cloning or plasmid preparation. Hosts for expression include E. coli strains containing a chromosomal copy of the gene for T7 RNA polymerase. These hosts are lysogens of bacteriophage DE3, a lambda derivative that carries the lacd gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21 (DE3) (Studier, F. W., Rosenberg, A. H., Dunn, J. J., and Dubendorff, J. W. (1990) Meth. Enzymol. 185, 60–89).

To express recombinant *M. catarrhalis* sequences, 50 nanograms of plasmid DNA isolated as described above is used to transform competent BL21 (DE3) bacteria as described above (provided by Novagen as part of the pET expression system kit). The lacZ gene (beta-galactosidase) is expressed in the pET-System as described for the *M. catarrhalis* recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the *M. catarrhalis* recombinant DNA constructions After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resuspended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE.

The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), *E. coli* (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| ORF Name | NTID | AAID | NT Length | AA Length | Score | Probability |
|---|---|---|---|---|---|---|
| 2538928_c3_3 | 1 | 1921 | 84 | 255 | 306 | 3.3e-27 |

| Protein name | | | | Locus Name | | Acc# |
|---|---|---|---|---|---|---|
| | | | | sp:ETFA_HUMAN | | P13804 |

Description

ELECTRON TRANSFER FLAVOPROTEIN ALPHA-SUBUNIT PRECURSOR (ALPHA-ETF)

| ORF Name | NTID | AAID | NT Length | AA Length | Score | Probability |
|---|---|---|---|---|---|---|
| 24035192_f2_1 | 2 | 1922 | 502 | 1509 | 138 | 1.5e-05 |

| Protein name | | | | Locus Name | | Acc# |
|---|---|---|---|---|---|---|
| icmF protein | | | | pir:T18341 | | T18341 |

Description

| ORF Name | NTID | AAID | NT Length | AA Length | Score | Probability |
|---|---|---|---|---|---|---|
| 10547151_c1_2 | 3 | 1923 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24317313_c2_2 | 4 | 1924 | 201 | 606 | 316 | 3.2e-27 |

| Protein name | | | | Locus Name | | Acc# |
|---|---|---|---|---|---|---|
| | | | | sp:SYFB_HAEIN | | P43820 |

Description

TRNA LIGASE BETA CHAIN) (PHERS)

| ORF Name | NTID | AAID | NT Length | AA Length | Score | Probability |
|---|---|---|---|---|---|---|
| 11911687_c2_42 | 5 | 1925 | 284 | 855 | 709 | 6.5e-70 |

| Protein name | | | | Locus Name | | Acc# |
|---|---|---|---|---|---|---|
| 3-methyl-2-oxobutanoate | | | | gp:PFL130846 | | AJ130846 |

Description

Pseudomonas fluorescens folK (partial), panB and panC (partial) genes.

| ORF Name | NTID | AAID | NT Length | AA Length | Score | Probability |
|---|---|---|---|---|---|---|
| 14334452_c2_44 | 6 | 1926 | 221 | 666 | 339 | 2.9e-35 |

| Protein name | | | | Locus Name | | Acc# |
|---|---|---|---|---|---|---|
| | | | | gp:ECHSDMSR | | X13145 |

Description

Escherichia Coli plasmid R124/3 hsdM, hsdS and hsdR genes for EcoR124/3 type I restriction and modification enzyme.

| ORF Name | NTID | AAID | NT Length | AA Length | Score | Probability |
|---|---|---|---|---|---|---|
| 16619747_c3_48 | 7 | 1927 | 73 | 222 | 158 | 1.6e-11 |

| Protein name | | | | Locus Name | | Acc# |
|---|---|---|---|---|---|---|
| | | | | sp:YBAV_HAEIN | | Q57134 |

Description

HYPOTHETICAL PROTEIN HI1008

| ORF Name | NTID | AAID | NT Length | AA Length | Score | Probability |
|---|---|---|---|---|---|---|
| 21657635_f3_22 | 8 | 1928 | 221 | 666 | 381 | 3.7e-35 |

| Protein name | | | | Locus Name | | Acc# |
|---|---|---|---|---|---|---|
| | | | | sp:DSBA_PSEAE | | P95460 |

Description

THIOL:DISULFIDE INTERCHANGE PROTEIN DSBA PRECURSOR

| ORF Name | NTID | AAID | NT Length | AA Length | Score | Probability |
|---|---|---|---|---|---|---|
| 23476431_c3_54 | 9 | 1929 | 181 | 546 | 123 | 3.8e-07 |

| Protein name | | | | Locus Name | | Acc# |
|---|---|---|---|---|---|---|
| | | | | sp:YJGA_HAEIN | | P45076 |

Description

HYPOTHETICAL PROTEIN HI1151

| ORF Name | NTID | AAID | NT Length | AA Length | Score | Probability |
|---|---|---|---|---|---|---|
| 23945165_c3_49 | 10 | 1930 | 170 | 513 | 334 | 3.6e-30 |

| Protein name | Locus Name | Acc# |
|---|---|---|
| 2-amino-4-hydroxy-6-hydroxymethyldihydropteridine | pir:C64046 | C64046 |

Description

| ORF Name | NTID | AAID | NT Length | AA Length | Score | Probability |
|---|---|---|---|---|---|---|
| 24351555_c2_38 | 11 | 1931 | 130 | 393 | 135 | 1.0e-08 |

| Protein name | Locus Name | Acc# |
|---|---|---|
|  | sp:MAZG_HAEIN | P44723 |

Description

MAZG PROTEIN HOMOLOG

| ORF Name | NTID | AAID | NT Length | AA Length | Score | Probability |
|---|---|---|---|---|---|---|
| 2835152_f2_14 | 12 | 1932 | 82 | 249 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 34178802_c2_45 | 13 | 1933 | 132 | 399 | 184 | 3.3e-14 |

| Protein name | Locus Name | Acc# |
|---|---|---|
| conserved hypothetical secreted protein HP1098 | pir:B64657 | B64657 |

Description

| ORF Name | NTID | AAID | NT Length | AA Length | Score | Probability |
|---|---|---|---|---|---|---|
| 35819090_c1_31 | 14 | 1934 | 623 | 1872 | 689 | 8.5e-68 |

| Protein name | Locus Name | Acc# |
|---|---|---|
| polynucleotide adenylyltransferase | gp:PPY18131 | Y18131 |

Description

Pseudomonas putida pcnB gene and partial folK gene.

| ORF_Name | NTID | AAID | NT Length | AA Length | Score | Probability |
|---|---|---|---|---|---|---|
| 4468761_f2_18 | 15 | 1935 | 61 | 186 | | |

| Protein name | | | | | Locus Name | Acc# |
|---|---|---|---|---|---|---|

Description

NO-HIT

| ORF_Name | NTID | AAID | NT Length | AA Length | Score | Probability |
|---|---|---|---|---|---|---|
| 4492138_c2_43 | 16 | 1936 | 283 | 852 | 660 | 1.0e-64 |

| Protein name | | | | | Locus Name | Acc# |
|---|---|---|---|---|---|---|
| | | | | | sp:PANC_SCHPO | Q09673 |

Description (SYNTHETASE) (PANTOATE ACTIVATING ENZYME)

| ORF_Name | NTID | AAID | NT Length | AA Length | Score | Probability |
|---|---|---|---|---|---|---|
| 48796812_c3_47 | 17 | 1937 | 84 | 255 | 138 | 1.8e-08 |

| Protein name | | | | | Locus Name | Acc# |
|---|---|---|---|---|---|---|
| | | | | | sp:CBF5_YEAST | P33322 |

Description 5) (NUCLEOLAR PROTEIN CBF5) (P64')

| ORF_Name | NTID | AAID | NT Length | AA Length | Score | Probability |
|---|---|---|---|---|---|---|
| 5110943_c1_32 | 18 | 1938 | 298 | 897 | 604 | 8.7e-59 |

| Protein name | | | | | Locus Name | Acc# |
|---|---|---|---|---|---|---|
| | | | | | gp:AB033988 | AB033988 |

Description

Shewanella violacea gene for RpoN(sigma54), nitrogen reguratory IIAprotein, phosphocarrier protein NPR, hypothetical proteins, partialand complete cds.

| ORF_Name | NTID | AAID | NT Length | AA Length | Score | Probability |
|---|---|---|---|---|---|---|
| 5112807_c3_52 | 19 | 1939 | 92 | 279 | | |

| Protein name | | | | | Locus Name | Acc# |
|---|---|---|---|---|---|---|

Description

NO-HIT

| ORF_Name | NTID | AAID | NT Length | AA Length | Score | Probability |
|---|---|---|---|---|---|---|
| 26285938_f1_1 | 20 | 1940 | 207 | 624 | 541 | 4.1e-52 |

| Protein name | | | | Locus_Name | | Acc# |
|---|---|---|---|---|---|---|
| | | | | sp:YCEG_HAEIN | | P44720 |

Description

HYPOTHETICAL PROTEIN HI0457

| ORF_Name | NTID | AAID | NT Length | AA Length | Score | Probability |
|---|---|---|---|---|---|---|
| 30658587_f1_2 | 21 | 1941 | 73 | 219 | 126 | 4.8e-08 |

| Protein name | | | | Locus_Name | | Acc# |
|---|---|---|---|---|---|---|
| | | | | sp:KTHY_BACSU | | P37537 |

Description

THYMIDYLATE KINASE, (DTMP KINASE)

| ORF_Name | NTID | AAID | NT Length | AA Length | Score | Probability |
|---|---|---|---|---|---|---|
| 2767080_f1_2 | 22 | 1942 | 373 | 1122 | 1522 | 4.6e-156 |

| Protein name | | | | Locus_Name | | Acc# |
|---|---|---|---|---|---|---|
| | | | | sp:EFTU_SHEPU | | P33169 |

Description

ELONGATION FACTOR TU (EF-TU)

| ORF_Name | NTID | AAID | NT Length | AA Length | Score | Probability |
|---|---|---|---|---|---|---|
| 32110007_c2_8 | 23 | 1943 | 88 | 267 | 114 | 7.3e-07 |

| Protein name | | | | Locus_Name | | Acc# |
|---|---|---|---|---|---|---|
| hypothetical protein PH1485 | | | | pir:H71023 | | H71023 |

Description

| ORF_Name | NTID | AAID | NT Length | AA Length | Score | Probability |
|---|---|---|---|---|---|---|
| 36329582_c1_5 | 24 | 1944 | 60 | 183 | 144 | 5.5e-09 |

| Protein name | | | | Locus_Name | | Acc# |
|---|---|---|---|---|---|---|
| | | | | sp:YHA2_EIKCO | | P35649 |

Description

HYPOTHETICAL 66.3 KD PROTEIN IN HAG2 5'REGION

| ORF Name | NTID | AAID | NT Length | AA Length | Score | Probability |
|---|---|---|---|---|---|---|
| 971016_f1_1 | 25 | 1945 | 198 | 597 | 643 | 6.4e-63 |

| Protein name | | | | Locus Name | | Acc# |
|---|---|---|---|---|---|---|
| | | | | sp:EFG_HELPY | | P56002 |

Description

ELONGATION FACTOR G (EF-G)

| ORF Name | NTID | AAID | NT Length | AA Length | Score | Probability |
|---|---|---|---|---|---|---|
| 2225312_f3_18 | 26 | 1946 | 427 | 1284 | 416 | 1.9e-64 |

| Protein name | | | | Locus Name | | Acc# |
|---|---|---|---|---|---|---|
| glycerophosphoryl diester phosphodiesterase | | | | pir:D75630 | | D75630 |

Description

| ORF Name | NTID | AAID | NT Length | AA Length | Score | Probability |
|---|---|---|---|---|---|---|
| 23457692_f1_1 | 27 | 1947 | 392 | 1179 | 360 | 1.9e-42 |

| Protein name | | | | Locus Name | | Acc# |
|---|---|---|---|---|---|---|
| | | | | sp:RECF_PSEPU | | P13456 |

Description

RECF PROTEIN

| ORF Name | NTID | AAID | NT Length | AA Length | Score | Probability |
|---|---|---|---|---|---|---|
| 26042927_f3_19 | 28 | 1948 | 84 | 255 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 26750837_f1_4 | 29 | 1949 | 111 | 336 | 202 | 4.9e-16 |

| Protein name | | | | Locus Name | | Acc# |
|---|---|---|---|---|---|---|
| hypothetical protein | | | | pir:S76551 | | S76551 |

Description

| ORF Name | NTID | AAID | NT Length | AA Length | Score | Probability |
|---|---|---|---|---|---|---|
| 36144675_f1_2 | 30 | 1950 | 525 | 1578 | 1851 | 6.3e-191 |

| Protein name | | | | Locus Name | | Acc# |
|---|---|---|---|---|---|---|
| | | | | sp:GUAA_HAEIN | | P44335 |

Description

AMIDOTRANSFERASE) (GMP SYNTHETASE)

| ORF Name | NTID | AAID | NT Length | AA Length | Score | Probability |
|---|---|---|---|---|---|---|
| 4298443_f2_8 | 31 | 1951 | 822 | 2469 | 2597 | 5.6e-270 |

| Protein name | | | | Locus Name | | Acc# |
|---|---|---|---|---|---|---|
| | | | | sp:GYRB_ECOLI | | |

Description

DNA GYRASE SUBUNIT B,

| ORF Name | NTID | AAID | NT Length | AA Length | Score | Probability |
|---|---|---|---|---|---|---|
| 12617627_c1_1 | 32 | 1952 | 128 | 387 | 650 | 1.2e-63 |

| Protein name | | | | Locus Name | | Acc# |
|---|---|---|---|---|---|---|
| transposase | | | | pir:I67760 | | I67760 |

Description

| ORF Name | NTID | AAID | NT Length | AA Length | Score | Probability |
|---|---|---|---|---|---|---|
| 34175180_c2_2 | 33 | 1953 | 90 | 273 | 137 | 1.7e-08 |

| Protein name | | | | Locus Name | | Acc# |
|---|---|---|---|---|---|---|
| transposase | | | | gp:AB026428 | | AB026428 |

Description

Methylomonas aminofaciens ribulose monophosphate pathway genes(rmpD, rmpA, IS10-R rmpI, rmpB), complete cds.

| ORF Name | NTID | AAID | NT Length | AA Length | Score | Probability |
|---|---|---|---|---|---|---|
| 16690875_f1_2 | 34 | 1954 | 82 | 249 | 90 | 0.00026 |

| Protein name | | | | Locus Name | | Acc# |
|---|---|---|---|---|---|---|
| TolR protein | | | | gp:PPPAL1 | | X74218 |

Description

Pseudomonas putida ruvB, tolQ, tolR, tolA, tolB and oprL genes.

| ORF Name | NTID | AAID | NT Length | AA Length | Score | Probability |
|---|---|---|---|---|---|---|
| 1953953_c2_15 | 35 | 1955 | 534 | 1605 | 1387 | 9.3e-142 |

| Protein name | | | | | Locus Name | Acc# |
|---|---|---|---|---|---|---|
| | | | | | sp:ANIA_NEIGO | Q02219 |

Description

MAJOR OUTER MEMBRANE PROTEIN PAN 1 PRECURSOR

| ORF Name | NTID | AAID | NT Length | AA Length | Score | Probability |
|---|---|---|---|---|---|---|
| 22667557_f2_6 | 36 | 1956 | 177 | 534 | 260 | 4.5e-31 |

| Protein name | | | | | Locus Name | Acc# |
|---|---|---|---|---|---|---|
| | | | | | sp:YHDE_BACSU | O07573 |

Description

HYPOTHETICAL 16.6 KD PROTEIN IN GLPD-SPOVR INTERGENIC REGION

| ORF Name | NTID | AAID | NT Length | AA Length | Score | Probability |
|---|---|---|---|---|---|---|
| 30644217_f2_8 | 37 | 1957 | 83 | 252 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 4881533_f2_7 | 38 | 1958 | 62 | 189 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 6651712_f2_2 | 39 | 1959 | 271 | 816 | 611 | 1.6e-59 |

| Protein name | | | | | Locus Name | Acc# |
|---|---|---|---|---|---|---|
| isocitrate lyase | | | | | gp:AB004651 | AB004651 |

Description

Hyphomicrobium methylovorum gene for isocitrate lyase,inorganicphosphate transporter,methionine synthase,complete and partial cds.

| ORF_Name | NTID | AAID | NT Length | AA Length | Score | Probability |
|---|---|---|---|---|---|---|
| 14647952_f1_1 | 40 | 1960 | 912 | 2739 | 2108 | 3.7e-218 |

| Protein name | Locus Name | Acc# |
|---|---|---|
| initiation factor IF2-alpha | gp:PVAJ2737 | AJ002737 |

Description

Proteus vulgaris infB gene and partial nusA and rbfA genes.

| ORF_Name | NTID | AAID | NT Length | AA Length | Score | Probability |
|---|---|---|---|---|---|---|
| 15032818_c1_15 | 41 | 1961 | 172 | 519 | 112 | 4.1e-05 |

| Protein name | Locus Name | Acc# |
|---|---|---|
| hypothetical protein | pir:G75410 | G75410 |

Description

| ORF_Name | NTID | AAID | NT Length | AA Length | Score | Probability |
|---|---|---|---|---|---|---|
| 21644075_c1_14 | 42 | 1962 | 199 | 600 | 381 | 3.7e-35 |

| Protein name | Locus Name | Acc# |
|---|---|---|
| conserved hypothetical protein | pir:F75410 | F75410 |

Description

| ORF_Name | NTID | AAID | NT Length | AA Length | Score | Probability |
|---|---|---|---|---|---|---|
| 24650277_f1_3 | 43 | 1963 | 312 | 939 | 543 | 2.5e-52 |

| Protein name | Locus Name | Acc# |
|---|---|---|
|  | sp:TRUB_HAEIN | P45142 |

Description (HYDROLYASE)

| ORF_Name | NTID | AAID | NT Length | AA Length | Score | Probability |
|---|---|---|---|---|---|---|
| 3332760_f2_11 | 44 | 1964 | 61 | 186 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3407812_f2_9 | 45 | 1965 | 168 | 507 | 215 | 1.4e-17 |

| Protein name | | | | Locus Name | | Acc# |
|---|---|---|---|---|---|---|
| | | | | sp:RBFA_ECOLI | | P09170 |

Description

RIBOSOME-BINDING FACTOR A (P15B PROTEIN)

| ORF Name | NTID | AAID | NT Length | AA Length | Score | Probability |
|---|---|---|---|---|---|---|
| 4573462_c2_24 | 46 | 1966 | 103 | 312 | 171 | 2.0e-12 |

| Protein name | | | | Locus Name | | Acc# |
|---|---|---|---|---|---|---|
| conserved hypothetical protein | | | | pir:F75410 | | F75410 |

Description

| ORF Name | NTID | AAID | NT Length | AA Length | Score | Probability |
|---|---|---|---|---|---|---|
| 4968825_f2_5 | 47 | 1967 | 217 | 654 | 466 | 3.7e-44 |

| Protein name | | | | Locus Name | | Acc# |
|---|---|---|---|---|---|---|
| | | | | sp:NUSA_ECOLI | | P03003 |

Description

N UTILIZATION SUBSTANCE PROTEIN A (NUSA PROTEIN) (L FACTOR)

| ORF Name | NTID | AAID | NT Length | AA Length | Score | Probability |
|---|---|---|---|---|---|---|
| 7070265_f1_4 | 48 | 1968 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4143942_f3_1 | 49 | 1969 | 319 | 957 | 164 | 1.1e-11 |

| Protein name | | | | Locus Name | | Acc# |
|---|---|---|---|---|---|---|
| hypothetical protein b1759 | | | | pir:G64935 | | G64935 |

Description

| ORF_Name | NTID | AAID | NT Length | AA Length | Score | Probability |
|---|---|---|---|---|---|---|
| 1072952_f3_19 | 50 | 1970 | 331 | 996 | 281 | 2.5e-24 |

| Protein name | | | | Locus Name | | Acc# |
|---|---|---|---|---|---|---|
| | | | | sp:SUG2_YEAST | | |

Description

PROBABLE 26S PROTEASE SUBUNIT SUG2 (PROTEASOMAL CAP SUBUNIT)

| ORF_Name | NTID | AAID | NT Length | AA Length | Score | Probability |
|---|---|---|---|---|---|---|
| 112880_f1_4 | 51 | 1971 | 99 | 300 | 120 | 1.7e-07 |

| Protein name | | | | Locus Name | | Acc# |
|---|---|---|---|---|---|---|
| hypothetical protein APE2554 | | | | pir:C72489 | | C72489 |

Description

| ORF_Name | NTID | AAID | NT Length | AA Length | Score | Probability |
|---|---|---|---|---|---|---|
| 14633260_f2_12 | 52 | 1972 | 167 | 504 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 19532782_c2_33 | 53 | 1973 | 513 | 1542 | 1454 | 7.4e-149 |

| Protein name | | | | Locus Name | | Acc# |
|---|---|---|---|---|---|---|
| | | | | sp:TRPE_ACICA | | P23315 |

Description

ANTHRANILATE SYNTHASE COMPONENT I,

| ORF_Name | NTID | AAID | NT Length | AA Length | Score | Probability |
|---|---|---|---|---|---|---|
| 20939567_f1_1 | 54 | 1974 | 138 | 417 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 22070965_f2_11 | 55 | 1975 | 123 | 372 | 88 | 0.018 |

Protein name: alanine--tRNA ligase, alaS:alanyl-tRNA synthetase:alanyl-tRNA synthetase Locus Name: pir:D70127  Acc#: D70127

Description:

| ORF Name | NTID | AAID | NT Length | AA Length | Score | Probability |
|---|---|---|---|---|---|---|
| 23839667_c1_25 | 56 | 1976 | 318 | 957 | 732 | 2.4e-72 |

Protein name:

Locus Name: sp:DAPA_HAEIN  Acc#: P43797

Description: DIHYDRODIPICOLINATE SYNTHASE, (DHDPS)

| ORF Name | NTID | AAID | NT Length | AA Length | Score | Probability |
|---|---|---|---|---|---|---|
| 26281300_c3_35 | 57 | 1977 | 119 | 360 | 257 | 5.1e-22 |

Protein name:

Locus Name: sp:Y01B_MYCTU  Acc#: Q10514

Description: HYPOTHETICAL 39.6 KD PROTEIN CY427.11C

| ORF Name | NTID | AAID | NT Length | AA Length | Score | Probability |
|---|---|---|---|---|---|---|
| 30507291_f3_20 | 58 | 1978 | 174 | 525 | | |

Protein name:

Locus Name:  Acc#:

Description: NO-HIT

| ORF Name | NTID | AAID | NT Length | AA Length | Score | Probability |
|---|---|---|---|---|---|---|
| 4792250_c1_26 | 59 | 1979 | 114 | 345 | | |

Protein name:

Locus Name:  Acc#:

Description: NO-HIT

| ORF Name | NTID | AAID | NT Length | AA Length | Score | Probability |
|---|---|---|---|---|---|---|
| 5282805_c3_34 | 60 | 1980 | 241 | 726 | 786 | 4.5e-78 |

| Protein name | Locus Name | Acc# |
|---|---|---|
| | sp:PUR7_ECOLI | P21155 |

Description (SAICAR SYNTHETASE)

| ORF Name | NTID | AAID | NT Length | AA Length | Score | Probability |
|---|---|---|---|---|---|---|
| 24020430_f2_1 | 61 | 1981 | 127 | 381 | 649 | 1.5e-63 |

| Protein name | Locus Name | Acc# |
|---|---|---|
| transposase | pir:I67760 | I67760 |

Description

| ORF Name | NTID | AAID | NT Length | AA Length | Score | Probability |
|---|---|---|---|---|---|---|
| 129813_f2_1 | 62 | 1982 | 126 | 381 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4391518_f2_4 | 63 | 1983 | 64 | 195 | 108 | 3.2e-06 |

| Protein name | Locus Name | Acc# |
|---|---|---|
| | sp:THIX_HAEIN | P43787 |

Description

THIOREDOXIN-LIKE PROTEIN HI1115

| ORF Name | NTID | AAID | NT Length | AA Length | Score | Probability |
|---|---|---|---|---|---|---|
| 4495268_f2_2 | 64 | 1984 | 110 | 333 | 512 | 4.9e-49 |

| Protein name | Locus Name | Acc# |
|---|---|---|
| ferredoxin [3Fe-4S | pir:FEAV | |

Description

| ORF Name | NTID | AAID | NT Length | AA Length | Score | Probability |
|---|---|---|---|---|---|---|
| 4860875_f3_6 | 65 | 1985 | 159 | 480 | 204 | 2.1e-16 |

Protein name: hypothetical protein APE2447
Locus Name: pir:F72475
Acc#: F72475

Description:

| ORF Name | NTID | AAID | NT Length | AA Length | Score | Probability |
|---|---|---|---|---|---|---|
| 15677200_f2_2 | 66 | 1986 | 158 | 477 | 428 | 3.9e-40 |

Protein name:
Locus Name: sp:CYSW_ECOLI
Acc#:

Description: SULFATE TRANSPORT SYSTEM PERMEASE PROTEIN CYSW

| ORF Name | NTID | AAID | NT Length | AA Length | Score | Probability |
|---|---|---|---|---|---|---|
| 4490678_f1_1 | 67 | 1987 | 247 | 741 | 643 | 6.4e-63 |

Protein name:
Locus Name: sp:CYSA_ECOLI
Acc#:

Description: SULFATE TRANSPORT ATP-BINDING PROTEIN CYSA

| ORF Name | NTID | AAID | NT Length | AA Length | Score | Probability |
|---|---|---|---|---|---|---|
| 16054077_f3_20 | 68 | 1988 | 520 | 1563 | | |

Protein name:
Locus Name:
Acc#:

Description: NO-HIT

| ORF Name | NTID | AAID | NT Length | AA Length | Score | Probability |
|---|---|---|---|---|---|---|
| 16495465_f1_1 | 69 | 1989 | 77 | 234 | 72 | 0.020 |

Protein name:
Locus Name: sp:YDIE_ECOLI
Acc#: P40721

Description: HYPOTHETICAL 7.1 KD PROTEIN IN AROH-NLPC INTERGENIC REGION

| ORF Name | NTID | AAID | NT Length | AA Length | Score | Probability |
|---|---|---|---|---|---|---|
| 23485750_c3_36 | 70 | 1990 | 68 | 207 | | |

Protein name | | | | | Locus Name | Acc#

Description

NO-HIT

| ORF Name | NTID | AAID | NT Length | AA Length | Score | Probability |
|---|---|---|---|---|---|---|
| 23730017_c1_24 | 71 | 1991 | 947 | 2844 | 278 | 2.2e-36 |

Protein name | | | | | Locus Name | Acc#
| | | | | | sp:YTFM_HAEIN | P44038

Description

HYPOTHETICAL PROTEIN HI0698 PRECURSOR

| ORF Name | NTID | AAID | NT Length | AA Length | Score | Probability |
|---|---|---|---|---|---|---|
| 23859387_f2_14 | 72 | 1992 | 296 | 891 | 93 | 0.048 |

Protein name | | | | | Locus Name | Acc#
conserved hypothetical protein yrrB | | | | | pir:H69978 | H69978

Description

| ORF Name | NTID | AAID | NT Length | AA Length | Score | Probability |
|---|---|---|---|---|---|---|
| 34119002_f3_18 | 73 | 1993 | 444 | 1335 | 714 | 1.1e-69 |

Protein name | | | | | Locus Name | Acc#
2-acylglycerophosphoethanolamine acyltransferase (aas) RP620 | | | | | pir:E71667 | E71667

Description

| ORF Name | NTID | AAID | NT Length | AA Length | Score | Probability |
|---|---|---|---|---|---|---|
| 4480217_c3_35 | 74 | 1994 | 1675 | 5028 | 678 | 1.5e-79 |

Protein name | | | | | Locus Name | Acc#
| | | | | | sp:YTFN_HAEIN | Q57523

Description

HYPOTHETICAL PROTEIN HI0696

| ORF Name | NTID | AAID | NT Length | AA Length | Score | Probability |
|---|---|---|---|---|---|---|
| 12378407_c2_32 | 75 | 1995 | 278 | 834 | 626 | 4.1e-61 |

| Protein name | | | | Locus Name | | Acc# |
|---|---|---|---|---|---|---|
| | | | | sp:PDXJ_ECOLI | | P24223 |

Description

PYRIDOXAL PHOSPHATE BIOSYNTHETIC PROTEIN PDXJ

| ORF Name | NTID | AAID | NT Length | AA Length | Score | Probability |
|---|---|---|---|---|---|---|
| 14487952_f1_7 | 76 | 1996 | 72 | 219 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 161402_c2_29 | 77 | 1997 | 61 | 186 | 59 | 0.018 |

| Protein name | | | | Locus Name | | Acc# |
|---|---|---|---|---|---|---|
| envelope glycoprotein | | | | gp:HIVU90070 | | U90070 |

Description

HIV-1 strain VN16 from Vietnam, envelope glycoprotein V3 region(env) gene, partial cds.

| ORF Name | NTID | AAID | NT Length | AA Length | Score | Probability |
|---|---|---|---|---|---|---|
| 16171905_c2_28 | 78 | 1998 | 67 | 204 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 22324331_f2_16 | 79 | 1999 | 77 | 234 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 22463311_f3_22 | 80 | 2000 | 103 | 312 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 23442503_c2_31 | 81 | 2001 | 346 | 1041 | 831 | 7.7e-83 |

| Protein name | | | | Locus Name | | Acc# |
|---|---|---|---|---|---|---|
| Era | | | | gp:AF123492 | | AF123492 |

Description

Pseudomonas aeruginosa rnc-era-recO operon, complete sequence.

| ORF Name | NTID | AAID | NT Length | AA Length | Score | Probability |
|---|---|---|---|---|---|---|
| 24412781_c3_34 | 82 | 2002 | 101 | 306 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 26570925_c2_30 | 83 | 2003 | 268 | 807 | 500 | 9.1e-48 |

| Protein name | | | | Locus Name | | Acc# |
|---|---|---|---|---|---|---|
| | | | | sp:RNC_ECOLI | | |

Description

RIBONUCLEASE III, (RNASE III)

| ORF Name | NTID | AAID | NT Length | AA Length | Score | Probability |
|---|---|---|---|---|---|---|
| 26678567_c1_24 | 84 | 2004 | 63 | 192 | 88 | 0.00042 |

| Protein name | | | | Locus Name | | Acc# |
|---|---|---|---|---|---|---|
| hypothetical protein 29.1 | | | | pir:S59084 | | S59084 |

Description

| ORF Name | NTID | AAID | NT Length | AA Length | Score | Probability |
|---|---|---|---|---|---|---|
| 35161562_c1_27 | 85 | 2005 | 212 | 639 | 103 | 0.0015 |

Protein name: RecO
Locus Name: gp:AF123492
Acc#: AF123492

Description: Pseudomonas aeruginosa rnc-era-recO operon, complete sequence.

| ORF Name | NTID | AAID | NT Length | AA Length | Score | Probability |
|---|---|---|---|---|---|---|
| 4063308_c3_35 | 86 | 2006 | 607 | 1824 | 2257 | 5.9e-234 |

Protein name:
Locus Name: sp:LEPA_HAEIN
Acc#: P43729

Description: GTP-BINDING PROTEIN LEPA

| ORF Name | NTID | AAID | NT Length | AA Length | Score | Probability |
|---|---|---|---|---|---|---|
| 4100003_f3_20 | 87 | 2007 | 159 | 480 | 624 | 6.6e-61 |

Protein name:
Locus Name: sp:Y882_HAEIN
Acc#: P44068

Description: HYPOTHETICAL PROTEIN HI0882

| ORF Name | NTID | AAID | NT Length | AA Length | Score | Probability |
|---|---|---|---|---|---|---|
| 7032838_c3_36 | 88 | 2008 | 367 | 1104 | 276 | 2.0e-44 |

Protein name: signal peptidase I
Locus Name: gp:ECOK12RIII
Acc#: D64044

Description: Escherichia coli ribonuclease III and other genes, complete cds.

| ORF Name | NTID | AAID | NT Length | AA Length | Score | Probability |
|---|---|---|---|---|---|---|
| 9869702_f3_21 | 89 | 2009 | 60 | 183 | | |

Protein name:
Locus Name:
Acc#:

Description: NO-HIT

| ORF Name | NTID | AAID | NT Length | AA Length | Score | Probability |
|---|---|---|---|---|---|---|
| 10802330_f3_20 | 90 | 2010 | 64 | 195 | | |

Protein name: 
Locus Name: 
Acc#:

Description: NO-HIT

| ORF Name | NTID | AAID | NT Length | AA Length | Score | Probability |
|---|---|---|---|---|---|---|
| 12714056_c1_22 | 91 | 2011 | 377 | 1134 | 1472 | 9.1e-151 |

Protein name: putative formaldehyde dehydrogenase
Locus Name: gp:PSP243941
Acc#: AJ243941

Description: Pseudomonas sp. strain HR199 partial vanB, fdh, gcs, ehyA and ehyBgenes.

| ORF Name | NTID | AAID | NT Length | AA Length | Score | Probability |
|---|---|---|---|---|---|---|
| 14844626_c2_34 | 92 | 2012 | 202 | 609 | 93 | 0.028 |

Protein name: transcription regulator, TetR family
Locus Name: pir:F75482
Acc#: F75482

Description:

| ORF Name | NTID | AAID | NT Length | AA Length | Score | Probability |
|---|---|---|---|---|---|---|
| 15705056_c1_24 | 93 | 2013 | 72 | 219 | | |

Protein name:
Locus Name:
Acc#:

Description: NO-HIT

| ORF Name | NTID | AAID | NT Length | AA Length | Score | Probability |
|---|---|---|---|---|---|---|
| 159667_c2_31 | 94 | 2014 | 67 | 204 | | |

Protein name:
Locus Name:
Acc#:

Description: NO-HIT

| ORF Name | NTID | AAID | NT Length | AA Length | Score | Probability |
|---|---|---|---|---|---|---|
| 30079512_f3_17 | 95 | 2015 | 76 | 231 | 87 | 0.00053 |

Protein name | Locus Name | Acc#
sp:FIXS_RHIME | P18399

Description

NITROGEN FIXATION PROTEIN FIXS

| ORF Name | NTID | AAID | NT Length | AA Length | Score | Probability |
|---|---|---|---|---|---|---|
| 35578402_f2_7 | 96 | 2016 | 441 | 1326 | 1116 | 4.8e-113 |

Protein name | Locus Name | Acc#
sp:YEEF_ECOLI | P33016

Description

HYPOTHETICAL 49.8 KD TRANSPORT PROTEIN IN SBCB-HISL INTERGENIC REGION

| ORF Name | NTID | AAID | NT Length | AA Length | Score | Probability |
|---|---|---|---|---|---|---|
| 3910876_f3_16 | 97 | 2017 | 501 | 1506 | 742 | 2.1e-73 |

Protein name | Locus Name | Acc#
sp:YDIU_ECOLI |

Description

HYPOTHETICAL 54.4 KD PROTEIN IN AROH-NLPC INTERGENIC REGION

| ORF Name | NTID | AAID | NT Length | AA Length | Score | Probability |
|---|---|---|---|---|---|---|
| 5097812_c2_30 | 98 | 2018 | 120 | 363 | 280 | 1.9e-24 |

Protein name | Locus Name | Acc#
sp:YAIM_ECOLI |

Description

HYPOTHETICAL 31.4 KD PROTEIN IN MHPT-ADHC INTERGENIC REGION

| ORF Name | NTID | AAID | NT Length | AA Length | Score | Probability |
|---|---|---|---|---|---|---|
| 5210318_f2_10 | 99 | 2019 | 289 | 870 | 196 | 1.5e-15 |

Protein name | Locus Name | Acc#
hypothetical protein HP0861 | pir:E64627 | E64627

Description

| ORF Name | NTID | AAID | NT Length | AA Length | Score | Probability |
|---|---|---|---|---|---|---|
| 6740877_f3_15 | 100 | 2020 | 406 | 1221 | 639 | 1.7e-62 |

| Protein name | | | | Locus Name | | Acc# |
|---|---|---|---|---|---|---|
| stearoyl-CoA desaturase | | | | gp:AF026401 | | AF026401 |

Description

Mucor rouxii stearoyl-CoA desaturase (Ole1) gene, complete cds.

| ORF Name | NTID | AAID | NT Length | AA Length | Score | Probability |
|---|---|---|---|---|---|---|
| 994001_c1_23 | 101 | 2021 | 176 | 531 | 573 | 1.7e-55 |

| Protein name | | | | Locus Name | | Acc# |
|---|---|---|---|---|---|---|
| | | | | sp:YEIG_ECOLI | | P33018 |

Description

HYPOTHETICAL 31.3 KD PROTEIN IN FOLE-CIRA INTERGENIC REGION

| ORF Name | NTID | AAID | NT Length | AA Length | Score | Probability |
|---|---|---|---|---|---|---|
| 1048137_c3_65 | 102 | 2022 | 67 | 204 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 10585925_f1_2 | 103 | 2023 | 73 | 222 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14885910_c2_51 | 104 | 2024 | 86 | 258 | 71 | 0.026 |

| Protein name | | | | Locus Name | | Acc# |
|---|---|---|---|---|---|---|
| PagK | | | | gp:AF013775 | | AF013775 |

Description

Salmonella typhimurium PagK (pagK), PagM (pagM), and PagO (pagO) genes, complete cds.

| ORF Name | NTID | AAID | NT Length | AA Length | Score | Probability |
|---|---|---|---|---|---|---|
| 22554587_c3_57 | 105 | 2025 | 159 | 480 | 480 | 1.2e-45 |

| Protein name | Locus Name | Acc# |
|---|---|---|
| | sp:SMPB_ECOLI | |

Description

SMALL PROTEIN B (18.3 KD PROTEIN)

| ORF Name | NTID | AAID | NT Length | AA Length | Score | Probability |
|---|---|---|---|---|---|---|
| 23437838_f3_28 | 106 | 2026 | 725 | 2178 | 1684 | 3.1e-173 |

| Protein name | Locus Name | Acc# |
|---|---|---|
| | sp:DNLJ_HAEIN | P43813 |

Description

)

| ORF Name | NTID | AAID | NT Length | AA Length | Score | Probability |
|---|---|---|---|---|---|---|
| 23468813_f3_22 | 107 | 2027 | 309 | 930 | 294 | 6.2e-26 |

| Protein name | Locus Name | Acc# |
|---|---|---|
| putative permease BitE | gp:SHU75349 | U75349 |

Description

Serpulina hyodysenteriae bit operon, complete sequence.

| ORF Name | NTID | AAID | NT Length | AA Length | Score | Probability |
|---|---|---|---|---|---|---|
| 234807_f1_11 | 108 | 2028 | 175 | 528 | 456 | 4.2e-43 |

| Protein name | Locus Name | Acc# |
|---|---|---|
| lipopolysaccharide core biosynthesis protein kdtB homolog | pir:S72166 | S72166 |

Description

| ORF Name | NTID | AAID | NT Length | AA Length | Score | Probability |
|---|---|---|---|---|---|---|
| 23705040_f2_16 | 109 | 2029 | 360 | 1083 | 670 | 8.8e-66 |

| Protein name | Locus Name | Acc# |
|---|---|---|
| | sp:POTA_HAEIN | P45171 |

Description

SPERMIDINE/PUTRESCINE TRANSPORT ATP-BINDING PROTEIN POTA

| ORF Name | NTID | AAID | NT Length | AA Length | Score | Probability |
|---|---|---|---|---|---|---|
| 23726687_f2_17 | 110 | 2030 | 335 | 1008 | 745 | 9.9e-74 |

Protein name: conserved hypothetical protein yddN
Locus Name: pir:F69776
Acc#: F69776

Description

| ORF Name | NTID | AAID | NT Length | AA Length | Score | Probability |
|---|---|---|---|---|---|---|
| 23884387_c1_37 | 111 | 2031 | 219 | 660 | | |

Protein name
Locus Name
Acc#

Description

NO-HIT

| ORF Name | NTID | AAID | NT Length | AA Length | Score | Probability |
|---|---|---|---|---|---|---|
| 24252305_f2_19 | 112 | 2032 | 298 | 897 | 155 | 8.2e-09 |

Protein name
Locus Name: sp:YDFC_BACSU
Acc#: P96680

Description

HYPOTHETICAL 33.6 KD PROTEIN IN CSPC-NAP INTERGENIC REGION

| ORF Name | NTID | AAID | NT Length | AA Length | Score | Probability |
|---|---|---|---|---|---|---|
| 24797312_f1_4 | 113 | 2033 | 275 | 828 | 132 | 5.0e-06 |

Protein name: hypothetical protein PH1114
Locus Name: pir:C71052
Acc#: C71052

Description

| ORF Name | NTID | AAID | NT Length | AA Length | Score | Probability |
|---|---|---|---|---|---|---|
| 25901467_c3_54 | 114 | 2034 | 88 | 267 | | |

Protein name
Locus Name
Acc#

Description

NO-HIT

| ORF Name | NTID | AAID | NT Length | AA Length | Score | Probability |
|---|---|---|---|---|---|---|
| 30272051_f3_24 | 115 | 2035 | 248 | 747 | 169 | 2.2e-11 |

| Protein name | Locus Name | Acc# |
|---|---|---|
| probable morphological differentiation-associated protein | pir:T36679 | T36679 |

Description

| ORF Name | NTID | AAID | NT Length | AA Length | Score | Probability |
|---|---|---|---|---|---|---|
| 3323802_f3_23 | 116 | 2036 | 286 | 861 | 232 | 2.3e-19 |

| Protein name | Locus Name | Acc# |
|---|---|---|
| permease protein | gp:CJAJ750 | AJ000750 |

Description

Campylobacter jejuni malF gene, partial.

| ORF Name | NTID | AAID | NT Length | AA Length | Score | Probability |
|---|---|---|---|---|---|---|
| 35976510_f3_30 | 117 | 2037 | 89 | 270 | 343 | 4.0e-31 |

| Protein name | Locus Name | Acc# |
|---|---|---|
|  | pir:FEKRV |  |

Description

| ORF Name | NTID | AAID | NT Length | AA Length | Score | Probability |
|---|---|---|---|---|---|---|
| 36383542_f1_13 | 118 | 2038 | 107 | 321 | 96 | 5.9e-05 |

| Protein name | Locus Name | Acc# |
|---|---|---|
| KH type splicing regulatory protein | gp:HSKHSRP3 | AF093747 |

Description

Homo sapiens KH type splicing regulatory protein (KHSRP) gene, exon2 and partial cds.

| ORF Name | NTID | AAID | NT Length | AA Length | Score | Probability |
|---|---|---|---|---|---|---|
| 3923288_c1_39 | 119 | 2039 | 343 | 1032 | 254 | 1.1e-21 |

| Protein name | Locus Name | Acc# |
|---|---|---|
| probable regulatory protein (pfoS/R) | pir:E71373 | E71373 |

Description

| ORF Name | NTID | AAID | NT Length | AA Length | Score | Probability |
|---|---|---|---|---|---|---|
| 3938393_c3_64 | 120 | 2040 | 218 | 657 | 726 | 1.0e-71 |
| Protein name | | | | Locus Name | | Acc# |
| uracil phosphoribosyltransferase, upp | | | | pir:A65026 | | |

Description

| ORF Name | NTID | AAID | NT Length | AA Length | Score | Probability |
|---|---|---|---|---|---|---|
| 4064638_f1_3 | 121 | 2041 | 371 | 1116 | 152 | 4.7e-08 |
| Protein name | | | | Locus Name | | Acc# |
| | | | | sp:Y131_HAEIN | | P43951 |

Description

HYPOTHETICAL PROTEIN HI0131 PRECURSOR

| ORF Name | NTID | AAID | NT Length | AA Length | Score | Probability |
|---|---|---|---|---|---|---|
| 4101568_f3_29 | 122 | 2042 | 263 | 792 | 512 | 4.9e-49 |
| Protein name | | | | Locus Name | | Acc# |
| | | | | sp:FRP_VIBHA | | Q56691 |

Description (NADPH-FMN OXIDOREDUCTASE)

| ORF Name | NTID | AAID | NT Length | AA Length | Score | Probability |
|---|---|---|---|---|---|---|
| 682641_c1_33 | 123 | 2043 | 86 | 261 | 100 | 2.2e-05 |
| Protein name | | | | Locus Name | | Acc# |
| hypothetical protein PH0217 | | | | pir:G71244 | | G71244 |

Description

| ORF Name | NTID | AAID | NT Length | AA Length | Score | Probability |
|---|---|---|---|---|---|---|
| 10790_f3_68 | 124 | 2044 | 731 | 2196 | 594 | 9.0e-86 |
| Protein name | | | | Locus Name | | Acc# |
| | | | | sp:PRIM_HAEIN | | Q08346 |

Description

DNA PRIMASE,

| ORF Name | NTID | AAID | NT Length | AA Length | Score | Probability |
|---|---|---|---|---|---|---|
| 119012_c3_118 | 125 | 2045 | 438 | 1317 | 1830 | 1.1e-188 |

| Protein name | | | | Locus Name | | Acc# |
|---|---|---|---|---|---|---|
| | | | | sp:YJCD_HAEIN | | P44530 |

Description

HYPOTHETICAL PROTEIN HI0125

| ORF Name | NTID | AAID | NT Length | AA Length | Score | Probability |
|---|---|---|---|---|---|---|
| 12214386_c3_117 | 126 | 2046 | 125 | 378 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 12540957_c3_121 | 127 | 2047 | 280 | 843 | 227 | 7.7e-19 |

| Protein name | | | | Locus Name | | Acc# |
|---|---|---|---|---|---|---|
| probable yfiH protein | | | | pir:A70579 | | A70579 |

Description

| ORF Name | NTID | AAID | NT Length | AA Length | Score | Probability |
|---|---|---|---|---|---|---|
| 12593961_f2_35 | 128 | 2048 | 68 | 207 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 19532813_f3_73 | 129 | 2049 | 134 | 405 | 252 | 1.7e-21 |

| Protein name | | | | Locus Name | | Acc# |
|---|---|---|---|---|---|---|
| RpsT protein | | | | gp:VCNHAR | | AJ002395 |

Description

Vibrio cholerae nhaR, hlyU, mviN, and rpsT genes.

| ORF Name | NTID | AAID | NT Length | AA Length | Score | Probability |
|---|---|---|---|---|---|---|
| 209375_c1_95 | 130 | 2050 | 750 | 2250 | 1867 | 1.3e-192 |

Protein name | Locus Name | Acc#
sp:CLPA_ECOLI

Description
ATP-DEPENDENT CLP PROTEASE ATP-BINDING SUBUNIT CLPA

| ORF Name | NTID | AAID | NT Length | AA Length | Score | Probability |
|---|---|---|---|---|---|---|
| 21641077_f2_49 | 131 | 2051 | 199 | 600 | 132 | 4.3e-08 |

Protein name | Locus Name | Acc#
hypothetical protein | gp:SYCSLLE

Description
Synechocystis sp. PCC6803 complete genome, 22/27, 2755703-2868766.

| ORF Name | NTID | AAID | NT Length | AA Length | Score | Probability |
|---|---|---|---|---|---|---|
| 22143827_c1_89 | 132 | 2052 | 250 | 753 | 246 | 7.5e-21 |

Protein name | Locus Name | Acc#
 | sp:YIV8_YEAST | P40582

Description
HYPOTHETICAL 26.8 KD PROTEIN IN HYR1 3'REGION

| ORF Name | NTID | AAID | NT Length | AA Length | Score | Probability |
|---|---|---|---|---|---|---|
| 22453453_c2_104 | 133 | 2053 | 426 | 1281 | 492 | 6.4e-47 |

Protein name | Locus Name | Acc#
carboxyl-terminal proteinase | pir:F70369 | F70369

Description

| ORF Name | NTID | AAID | NT Length | AA Length | Score | Probability |
|---|---|---|---|---|---|---|
| 22831262_c1_94 | 134 | 2054 | 128 | 387 | 185 | 2.2e-14 |

Protein name | Locus Name | Acc#
 | sp:YLJA_ECOLI | P75832

Description
12.2 KD PROTEIN IN CSPD-CLPA INTERGENIC REGION

| ORF Name | NTID | AAID | NT Length | AA Length | Score | Probability |
|---|---|---|---|---|---|---|
| 23632215_f2_59 | 135 | 2055 | 64 | 195 | | |
| Protein name | | | | Locus Name | | Acc# |
| | | | | | | |

Description

NO-HIT

| ORF Name | NTID | AAID | NT Length | AA Length | Score | Probability |
|---|---|---|---|---|---|---|
| 23645875_c1_84 | 136 | 2056 | 605 | 1818 | 723 | 2.1e-71 |
| Protein name | | | | Locus Name | | Acc# |
| | | | | sp:CYDD_ECOLI | | |

Description

TRANSPORT ATP-BINDING PROTEIN CYDD

| ORF Name | NTID | AAID | NT Length | AA Length | Score | Probability |
|---|---|---|---|---|---|---|
| 23875303_c2_109 | 137 | 2057 | 72 | 219 | | |
| Protein name | | | | Locus Name | | Acc# |

Description

NO-HIT

| ORF Name | NTID | AAID | NT Length | AA Length | Score | Probability |
|---|---|---|---|---|---|---|
| 24236642_c1_91 | 138 | 2058 | 350 | 1053 | 695 | 2.0e-68 |
| Protein name | | | | Locus Name | | Acc# |
| | | | | sp:RLUD_ECOLI | | |

Description (PSEUDOURIDYLATE SYNTHASE) (URACIL HYDROLYASE)

| ORF Name | NTID | AAID | NT Length | AA Length | Score | Probability |
|---|---|---|---|---|---|---|
| 24317757_f3_67 | 139 | 2059 | 368 | 1107 | 352 | 4.4e-32 |
| Protein name | | | | Locus Name | | Acc# |
| | | | | sp:YPIY_PSEAE | | P33641 |

Description

HYPOTHETICAL 38.5 KD LIPOPROTEIN IN PILS 5'REGION PRECURSOR (ORFY)

| ORF Name | NTID | AAID | NT Length | AA Length | Score | Probability |
|---|---|---|---|---|---|---|
| 24318805_f2_60 | 140 | 2060 | 205 | 618 | 229 | 4.8e-19 |

| Protein name | Locus Name | Acc# |
|---|---|---|
| hypothetical protein | gp:ASA224767 | AJ224767 |

Description

Acinetobacter sp. ADP1 lon gene and ORFs.

| ORF Name | NTID | AAID | NT Length | AA Length | Score | Probability |
|---|---|---|---|---|---|---|
| 24417012_f2_52 | 141 | 2061 | 232 | 699 | 101 | 0.011 |

| Protein name | Locus Name | Acc# |
|---|---|---|
| LpsB | gp:AF193023 | AF193023 |

Description

Sinorhizobium meliloti GreA (greA), LpsB (lpsB), LpsE (lpsE), LpsD(lpsD), LpsC (lpsC), and Lrp (lrp) genes, complete cds.

| ORF Name | NTID | AAID | NT Length | AA Length | Score | Probability |
|---|---|---|---|---|---|---|
| 24650062_c3_119 | 142 | 2062 | 234 | 705 | 148 | 3.1e-09 |

| Protein name | Locus Name | Acc# |
|---|---|---|
| hypothetical protein C33F10.3 | pir:T15745 | T15745 |

Description

| ORF Name | NTID | AAID | NT Length | AA Length | Score | Probability |
|---|---|---|---|---|---|---|
| 2468950_c3_123 | 143 | 2063 | 67 | 204 | 123 | 1.4e-06 |

| Protein name | Locus Name | Acc# |
|---|---|---|
|  | sp:COPA_HELFE | O32619 |

Description

COPPER-TRANSPORTING ATPASE,

| ORF Name | NTID | AAID | NT Length | AA Length | Score | Probability |
|---|---|---|---|---|---|---|
| 25391941_c2_116 | 144 | 2064 | 298 | 897 |  |  |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 261635_f1_16 | 145 | 2065 | 217 | 654 | 603 | 1.1e-58 |

| Protein name | Locus_Name | Acc# |
|---|---|---|
| response regulator GacA | gp:AF115381 | AF115381 |

Description

Pseudomonas aureofaciens 30-84 response regulator GacA (gacA) gene, complete cds.

| ORF_Name | NTID | AAID | NT Length | AA Length | Score | Probability |
|---|---|---|---|---|---|---|
| 31431512_f1_22 | 146 | 2066 | 182 | 549 | 295 | 4.8e-26 |

| Protein name | Locus_Name | Acc# |
|---|---|---|
| bacterioferritin comigratory protein | pir:F71971 | F71971 |

Description

| ORF_Name | NTID | AAID | NT Length | AA Length | Score | Probability |
|---|---|---|---|---|---|---|
| 31832188_c2_114 | 147 | 2067 | 440 | 1323 | 1025 | 2.1e-103 |

| Protein name | Locus_Name | Acc# |
|---|---|---|
|  | sp:Y290_HAEIN | P77868 |

Description

PROBABLE CATION-TRANSPORTING ATPASE HI0290,

| ORF_Name | NTID | AAID | NT Length | AA Length | Score | Probability |
|---|---|---|---|---|---|---|
| 33845302_c2_115 | 148 | 2068 | 288 | 867 | 653 | 5.6e-64 |

| Protein name | Locus_Name | Acc# |
|---|---|---|
|  | sp:Y290_HAEIN | P77868 |

Description

PROBABLE CATION-TRANSPORTING ATPASE HI0290,

| ORF_Name | NTID | AAID | NT Length | AA Length | Score | Probability |
|---|---|---|---|---|---|---|
| 35974750_f2_38 | 149 | 2069 | 261 | 786 | 603 | 1.1e-58 |

| Protein name | Locus_Name | Acc# |
|---|---|---|
|  | sp:YBGI_HAEIN |  |

Description

HYPOTHETICAL PROTEIN HI0105

| ORF Name | NTID | AAID | NT Length | AA Length | Score | Probability |
|---|---|---|---|---|---|---|
| 4806512_c2_96 | 150 | 2070 | 463 | 1392 | 1501 | 7.7e-154 |

| Protein name | Locus Name | Acc# |
|---|---|---|
| hypothetical protein 7 | pir:T00129 | T00129 |

Description

| ORF Name | NTID | AAID | NT Length | AA Length | Score | Probability |
|---|---|---|---|---|---|---|
| 5109843_c2_99 | 151 | 2071 | 579 | 1740 | 291 | 4.3e-45 |

| Protein name | Locus Name | Acc# |
|---|---|---|
|  | sp:CYDC_ECOLI | P23886 |

Description

TRANSPORT ATP-BINDING PROTEIN CYDC

| ORF Name | NTID | AAID | NT Length | AA Length | Score | Probability |
|---|---|---|---|---|---|---|
| 6718_c2_103 | 152 | 2072 | 531 | 1596 | 1457 | 3.5e-149 |

| Protein name | Locus Name | Acc# |
|---|---|---|
|  | sp:PMGI_ECOLI | P37689 |

Description (EC 5.4.2.1) (PHOSPHOGLYCEROMUTASE) (BPG-INDEPENDENT PGAM)

| ORF Name | NTID | AAID | NT Length | AA Length | Score | Probability |
|---|---|---|---|---|---|---|
| 6837753_f1_23 | 153 | 2073 | 224 | 675 | 147 | 3.2e-08 |

| Protein name | Locus Name | Acc# |
|---|---|---|
| capm protein (capM1) RP344 | pir:B71691 | B71691 |

Description

| ORF Name | NTID | AAID | NT Length | AA Length | Score | Probability |
|---|---|---|---|---|---|---|
| 789811_c1_88 | 154 | 2074 | 892 | 2679 | 2203 | 2.3e-256 |

| Protein name | Locus Name | Acc# |
|---|---|---|
|  | sp:GYRA_ECOLI | P09097 |

Description

DNA GYRASE SUBUNIT A,

| ORF Name | NTID | AAID | NT Length | AA Length | Score | Probability |
|---|---|---|---|---|---|---|
| 986638_c3_5 | 155 | 2075 | 262 | 789 | 1149 | 1.5e-116 |

Protein name: multidrug transporter homolog
Locus Name: pir:G69005
Acc#: G69005

Description

| ORF Name | NTID | AAID | NT Length | AA Length | Score | Probability |
|---|---|---|---|---|---|---|
| 12985037_c2_42 | 156 | 2076 | 158 | 477 | 354 | 1.9e-31 |

Protein name:
Locus Name: sp:PILQ_PSEAE
Acc#: P34750

Description: FIMBRIAL ASSEMBLY PROTEIN PILQ PRECURSOR

| ORF Name | NTID | AAID | NT Length | AA Length | Score | Probability |
|---|---|---|---|---|---|---|
| 14301467_c3_49 | 157 | 2077 | 231 | 696 | 316 | 2.9e-28 |

Protein name: carbonic anhydrase
Locus Name: pir:D75298
Acc#: D75298

Description

| ORF Name | NTID | AAID | NT Length | AA Length | Score | Probability |
|---|---|---|---|---|---|---|
| 1557_c1_31 | 158 | 2078 | 501 | 1506 | 1393 | 2.1e-142 |

Protein name:
Locus Name: sp:YLEA_HAEIN
Acc#: Q57163

Description: HYPOTHETICAL PROTEIN HI0019

| ORF Name | NTID | AAID | NT Length | AA Length | Score | Probability |
|---|---|---|---|---|---|---|
| 19615687_f1_6 | 159 | 2079 | 87 | 264 | | |

Protein name:
Locus Name:
Acc#:

Description: NO-HIT

| ORF Name | NTID | AAID | NT Length | AA Length | Score | Probability |
|---|---|---|---|---|---|---|
| 23445308_f2_18 | 160 | 2080 | 224 | 672 | | |

Protein name | | | | Locus Name | | Acc#

Description

NO-HIT

| ORF Name | NTID | AAID | NT Length | AA Length | Score | Probability |
|---|---|---|---|---|---|---|
| 23859562_c1_32 | 161 | 2081 | 233 | 702 | 140 | 1.7e-09 |

Protein name: pilus expression protein | Locus Name: gp:PSEPONA | Acc#: L28837

Description

Pseudomonas syringae penicillin binding protein (ponA), membraneproteins (pilN, pilO), pilus expression proteins (pilM, pilP) genes, complete cds and pilus expression protein (pilQ) gene, partial cds.

| ORF Name | NTID | AAID | NT Length | AA Length | Score | Probability |
|---|---|---|---|---|---|---|
| 24040911_c1_33 | 162 | 2082 | 327 | 984 | 220 | 6.3e-30 |

Protein name | | | | Locus Name: sp:PILQ_PSEAE | | Acc#: P34750

Description

FIMBRIAL ASSEMBLY PROTEIN PILQ PRECURSOR

| ORF Name | NTID | AAID | NT Length | AA Length | Score | Probability |
|---|---|---|---|---|---|---|
| 34510950_c2_39 | 163 | 2083 | 645 | 1938 | 201 | 4.9e-15 |

Protein name: membrane protein | Locus Name: gp:PSEPONA | Acc#: L28837

Description

Pseudomonas syringae penicillin binding protein (ponA), membraneproteins (pilN, pilO), pilus expression proteins (pilM, pilP) genes, complete cds and pilus expression protein (pilQ) gene, partial cds.

| ORF_Name | NTID | AAID | NT Length | AA Length | Score | Probability |
|---|---|---|---|---|---|---|
| 34589061_c1_36 | 164 | 2084 | 183 | 552 | 365 | 1.8e-33 |

Protein name: lactoylglutathione lyase,:glyoxalase I
Locus Name: pir:A46714
Acc#:

Description

| ORF_Name | NTID | AAID | NT Length | AA Length | Score | Probability |
|---|---|---|---|---|---|---|
| 4304693_c1_34 | 165 | 2085 | 375 | 1128 | 883 | 2.4e-88 |

Protein name:
Locus Name: sp:AROB_NEIGO
Acc#: O50468

Description: 3-DEHYDROQUINATE SYNTHASE,

| ORF_Name | NTID | AAID | NT Length | AA Length | Score | Probability |
|---|---|---|---|---|---|---|
| 4877328_c1_35 | 166 | 2086 | 318 | 957 | | |

Protein name:
Locus Name:
Acc#:

Description: NO-HIT

| ORF_Name | NTID | AAID | NT Length | AA Length | Score | Probability |
|---|---|---|---|---|---|---|
| 7042153_c2_43 | 167 | 2087 | 231 | 696 | 452 | 1.1e-42 |

Protein name:
Locus Name: sp:AROK_HAEIN
Acc#: P43880

Description: SHIKIMATE KINASE, (SK)

| ORF_Name | NTID | AAID | NT Length | AA Length | Score | Probability |
|---|---|---|---|---|---|---|
| 7083457_c3_46 | 168 | 2088 | 216 | 651 | 154 | 4.2e-11 |

Protein name: fimbrial assembly protein pilO
Locus Name: pir:S77728
Acc#: S77728

Description

| ORF Name | NTID | AAID | NT Length | AA Length | Score | Probability |
|---|---|---|---|---|---|---|
| 23703142_c1_3 | 169 | 2089 | 300 | 900 | 635 | 4.5e-62 |

| Protein name | | | | Locus Name | | Acc# |
|---|---|---|---|---|---|---|
| | | | | sp:YJEK_ECOLI | | P39280 |

Description

HYPOTHETICAL 38.7 KD PROTEIN IN MOPA-EFP INTERGENIC REGION

| ORF Name | NTID | AAID | NT Length | AA Length | Score | Probability |
|---|---|---|---|---|---|---|
| 34119052_f1_1 | 170 | 2090 | 204 | 612 | 663 | 4.9e-65 |

| Protein name | | | | Locus Name | | Acc# |
|---|---|---|---|---|---|---|
| translation elongation factor EF-P | | | | pir:S34443 | | |

Description

| ORF Name | NTID | AAID | NT Length | AA Length | Score | Probability |
|---|---|---|---|---|---|---|
| 32712915_c2_17 | 171 | 2091 | 77 | 234 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 33984701_f3_10 | 172 | 2092 | 579 | 1740 | 1233 | 1.9e-125 |

| Protein name | | | | Locus Name | | Acc# |
|---|---|---|---|---|---|---|
| | | | | sp:PMSR_NEIGO | | P14930 |

Description

PEPTIDE METHIONINE SULFOXIDE REDUCTASE (PEPTIDE MET(O) REDUCTASE)

| ORF Name | NTID | AAID | NT Length | AA Length | Score | Probability |
|---|---|---|---|---|---|---|
| 36131500_c3_21 | 173 | 2093 | 308 | 927 | 655 | 3.4e-64 |

| Protein name | | | | Locus Name | | Acc# |
|---|---|---|---|---|---|---|
| | | | | sp:HTPX_ECOLI | | P23894 |

Description

PROBABLE PROTEASE HTPX, (HEAT SHOCK PROTEIN HTPX)

| ORF_Name | NTID | AAID | NT Length | AA Length | Score | Probability |
|---|---|---|---|---|---|---|
| 3907578_c1_15 | 174 | 2094 | 299 | 900 | 572 | 2.1e-55 |

| Protein name | | | | Locus Name | | Acc# |
|---|---|---|---|---|---|---|
| | | | | sp:DHPS_ECOLI | | |

Description

PYROPHOSPHORYLASE)

| ORF_Name | NTID | AAID | NT Length | AA Length | Score | Probability |
|---|---|---|---|---|---|---|
| 4100312_f3_13 | 175 | 2095 | 106 | 321 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 48828062_c2_16 | 176 | 2096 | 115 | 348 | 223 | 1.2e-16 |

| Protein name | | | | Locus Name | | Acc# |
|---|---|---|---|---|---|---|
| probable transglycosylase | | | | pir:T12796 | | |

Description

| ORF_Name | NTID | AAID | NT Length | AA Length | Score | Probability |
|---|---|---|---|---|---|---|
| 831318_f2_7 | 177 | 2097 | 472 | 1419 | 1225 | 1.4e-124 |

| Protein name | | | | Locus Name | | Acc# |
|---|---|---|---|---|---|---|
| | | | | sp:HFLX_ECOLI | | P25519 |

Description

GTP-BINDING PROTEIN HFLX

| ORF_Name | NTID | AAID | NT Length | AA Length | Score | Probability |
|---|---|---|---|---|---|---|
| 870250_f2_6 | 178 | 2098 | 255 | 768 | 394 | 1.6e-36 |

| Protein name | | | | Locus Name | | Acc# |
|---|---|---|---|---|---|---|
| hypothetical protein in endA-gshB intergenic region | | | | pir:A65080 | | A65080 |

Description

115

| ORF Name | NTID | AAID | NT Length | AA Length | Score | Probability |
|---|---|---|---|---|---|---|
| 10548386_f2_19 | 179 | 2099 | 647 | 1944 | | |

Protein name | Locus Name | Acc#

Description

NO-HIT

| ORF Name | NTID | AAID | NT Length | AA Length | Score | Probability |
|---|---|---|---|---|---|---|
| 10626558_c2_94 | 180 | 2100 | 182 | 549 | 73 | 0.039 |

Protein name | Locus Name | Acc#
| | sp:TEGP_HSV11 | P06481

Description

TEGUMENT PHOSPHOPROTEIN US9 (10 KD PROTEIN)

| ORF Name | NTID | AAID | NT Length | AA Length | Score | Probability |
|---|---|---|---|---|---|---|
| 1178127_f1_10 | 181 | 2101 | 445 | 1338 | 1319 | 1.5e-134 |

Protein name | Locus Name | Acc#
| | sp:SYS_HAEIN | P43833

Description

SERYL-TRNA SYNTHETASE, (SERINE--TRNA LIGASE) (SERRS)

| ORF Name | NTID | AAID | NT Length | AA Length | Score | Probability |
|---|---|---|---|---|---|---|
| 12109686_c1_63 | 182 | 2102 | 66 | 201 | | |

Protein name | Locus Name | Acc#

Description

NO-HIT

| ORF Name | NTID | AAID | NT Length | AA Length | Score | Probability |
|---|---|---|---|---|---|---|
| 12892086_f2_26 | 183 | 2103 | 81 | 246 | | |

Protein name | Locus Name | Acc#

Description

NO-HIT

| ORF Name | NTID | AAID | NT Length | AA Length | Score | Probability |
|---|---|---|---|---|---|---|
| 1369428_c2_97 | 184 | 2104 | 78 | 237 | | |

Protein name | Locus Name | Acc#

Description

NO-HIT

| ORF Name | NTID | AAID | NT Length | AA Length | Score | Probability |
|---|---|---|---|---|---|---|
| 13710925_f3_46 | 185 | 2105 | 148 | 447 | 652 | 7.1e-64 |

Protein name | Locus Name: sp:MT1C_MORBO | Acc# P34721

Description

METHYLTRANSFERASE MBOI C) (M.MBOI C)

| ORF Name | NTID | AAID | NT Length | AA Length | Score | Probability |
|---|---|---|---|---|---|---|
| 1412642_c1_65 | 186 | 2106 | 147 | 444 | 88 | 0.00042 |

Protein name | Locus Name: sp:YRKI_BACSU | Acc# P54436

Description

HYPOTHETICAL 8.2 KD PROTEIN IN BLTR-SPOIIIC INTERGENIC REGION

| ORF Name | NTID | AAID | NT Length | AA Length | Score | Probability |
|---|---|---|---|---|---|---|
| 14250312_c2_100 | 187 | 2107 | 246 | 741 | | |

Protein name | Locus Name | Acc#

Description

NO-HIT

| ORF Name | NTID | AAID | NT Length | AA Length | Score | Probability |
|---|---|---|---|---|---|---|
| 1433466_c2_111 | 188 | 2108 | 85 | 258 | 141 | 9.6e-09 |

Protein name | Locus Name: sp:MVIN_ECOLI | Acc# P75932

Description

VIRULENCE FACTOR MVIN HOMOLOG

| ORF Name | NTID | AAID | NT Length | AA Length | Score | Probability |
|---|---|---|---|---|---|---|
| 14875390_f3_51 | 189 | 2109 | 134 | 405 | 302 | 1.0e-26 |

Protein name | | | | Locus Name | Acc# |
| | | | sp:YAEL_ECOLI | P37764 |

Description

HYPOTHETICAL 49.1 KD PROTEIN IN CDSA-HLPA INTERGENIC REGION

| ORF Name | NTID | AAID | NT Length | AA Length | Score | Probability |
|---|---|---|---|---|---|---|
| 15020887_c1_83 | 190 | 2110 | 189 | 570 | | |

Protein name | | | | Locus Name | Acc# |

Description

NO-HIT

| ORF Name | NTID | AAID | NT Length | AA Length | Score | Probability |
|---|---|---|---|---|---|---|
| 15885450_c3_142 | 191 | 2111 | 342 | 1029 | 624 | 6.6e-61 |

Protein name | | | | Locus Name | Acc# |
| | | | sp:MVIN_HAEIN | P44958 |

Description

VIRULENCE FACTOR MVIN HOMOLOG

| ORF Name | NTID | AAID | NT Length | AA Length | Score | Probability |
|---|---|---|---|---|---|---|
| 166043_f1_8 | 192 | 2112 | 259 | 780 | 416 | 7.3e-39 |

Protein name | | | | Locus Name | Acc# |
cytochrome c maturation protein B | | | | gp:AF044582 | AF044582 |

Description

Shewanella putrefaciens NrfG homolog gene, partial cds; andmono-heme c-type cytochrome ScyA (scyA), cytochrome c maturationprotein A (ccmA), cytochrome c maturation protein B (ccmB),cytochrome c maturation protein C (ccmC), cytochrome c maturationprotein D (ccmD), and cytochrome c maturation protein E (ccmE)genes, complete cds.

| ORF_Name | NTID | AAID | NT Length | AA Length | Score | Probability |
|---|---|---|---|---|---|---|
| 17069628_f1_4 | 193 | 2113 | 116 | 351 | | |

Protein name | | | | Locus_Name | | Acc#

Description

NO-HIT

| ORF_Name | NTID | AAID | NT Length | AA Length | Score | Probability |
|---|---|---|---|---|---|---|
| 187703_f2_21 | 194 | 2114 | 113 | 342 | 90 | 0.00026 |

Protein name | | | | Locus_Name | | Acc#
| | | | | sp:Y4AR_RHISN | | P55365

Description

HYPOTHETICAL 12.1 KD PROTEIN Y4AR

| ORF_Name | NTID | AAID | NT Length | AA Length | Score | Probability |
|---|---|---|---|---|---|---|
| 22462757_c1_67 | 195 | 2115 | 67 | 204 | 89 | 0.00033 |

Protein name | | | | Locus_Name | | Acc#
hypothetical protein SC6E10.02 | | | | pir:T35489 | | T35489

Description

| ORF_Name | NTID | AAID | NT Length | AA Length | Score | Probability |
|---|---|---|---|---|---|---|
| 23470003_c1_81 | 196 | 2116 | 155 | 468 | 346 | 2.3e-31 |

Protein name | | | | Locus_Name | | Acc#
| | | | | sp:MVIN_ECOLI | | P75932

Description

VIRULENCE FACTOR MVIN HOMOLOG

| ORF_Name | NTID | AAID | NT Length | AA Length | Score | Probability |
|---|---|---|---|---|---|---|
| 23914017_c2_104 | 197 | 2117 | 88 | 267 | 134 | 5.5e-09 |

Protein name | | | | Locus_Name | | Acc#
hypothetical protein ydaT | | | | pir:C69770 | | C69770

Description

| ORF Name | NTID | AAID | NT Length | AA Length | Score | Probability |
|---|---|---|---|---|---|---|
| 24219792_f2_34 | 198 | 2118 | 296 | 891 | 440 | 2.1e-41 |

| Protein name | | | | Locus Name | | Acc# |
|---|---|---|---|---|---|---|
| | | | | sp:CDSA_PSEAE | | Q59640 |

Description

SYNTHASE)

| ORF Name | NTID | AAID | NT Length | AA Length | Score | Probability |
|---|---|---|---|---|---|---|
| 24244033_c1_70 | 199 | 2119 | 302 | 909 | 620 | 1.8e-60 |

| Protein name | | | | Locus Name | | Acc# |
|---|---|---|---|---|---|---|
| | | | | sp:YGLA_SYNP2 | | P28606 |

Description

HYPOTHETICAL 34.1 KD PROTEIN IN GLNA 3'REGION

| ORF Name | NTID | AAID | NT Length | AA Length | Score | Probability |
|---|---|---|---|---|---|---|
| 24252302_c2_106 | 200 | 2120 | 493 | 1482 | 1229 | 5.1e-125 |

| Protein name | | | | Locus Name | | Acc# |
|---|---|---|---|---|---|---|
| 2-oxoglutarate/malate translocator homolog yfIS | | | | pir:F69811 | | F69811 |

Description

| ORF Name | NTID | AAID | NT Length | AA Length | Score | Probability |
|---|---|---|---|---|---|---|
| 24330005_c3_122 | 201 | 2121 | 314 | 945 | 413 | 1.5e-38 |

| Protein name | | | | Locus Name | | Acc# |
|---|---|---|---|---|---|---|
| | | | | gp:AB017194 | | AB017194 |

Description

Plectonema boryanum ORF270, proline iminopeptidase, ferredoxin andamidase enhancer genes, complete and partial cds.

| ORF_Name | NTID | AAID | NT Length | AA Length | Score | Probability |
|---|---|---|---|---|---|---|
| 24650962_f3_45 | 202 | 2122 | 261 | 786 | 806 | 3.4e-80 |

| Protein name | | Locus Name | Acc# |
|---|---|---|---|
| | | sp:T2D1_STRPN | P09356 |

Description (R.DPNI)

| ORF_Name | NTID | AAID | NT Length | AA Length | Score | Probability |
|---|---|---|---|---|---|---|
| 24735875_f2_16 | 203 | 2123 | 73 | 222 | 54 | 0.017 |

| Protein name | | Locus Name | Acc# |
|---|---|---|---|
| | | sp:YMT0_YEAST | Q04210 |

Description

HYPOTHETICAL 19.2 KD PROTEIN IN SUB1-ARGR1 INTERGENIC REGION

| ORF_Name | NTID | AAID | NT Length | AA Length | Score | Probability |
|---|---|---|---|---|---|---|
| 25391007_c2_110 | 204 | 2124 | 216 | 651 | 443 | 1.0e-41 |

| Protein name | Locus Name | Acc# |
|---|---|---|
| N-acetyl-anhydromuramyl-L-alanine amidase | gp:AF082575 | AF082575 |

Description

Pseudomonas aeruginosa N-acetyl-anhydromuramyl-L-alanine amidase(ampD) and transmembrane protein AmpE (ampE) genes, complete cds.

| ORF_Name | NTID | AAID | NT Length | AA Length | Score | Probability |
|---|---|---|---|---|---|---|
| 25662782_f2_24 | 205 | 2125 | 258 | 777 | 288 | 2.7e-25 |

| Protein name | | Locus Name | Acc# |
|---|---|---|---|
| | | sp:CCMA_RHOCA | P29959 |

Description

PROTEIN HELA)

| ORF_Name | NTID | AAID | NT Length | AA Length | Score | Probability |
|---|---|---|---|---|---|---|
| 289052_c1_66 | 206 | 2126 | 154 | 465 | 220 | 4.3e-18 |

| Protein name | Locus Name | Acc# |
|---|---|---|
| conserved hypothetical protein | pir:B75344 | B75344 |

Description

| ORF_Name | NTID | AAID | NT Length | AA Length | Score | Probability |
|---|---|---|---|---|---|---|
| 29301457_f3_44 | 207 | 2127 | 93 | 282 | | |

Protein name | | | | Locus_Name | | Acc# |

Description

NO-HIT

| ORF_Name | NTID | AAID | NT Length | AA Length | Score | Probability |
|---|---|---|---|---|---|---|
| 29507800_c2_95 | 208 | 2128 | 397 | 1194 | 883 | 2.4e-88 |

Protein name | | | | Locus_Name | | Acc# |
| | | | | sp:RP32_PSEAE | | P42378 |

Description

RNA POLYMERASE SIGMA-32 FACTOR

| ORF_Name | NTID | AAID | NT Length | AA Length | Score | Probability |
|---|---|---|---|---|---|---|
| 34569707_c3_131 | 209 | 2129 | 95 | 288 | 74 | 0.023 |

Protein name | | | | Locus_Name | | Acc# |
F22C12.13 | | | | gp:AC007764 | | AC007764 |

Description

Genomic sequence for Arabidopsis thaliana BAC F22C12 from chromosome I, complete sequence.

| ORF_Name | NTID | AAID | NT Length | AA Length | Score | Probability |
|---|---|---|---|---|---|---|
| 36335200_f1_13 | 210 | 2130 | 347 | 1044 | 506 | 2.1e-48 |

Protein name | | | | Locus_Name | | Acc# |
| | | | | sp:YAEL_ECOLI | | P37764 |

Description

HYPOTHETICAL 49.1 KD PROTEIN IN CDSA-HLPA INTERGENIC REGION

| ORF Name | NTID | AAID | NT Length | AA Length | Score | Probability |
|---|---|---|---|---|---|---|
| 36520625_f2_31 | 211 | 2131 | 256 | 771 | 723 | 2.1e-71 |

| Protein name | Locus Name | Acc# |
|---|---|---|
| UMP kinase | gp:AB010087 | AB010087 |

Description

Pseudomonas aeruginosa rpsB, tsf, pyrH, frr genes for ribosomalprotein S2, elongation factor Ts, UMP kinase, ribosome recyclingfactor, complete cds.

| ORF Name | NTID | AAID | NT Length | AA Length | Score | Probability |
|---|---|---|---|---|---|---|
| 3907818_f2_32 | 212 | 2132 | 187 | 564 | 614 | 7.6e-60 |

| Protein name | Locus Name | Acc# |
|---|---|---|
| ribosome recycling factor | gp:AB010087 | AB010087 |

Description

Pseudomonas aeruginosa rpsB, tsf, pyrH, frr genes for ribosomalprotein S2, elongation factor Ts, UMP kinase, ribosome recyclingfactor, complete cds.

| ORF Name | NTID | AAID | NT Length | AA Length | Score | Probability |
|---|---|---|---|---|---|---|
| 391068_f2_33 | 213 | 2133 | 272 | 819 | 534 | 2.3e-51 |

| Protein name | Locus Name | Acc# |
|---|---|---|
|  | sp:UPPS_ECOLI |  |

Description (DI-TRANS-POLY-CIS-DECAPRENYLCISTRANSFERASE)

| ORF Name | NTID | AAID | NT Length | AA Length | Score | Probability |
|---|---|---|---|---|---|---|
| 3915930_f3_50 | 214 | 2134 | 204 | 615 | 592 | 1.6e-57 |

| Protein name | Locus Name | Acc# |
|---|---|---|
|  | sp:TKT1_ECOLI | P27302 |

Description

TRANSKETOLASE 1, (TK 1)

| ORF Name | NTID | AAID | NT Length | AA Length | Score | Probability |
|---|---|---|---|---|---|---|
| 3947932_f3_41 | 215 | 2135 | 299 | 900 | 125 | 2.0e-05 |

| Protein name | | | | Locus Name | | Acc# |
|---|---|---|---|---|---|---|
| | | | | sp:YEEZ_ECOLI | | P76370 |

Description

HYPOTHETICAL 29.7 KD PROTEIN IN SBCB-HISL INTERGENIC REGION PRECURSOR

| ORF Name | NTID | AAID | NT Length | AA Length | Score | Probability |
|---|---|---|---|---|---|---|
| 4110687_f2_30 | 216 | 2136 | 497 | 1494 | 1775 | 7.1e-183 |

| Protein name | | | | Locus Name | | Acc# |
|---|---|---|---|---|---|---|
| | | | | sp:TKT1_ECOLI | | P27302 |

Description

TRANSKETOLASE 1, (TK 1)

| ORF Name | NTID | AAID | NT Length | AA Length | Score | Probability |
|---|---|---|---|---|---|---|
| 4345300_f2_20 | 217 | 2137 | 989 | 2970 | 2958 | 0.0 |

| Protein name | | | | Locus Name | | Acc# |
|---|---|---|---|---|---|---|
| | | | | sp:SYV_HAEIN | | P43834 |

Description

VALYL-TRNA SYNTHETASE, (VALINE--TRNA LIGASE) (VALRS)

| ORF Name | NTID | AAID | NT Length | AA Length | Score | Probability |
|---|---|---|---|---|---|---|
| 4495268_c1_84 | 218 | 2138 | 110 | 333 | 512 | 4.9e-49 |

| Protein name | | | | Locus Name | | Acc# |
|---|---|---|---|---|---|---|
| ferredoxin [3Fe-4S] | | | | pir:FEAV | | |

Description

| ORF Name | NTID | AAID | NT Length | AA Length | Score | Probability |
|---|---|---|---|---|---|---|
| 4693768_f1_11 | 219 | 2139 | 435 | 1308 | 854 | 2.8e-85 |

| Protein name | | | | Locus Name | | Acc# |
|---|---|---|---|---|---|---|
| | | | | sp:DXR_ECOLI | | |

Description

REDUCTOISOMERASE)

| ORF_Name | NTID | AAID | NT Length | AA Length | Score | Probability |
|---|---|---|---|---|---|---|
| 4772325_c1_69 | 220 | 2140 | 93 | 282 | 77 | 0.0071 |

| Protein name | | | | Locus Name | | Acc# |
|---|---|---|---|---|---|---|
| cytochrome b | | | | gp:ASA228475 | | AJ228475 |

Description

Andricus solitarius cytb gene.

| ORF_Name | NTID | AAID | NT Length | AA Length | Score | Probability |
|---|---|---|---|---|---|---|
| 5109626_f1_6 | 221 | 2141 | 81 | 246 | 355 | 2.1e-32 |

| Protein name | | | | Locus Name | | Acc# |
|---|---|---|---|---|---|---|
| | | | | sp:MT1A_MORBO | | P34720 |

Description

METHYLTRANSFERASE MBOI A) (M.MBOI A)

| ORF_Name | NTID | AAID | NT Length | AA Length | Score | Probability |
|---|---|---|---|---|---|---|
| 5350281_c3_139 | 222 | 2142 | 76 | 231 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 6823912_f3_37 | 223 | 2143 | 63 | 192 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 103187_f2_5 | 224 | 2144 | 98 | 297 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 16917_f2_4 | 225 | 2145 | 164 | 495 | 307 | 2.6e-27 |

| Protein name | | | | Locus Name | | Acc# |
|---|---|---|---|---|---|---|
| | | | | sp:CYST_ECOLI | | P16701 |

Description

SULFATE TRANSPORT SYSTEM PERMEASE PROTEIN CYST

| ORF Name | NTID | AAID | NT Length | AA Length | Score | Probability |
|---|---|---|---|---|---|---|
| 20163930_c1_9 | 226 | 2146 | 271 | 813 | 502 | 5.6e-48 |

| Protein name | | | | Locus Name | | Acc# |
|---|---|---|---|---|---|---|
| | | | | sp:RHLB_HAEIN | | P44922 |

Description

ATP-DEPENDENT RNA HELICASE RHLB HOMOLOG

| ORF Name | NTID | AAID | NT Length | AA Length | Score | Probability |
|---|---|---|---|---|---|---|
| 24257755_c1_8 | 227 | 2147 | 155 | 468 | | |

| Protein name | | | | Locus Name | | Acc# |

Description

NO-HIT

| ORF Name | NTID | AAID | NT Length | AA Length | Score | Probability |
|---|---|---|---|---|---|---|
| 16594167_f1_5 | 228 | 2148 | 510 | 1533 | | |

| Protein name | | | | Locus Name | | Acc# |

Description

NO-HIT

| ORF Name | NTID | AAID | NT Length | AA Length | Score | Probability |
|---|---|---|---|---|---|---|
| 22897255_f2_6 | 229 | 2149 | 269 | 810 | 305 | 4.2e-27 |

| Protein name | | | | Locus Name | | Acc# |
|---|---|---|---|---|---|---|
| putative acyltransferase | | | | gp:SCM10 | | AL133469 |

Description

Streptomyces coelicolor cosmid M10.

| ORF Name | NTID | AAID | NT Length | AA Length | Score | Probability |
|---|---|---|---|---|---|---|
| 24485937_f3_13 | 230 | 2150 | 62 | 189 | 147 | 1.7e-09 |

| Protein name | Locus Name | Acc# |
|---|---|---|
| glutamate dehydrogenase | gp:UAN010746 | AJ010746 |

Description

Antarctic bacterium TAD1, dhe gene.

| ORF Name | NTID | AAID | NT Length | AA Length | Score | Probability |
|---|---|---|---|---|---|---|
| 2501562_f3_9 | 231 | 2151 | 288 | 867 | 547 | 9.5e-53 |

| Protein name | Locus Name | Acc# |
|---|---|---|
| | sp:FTSH_ECOLI | P28691 |

Description

CELL DIVISION PROTEIN FTSH,

| ORF Name | NTID | AAID | NT Length | AA Length | Score | Probability |
|---|---|---|---|---|---|---|
| 25415636_f1_4 | 232 | 2152 | 679 | 2040 | 1148 | 7.4e-181 |

| Protein name | Locus Name | Acc# |
|---|---|---|
| | sp:HTPG_ECOLI | P10413 |

Description

PROTEIN C62.5)

| ORF Name | NTID | AAID | NT Length | AA Length | Score | Probability |
|---|---|---|---|---|---|---|
| 26366686_c2_24 | 233 | 2153 | 791 | 2376 | 1520 | 7.5e-156 |

| Protein name | Locus Name | Acc# |
|---|---|---|
| penicillin-binding protein 1A | gp:PAU73780 | U73780 |

Description

Pseudomonas aeruginosa penicillin-binding protein 1A (ponA) gene, complete cds, and malic enzyme gene, partial cds.

| ORF Name | NTID | AAID | NT Length | AA Length | Score | Probability |
|---|---|---|---|---|---|---|
| 12304661_f2_18 | 234 | 2154 | 584 | 1755 | 763 | 1.2e-75 |

Protein name | | | | Locus Name | | Acc# |
| | | | | sp:RECN_ECOLI | | |

Description

DNA REPAIR PROTEIN RECN (RECOMBINATION PROTEIN N)

| ORF Name | NTID | AAID | NT Length | AA Length | Score | Probability |
|---|---|---|---|---|---|---|
| 16578133_c3_57 | 235 | 2155 | 65 | 198 | 74 | 0.013 |

Protein name | | | | Locus Name | | Acc# |
| | | | | sp:PSBR_TOBAC | | Q40519 |

Description

PHOTOSYSTEM II 10 KD POLYPEPTIDE PRECURSOR (PII10)

| ORF Name | NTID | AAID | NT Length | AA Length | Score | Probability |
|---|---|---|---|---|---|---|
| 19564510_f2_17 | 236 | 2156 | 194 | 585 | 444 | 7.8e-42 |

Protein name | | | | Locus Name | | Acc# |
| N-formylmethionylaminoacyl-tRNA deformylase, | | | | pir:S23107 | | |

Description

| ORF Name | NTID | AAID | NT Length | AA Length | Score | Probability |
|---|---|---|---|---|---|---|
| 23554638_f3_29 | 237 | 2157 | 285 | 858 | 531 | 4.7e-51 |

Protein name | | | | Locus Name | | Acc# |
| beta-ketoacyl-acyl carrier protein synthase II | | | | gp:AF188707 | | AF188707 |

Description

Photobacterium profundum acyl carrier protein (acpP) gene, partialcds; beta-ketoacyl-acyl carrier protein synthase II (fabF) gene,complete cds; and aminodeoxychorismate lyase (pabC) gene, partialcds.

| ORF_Name | NTID | AAID | NT Length | AA Length | Score | Probability |
|---|---|---|---|---|---|---|
| 23912502_f1_9 | 238 | 2158 | 90 | 273 | 200 | 5.6e-16 |

| Protein name | | | | Locus Name | | Acc# |
|---|---|---|---|---|---|---|
| | | | | sp:YHHP_ECOLI | | P37618 |

Description

HYPOTHETICAL 9.1 KD PROTEIN IN FTSY-NIKA INTERGENIC REGION

| ORF_Name | NTID | AAID | NT Length | AA Length | Score | Probability |
|---|---|---|---|---|---|---|
| 23985753_f3_27 | 239 | 2159 | 167 | 504 | 273 | 1.0e-23 |

| Protein name | | | | Locus Name | | Acc# |
|---|---|---|---|---|---|---|
| | | | | gp:ECU28377 | | U28377 |

Description

Escherichia coli K-12 genome; approximately 65 to 68 minutes.

| ORF_Name | NTID | AAID | NT Length | AA Length | Score | Probability |
|---|---|---|---|---|---|---|
| 24302263_f1_6 | 240 | 2160 | 193 | 582 | 340 | 8.2e-31 |

| Protein name | | | | Locus Name | | Acc# |
|---|---|---|---|---|---|---|
| hypothetical protein b2948 | | | | pir:C65080 | | C65080 |

Description

| ORF_Name | NTID | AAID | NT Length | AA Length | Score | Probability |
|---|---|---|---|---|---|---|
| 24353458_f2_20 | 241 | 2161 | 308 | 927 | 671 | 6.9e-66 |

| Protein name | | | | Locus Name | | Acc# |
|---|---|---|---|---|---|---|
| site-specific recombinase | | | | gp:AF033497 | | AF033497 |

Description

Proteus mirabilis site-specific recombinase (xerD) gene, completecds.

| ORF_Name | NTID | AAID | NT Length | AA Length | Score | Probability |
|---|---|---|---|---|---|---|
| 24642562_f2_13 | 242 | 2162 | 102 | 309 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 3007832_f2_19 | 243 | 2163 | 169 | 510 | | |

| Protein name | | | | | Locus_Name | Acc# |
|---|---|---|---|---|---|---|
| | | | | | | |

Description

NO-HIT

| ORF_Name | NTID | AAID | NT Length | AA Length | Score | Probability |
|---|---|---|---|---|---|---|
| 36205013_f3_23 | 244 | 2164 | 361 | 1086 | 291 | 1.3e-25 |

| Protein name | | | | | Locus_Name | Acc# |
|---|---|---|---|---|---|---|
| hypothetical protein | | | | | pir:G75388 | G75388 |

Description

| ORF_Name | NTID | AAID | NT Length | AA Length | Score | Probability |
|---|---|---|---|---|---|---|
| 3953593_c1_39 | 245 | 2165 | 211 | 636 | 386 | 1.1e-35 |

| Protein name | | | | | Locus_Name | Acc# |
|---|---|---|---|---|---|---|
| imidazoleglycerol-phosphate synthase | | | | | pir:D69070 | D69070 |

Description

| ORF_Name | NTID | AAID | NT Length | AA Length | Score | Probability |
|---|---|---|---|---|---|---|
| 4883425_f1_2 | 246 | 2166 | 206 | 621 | 234 | 1.4e-19 |

| Protein name | | | | | Locus_Name | Acc# |
|---|---|---|---|---|---|---|
| | | | | | sp:YQIA_ECOLI | P36653 |

Description

HYPOTHETICAL 21.6 KD PROTEIN IN PARE-ICC INTERGENIC REGION (F193)

| ORF_Name | NTID | AAID | NT Length | AA Length | Score | Probability |
|---|---|---|---|---|---|---|
| 6506_f1_3 | 247 | 2167 | 637 | 1914 | 2041 | 4.6e-211 |

| Protein name | | | | | Locus_Name | Acc# |
|---|---|---|---|---|---|---|
| topoisomerase IV subunit | | | | | gp:AB003429 | AB003429 |

Description

Pseudomonas aeruginosa DNA for topoisomerase IV subunit, completecds.

| ORF Name | NTID | AAID | NT Length | AA Length | Score | Probability |
|---|---|---|---|---|---|---|
| 805180_c1_38 | 248 | 2168 | 222 | 669 | 554 | 1.7e-53 |

| Protein name | | | | Locus Name | | Acc# |
|---|---|---|---|---|---|---|
| | | | | sp:HIS7_PEA | | Q43072 |

Description

IMIDAZOLEGLYCEROL-PHOSPHATE DEHYDRATASE, (IGPD)

| ORF Name | NTID | AAID | NT Length | AA Length | Score | Probability |
|---|---|---|---|---|---|---|
| 823381_f3_24 | 249 | 2169 | 134 | 405 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 862761_c1_43 | 250 | 2170 | 72 | 219 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 12281888_c1_40 | 251 | 2171 | 78 | 237 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1367177_f2_15 | 252 | 2172 | 304 | 915 | 674 | 3.3e-66 |

| Protein name | | | | Locus Name | | Acc# |
|---|---|---|---|---|---|---|
| | | | | sp:GALU_ECOLI | | P25520 |

Description

URIDYLYLTRANSFERASE) (URIDINE DIPHOSPHOGLUCOSE PYROPHOSPHORYLASE)

| ORF Name | NTID | AAID | NT Length | AA Length | Score | Probability |
|---|---|---|---|---|---|---|
| 14463877_f3_23 | 253 | 2173 | 330 | 993 | 273 | 1.0e-23 |

Protein name | | | | Locus Name | | Acc#
sp:YJGQ_ECOLI — P39341

Description

HYPOTHETICAL 39.8 KD PROTEIN IN PEPA-GNTV INTERGENIC REGION (O361)

| ORF Name | NTID | AAID | NT Length | AA Length | Score | Probability |
|---|---|---|---|---|---|---|
| 156515_f2_20 | 254 | 2174 | 178 | 537 | | |

Protein name | | | | Locus Name | | Acc#

Description

NO-HIT

| ORF Name | NTID | AAID | NT Length | AA Length | Score | Probability |
|---|---|---|---|---|---|---|
| 16040927_c2_50 | 255 | 2175 | 112 | 339 | | |

Protein name | | | | Locus Name | | Acc#

Description

NO-HIT

| ORF Name | NTID | AAID | NT Length | AA Length | Score | Probability |
|---|---|---|---|---|---|---|
| 16610183_c2_54 | 256 | 2176 | 310 | 933 | 569 | 4.4e-55 |

Protein name | | | | Locus Name | | Acc#
sp:TESB_ECOLI — P23911

Description

ACYL-COA THIOESTERASE II,

| ORF Name | NTID | AAID | NT Length | AA Length | Score | Probability |
|---|---|---|---|---|---|---|
| 16819827_f1_6 | 257 | 2177 | 137 | 414 | | |

Protein name | | | | Locus Name | | Acc#

Description

NO-HIT

| ORF Name | NTID | AAID | NT Length | AA Length | Score | Probability |
|---|---|---|---|---|---|---|
| 19531885_c3_57 | 258 | 2178 | 60 | 183 | | |

Protein name | | | | Locus Name | | Acc# |

Description

NO-HIT

| ORF Name | NTID | AAID | NT Length | AA Length | Score | Probability |
|---|---|---|---|---|---|---|
| 19538388_f2_14 | 259 | 2179 | 75 | 228 | 73 | 0.016 |

Protein name | | | | Locus Name | | Acc# |
| | | | | gp:SMI240618 | | AJ240618 |

Description

Streptococcus mitis xpt gene, strain 12261.

| ORF Name | NTID | AAID | NT Length | AA Length | Score | Probability |
|---|---|---|---|---|---|---|
| 20942936_f3_27 | 260 | 2180 | 376 | 1131 | 1060 | 4.1e-107 |

Protein name | | | | Locus Name | | Acc# |
| | | | | sp:GALE_BACSU | | P55180 |

Description

GALACTOSE 4-EPIMERASE)

| ORF Name | NTID | AAID | NT Length | AA Length | Score | Probability |
|---|---|---|---|---|---|---|
| 21675051_f3_28 | 261 | 2181 | 321 | 966 | 447 | 3.8e-42 |

Protein name | | | | Locus Name | | Acc# |
| | | | | sp:YRFI_ECOLI | | P45803 |

Description

HYPOTHETICAL 32.5 KD PROTEIN IN MRCA-PCKA INTERGENIC REGION

| ORF Name | NTID | AAID | NT Length | AA Length | Score | Probability |
|---|---|---|---|---|---|---|
| 23557930_c3_61 | 262 | 2182 | 619 | 1860 | 1768 | 3.9e-182 |

| Protein name | Locus Name | Acc# |
|---|---|---|
| glucosamine synthase | gp:AF032884 | |

Description

Thiobacillus ferrooxidans N-acetylglucosamine-1-phosphateuridyltransferase (glmU) gene, partial cds; glucosamine synthase(glmS) and RecG (recG) genes, complete cds; and transposon Tn5468,complete sequence.

| ORF Name | NTID | AAID | NT Length | AA Length | Score | Probability |
|---|---|---|---|---|---|---|
| 23634680_f2_18 | 263 | 2183 | 423 | 1272 | 383 | 2.3e-35 |

| Protein name | Locus Name | Acc# |
|---|---|---|
| putative UDP-glucose dehydrogenase | gp:ALW243431 | AJ243431 |

Description

Acinetobacter lwoffii wzc, wzb, wza, weeA, weeB, wceC, wzx, wzy,weeD, weeE, weeF, weeG, weeH, weeI, weeJ, weeK, galU, ugd, pgi,galE, pgm (partial) and mip (partial) genes (emulsan biosyntheticgene cluster), strain RAG-1.

| ORF Name | NTID | AAID | NT Length | AA Length | Score | Probability |
|---|---|---|---|---|---|---|
| 24400250_f3_24 | 264 | 2184 | 860 | 2583 | 1162 | 6.4e-118 |

| Protein name | Locus Name | Acc# |
|---|---|---|
| | sp:PLSB_HAEIN | P44857 |

Description

GLYCEROL-3-PHOSPHATE ACYLTRANSFERASE, (GPAT)

| ORF Name | NTID | AAID | NT Length | AA Length | Score | Probability |
|---|---|---|---|---|---|---|
| 24493801_f3_30 | 265 | 2185 | 375 | 1128 | 489 | 1.3e-46 |

| Protein name | Locus Name | Acc# |
|---|---|---|
| FauI DNA methyltransferase | gp:AF029070 | AF029070 |

Description

Flavobacterium aquatile FauI DNA methyltransferase (fauIM) gene,complete cds.

| ORF_Name | NTID | AAID | NT Length | AA Length | Score | Probability |
|---|---|---|---|---|---|---|
| 26797302_c2_55 | 266 | 2186 | 393 | 1182 | 515 | 2.3e-49 |

| Protein name | Locus Name | Acc# |
|---|---|---|
| | sp:YAIW_ECOLI | P77562 |

Description

HYPOTHETICAL 40.4 KD PROTEIN IN SBMA-DDLA INTERGENIC REGION

| ORF_Name | NTID | AAID | NT Length | AA Length | Score | Probability |
|---|---|---|---|---|---|---|
| 3317260_f1_5 | 267 | 2187 | 573 | 1722 | 1505 | 2.9e-154 |

| Protein name | Locus Name | Acc# |
|---|---|---|
| putative phosphoglucose isomerase | gp:ALW243431 | AJ243431 |

Description

Acinetobacter lwoffii wzc, wzb, wza, weeA, weeB, wceC, wzx, wzy, weeD, weeE, weeF, weeG, weeH, weeI, weeJ, weeK, galU, ugd, pgi, galE, pgm (partial) and mip (partial) genes (emulsan biosyntheticgene cluster), strain RAG-1.

| ORF_Name | NTID | AAID | NT Length | AA Length | Score | Probability |
|---|---|---|---|---|---|---|
| 3938762_f2_22 | 268 | 2188 | 71 | 216 | 71 | 0.026 |

| Protein name | Locus Name | Acc# |
|---|---|---|
| transcription regulator homolog yozG | pir:C69931 | C69931 |

Description

| ORF_Name | NTID | AAID | NT Length | AA Length | Score | Probability |
|---|---|---|---|---|---|---|
| 6729635_c2_46 | 269 | 2189 | 171 | 516 | 94 | 0.0062 |

| Protein name | Locus Name | Acc# |
|---|---|---|
| hypothetical protein C45H4.14 | pir:T32722 | T32722 |

Description

| ORF_Name | NTID | AAID | NT Length | AA Length | Score | Probability |
|---|---|---|---|---|---|---|
| 976387_f2_19 | 270 | 2190 | 88 | 267 | 74 | 0.0025 |

| Protein name | Locus Name | Acc# |
|---|---|---|
| hypothetical protein T16L4.170 | pir:T09929 | T09929 |

Description

| ORF Name | NTID | AAID | NT Length | AA Length | Score | Probability |
|---|---|---|---|---|---|---|
| 10823462_cl_13 | 271 | 2191 | 67 | 204 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 12376535_f2_5 | 272 | 2192 | 214 | 645 | 74 | 0.0011 |

| Protein name | Locus Name | Acc# |
|---|---|---|
| | gp:VCU39068 | U39068 |

Description

Vibrio cholerae pathogenicity island, partial and complete cds.

| ORF Name | NTID | AAID | NT Length | AA Length | Score | Probability |
|---|---|---|---|---|---|---|
| 22065635_f2_9 | 273 | 2193 | 521 | 1566 | 1440 | 2.2e-147 |

| Protein name | Locus Name | Acc# |
|---|---|---|
| sodium/proline symporter opuE:proline transporter opuE | pir:H69670 | H69670 |

Description

| ORF Name | NTID | AAID | NT Length | AA Length | Score | Probability |
|---|---|---|---|---|---|---|
| 24228400_cl_20 | 274 | 2194 | 479 | 1440 | 1110 | 2.1e-112 |

| Protein name | Locus Name | Acc# |
|---|---|---|
| | sp:HEMN_ECOLI | |

Description (COPROPORPHYRINOGENASE) (COPROGEN OXIDASE)

| ORF Name | NTID | AAID | NT Length | AA Length | Score | Probability |
|---|---|---|---|---|---|---|
| 29328457_cl_14 | 275 | 2195 | 98 | 297 | 95 | 7.5e-05 |

| Protein name | Locus Name | Acc# |
|---|---|---|
| | sp:MINE_ECOLI | P18198 |

Description

CELL DIVISION TOPOLOGICAL SPECIFICITY FACTOR

| ORF Name | NTID | AAID | NT Length | AA Length | Score | Probability |
|---|---|---|---|---|---|---|
| 4880303_c1_19 | 276 | 2196 | 193 | 582 | 514 | 3.0e-49 |

| Protein name | | | | Locus Name | | Acc# |
|---|---|---|---|---|---|---|
| | | | | sp:PTH_HAEIN | | P44682 |

Description

PEPTIDYL-TRNA HYDROLASE, (PTH)

| ORF Name | NTID | AAID | NT Length | AA Length | Score | Probability |
|---|---|---|---|---|---|---|
| 6835875_f2_4 | 277 | 2197 | 60 | 183 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 900011_c3_28 | 278 | 2198 | 234 | 705 | 269 | 2.7e-23 |

| Protein name | | | | Locus Name | | Acc# |
|---|---|---|---|---|---|---|
| probable ribosomal protein L25 | | | | pir:H71665 | | H71665 |

Description

| ORF Name | NTID | AAID | NT Length | AA Length | Score | Probability |
|---|---|---|---|---|---|---|
| 9869006_f1_2 | 279 | 2199 | 72 | 219 | 271 | 1.7e-23 |

| Protein name | | | | Locus Name | | Acc# |
|---|---|---|---|---|---|---|
| 30S subunit ribosomal protein S21 | | | | gp:AF014397 | | AF014397 |

Description

Pseudomonas putida macromolecular synthesis operon: 30S subunit ribosomal protein S21 (rpsU), DNA primase (dnaG), and sigma-70(rpoD) genes, complete cds.

| ORF Name | NTID | AAID | NT Length | AA Length | Score | Probability |
|---|---|---|---|---|---|---|
| 11885875_c3_76 | 280 | 2200 | 455 | 1368 | 1218 | 7.5e-124 |

| Protein name | | | | Locus Name | | Acc# |
|---|---|---|---|---|---|---|
| | | | | sp:Y164_HAEIN | | |

Description

HYPOTHETICAL PROTEIN HI0164/165

| ORF Name | NTID | AAID | NT Length | AA Length | Score | Probability |
|---|---|---|---|---|---|---|
| 12687781_c3_70 | 281 | 2201 | 174 | 525 | 512 | 4.9e-49 |

| Protein name | Locus Name | Acc# |
|---|---|---|
| | sp:IF3_HAEIN | P43814 |

Description

TRANSLATION INITIATION FACTOR IF-3

| ORF Name | NTID | AAID | NT Length | AA Length | Score | Probability |
|---|---|---|---|---|---|---|
| 14093967_c1_49 | 282 | 2202 | 211 | 636 | 741 | 2.6e-73 |

| Protein name | Locus Name | Acc# |
|---|---|---|
| NqrE | gp:AF165980 | AF165980 |

Description

Vibrio harveyi Na+-translocating NADH-quinone oxidoreductase complex operon, complete sequence.

| ORF Name | NTID | AAID | NT Length | AA Length | Score | Probability |
|---|---|---|---|---|---|---|
| 14540908_c3_77 | 283 | 2203 | 270 | 813 | 474 | 5.2e-45 |

| Protein name | Locus Name | Acc# |
|---|---|---|
| NqrC | gp:AF117331 | AF117331 |

Description

Vibrio cholerae N16961 Na+-translocating NADH-ubiquinone oxidoreductase enzyme complex, complete sequence.

| ORF Name | NTID | AAID | NT Length | AA Length | Score | Probability |
|---|---|---|---|---|---|---|
| 15865712_f2_21 | 284 | 2204 | 189 | 570 | 162 | 6.0e-12 |

| Protein name | Locus Name | Acc# |
|---|---|---|
| | gp:ECOUW93 | U14003 |

Description

Escherichia coli K-12 chromosomal region from 92.8 to 00.1 minutes.

| ORF Name | NTID | AAID | NT Length | AA Length | Score | Probability |
|---|---|---|---|---|---|---|
| 16460432_c2_65 | 285 | 2205 | 78 | 237 | | |

Protein name | Locus Name | Acc#

Description

NO-HIT

| ORF Name | NTID | AAID | NT Length | AA Length | Score | Probability |
|---|---|---|---|---|---|---|
| 22038177_f3_27 | 286 | 2206 | 557 | 1674 | 1801 | 1.2e-185 |

Protein name: putative efflux pump component MtrF
Locus Name: gp:AF176821
Acc#: AF176821

Description

Neisseria gonorrhoeae strain EU75 putative efflux pump componentMtrF (mtrF) gene, complete cds.

| ORF Name | NTID | AAID | NT Length | AA Length | Score | Probability |
|---|---|---|---|---|---|---|
| 24423260_c1_42 | 287 | 2207 | 437 | 1314 | 121 | 2.5e-05 |

Protein name: pr2
Locus Name: gp:MHU19289
Acc#: U19289

Description

Mycoplasma hyopneumoniae J ATCC 27219 multidrug resistance proteinhomologs pr1 and pr2 genes, complete cds, and 23S rRNA gene, partial sequence.

| ORF Name | NTID | AAID | NT Length | AA Length | Score | Probability |
|---|---|---|---|---|---|---|
| 25392778_f1_1 | 288 | 2208 | 201 | 606 | 387 | 8.6e-36 |

Protein name: 4-hydroxyphenylacetate 3-monooxygenase (EC
Locus Name: gp:D90737
Acc#:

Description

Escherichia coli genomic DNA. (22.8 - 23.1 min).

| ORF Name | NTID | AAID | NT Length | AA Length | Score | Probability |
|---|---|---|---|---|---|---|
| 31268837_f3_28 | 289 | 2209 | 412 | 1239 | 1836 | 2.4e-189 |

| Protein name | | | | Locus Name | | Acc# |
|---|---|---|---|---|---|---|
| | | | | sp:CATA_HAEIN | | P44390 |

Description

CATALASE,

| ORF Name | NTID | AAID | NT Length | AA Length | Score | Probability |
|---|---|---|---|---|---|---|
| 33223291_f2_19 | 290 | 2210 | 71 | 216 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 33235937_c2_59 | 291 | 2211 | 782 | 2349 | 1415 | 1.0e-144 |

| Protein name | | | | Locus Name | | Acc# |
|---|---|---|---|---|---|---|
| | | | | sp:VACB_ECOLI | | |

Description

VACB PROTEIN

| ORF Name | NTID | AAID | NT Length | AA Length | Score | Probability |
|---|---|---|---|---|---|---|
| 33867132_f1_12 | 292 | 2212 | 225 | 678 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 3399183_c2_61 | 293 | 2213 | 415 | 1248 | 1268 | 3.8e-129 |

| Protein name | | | | Locus Name | | Acc# |
|---|---|---|---|---|---|---|
| NqrB | | | | gp:AF117331 | | AF117331 |

Description

Vibrio cholerae N16961 Na+-translocating NADH-ubiquinoneoxidoreductase enzyme complex, complete sequence.

| ORF_Name | NTID | AAID | NT Length | AA Length | Score | Probability |
|---|---|---|---|---|---|---|
| 34000785_c3_73 | 294 | 2214 | 61 | 186 | | |

| Protein name | | | | | Locus Name | Acc# |
|---|---|---|---|---|---|---|
| | | | | | | |

Description

NO-HIT

| ORF_Name | NTID | AAID | NT Length | AA Length | Score | Probability |
|---|---|---|---|---|---|---|
| 34196052_c2_63 | 295 | 2215 | 416 | 1251 | 1650 | 1.2e-169 |

| Protein name | | | | | Locus Name | Acc# |
|---|---|---|---|---|---|---|
| NqrF | | | | | gp:AF117331 | AF117331 |

Description

Vibrio cholerae N16961 Na+-translocating NADH-ubiquinoneoxidoreductase enzyme complex, complete sequence.

| ORF_Name | NTID | AAID | NT Length | AA Length | Score | Probability |
|---|---|---|---|---|---|---|
| 3939043_c2_58 | 296 | 2216 | 642 | 1929 | 2200 | 6.5e-228 |

| Protein name | | | | | Locus Name | Acc# |
|---|---|---|---|---|---|---|
| | | | | | sp:SYT_HAEIN | P43014 |

Description (THRRS)

| ORF_Name | NTID | AAID | NT Length | AA Length | Score | Probability |
|---|---|---|---|---|---|---|
| 4720967_c2_62 | 297 | 2217 | 227 | 684 | 679 | 9.8e-67 |

| Protein name | | | | | Locus Name | Acc# |
|---|---|---|---|---|---|---|
| | | | | | sp:Y168_HAEIN | |

Description

HYPOTHETICAL PROTEIN HI0168/169

| ORF_Name | NTID | AAID | NT Length | AA Length | Score | Probability |
|---|---|---|---|---|---|---|
| 473137_c1_41 | 298 | 2218 | 76 | 231 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4801625_f2_20 | 299 | 2219 | 252 | 759 | 622 | 1.1e-60 |

Protein name | | | | Locus Name | | Acc#
| | | | | sp:HIS4_RHOSH | | P50936

Description

ISOMERASE,

| ORF Name | NTID | AAID | NT Length | AA Length | Score | Probability |
|---|---|---|---|---|---|---|
| 5882211_f2_14 | 300 | 2220 | 118 | 357 | 153 | 2.7e-10 |

Protein name | | | | Locus Name | | Acc#
hypothetical protein 1 | | | | pir:S47051 | | S47051

Description

| ORF Name | NTID | AAID | NT Length | AA Length | Score | Probability |
|---|---|---|---|---|---|---|
| 682641_c2_55 | 301 | 2221 | 86 | 261 | 100 | 2.2e-05 |

Protein name | | | | Locus Name | | Acc#
hypothetical protein PH0217 | | | | pir:G71244 | | G71244

Description

| ORF Name | NTID | AAID | NT Length | AA Length | Score | Probability |
|---|---|---|---|---|---|---|
| 14103377_f2_9 | 302 | 2222 | 166 | 501 | 434 | 9.0e-41 |

Protein name | | | | Locus Name | | Acc#
| | | | | sp:MTGA_ACICA | | O24849

Description (EC 2.4.2.-) (MONOFUNCTIONAL TGASE)

| ORF Name | NTID | AAID | NT Length | AA Length | Score | Probability |
|---|---|---|---|---|---|---|
| 16973437_c3_30 | 303 | 2223 | 79 | 240 | | |

Protein name | | | | Locus Name | | Acc#

Description

NO-HIT

| ORF Name | NTID | AAID | NT Length | AA Length | Score | Probability |
|---|---|---|---|---|---|---|
| 19745308_f1_3 | 304 | 2224 | 66 | 201 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24261257_f3_14 | 305 | 2225 | 123 | 372 | 140 | 8.0e-09 |

| Protein name | | | | | Locus Name | Acc# |
|---|---|---|---|---|---|---|
| | | | | | sp:PNCB_SALTY | P22253 |

Description

NICOTINATE PHOSPHORIBOSYLTRANSFERASE, (NAPRTASE)

| ORF Name | NTID | AAID | NT Length | AA Length | Score | Probability |
|---|---|---|---|---|---|---|
| 25600925_f1_2 | 306 | 2226 | 91 | 276 | 98 | 9.9e-05 |

| Protein name | | | | | Locus Name | Acc# |
|---|---|---|---|---|---|---|
| | | | | | sp:MTGA_ACICA | O24849 |

Description (EC 2.4.2.-) (MONOFUNCTIONAL TGASE)

| ORF Name | NTID | AAID | NT Length | AA Length | Score | Probability |
|---|---|---|---|---|---|---|
| 30659433_c2_21 | 307 | 2227 | 68 | 207 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 3303178_f1_1 | 308 | 2228 | 179 | 540 | 430 | 2.4e-40 |

| Protein name | | | | | Locus Name | Acc# |
|---|---|---|---|---|---|---|
| solanesyl diphosphate synthase | | | | | gp:AB001997 | AB001997 |

Description

Rhodobacter capsulatus DNA for solanesyl diphosphate synthase, complete cds.

| ORF Name | NTID | AAID | NT Length | AA Length | Score | Probability |
|---|---|---|---|---|---|---|
| 35182887_c2_23 | 309 | 2229 | 191 | 576 | 684 | 2.9e-67 |

Protein name | Locus Name | Acc#
sp:IPYR_HAEIN | P44529

Description

PHOSPHO-HYDROLASE) (PPASE)

| ORF Name | NTID | AAID | NT Length | AA Length | Score | Probability |
|---|---|---|---|---|---|---|
| 36126655_f1_4 | 310 | 2230 | 374 | 1125 | 1283 | 9.7e-131 |

Protein name | Locus Name | Acc#
sp:AROC_HAEIN | P43875

Description

PHOSPHOLYASE)

| ORF Name | NTID | AAID | NT Length | AA Length | Score | Probability |
|---|---|---|---|---|---|---|
| 6834702_f2_11 | 311 | 2231 | 162 | 489 | 371 | 4.3e-34 |

Protein name | Locus Name | Acc#
sp:YCHJ_HAEIN | P44609

Description

HYPOTHETICAL PROTEIN HI0277

| ORF Name | NTID | AAID | NT Length | AA Length | Score | Probability |
|---|---|---|---|---|---|---|
| 882636_c1_15 | 312 | 2232 | 258 | 777 | 417 | 5.7e-39 |

Protein name | Locus Name | Acc#
lipoate biosynthesis protein B | gp:AF147448 | AF147448

Description

Pseudomonas aeruginosa strain PAO1 penicillin-binding protein 2(pbpA), rod-shape-determining protein (rodA), membrane-bound lytictransglycosylase (mltB), rare lipoprotein A (rlpA),penicillin-binding protein 5 (dacA), and lipoate biosynthesisprotein B (lipB) genes, complete cds; and unknown gene.

| ORF Name | NTID | AAID | NT Length | AA Length | Score | Probability |
|---|---|---|---|---|---|---|
| 973756_c3_34 | 313 | 2233 | 138 | 417 | | |

Protein name | Locus Name | Acc#

Description

NO-HIT

| ORF Name | NTID | AAID | NT Length | AA Length | Score | Probability |
|---|---|---|---|---|---|---|
| 975055_f2_10 | 314 | 2234 | 745 | 2238 | 2349 | 1.1e-243 |

Protein name: polyphosphate kinase | Locus Name: gp:ACRBDOXN | Acc# Z46863

Description

Acinetobacter sp. cysD, cobQ, sodM, lysS, rubA, rubB, estB, oxyR, ppk, mtgA, ORF2 and ORF3 genes.

| ORF Name | NTID | AAID | NT Length | AA Length | Score | Probability |
|---|---|---|---|---|---|---|
| 10673587_f1_4 | 315 | 2235 | 402 | 1209 | 1210 | 5.3e-123 |

Protein name | Locus Name: sp:TYRB_ECOLI | Acc# P04693

Description

AROMATIC-AMINO-ACID AMINOTRANSFERASE, (AROAT) (ARAT)

| ORF Name | NTID | AAID | NT Length | AA Length | Score | Probability |
|---|---|---|---|---|---|---|
| 14572162_f1_1 | 316 | 2236 | 260 | 783 | 586 | 7.0e-57 |

Protein name | Locus Name: sp:YCIK_ECOLI | Acc#

Description (EC 1.-.-.-)

| ORF Name | NTID | AAID | NT Length | AA Length | Score | Probability |
|---|---|---|---|---|---|---|
| 20126386_f2_8 | 317 | 2237 | 198 | 597 | 325 | 3.2e-29 |

Protein name | Locus Name: sp:YTFL_ECOLI | Acc# P39319

Description

HYPOTHETICAL 49.8 KD PROTEIN IN CYSQ-MSRA INTERGENIC REGION

| ORF Name | NTID | AAID | NT Length | AA Length | Score | Probability |
|---|---|---|---|---|---|---|
| 2609375_c2_26 | 318 | 2238 | 92 | 279 | | |

Protein name | Locus Name | Acc#

Description

NO-HIT

| ORF Name | NTID | AAID | NT Length | AA Length | Score | Probability |
|---|---|---|---|---|---|---|
| 26808317_f2_6 | 319 | 2239 | 232 | 699 | 576 | 8.1e-56 |

Protein name | Locus Name | Acc#
| | sp:UBIG_ECOLI | |

Description

METHYLTRANSFERASE)

| ORF Name | NTID | AAID | NT Length | AA Length | Score | Probability |
|---|---|---|---|---|---|---|
| 34394050_f3_15 | 320 | 2240 | 308 | 927 | 889 | 5.5e-89 |

Protein name | Locus Name | Acc#
| | sp:YTFL_ECOLI | P39319 |

Description

HYPOTHETICAL 49.8 KD PROTEIN IN CYSQ-MSRA INTERGENIC REGION

| ORF Name | NTID | AAID | NT Length | AA Length | Score | Probability |
|---|---|---|---|---|---|---|
| 3911568_f2_7 | 321 | 2241 | 233 | 702 | 267 | 4.5e-23 |

Protein name | Locus Name | Acc#
| | sp:GPHC_ALCEU | P40852 |

Description

PHOSPHOGLYCOLATE PHOSPHATASE, CHROMOSOMAL, (PGP)

| ORF Name | NTID | AAID | NT Length | AA Length | Score | Probability |
|---|---|---|---|---|---|---|
| 4117193_c2_25 | 322 | 2242 | 506 | 1521 | 963 | 7.9e-97 |

Protein name | Locus Name | Acc#
leucine aminopeptidase | gp:PPU010261 | AJ010261

Description

Pseudomonas putida pepA gene.

146

| ORF_Name | NTID | AAID | NT Length | AA Length | Score | Probability |
|---|---|---|---|---|---|---|
| 4144818_f3_16 | 323 | 2243 | 362 | 1089 | 766 | 5.9e-76 |

Protein name: probable ionictransporter
Locus Name: pir:F70819
Acc#: F70819

Description

| ORF_Name | NTID | AAID | NT Length | AA Length | Score | Probability |
|---|---|---|---|---|---|---|
| 4976550_f1_3 | 324 | 2244 | 312 | 939 | 399 | 4.6e-37 |

Protein name:
Locus Name: sp:YBHD_ECOLI
Acc#:

Description: HYPOTHETICAL TRANSCRIPTIONAL REGULATOR IN MODC-BIOA INTERGENIC REGION

| ORF_Name | NTID | AAID | NT Length | AA Length | Score | Probability |
|---|---|---|---|---|---|---|
| 1441017_c1_38 | 325 | 2245 | 98 | 297 | 124 | 1.2e-07 |

Protein name: opacity protein opa51
Locus Name: pir:S36329
Acc#:

Description

| ORF_Name | NTID | AAID | NT Length | AA Length | Score | Probability |
|---|---|---|---|---|---|---|
| 14462827_c3_53 | 326 | 2246 | 89 | 270 | 292 | 1.0e-25 |

Protein name: ribosomal protein S15
Locus Name: pir:S38882
Acc#: S38882

Description

| ORF_Name | NTID | AAID | NT Length | AA Length | Score | Probability |
|---|---|---|---|---|---|---|
| 14494026_c2_50 | 327 | 2247 | 219 | 660 | 500 | 9.1e-48 |

Protein name:
Locus Name: sp:HIS1_BACSU
Acc#: O34520

Description: ATP PHOSPHORIBOSYLTRANSFERASE,

| ORF_Name | NTID | AAID | NT Length | AA Length | Score | Probability |
|---|---|---|---|---|---|---|
| 14509682_c2_45 | 328 | 2248 | 165 | 498 | 230 | 3.7e-19 |

Protein name

Locus Name: gp:VCU39068  Acc#: U39068

Description

Vibrio cholerae pathogenicity island, partial and complete cds.

| ORF_Name | NTID | AAID | NT Length | AA Length | Score | Probability |
|---|---|---|---|---|---|---|
| 157765_c2_48 | 329 | 2249 | 96 | 291 | 182 | 4.5e-14 |

Protein name

Locus Name: sp:YRPM_ACICA  Acc#: P33989

Description

HYPOTHETICAL 9.2 KD PROTEIN IN RPON-MURA INTERGENIC REGION (ORF3)

| ORF_Name | NTID | AAID | NT Length | AA Length | Score | Probability |
|---|---|---|---|---|---|---|
| 16510933_c2_52 | 330 | 2250 | 525 | 1578 | 545 | 1.6e-52 |

Protein name

Locus Name: sp:FUMB_ECOLI  Acc#:

Description

FUMARATE HYDRATASE CLASS I, ANAEROBIC, (FUMARASE)

| ORF_Name | NTID | AAID | NT Length | AA Length | Score | Probability |
|---|---|---|---|---|---|---|
| 23445931_c2_51 | 331 | 2251 | 454 | 1365 | 942 | 1.3e-94 |

Protein name: histidinol dehydrogenase

Locus Name: pir:E70368  Acc#: E70368

Description

| ORF_Name | NTID | AAID | NT Length | AA Length | Score | Probability |
|---|---|---|---|---|---|---|
| 23650253_c2_49 | 332 | 2252 | 421 | 1266 | 1337 | 1.8e-136 |

Protein name

Locus Name: sp:MURA_ACICA  Acc#: P33986

Description

TRANSFERASE) (EPT)

| ORF Name | NTID | AAID | NT Length | AA Length | Score | Probability |
|---|---|---|---|---|---|---|
| 2381950_c3_58 | 333 | 2253 | 61 | 186 | | |

Protein name | Locus Name | Acc#

Description

NO-HIT

| ORF Name | NTID | AAID | NT Length | AA Length | Score | Probability |
|---|---|---|---|---|---|---|
| 23867127_c1_41 | 334 | 2254 | 275 | 828 | 147 | 5.2e-10 |

Protein name | Locus Name: sp:YRAP_ECOLI | Acc# P45467

Description (O191)

| ORF Name | NTID | AAID | NT Length | AA Length | Score | Probability |
|---|---|---|---|---|---|---|
| 24395637_c1_40 | 335 | 2255 | 149 | 450 | 143 | 6.2e-10 |

Protein name | Locus Name: sp:YRAN_ECOLI | Acc# P45465

Description

HYPOTHETICAL 14.8 KD PROTEIN IN AGAI-MTR INTERGENIC REGION (O131)

| ORF Name | NTID | AAID | NT Length | AA Length | Score | Probability |
|---|---|---|---|---|---|---|
| 34010260_f1_1 | 336 | 2256 | 119 | 360 | 204 | 2.1e-16 |

Protein name: general stress protein homolog ykzA | Locus Name: pir:F69870 | Acc# F69870

Description

| ORF Name | NTID | AAID | NT Length | AA Length | Score | Probability |
|---|---|---|---|---|---|---|
| 5079188_f3_35 | 337 | 2257 | 163 | 492 | 461 | 1.2e-43 |

Protein name: hypothetical protein | Locus Name: gp:ASA224767 | Acc# AJ224767

Description

Acinetobacter sp. ADP1 lon gene and ORFs.

| ORF Name | NTID | AAID | NT Length | AA Length | Score | Probability |
|---|---|---|---|---|---|---|
| 5330087_c3_61 | 338 | 2258 | 370 | 1113 | 922 | 1.7e-92 |

Protein name:

Locus Name: sp:HIS8_ACEXY

Acc#: P45358

Description: PHOSPHATE TRANSAMINASE)

| ORF Name | NTID | AAID | NT Length | AA Length | Score | Probability |
|---|---|---|---|---|---|---|
| 954837_c2_44 | 339 | 2259 | 699 | 2100 | 2198 | 1.1e-227 |

Protein name: polyribonucleotide nucleotidyltransferase

Locus Name: gp:PPY18132

Acc#: Y18132

Description: Pseudomonas putida rps0 and pnp genes.

| ORF Name | NTID | AAID | NT Length | AA Length | Score | Probability |
|---|---|---|---|---|---|---|
| 969392_f1_13 | 340 | 2260 | 73 | 222 | | |

Protein name:

Locus Name:

Acc#:

Description: NO-HIT

| ORF Name | NTID | AAID | NT Length | AA Length | Score | Probability |
|---|---|---|---|---|---|---|
| 1070165_c3_42 | 341 | 2261 | 72 | 219 | | |

Protein name:

Locus Name:

Acc#:

Description: NO-HIT

| ORF Name | NTID | AAID | NT Length | AA Length | Score | Probability |
|---|---|---|---|---|---|---|
| 10993750_f1_2 | 342 | 2262 | 137 | 414 | | |

Protein name:

Locus Name:

Acc#:

Description: NO-HIT

| ORF Name | NTID | AAID | NT Length | AA Length | Score | Probability |
|---|---|---|---|---|---|---|
| 20884677_c3_43 | 343 | 2263 | 560 | 1683 | 1389 | 5.7e-142 |

Protein name: probable acyl-CoA dehydrogenase
Locus Name: pir:B75282
Acc#: B75282

Description

| ORF Name | NTID | AAID | NT Length | AA Length | Score | Probability |
|---|---|---|---|---|---|---|
| 24395191_c1_31 | 344 | 2264 | 97 | 294 | 71 | 0.011 |

Protein name: conserved hypothetical protein aq_1236
Locus Name: pir:F70406
Acc#: F70406

Description

| ORF Name | NTID | AAID | NT Length | AA Length | Score | Probability |
|---|---|---|---|---|---|---|
| 33804680_c2_35 | 345 | 2265 | 796 | 2391 | 709 | 4.4e-72 |

Protein name: site-specific recombinase
Locus Name: gp:NGU82253
Acc#: U82253

Description: Neisseria gonorrhoeae site-specific recombinase (gcr) gene, complete cds.

| ORF Name | NTID | AAID | NT Length | AA Length | Score | Probability |
|---|---|---|---|---|---|---|
| 34085165_f3_20 | 346 | 2266 | 496 | 1491 | 1327 | 2.1e-135 |

Protein name
Locus Name: sp:RPSD_PSEAE
Acc#: P26480

Description: RNA POLYMERASE SIGMA FACTOR RPOD (SIGMA-70)

| ORF Name | NTID | AAID | NT Length | AA Length | Score | Probability |
|---|---|---|---|---|---|---|
| 35823506_c2_32 | 347 | 2267 | 514 | 1545 | 1343 | 4.3e-137 |

Protein name: Butyryl-CoA:Acetate Coenzyme A transferase
Locus Name: gp:CTACTAGEN
Acc#: Z69031

Description: C.thermosaccharolyticum actA gene.

| ORF_Name | NTID | AAID | NT Length | AA Length | Score | Probability |
|---|---|---|---|---|---|---|
| 35939753_c2_34 | 348 | 2268 | 73 | 222 | 106 | 7.2e-05 |

| Protein name | Locus Name | Acc# |
|---|---|---|
| probable acyl-CoA dehydrogenase | pir:B75282 | B75282 |

Description

| ORF_Name | NTID | AAID | NT Length | AA Length | Score | Probability |
|---|---|---|---|---|---|---|
| 3917193_c2_33 | 349 | 2269 | 95 | 288 | 147 | 2.9e-09 |

| Protein name | Locus Name | Acc# |
|---|---|---|
| probable acyl-CoA dehydrogenase | pir:B75282 | B75282 |

Description

| ORF_Name | NTID | AAID | NT Length | AA Length | Score | Probability |
|---|---|---|---|---|---|---|
| 3954817_c1_27 | 350 | 2270 | 159 | 480 | 386 | 2.9e-35 |

| Protein name | Locus Name | Acc# |
|---|---|---|
| probable acyl-CoA dehydrogenase | pir:B75282 | B75282 |

Description

| ORF_Name | NTID | AAID | NT Length | AA Length | Score | Probability |
|---|---|---|---|---|---|---|
| 5167157_c2_39 | 351 | 2271 | 161 | 486 | 104 | 8.4e-06 |

| Protein name | Locus Name | Acc# |
|---|---|---|
| hypothetical protein PH1801 | pir:A71191 | A71191 |

Description

| ORF_Name | NTID | AAID | NT Length | AA Length | Score | Probability |
|---|---|---|---|---|---|---|
| 9923125_c2_40 | 352 | 2272 | 73 | 222 | | |

| Protein name | Locus Name | Acc# |
|---|---|---|
| | | |

Description

NO-HIT

| ORF_Name | NTID | AAID | NT Length | AA Length | Score | Probability |
|---|---|---|---|---|---|---|
| 10355437_f2_5 | 353 | 2273 | 147 | 444 | 159 | 2.0e-11 |

Protein name | | | | Locus Name | | Acc# |
| | | | | sp:THID_HAEIN | | P44697 |

Description (HMP-P KINASE)

| ORF_Name | NTID | AAID | NT Length | AA Length | Score | Probability |
|---|---|---|---|---|---|---|
| 23912827_c3_10 | 354 | 2274 | 79 | 240 | | |

Protein name | | | | Locus Name | | Acc# |

Description

NO-HIT

| ORF_Name | NTID | AAID | NT Length | AA Length | Score | Probability |
|---|---|---|---|---|---|---|
| 35267912_c3_11 | 355 | 2275 | 306 | 921 | 483 | 5.8e-46 |

Protein name | | | | Locus Name | | Acc# |
| | | | | sp:PROC_HAEIN | | P43869 |

Description

PYRROLINE-5-CARBOXYLATE REDUCTASE, (P5CR) (P5C REDUCTASE)

| ORF_Name | NTID | AAID | NT Length | AA Length | Score | Probability |
|---|---|---|---|---|---|---|
| 4062840_c2_9 | 356 | 2276 | 191 | 576 | 206 | 1.3e-16 |

Protein name | | | | Locus Name | | Acc# |
| | | | | sp:YGGT_HAEIN | | P44097 |

Description

HYPOTHETICAL PROTEIN HI1036

| ORF_Name | NTID | AAID | NT Length | AA Length | Score | Probability |
|---|---|---|---|---|---|---|
| 10164063_c2_87 | 357 | 2277 | 242 | 729 | 425 | 8.1e-40 |

Protein name | | | | Locus Name | | Acc# |
| | | | | sp:YAEB_ECOLI | | P28634 |

Description

HYPOTHETICAL 26.4 KD PROTEIN IN PROS-RCSF INTERGENIC REGION (ORF3)

| ORF Name | NTID | AAID | NT Length | AA Length | Score | Probability |
|---|---|---|---|---|---|---|
| 14568812_c3_97 | 358 | 2278 | 426 | 1281 | 287 | 5.5e-37 |

| Protein name | Locus Name | Acc# |
|---|---|---|
| probable lipD protein | pir:G70634 | G70634 |

Description

---

| ORF Name | NTID | AAID | NT Length | AA Length | Score | Probability |
|---|---|---|---|---|---|---|
| 14901512_c3_103 | 359 | 2279 | 156 | 471 | 210 | 4.9e-17 |

| Protein name | Locus Name | Acc# |
|---|---|---|
| | sp:HIT_BACSU | O07513 |

Description

HIT PROTEIN

---

| ORF Name | NTID | AAID | NT Length | AA Length | Score | Probability |
|---|---|---|---|---|---|---|
| 164813_f3_52 | 360 | 2280 | 431 | 1296 | 1416 | 7.8e-145 |

| Protein name | Locus Name | Acc# |
|---|---|---|
| | gp:AB025342 | AB025342 |

Description

Moritella marina genes, complete cds, similar to eicosapentaenoicacid synthesis gene cluster.

---

| ORF Name | NTID | AAID | NT Length | AA Length | Score | Probability |
|---|---|---|---|---|---|---|
| 17068763_f1_16 | 361 | 2281 | 337 | 1014 | 1048 | 7.8e-106 |

| Protein name | Locus Name | Acc# |
|---|---|---|
| | sp:HEM2_PSEAE | Q59643 |

Description

SYNTHASE) (ALAD) (ALADH)

---

| ORF Name | NTID | AAID | NT Length | AA Length | Score | Probability |
|---|---|---|---|---|---|---|
| 23444400_c3_92 | 362 | 2282 | 336 | 1011 | 1151 | 9.4e-117 |

| Protein name | Locus Name | Acc# |
|---|---|---|
| | sp:RUVB_ECOLI | P08577 |

Description

HOLLIDAY JUNCTION DNA HELICASE RUVB

| ORF_Name | NTID | AAID | NT Length | AA Length | Score | Probability |
|---|---|---|---|---|---|---|
| 23526552_c2_83 | 363 | 2283 | 422 | 1269 | 316 | 2.9e-28 |

| Protein name | | Locus Name | Acc# |
|---|---|---|---|
| conserved hypothetical protein yueF | | pir:G70007 | G70007 |

Description

| ORF_Name | NTID | AAID | NT Length | AA Length | Score | Probability |
|---|---|---|---|---|---|---|
| 23595281_f1_17 | 364 | 2284 | 783 | 2352 | 2265 | 8.4e-235 |

| Protein name | | Locus Name | Acc# |
|---|---|---|---|
| hypothetical protein b2463 | | pir:F65021 | F65021 |

Description

| ORF_Name | NTID | AAID | NT Length | AA Length | Score | Probability |
|---|---|---|---|---|---|---|
| 23828428_f3_57 | 365 | 2285 | 272 | 819 | 250 | 1.6e-40 |

| Protein name | | Locus Name | Acc# |
|---|---|---|---|
| aldoketoreductase | | gp:AF001865 | AF001865 |

Description

Leishmania mexicana amazonensis aldoketoreductase (PTR-1) gene, complete cds.

| ORF_Name | NTID | AAID | NT Length | AA Length | Score | Probability |
|---|---|---|---|---|---|---|
| 24250012_c1_66 | 366 | 2286 | 576 | 1731 | 1104 | 9.0e-112 |

| Protein name | | Locus Name | Acc# |
|---|---|---|---|
| glycine betaine transporter BetL | | gp:AF102174 | AF102174 |

Description

Listeria monocytogenes glycine betaine transporter BetL (betL) gene, complete cds.

| ORF_Name | NTID | AAID | NT Length | AA Length | Score | Probability |
|---|---|---|---|---|---|---|
| 24313512_f2_37 | 367 | 2287 | 121 | 366 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 24317157_f3_55 | 368 | 2288 | 179 | 540 | | |

Protein name | Locus Name | Acc#

Description

NO-HIT

| ORF Name | NTID | AAID | NT Length | AA Length | Score | Probability |
|---|---|---|---|---|---|---|
| 2517175_f1_18 | 369 | 2289 | 78 | 237 | | |

Protein name | Locus Name | Acc#

Description

NO-HIT

| ORF Name | NTID | AAID | NT Length | AA Length | Score | Probability |
|---|---|---|---|---|---|---|
| 29376681_f1_1 | 370 | 2290 | 84 | 255 | | |

Protein name | Locus Name | Acc#

Description

NO-HIT

| ORF Name | NTID | AAID | NT Length | AA Length | Score | Probability |
|---|---|---|---|---|---|---|
| 30360452_f1_6 | 371 | 2291 | 80 | 243 | | |

Protein name | Locus Name | Acc#

Description

NO-HIT

| ORF Name | NTID | AAID | NT Length | AA Length | Score | Probability |
|---|---|---|---|---|---|---|
| 30662517_c3_106 | 372 | 2292 | 479 | 1440 | 514 | 3.0e-49 |

Protein name | Locus Name | Acc#
| | sp:ACRE_ECOLI | P24180

Description

ACRIFLAVIN RESISTANCE PROTEIN E PRECURSOR (ENVC PROTEIN)

| ORF Name | NTID | AAID | NT Length | AA Length | Score | Probability |
|---|---|---|---|---|---|---|
| 31423292_c2_80 | 373 | 2293 | 308 | 927 | 327 | 2.0e-29 |

| Protein name | | | | Locus Name | | Acc# |
|---|---|---|---|---|---|---|
| hypothetical protein Rv0241c | | | | pir:E70938 | | E70938 |

Description

| ORF Name | NTID | AAID | NT Length | AA Length | Score | Probability |
|---|---|---|---|---|---|---|
| 31466_f3_54 | 374 | 2294 | 71 | 216 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 34110436_f2_30 | 375 | 2295 | 116 | 351 | 83 | 0.030 |

| Protein name | | | | Locus Name | | Acc# |
|---|---|---|---|---|---|---|
| microfilarial sheath protein SHP3 | | | | gp:LSU54556 | | U54556 |

Description

Litomosoides sigmodontis microfilarial sheath protein SHP3a (shp3a) and microfilarial sheath protein SHP3 (shp3) genes, complete cds.

| ORF Name | NTID | AAID | NT Length | AA Length | Score | Probability |
|---|---|---|---|---|---|---|
| 4147193_f2_29 | 376 | 2296 | 635 | 1908 | 1651 | 3.4e-242 |

| Protein name | | | | Locus Name | | Acc# |
|---|---|---|---|---|---|---|
| dihydroxy-acid dehydratase, | | | | pir:DWECDA | | |

Description

| ORF Name | NTID | AAID | NT Length | AA Length | Score | Probability |
|---|---|---|---|---|---|---|
| 4350088_c3_96 | 377 | 2297 | 458 | 1377 | 863 | 3.1e-86 |

| Protein name | | | | Locus Name | | Acc# |
|---|---|---|---|---|---|---|
| | | | | gp:MLCB1883 | | AL022486 |

Description

Mycobacterium leprae cosmid B1883.

| ORF Name | NTID | AAID | NT Length | AA Length | Score | Probability |
|---|---|---|---|---|---|---|
| 4381318_f3_56 | 378 | 2298 | 250 | 753 | 585 | 9.0e-57 |

| Protein name | | | | | Locus Name | Acc# |
|---|---|---|---|---|---|---|
| | | | | | sp:CCA_ECOLI | P06961 |

Description (TRNA CCA-PYROPHOSPHORYLASE) (CCA-ADDING ENZYME)

| ORF Name | NTID | AAID | NT Length | AA Length | Score | Probability |
|---|---|---|---|---|---|---|
| 4712537_c1_60 | 379 | 2299 | 117 | 354 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 4769050_c2_79 | 380 | 2300 | 99 | 300 | 117 | 3.5e-07 |

| Protein name | | | | | Locus Name | Acc# |
|---|---|---|---|---|---|---|
| hypothetical protein APE0395 | | | | | pir:B72732 | B72732 |

Description

| ORF Name | NTID | AAID | NT Length | AA Length | Score | Probability |
|---|---|---|---|---|---|---|
| 5266540_f1_8 | 381 | 2301 | 219 | 660 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 6250012_f1_7 | 382 | 2302 | 313 | 942 | 952 | 1.2e-95 |

| Protein name | | | | | Locus Name | Acc# |
|---|---|---|---|---|---|---|
| ferredoxin--NADP+ reductase, | | | | | pir:A57432 | |

Description

| ORF Name | NTID | AAID | NT Length | AA Length | Score | Probability |
|---|---|---|---|---|---|---|
| 6697266_c1_62 | 383 | 2303 | 78 | 237 | | |

Protein name | Locus Name | Acc#

Description

NO-HIT

| ORF Name | NTID | AAID | NT Length | AA Length | Score | Probability |
|---|---|---|---|---|---|---|
| 6817191_c2_89 | 384 | 2304 | 975 | 2925 | 2816 | 3.5e-293 |

Protein name | Locus Name | Acc#
| sp:YHIV_ECOLI | P37637

Description

HYPOTHETICAL 111.5 KD PROTEIN IN HDED-GADA INTERGENIC REGION

| ORF Name | NTID | AAID | NT Length | AA Length | Score | Probability |
|---|---|---|---|---|---|---|
| 781302_c3_98 | 385 | 2305 | 185 | 558 | 541 | 4.1e-52 |

Protein name | Locus Name | Acc#
| sp:HPRT_ECOLI | P36766

Description

HYPOXANTHINE PHOSPHORIBOSYLTRANSFERASE, (HPRT)

| ORF Name | NTID | AAID | NT Length | AA Length | Score | Probability |
|---|---|---|---|---|---|---|
| 100305_c3_168 | 386 | 2306 | 251 | 756 | 528 | 9.8e-51 |

Protein name | Locus Name | Acc#
| sp:YHHW_ECOLI | P46852

Description

HYPOTHETICAL 26.3 KD PROTEIN IN GNTR-GGT INTERGENIC REGION (F231)

| ORF Name | NTID | AAID | NT Length | AA Length | Score | Probability |
|---|---|---|---|---|---|---|
| 10604658_f2_36 | 387 | 2307 | 488 | 1467 | 705 | 1.7e-69 |

Protein name | Locus Name | Acc#
| RdxB | gp:RSU67862 | U67862

Description

Rhodobacter sphaeroides rdxB and rdxH genes, complete cds, and ccoP and rdxI genes, partial cds.

| ORF Name | NTID | AAID | NT Length | AA Length | Score | Probability |
|---|---|---|---|---|---|---|
| 12509836_f2_57 | 388 | 2308 | 137 | 414 | 178 | 1.2e-13 |

Protein name: hypothetical protein R186.1
Locus Name: pir:T24235
Acc#: T24235

Description

| ORF Name | NTID | AAID | NT Length | AA Length | Score | Probability |
|---|---|---|---|---|---|---|
| 1272201_c3_158 | 389 | 2309 | 168 | 507 | 109 | 8.2e-05 |

Protein name: hypothetical protein SPAC869.06c
Locus Name: pir:T39117
Acc#: T39117

Description

| ORF Name | NTID | AAID | NT Length | AA Length | Score | Probability |
|---|---|---|---|---|---|---|
| 13080050_f1_26 | 390 | 2310 | 66 | 201 | 74 | 0.021 |

Protein name: PilT
Locus Name: gp:STAF000001
Acc#:

Description: Salmonella typhi topoisomerase B (topB), single strand bindingprotein (ssb), Ytl2 homolog (ytl2) genes, complete cds; pil operon, complete sequence; Rci (rci) gene, complete cds.

| ORF Name | NTID | AAID | NT Length | AA Length | Score | Probability |
|---|---|---|---|---|---|---|
| 13723751_c3_176 | 391 | 2311 | 423 | 1272 | 1357 | 1.4e-138 |

Protein name: FixNd
Locus Name: gp:RLFIXND
Acc#: Z80339

Description: R.leguminosarum fixNd and fixOd genes.

| ORF Name | NTID | AAID | NT Length | AA Length | Score | Probability |
|---|---|---|---|---|---|---|
| 140_f1_11 | 392 | 2312 | 144 | 435 | | |

Protein name:
Locus Name:
Acc#:

Description

NO-HIT

| ORF Name | NTID | AAID | NT Length | AA Length | Score | Probability |
|---|---|---|---|---|---|---|
| 14650251_c1_125 | 393 | 2313 | 243 | 732 | 385 | 1.4e-35 |
| Protein name | | | | Locus Name | | Acc# |
| | | | | sp:YGBP_HAEIN | | O05029 |

Description

HYPOTHETICAL PROTEIN HI0672

| ORF Name | NTID | AAID | NT Length | AA Length | Score | Probability |
|---|---|---|---|---|---|---|
| 156261_f2_53 | 394 | 2314 | 158 | 477 | 522 | 4.3e-50 |
| Protein name | | | | Locus Name | | Acc# |
| | | | | sp:RL13_HAEIN | | P44387 |

Description

50S RIBOSOMAL PROTEIN L13

| ORF Name | NTID | AAID | NT Length | AA Length | Score | Probability |
|---|---|---|---|---|---|---|
| 15859456_f3_74 | 395 | 2315 | 96 | 291 | 105 | 6.6e-06 |
| Protein name | | | | Locus Name | | Acc# |
| hypothetical protein PH0639 | | | | pir:H71108 | | H71108 |

Description

| ORF Name | NTID | AAID | NT Length | AA Length | Score | Probability |
|---|---|---|---|---|---|---|
| 16803811_f1_13 | 396 | 2316 | 216 | 651 | 87 | 0.040 |
| Protein name | | | | Locus Name | | Acc# |
| somatostatin sst2B receptor | | | | gp:RNSST2B | | X98234 |

Description

R.norvegicus mRNA for somatostatin receptor.

| ORF Name | NTID | AAID | NT Length | AA Length | Score | Probability |
|---|---|---|---|---|---|---|
| 16853590_c3_164 | 397 | 2317 | 233 | 702 | 265 | 7.3e-23 |
| Protein name | | | | Locus Name | | Acc# |
| | | | | sp:YEAZ_ECOLI | | |

Description

HYPOTHETICAL 25.2 KD PROTEIN IN FADD-PABB INTERGENIC REGION

| ORF Name | NTID | AAID | NT Length | AA Length | Score | Probability |
|---|---|---|---|---|---|---|
| 19563312_c2_137 | 398 | 2318 | 96 | 291 | 71 | 0.038 |

| Protein name | | | | | Locus Name | Acc# |
|---|---|---|---|---|---|---|
| | | | | | sp:YYAB_BACSU | P37523 |

Description

HYPOTHETICAL 17.0 KD PROTEIN IN SPO0J-GIDB INTERGENIC REGION

| ORF Name | NTID | AAID | NT Length | AA Length | Score | Probability |
|---|---|---|---|---|---|---|
| 19632661_f3_91 | 399 | 2319 | 134 | 405 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 203577_c1_95 | 400 | 2320 | 751 | 2256 | 2566 | 1.1e-266 |

| Protein name | | | | | Locus Name | Acc# |
|---|---|---|---|---|---|---|
| | | | | | sp:CLPB_HAEIN | P44403 |

Description

CLPB PROTEIN

| ORF Name | NTID | AAID | NT Length | AA Length | Score | Probability |
|---|---|---|---|---|---|---|
| 21988931_f3_88 | 401 | 2321 | 211 | 636 | 563 | 1.9e-54 |

| Protein name | | | | | Locus Name | Acc# |
|---|---|---|---|---|---|---|
| | | | | | sp:UCRI_CHRVI | O31214 |

Description (RIESKE IRON-SULFUR PROTEIN) (RISP)

| ORF Name | NTID | AAID | NT Length | AA Length | Score | Probability |
|---|---|---|---|---|---|---|
| 22066661_f2_40 | 402 | 2322 | 191 | 576 | 364 | 2.4e-33 |

| Protein name | | | | | Locus Name | Acc# |
|---|---|---|---|---|---|---|
| | | | | | sp:YAJQ_HAEIN | P44096 |

Description

HYPOTHETICAL PROTEIN HI1034

| ORF Name | NTID | AAID | NT Length | AA Length | Score | Probability |
|---|---|---|---|---|---|---|
| 23525307_c2_146 | 403 | 2323 | 213 | 642 | 554 | 3.5e-58 |

Protein name: cytochrome-c oxidase, type cbb3 chain fixO
Locus Name: pir:S77596
Acc#: S77596

Description:

| ORF Name | NTID | AAID | NT Length | AA Length | Score | Probability |
|---|---|---|---|---|---|---|
| 23720002_c2_140 | 404 | 2324 | 61 | 186 | | |

Protein name:
Locus Name:
Acc#:

Description: NO-HIT

| ORF Name | NTID | AAID | NT Length | AA Length | Score | Probability |
|---|---|---|---|---|---|---|
| 23860681_f2_39 | 405 | 2325 | 455 | 1368 | 1917 | 6.4e-198 |

Protein name:
Locus Name: sp:ASSY_HAEIN
Acc#: P44315

Description: LIGASE)

| ORF Name | NTID | AAID | NT Length | AA Length | Score | Probability |
|---|---|---|---|---|---|---|
| 23864180_f1_18 | 406 | 2326 | 271 | 816 | 254 | 1.1e-21 |

Protein name: CorE
Locus Name: gp:AF130857
Acc#: AF130857

Description: Salmonella typhimurium cobalt resistance locus, partial sequence.

| ORF Name | NTID | AAID | NT Length | AA Length | Score | Probability |
|---|---|---|---|---|---|---|
| 23947151_f1_19 | 407 | 2327 | 102 | 309 | 119 | 2.2e-07 |

| Protein name | Locus Name | Acc# |
|---|---|---|
| unknown | gp:AF147448 | AF147448 |

Description

Pseudomonas aeruginosa strain PAO1 penicillin-binding protein 2(pbpA), rod-shape-determining protein (rodA), membrane-bound lytictransglycosylase (mltB), rare lipoprotein A (rlpA), penicillin-binding protein 5 (dacA), and lipoate biosynthesisprotein B (lipB) genes, complete cds; and unknown gene.

| ORF Name | NTID | AAID | NT Length | AA Length | Score | Probability |
|---|---|---|---|---|---|---|
| 24083208_f3_82 | 408 | 2328 | 71 | 216 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24271875_c1_122 | 409 | 2329 | 558 | 1677 | 1857 | 1.5e-191 |

| Protein name | Locus Name | Acc# |
|---|---|---|
| | sp:PYRG_HAEIN | P44341 |

Description

CTP SYNTHASE, (UTP--AMMONIA LIGASE) (CTP SYNTHETASE)

| ORF Name | NTID | AAID | NT Length | AA Length | Score | Probability |
|---|---|---|---|---|---|---|
| 24337827_f1_15 | 410 | 2330 | 355 | 1068 | 1038 | 8.9e-105 |

| Protein name | Locus Name | Acc# |
|---|---|---|
| dihydroorotase, | pir:T10453 | T10453 |

Description

| ORF Name | NTID | AAID | NT Length | AA Length | Score | Probability |
|---|---|---|---|---|---|---|
| 24344138_f3_68 | 411 | 2331 | 70 | 213 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24417875_c1_124 | 412 | 2332 | 141 | 426 | 135 | 4.3e-09 |
| Protein name | | | | Locus Name | | Acc# |
| | | | | sp:YGBQ_HAEIN | | P44035 |

Description

HYPOTHETICAL PROTEIN HI0673

| ORF Name | NTID | AAID | NT Length | AA Length | Score | Probability |
|---|---|---|---|---|---|---|
| 24500286_c3_163 | 413 | 2333 | 519 | 1560 | 1458 | 2.6e-152 |
| Protein name | | | | Locus Name | | Acc# |
| | | | | sp:SR54_ECOLI | | P07019 |

Description

SIGNAL RECOGNITION PARTICLE PROTEIN (FIFTY-FOUR HOMOLOG) (P48)

| ORF Name | NTID | AAID | NT Length | AA Length | Score | Probability |
|---|---|---|---|---|---|---|
| 24648402_f1_22 | 414 | 2334 | 1298 | 3897 | 386 | 5.4e-59 |
| Protein name | | | | Locus Name | | Acc# |
| probable exonuclease, | | | | pir:T03465 | | T03465 |

Description

| ORF Name | NTID | AAID | NT Length | AA Length | Score | Probability |
|---|---|---|---|---|---|---|
| 24844562_c3_167 | 415 | 2335 | 548 | 1647 | 1470 | 1.5e-150 |
| Protein name | | | | Locus Name | | Acc# |
| probable pitB protein | | | | pir:E70731 | | E70731 |

Description

| ORF Name | NTID | AAID | NT Length | AA Length | Score | Probability |
|---|---|---|---|---|---|---|
| 29880042_f3_83 | 416 | 2336 | 485 | 1458 | 527 | 3.1e-61 |
| Protein name | | | | Locus Name | | Acc# |
| | | | | sp:SBCD_ECOLI | | P13457 |

Description

EXONUCLEASE SBCD

| ORF_Name | NTID | AAID | NT Length | AA Length | Score | Probability |
|---|---|---|---|---|---|---|
| 3166026_f3_87 | 417 | 2337 | 67 | 204 | | |
| Protein name | | | | Locus Name | | Acc# |
| | | | | | | |

Description

NO-HIT

| ORF_Name | NTID | AAID | NT Length | AA Length | Score | Probability |
|---|---|---|---|---|---|---|
| 33204808_c1_101 | 418 | 2338 | 350 | 1053 | 231 | 2.8e-18 |
| Protein name | | | | Locus Name | | Acc# |
| hypothetical protein RP372 | | | | pir:E71694 | | E71694 |

Description

| ORF_Name | NTID | AAID | NT Length | AA Length | Score | Probability |
|---|---|---|---|---|---|---|
| 3367635_f2_55 | 419 | 2339 | 421 | 1266 | 1355 | 2.3e-138 |
| Protein name | | | | Locus Name | | Acc# |
| | | | | sp:CYB_CHRVI | | O31215 |

Description

CYTOCHROME B

| ORF_Name | NTID | AAID | NT Length | AA Length | Score | Probability |
|---|---|---|---|---|---|---|
| 33707182_f1_27 | 420 | 2340 | 252 | 759 | 364 | 2.7e-46 |
| Protein name | | | | Locus Name | | Acc# |
| | | | | sp:CY1_CHRVI | | O31216 |

Description

CYTOCHROME C1 PRECURSOR

| ORF_Name | NTID | AAID | NT Length | AA Length | Score | Probability |
|---|---|---|---|---|---|---|
| 33875885_c3_157 | 421 | 2341 | 68 | 207 | | |
| Protein name | | | | Locus Name | | Acc# |
| | | | | | | |

Description

NO-HIT

| ORF Name | NTID | AAID | NT Length | AA Length | Score | Probability |
|---|---|---|---|---|---|---|
| 34064681_c1_119 | 422 | 2342 | 87 | 264 | 71 | 0.026 |

| Protein name | Locus Name | Acc# |
|---|---|---|
| cb-type cytochrome c oxidase CcoQ subunit | gp:AB024290 | AB024290 |

Description

Magnetospirillum magnetotacticum ccoN, ccoO, ccoQ, ccoP gene forcb-type cytochrome c oxidase, complete cds.

| ORF Name | NTID | AAID | NT Length | AA Length | Score | Probability |
|---|---|---|---|---|---|---|
| 34120251_c1_105 | 423 | 2343 | 322 | 969 | 647 | 2.4e-63 |

| Protein name | Locus Name | Acc# |
|---|---|---|
|  | sp:UBIA_ECOLI | P26601 |

Description

POLYPRENYLTRANSFERASE)

| ORF Name | NTID | AAID | NT Length | AA Length | Score | Probability |
|---|---|---|---|---|---|---|
| 36379680_c2_127 | 424 | 2344 | 60 | 183 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3906686_c3_155 | 425 | 2345 | 653 | 1962 | 2231 | 3.4e-231 |

| Protein name | Locus Name | Acc# |
|---|---|---|
|  | sp:GIDA_PSEPU | P25756 |

Description

GLUCOSE INHIBITED DIVISION PROTEIN A

| ORF Name | NTID | AAID | NT Length | AA Length | Score | Probability |
|---|---|---|---|---|---|---|
| 3932753_c2_149 | 426 | 2346 | 767 | 2304 | 235 | 1.3e-16 |

| Protein name | Locus Name | Acc# |
|---|---|---|
|  | sp:REC2_HAEIN | P44408 |

Description

RECOMBINATION PROTEIN 2

| ORF_Name | NTID | AAID | NT Length | AA Length | Score | Probability |
|---|---|---|---|---|---|---|
| 3942318_f2_54 | 427 | 2347 | 131 | 396 | 507 | 1.7e-48 |

| Protein name | | | | Locus_Name | | Acc# |
|---|---|---|---|---|---|---|
| | | | | sp:RS9_HAESO | | P31782 |

Description

30S RIBOSOMAL PROTEIN S9

| ORF_Name | NTID | AAID | NT Length | AA Length | Score | Probability |
|---|---|---|---|---|---|---|
| 3947193_f2_56 | 428 | 2348 | 132 | 399 | 311 | 9.7e-28 |

| Protein name | | | | Locus_Name | | Acc# |
|---|---|---|---|---|---|---|
| | | | | sp:SSPB_HAEIN | | P45206 |

Description

STRINGENT STARVATION PROTEIN B HOMOLOG

| ORF_Name | NTID | AAID | NT Length | AA Length | Score | Probability |
|---|---|---|---|---|---|---|
| 4119075_c1_103 | 429 | 2349 | 281 | 846 | 464 | 6.0e-44 |

| Protein name | | | | Locus_Name | | Acc# |
|---|---|---|---|---|---|---|
| | | | | sp:BACA_ECOLI | | |

Description (EC 2.7.1.66)

| ORF_Name | NTID | AAID | NT Length | AA Length | Score | Probability |
|---|---|---|---|---|---|---|
| 4334463_c3_172 | 430 | 2350 | 169 | 510 | 78 | 2.8e-05 |

| Protein name | | | | Locus_Name | | Acc# |
|---|---|---|---|---|---|---|
| unknown | | | | gp:AF083916 | | AF083916 |

Description

Rhizobium etli Fnr-type transcriptional regulator FnrNc (fnrNc)gene, complete cds; and unknown genes.

| ORF Name | NTID | AAID | NT Length | AA Length | Score | Probability |
|---|---|---|---|---|---|---|
| 4798193_c3_178 | 431 | 2351 | 358 | 1077 | 368 | 5.6e-48 |

Protein name cytochrome-c oxidase, fixP chain:cb-type cytochrome-c oxidase 32K chain:cytochrome b410:fixP protein

Locus Name: pir:D47468   Acc#: D47468

Description

---

| ORF Name | NTID | AAID | NT Length | AA Length | Score | Probability |
|---|---|---|---|---|---|---|
| 500017_f3_73 | 432 | 2352 | 241 | 726 | 550 | 4.6e-53 |

Protein name

Locus Name: sp:RNT_VIBPA   Acc#: P46232

Description

RIBONUCLEASE T, (EXORIBONUCLEASE T) (RNASE T)

---

| ORF Name | NTID | AAID | NT Length | AA Length | Score | Probability |
|---|---|---|---|---|---|---|
| 520003_c1_126 | 433 | 2353 | 67 | 204 | | |

Protein name

Locus Name:   Acc#:

Description

NO-HIT

---

| ORF Name | NTID | AAID | NT Length | AA Length | Score | Probability |
|---|---|---|---|---|---|---|
| 5203453_c3_181 | 434 | 2354 | 445 | 1338 | 1467 | 3.1e-150 |

Protein name

Locus Name: sp:ENO_ECOLI   Acc#: P08324

Description

(GLYCERATE HYDRO-LYASE)

---

| ORF Name | NTID | AAID | NT Length | AA Length | Score | Probability |
|---|---|---|---|---|---|---|
| 5281318_c3_180 | 435 | 2355 | 290 | 873 | 1037 | 1.1e-104 |

Protein name

2-dehydro-3-deoxyphosphooctonate aldolase

Locus Name: gp:AF098791   Acc#: AF098791

Description

Pseudomonas aeruginosa 2-dehydro-3-deoxyphosphooctonate aldolase(kdsA) gene, complete cds.

| ORF Name | NTID | AAID | NT Length | AA Length | Score | Probability |
|---|---|---|---|---|---|---|
| 5901067_cl_104 | 436 | 2356 | 274 | 825 | 202 | 3.5e-16 |

| Protein name | Locus Name | Acc# |
|---|---|---|
| | sp:YHIQ_HAEIN | P44901 |

Description

HYPOTHETICAL PROTEIN HI0849

| ORF Name | NTID | AAID | NT Length | AA Length | Score | Probability |
|---|---|---|---|---|---|---|
| 7054650_cl_118 | 437 | 2357 | 62 | 189 | 53 | 0.015 |

| Protein name | Locus Name | Acc# |
|---|---|---|
| ORF-D | gp:ECO10KLS | D11109 |

Description

E. coli gene for 10K-L and 10K-S protein.

| ORF Name | NTID | AAID | NT Length | AA Length | Score | Probability |
|---|---|---|---|---|---|---|
| 957705_cl_113 | 438 | 2358 | 335 | 1008 | 407 | 6.5e-38 |

| Protein name | Locus Name | Acc# |
|---|---|---|
| putative regulatory protein | gp:AF087482 | AF087482 |

Description

Pseudomonas aeruginosa clcC and ohbH genes, Lys-R type regulatoryprotein (clcR), chlorocatechol-1,2-dioxygenase (clcA),chloromuconate cycloisomerase (clcB), dienelactone hydrolase(clcD), maleylacetate reductase (clcE), transposase (tnpA),ATP-binding protein (tnpB), putative regulatory protein (ohbR),o-halobenzoate dioxygenase reductase (ohbA), o-halobenzoatedioxygenase alpha subunit (ohbB), o-halobenzoate dioxygenase betasubunit (ohbC),

| ORF Name | NTID | AAID | NT Length | AA Length | Score | Probability |
|---|---|---|---|---|---|---|
| 9960917_f3_90 | 439 | 2359 | 223 | 672 | 354 | 2.7e-32 |

| Protein name | Locus Name | Acc# |
|---|---|---|
| | sp:SSPA_ECOLI | P05838 |

Description

STRINGENT STARVATION PROTEIN A

| ORF Name | NTID | AAID | NT Length | AA Length | Score | Probability |
|---|---|---|---|---|---|---|
| 10632090_f1_17 | 440 | 2360 | 506 | 1521 | 981 | 9.8e-99 |

| Protein name | | | | Locus Name | | Acc# |
|---|---|---|---|---|---|---|
| | | | | sp:NUON_ECOLI | | |

Description

OXIDOREDUCTASE CHAIN 14) (NUO14)

| ORF Name | NTID | AAID | NT Length | AA Length | Score | Probability |
|---|---|---|---|---|---|---|
| 1069465_c1_85 | 441 | 2361 | 75 | 228 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 10734830_c1_89 | 442 | 2362 | 60 | 183 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 1385390_f3_54 | 443 | 2363 | 216 | 651 | 409 | 4.0e-38 |

| Protein name | | | | Locus Name | | Acc# |
|---|---|---|---|---|---|---|
| | | | | sp:NUOJ_ECOLI | | |

Description

OXIDOREDUCTASE CHAIN 10) (NUO10)

| ORF Name | NTID | AAID | NT Length | AA Length | Score | Probability |
|---|---|---|---|---|---|---|
| 13863425_f2_23 | 444 | 2364 | 276 | 831 | 480 | 1.2e-45 |

| Protein name | | | | Locus Name | | Acc# |
|---|---|---|---|---|---|---|
| hypothetical protein RP682 | | | | pir:E71674 | | E71674 |

Description

| ORF Name | NTID | AAID | NT Length | AA Length | Score | Probability |
|---|---|---|---|---|---|---|
| 14454827_f2_28 | 445 | 2365 | 211 | 636 | 561 | 3.1e-54 |

| Protein name | Locus Name | Acc# |
|---|---|---|
| pyridoxamine 5-phosphate oxidase | pir:B75513 | B75513 |

Description

| ORF Name | NTID | AAID | NT Length | AA Length | Score | Probability |
|---|---|---|---|---|---|---|
| 14475702_c1_90 | 446 | 2366 | 259 | 780 | 91 | 0.00081 |

| Protein name | Locus Name | Acc# |
|---|---|---|
| ORF8 | gp:D78257 | D78257 |

Description

Enterococcus faecalis plasmid pYI17 genes for BacA, BacB, ORF3, ORF4, ORF5, ORF6, ORF7, ORF8, ORF9, ORF10, ORF11, partial cds.

| ORF Name | NTID | AAID | NT Length | AA Length | Score | Probability |
|---|---|---|---|---|---|---|
| 14578202_f1_12 | 447 | 2367 | 182 | 549 | 763 | 1.2e-75 |

| Protein name | Locus Name | Acc# |
|---|---|---|
| | sp:NUOI_ECOLI | |

Description

OXIDOREDUCTASE CHAIN 9) (NUO9)

| ORF Name | NTID | AAID | NT Length | AA Length | Score | Probability |
|---|---|---|---|---|---|---|
| 15625443_c1_84 | 448 | 2368 | 61 | 186 | | |

| Protein name | Locus Name | Acc# |
|---|---|---|
| | | |

Description

NO-HIT

| ORF_Name | NTID | AAID | NT Length | AA Length | Score | Probability |
|---|---|---|---|---|---|---|
| 175760_f3_46 | 449 | 2369 | 215 | 648 | 352 | 4.4e-32 |

Protein name: NADH dehydrogenase chain A
Locus Name: gp:AF057063
Acc#: AF057063

Description:
Erwinia carotovora subsp. carotovora aspartate aminotransferase(aat) gene, partial cds; HexA (hexA), NADH dehydrogenase chain A(nuoA), and NADH dehydrogenase chain B (nuoB) genes, complete cds;and NADH dehydrogenase chain C (nuoC) gene, partial cds.

| ORF_Name | NTID | AAID | NT Length | AA Length | Score | Probability |
|---|---|---|---|---|---|---|
| 19806577_f2_27 | 450 | 2370 | 452 | 1359 | 1177 | 1.7e-119 |

Protein name:
Locus Name: sp:MRSA_HAEIN
Acc#: P45164

Description:
MRSA PROTEIN HOMOLOG

| ORF_Name | NTID | AAID | NT Length | AA Length | Score | Probability |
|---|---|---|---|---|---|---|
| 2110657_f1_3 | 451 | 2371 | 328 | 987 | 760 | 2.6e-75 |

Protein name:
Locus Name: sp:Y926_SYNY3
Acc#: P72872

Description:
HYPOTHETICAL 37.9 KD PROTEIN SLL0926

| ORF_Name | NTID | AAID | NT Length | AA Length | Score | Probability |
|---|---|---|---|---|---|---|
| 22402252_f2_25 | 452 | 2372 | 63 | 192 | | |

Protein name:
Locus Name:
Acc#:

Description:
NO-HIT

| ORF Name | NTID | AAID | NT Length | AA Length | Score | Probability |
|---|---|---|---|---|---|---|
| 23683215_f2_38 | 453 | 2373 | 579 | 1740 | 1583 | 1.6e-162 |

Protein name — Locus Name: sp:NUOM_ECOLI — Acc#

Description: OXIDOREDUCTASE CHAIN 13) (NUO13)

| ORF Name | NTID | AAID | NT Length | AA Length | Score | Probability |
|---|---|---|---|---|---|---|
| 24225213_f3_50 | 454 | 2374 | 266 | 801 | 1183 | 3.8e-120 |

Protein name: Tou2 — Locus Name: gp:AF058689 — Acc#: AF058689

Description: Neisseria meningitidis strain Z2491, genomic sequence.

| ORF Name | NTID | AAID | NT Length | AA Length | Score | Probability |
|---|---|---|---|---|---|---|
| 24226502_c3_132 | 455 | 2375 | 270 | 813 | 888 | 7.0e-89 |

Protein name — Locus Name: sp:Y572_HAEIN — Acc#: P44758

Description: HYPOTHETICAL PROTEIN HI0572

| ORF Name | NTID | AAID | NT Length | AA Length | Score | Probability |
|---|---|---|---|---|---|---|
| 24391557_f1_10 | 456 | 2376 | 1046 | 3141 | 1655 | 8.6e-252 |

Protein name: NADH dehydrogenase (ubiquinone), I chain G:nuoK protein — Locus Name: pir:A65000 — Acc#

Description:

| ORF Name | NTID | AAID | NT Length | AA Length | Score | Probability |
|---|---|---|---|---|---|---|
| 24642893_f1_15 | 457 | 2377 | 619 | 1860 | 1809 | 1.8e-186 |

Protein name — Locus Name: sp:NUOL_ECOLI — Acc#

Description: OXIDOREDUCTASE CHAIN 12) (NUO12)

| ORF Name | NTID | AAID | NT Length | AA Length | Score | Probability |
|---|---|---|---|---|---|---|
| 2507286_f2_22 | 458 | 2378 | 213 | 642 | 770 | 2.2e-76 |

Protein name: outer membrane protein B1
Locus Name: gp:AF045251
Acc#: AF045251

Description: Moraxella catarrhalis outer membrane protein B1 gene, complete cds.

| ORF Name | NTID | AAID | NT Length | AA Length | Score | Probability |
|---|---|---|---|---|---|---|
| 25392135_f2_26 | 459 | 2379 | 61 | 186 | | |

Protein name:
Locus Name:
Acc#:

Description: NO-HIT

| ORF Name | NTID | AAID | NT Length | AA Length | Score | Probability |
|---|---|---|---|---|---|---|
| 25579763_f3_61 | 460 | 2380 | 281 | 846 | 374 | 2.3e-39 |

Protein name:
Locus Name: sp:FENR_ECOLI
Acc#:

Description: (FLXR) (FLDR) (METHYL VIOLOGEN RESISTANCE PROTEIN A) (DA1)

| ORF Name | NTID | AAID | NT Length | AA Length | Score | Probability |
|---|---|---|---|---|---|---|
| 26228401_c2_105 | 461 | 2381 | 156 | 471 | 123 | 8.1e-08 |

Protein name: hypothetical protein APE1413
Locus Name: pir:D72619
Acc#: D72619

Description:

| ORF Name | NTID | AAID | NT Length | AA Length | Score | Probability |
|---|---|---|---|---|---|---|
| 29688176_f1_1 | 462 | 2382 | 70 | 213 | 304 | 4.8e-26 |

Protein name: transferrin-binding protein 2 precursor
Locus Name: gp:AF105251
Acc#: AF105251

Description: Moraxella catarrhalis transferrin-binding protein 2 precursor(ompB1) gene, partial cds.

| ORF Name | NTID | AAID | NT Length | AA Length | Score | Probability |
|---|---|---|---|---|---|---|
| 30082693_f3_51 | 463 | 2383 | 491 | 1476 | 1378 | 8.3e-141 |

Protein name | Locus Name | Acc#
sp:NUOF_ECOLI

Description

OXIDOREDUCTASE CHAIN 6) (NUO6)

| ORF Name | NTID | AAID | NT Length | AA Length | Score | Probability |
|---|---|---|---|---|---|---|
| 30252036_c2_98 | 464 | 2384 | 63 | 192 | | |

Protein name | Locus Name | Acc#

Description

NO-HIT

| ORF Name | NTID | AAID | NT Length | AA Length | Score | Probability |
|---|---|---|---|---|---|---|
| 31283452_f1_11 | 465 | 2385 | 342 | 1029 | 1126 | 4.2e-114 |

Protein name | Locus Name | Acc#
sp:NUOH_ECOLI

Description

OXIDOREDUCTASE CHAIN 8) (NUO8)

| ORF Name | NTID | AAID | NT Length | AA Length | Score | Probability |
|---|---|---|---|---|---|---|
| 3182067_c3_131 | 466 | 2386 | 516 | 1551 | 1966 | 4.1e-203 |

Protein name | Locus Name | Acc#
sp:SYR_HAEIN | P43832

Description

ARGINYL-TRNA SYNTHETASE, (ARGININE--TRNA LIGASE) (ARGRS)

| ORF Name | NTID | AAID | NT Length | AA Length | Score | Probability |
|---|---|---|---|---|---|---|
| 33723387_f1_6 | 467 | 2387 | 235 | 708 | 799 | 1.9e-79 |

Protein name | Locus Name | Acc#
sp:NUOB_ECOLI

Description

OXIDOREDUCTASE CHAIN 2) (NUO2)

| ORF Name | NTID | AAID | NT Length | AA Length | Score | Probability |
|---|---|---|---|---|---|---|
| 33772186_f3_41 | 468 | 2388 | 416 | 1251 | 1601 | 1.9e-164 |

| Protein name | Locus Name | Acc# |
|---|---|---|
| transferrin binding protein B | gp:AF039313 | AF039313 |

Description

Moraxella catarrhalis strain LES-1 transferrin binding protein B (tbpB) gene, complete cds.

| ORF Name | NTID | AAID | NT Length | AA Length | Score | Probability |
|---|---|---|---|---|---|---|
| 34176950_f3_42 | 469 | 2389 | 548 | 1647 | 331 | 2.2e-29 |

| Protein name | Locus Name | Acc# |
|---|---|---|
|  | sp:Y170_METJA | Q57634 |

Description

HYPOTHETICAL PROTEIN MJ0170

| ORF Name | NTID | AAID | NT Length | AA Length | Score | Probability |
|---|---|---|---|---|---|---|
| 34414552_f3_47 | 470 | 2390 | 584 | 1755 | 2190 | 7.5e-227 |

| Protein name | Locus Name | Acc# |
|---|---|---|
| NADH dehydrogenase (ubiquinone), I, chain C-D | pir:D65000 |  |

Description

| ORF Name | NTID | AAID | NT Length | AA Length | Score | Probability |
|---|---|---|---|---|---|---|
| 35166075_f1_4 | 471 | 2391 | 294 | 885 | 315 | 3.7e-28 |

| Protein name | Locus Name | Acc# |
|---|---|---|
| periplasmic chaperone protein | gp:AF095845 | AF095845 |

Description

Pseudomonas syringae cell division/stress response protein (ftsK) and periplasmic chaperone protein (lolA) genes, complete cds.

| ORF Name | NTID | AAID | NT Length | AA Length | Score | Probability |
|---|---|---|---|---|---|---|
| 36144687_f3_49 | 472 | 2392 | 62 | 189 | 240 | 3.2e-20 |

| Protein name | | | | Locus Name | | Acc# |
|---|---|---|---|---|---|---|
| | | | | sp:NUOD_SALTY | | P33902 |

Description

OXIDOREDUCTASE CHAIN 4) (NUO4) (FRAGMENT)

| ORF Name | NTID | AAID | NT Length | AA Length | Score | Probability |
|---|---|---|---|---|---|---|
| 3915693_c1_80 | 473 | 2393 | 416 | 1251 | 211 | 1.7e-14 |

| Protein name | | | | Locus Name | | Acc# |
|---|---|---|---|---|---|---|
| | | | | gp:ECPMC7A | | X57583 |

Description

E.coli Plasmid pMccC7 mccA,B,C,D,E,F genes.

| ORF Name | NTID | AAID | NT Length | AA Length | Score | Probability |
|---|---|---|---|---|---|---|
| 4740902_c2_127 | 474 | 2394 | 313 | 942 | 114 | 0.00043 |

| Protein name | | | | Locus Name | | Acc# |
|---|---|---|---|---|---|---|
| | | | | sp:PRXH_BPMD2 | | O64252 |

Description

PUTATIVE NON-HEME HALOPEROXIDASE,

| ORF Name | NTID | AAID | NT Length | AA Length | Score | Probability |
|---|---|---|---|---|---|---|
| 4796875_f1_5 | 475 | 2395 | 78 | 237 | 144 | 4.8e-10 |

| Protein name | | | | Locus Name | | Acc# |
|---|---|---|---|---|---|---|
| conserved hypothetical protein | | | | pir:H75273 | | H75273 |

Description

| ORF Name | NTID | AAID | NT Length | AA Length | Score | Probability |
|---|---|---|---|---|---|---|
| 5097886_f1_14 | 476 | 2396 | 145 | 438 | 320 | 1.1e-28 |

| Protein name | | | | Locus Name | | Acc# |
|---|---|---|---|---|---|---|
| | | | | sp:NUOK_ECOLI | | |

Description

OXIDOREDUCTASE CHAIN 11) (NUO11)

| ORF_Name | NTID | AAID | NT Length | AA Length | Score | Probability |
|---|---|---|---|---|---|---|
| 7226452_f1_9 | 477 | 2397 | 174 | 525 | 470 | 1.4e-44 |

| Protein name | | | | Locus Name | | Acc# |
|---|---|---|---|---|---|---|
| | | | | sp:NUOE_SALTY | | P33903 |

Description

OXIDOREDUCTASE CHAIN 5) (NUO5)

| ORF_Name | NTID | AAID | NT Length | AA Length | Score | Probability |
|---|---|---|---|---|---|---|
| 10181576_f2_42 | 478 | 2398 | 101 | 306 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 10751312_f1_7 | 479 | 2399 | 939 | 2820 | 710 | 2.9e-114 |

| Protein name | | | | Locus Name | | Acc# |
|---|---|---|---|---|---|---|
| | | | | sp:YCBY_HAEIN | | |

Description

HYPOTHETICAL PROTEIN HI0116/115

| ORF_Name | NTID | AAID | NT Length | AA Length | Score | Probability |
|---|---|---|---|---|---|---|
| 10975302_c1_93 | 480 | 2400 | 293 | 882 | 185 | 2.5e-13 |

| Protein name | | | | Locus Name | | Acc# |
|---|---|---|---|---|---|---|
| probable D,D-carboxypeptidase | | | | pir:B71353 | | B71353 |

Description

| ORF_Name | NTID | AAID | NT Length | AA Length | Score | Probability |
|---|---|---|---|---|---|---|
| 19587762_c1_77 | 481 | 2401 | 89 | 270 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 19735877_f2_34 | 482 | 2402 | 63 | 192 | | |

| Protein name | | | | Locus_Name | | Acc# |
|---|---|---|---|---|---|---|
| | | | | | | |

Description

NO-HIT

| ORF_Name | NTID | AAID | NT Length | AA Length | Score | Probability |
|---|---|---|---|---|---|---|
| 21491075_c3_127 | 483 | 2403 | 517 | 1554 | 309 | 1.4e-41 |

| Protein name | | | | Locus_Name | | Acc# |
|---|---|---|---|---|---|---|
| CjaB protein | | | | gp:CJE17971 | | Y17971 |

Description

Campylobacter jejuni cjaB gene.

| ORF_Name | NTID | AAID | NT Length | AA Length | Score | Probability |
|---|---|---|---|---|---|---|
| 21520276_c3_136 | 484 | 2404 | 275 | 828 | | |

| Protein name | | | | Locus_Name | | Acc# |
|---|---|---|---|---|---|---|
| | | | | | | |

Description

NO-HIT

| ORF_Name | NTID | AAID | NT Length | AA Length | Score | Probability |
|---|---|---|---|---|---|---|
| 21603403_c3_126 | 485 | 2405 | 543 | 1632 | 857 | 1.3e-85 |

| Protein name | | | | Locus_Name | | Acc# |
|---|---|---|---|---|---|---|
| | | | | sp:YMDC_ECOLI | | P75919 |

Description

HYPOTHETICAL 55.9 KD PROTEIN IN CSGC-MDOG INTERGENIC REGION

| ORF_Name | NTID | AAID | NT Length | AA Length | Score | Probability |
|---|---|---|---|---|---|---|
| 21679677_f3_58 | 486 | 2406 | 476 | 1431 | 1649 | 1.6e-169 |

| Protein name | | | | Locus_Name | | Acc# |
|---|---|---|---|---|---|---|
| | | | | sp:GLNA_AZOVI | | P22248 |

Description

GLUTAMINE SYNTHETASE, (GLUTAMATE--AMMONIA LIGASE)

| ORF Name | NTID | AAID | NT Length | AA Length | Score | Probability |
|---|---|---|---|---|---|---|
| 22306532_c3_134 | 487 | 2407 | 255 | 768 | 426 | 6.3e-40 |

| Protein name | | | | Locus Name | | Acc# |
|---|---|---|---|---|---|---|
| | | | | sp:LPSA_PASHA | | Q05770 |

Description

LPSA PROTEIN

| ORF Name | NTID | AAID | NT Length | AA Length | Score | Probability |
|---|---|---|---|---|---|---|
| 22442010_f1_1 | 488 | 2408 | 354 | 1065 | 450 | 1.8e-42 |

| Protein name | | | | Locus Name | | Acc# |
|---|---|---|---|---|---|---|
| unknown | | | | gp:AF116284 | | AF116284 |

Description

Pseudomonas aeruginosa DnaJ-like protein gene, complete cds; and unknown genes.

| ORF Name | NTID | AAID | NT Length | AA Length | Score | Probability |
|---|---|---|---|---|---|---|
| 2375337_f3_49 | 489 | 2409 | 60 | 183 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 23944431_c2_116 | 490 | 2410 | 80 | 243 | 106 | 5.1e-06 |

| Protein name | | | | Locus Name | | Acc# |
|---|---|---|---|---|---|---|
| hypothetical protein APE0029 | | | | pir:H72754 | | H72754 |

Description

| ORF Name | NTID | AAID | NT Length | AA Length | Score | Probability |
|---|---|---|---|---|---|---|
| 23945931_f3_55 | 491 | 2411 | 346 | 1041 | 136 | 1.2e-06 |

| Protein name | | | | Locus Name | | Acc# |
|---|---|---|---|---|---|---|
| hypothetical protein slr1166 | | | | pir:S75877 | | S75877 |

Description

| ORF Name | NTID | AAID | NT Length | AA Length | Score | Probability |
|---|---|---|---|---|---|---|
| 23954511_f1_6 | 492 | 2412 | 811 | 2436 | 2745 | 1.2e-285 |

| Protein name | | | | Locus Name | | Acc# |
|---|---|---|---|---|---|---|
| | | | | sp:PPSA_ECOLI | | P23538 |

Description (PEP SYNTHASE)

| ORF Name | NTID | AAID | NT Length | AA Length | Score | Probability |
|---|---|---|---|---|---|---|
| 23989752_c1_84 | 493 | 2413 | 166 | 501 | 288 | 1.0e-42 |

| Protein name | | | | Locus Name | | Acc# |
|---|---|---|---|---|---|---|
| | | | | sp:3DHQ_NEUCR | | P05195 |

Description (DEHYDRATASE)

| ORF Name | NTID | AAID | NT Length | AA Length | Score | Probability |
|---|---|---|---|---|---|---|
| 24306512_c2_99 | 494 | 2414 | 202 | 609 | 509 | 1.0e-48 |

| Protein name | | | | Locus Name | | Acc# |
|---|---|---|---|---|---|---|
| | | | | sp:GCH1_OSTOS | | O61573 |

Description

GTP CYCLOHYDROLASE I, (GTP-CH-I)

| ORF Name | NTID | AAID | NT Length | AA Length | Score | Probability |
|---|---|---|---|---|---|---|
| 24337752_f2_32 | 495 | 2415 | 378 | 1137 | 884 | 1.9e-88 |

| Protein name | | | | Locus Name | | Acc# |
|---|---|---|---|---|---|---|
| | | | | sp:YDAO_ECOLI | | |

Description

HYPOTHETICAL 35.6 KD PROTEIN IN DBPA-INTR INTERGENIC REGION

| ORF Name | NTID | AAID | NT Length | AA Length | Score | Probability |
|---|---|---|---|---|---|---|
| 24646887_f1_16 | 496 | 2416 | 169 | 510 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24881717_f2_39 | 497 | 2417 | 107 | 324 | | |

Protein name | Locus Name | Acc#

Description

NO-HIT

| ORF Name | NTID | AAID | NT Length | AA Length | Score | Probability |
|---|---|---|---|---|---|---|
| 25595262_f3_68 | 498 | 2418 | 168 | 507 | | |

Protein name | Locus Name | Acc#

Description

NO-HIT

| ORF Name | NTID | AAID | NT Length | AA Length | Score | Probability |
|---|---|---|---|---|---|---|
| 26354750_f3_50 | 499 | 2419 | 60 | 183 | | |

Protein name | Locus Name | Acc#

Description

NO-HIT

| ORF Name | NTID | AAID | NT Length | AA Length | Score | Probability |
|---|---|---|---|---|---|---|
| 29332503_f3_66 | 500 | 2420 | 301 | 906 | 797 | 3.1e-79 |

Protein name: enoyl-(acyl-carrier protein) reductase | Locus Name: gp:AF104262 | Acc#: AF104262

Description

Pseudomonas aeruginosa enoyl-(acyl-carrier protein) reductase(fabI) gene, complete cds.

| ORF Name | NTID | AAID | NT Length | AA Length | Score | Probability |
|---|---|---|---|---|---|---|
| 29335786_f3_46 | 501 | 2421 | 249 | 750 | 428 | 3.9e-40 |

Protein name: unknown | Locus Name: gp:AF116284 | Acc#: AF116284

Description

Pseudomonas aeruginosa DnaJ-like protein gene, complete cds; andunknown genes.

| ORF Name | NTID | AAID | NT Length | AA Length | Score | Probability |
|---|---|---|---|---|---|---|
| 29382075_f1_4 | 502 | 2422 | 312 | 939 | 429 | 3.0e-40 |

| Protein name | Locus Name | Acc# |
|---|---|---|
| probable membrane protein b1520 | pir:C64906 | C64906 |

Description

| ORF Name | NTID | AAID | NT Length | AA Length | Score | Probability |
|---|---|---|---|---|---|---|
| 31425825_f1_22 | 503 | 2423 | 220 | 663 | 771 | 1.7e-76 |

| Protein name | Locus Name | Acc# |
|---|---|---|
| | sp:RPE_HAEIN | P44756 |

Description

EPIMERASE) (PPE) (R5P3E)

| ORF Name | NTID | AAID | NT Length | AA Length | Score | Probability |
|---|---|---|---|---|---|---|
| 32177_c3_133 | 504 | 2424 | 64 | 195 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3316436_f1_19 | 505 | 2425 | 462 | 1389 | 331 | 7.4e-30 |

| Protein name | Locus Name | Acc# |
|---|---|---|
| | sp:VISC_ECOLI | P25535 |

Description

VISC PROTEIN,

| ORF Name | NTID | AAID | NT Length | AA Length | Score | Probability |
|---|---|---|---|---|---|---|
| 33632828_f3_62 | 506 | 2426 | 249 | 750 | 559 | 5.1e-54 |

| Protein name | Locus Name | Acc# |
|---|---|---|
| ribose-5-phosphate isomerase | gp:AF037440 | AF037440 |

Description

Edwardsiella ictaluri D-3-phosphoglycerate dehydrogenase (serA)gene, partial cds; ribose-5-phosphate isomerase (rpiA), inhibitorof chromosome initiation (iciA), putative 26 kDa protein (yggE),putative 30.6 kDa protein (yggB), and fructose 1,6-bisphosphatealdolase (fda) genes, complete cds; and phosphoglycerate kinase(pgk) gene, partial cds.

| ORF Name | NTID | AAID | NT Length | AA Length | Score | Probability |
|---|---|---|---|---|---|---|
| 33863431_f3_53 | 507 | 2427 | 430 | 1293 | 456 | 4.2e-43 |

| Protein name | Locus Name | Acc# |
|---|---|---|
| conserved hypothetical protein | pir:F75546 | F75546 |

Description

| ORF Name | NTID | AAID | NT Length | AA Length | Score | Probability |
|---|---|---|---|---|---|---|
| 35163902_c2_109 | 508 | 2428 | 627 | 1884 | 960 | 8.9e-103 |

| Protein name | Locus Name | Acc# |
|---|---|---|
|  | sp:MSBA_ECOLI | P27299 |

Description

PROBABLE TRANSPORT ATP-BINDING PROTEIN MSBA

| ORF Name | NTID | AAID | NT Length | AA Length | Score | Probability |
|---|---|---|---|---|---|---|
| 35350061_c2_98 | 509 | 2429 | 64 | 195 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 36128378_f3_67 | 510 | 2430 | 124 | 375 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 3912568_c1_92 | 511 | 2431 | 525 | 1578 | 1470 | 1.5e-150 |

| Protein name | | | Locus Name | | | Acc# |
|---|---|---|---|---|---|---|
| soluble pyridine nucleotide transhydrogenase | | | gp:AF159108 | | | AF159108 |

Description

Azotobacter vinelandii soluble pyridine nucleotide transhydrogenase(sth) gene, complete cds.

| ORF Name | NTID | AAID | NT Length | AA Length | Score | Probability |
|---|---|---|---|---|---|---|
| 4111008_f2_33 | 512 | 2432 | 94 | 285 | 240 | 3.2e-20 |

| Protein name | | | Locus Name | | | Acc# |
|---|---|---|---|---|---|---|
| | | | sp:CSPA_PSEAE | | | P95459 |

Description

MAJOR COLD SHOCK PROTEIN CSPA

| ORF Name | NTID | AAID | NT Length | AA Length | Score | Probability |
|---|---|---|---|---|---|---|
| 4500892_c1_91 | 513 | 2433 | 291 | 876 | 599 | 2.9e-58 |

| Protein name | | | Locus Name | | | Acc# |
|---|---|---|---|---|---|---|
| | | | sp:YDIA_ECOLI | | | |

Description

HYPOTHETICAL 31.2 KD PROTEIN IN PPSA-AROH INTERGENIC REGION

| ORF Name | NTID | AAID | NT Length | AA Length | Score | Probability |
|---|---|---|---|---|---|---|
| 5132667_f1_12 | 514 | 2434 | 368 | 1107 | 124 | 6.4e-05 |

| Protein name | Locus Name | Acc# |
|---|---|---|
| mannosyltransferase-like protein | gp:YPS251712 | AJ251712 |

Description

Yersinia pseudotuberculosis serotype O:1b hemH gene (partial) andO-antigen gene cluster for ddhD gene, ddhA gene, ddhB gene, ddhCgene, prt gene, wbyH gene, wzx gene, wbyI gene, wbyJ gene, wzygene, wbyK gene, gmd gene, fcl gene, manC gene, wbyL gene, manBgene and wzz gene.

| ORF Name | NTID | AAID | NT Length | AA Length | Score | Probability |
|---|---|---|---|---|---|---|
| 5859762_c2_120 | 515 | 2435 | 115 | 348 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5894501_c1_82 | 516 | 2436 | 551 | 1656 | 564 | 1.5e-54 |

| Protein name | Locus Name | Acc# |
|---|---|---|
| | sp:Y653_HAEIN | P44029 |

Description

HYPOTHETICAL PROTEIN HI0653

| ORF Name | NTID | AAID | NT Length | AA Length | Score | Probability |
|---|---|---|---|---|---|---|
| 5993768_c2_122 | 517 | 2437 | 514 | 1542 | 305 | 4.6e-24 |

| Protein name | Locus Name | Acc# |
|---|---|---|
| | sp:OSTA_HAEIN | P44846 |

Description

ORGANIC SOLVENT TOLERANCE PROTEIN HOMOLOG PRECURSOR

| ORF Name | NTID | AAID | NT Length | AA Length | Score | Probability |
|---|---|---|---|---|---|---|
| 7150051_c3_131 | 518 | 2438 | 70 | 213 | 131 | 1.2e-08 |

| Protein name | | | | Locus Name | | Acc# |
|---|---|---|---|---|---|---|
| hypothetical protein APE2143 | | | | pir:B72521 | | B72521 |

Description

| ORF Name | NTID | AAID | NT Length | AA Length | Score | Probability |
|---|---|---|---|---|---|---|
| 977055_c3_129 | 519 | 2439 | 327 | 984 | 505 | 2.7e-48 |

| Protein name | | | | Locus Name | | Acc# |
|---|---|---|---|---|---|---|
| | | | | sp:YBJE_ECOLI | | P75826 |

Description

HYPOTHETICAL 34.4 KD PROTEIN IN POXB-AQPZ INTERGENIC REGION

| ORF Name | NTID | AAID | NT Length | AA Length | Score | Probability |
|---|---|---|---|---|---|---|
| 9882793_c3_128 | 520 | 2440 | 65 | 198 | 109 | 2.5e-06 |

| Protein name | | | | Locus Name | | Acc# |
|---|---|---|---|---|---|---|
| hypothetical protein APE0666 | | | | pir:F72654 | | F72654 |

Description

| ORF Name | NTID | AAID | NT Length | AA Length | Score | Probability |
|---|---|---|---|---|---|---|
| 23615951_c1_12 | 521 | 2441 | 125 | 378 | 182 | 4.5e-14 |

| Protein name | | | | Locus Name | | Acc# |
|---|---|---|---|---|---|---|
| adhesin complex 25K protein precursor:LecA protein | | | | pir:JC5327 | | |

Description

| ORF Name | NTID | AAID | NT Length | AA Length | Score | Probability |
|---|---|---|---|---|---|---|
| 24259425_c3_15 | 522 | 2442 | 165 | 498 | 194 | 2.4e-15 |

| Protein name | | | | Locus Name | | Acc# |
|---|---|---|---|---|---|---|
| adhesin complex 25K protein precursor:LecA protein | | | | pir:JC5327 | | |

Description

| ORF Name | NTID | AAID | NT Length | AA Length | Score | Probability |
|---|---|---|---|---|---|---|
| 33986343_f3_10 | 523 | 2443 | 699 | 2100 | 2411 | 2.9e-250 |

| Protein name | Locus Name | Acc# |
|---|---|---|
| oligopeptidepermease | gp:SPOPPDACA | X89237 |

Description

S.pyogenes DNA for oppA, oppB, oppC, oppD, oppF, and dacA genes.

| ORF Name | NTID | AAID | NT Length | AA Length | Score | Probability |
|---|---|---|---|---|---|---|
| 4727338_f3_9 | 524 | 2444 | 325 | 978 | 1264 | 1.0e-128 |

| Protein name | Locus Name | Acc# |
|---|---|---|
| oligopeptidepermease | gp:SPOPPDACA | X89237 |

Description

S.pyogenes DNA for oppA, oppB, oppC, oppD, oppF, and dacA genes.

| ORF Name | NTID | AAID | NT Length | AA Length | Score | Probability |
|---|---|---|---|---|---|---|
| 4788508_f3_11 | 525 | 2445 | 63 | 192 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6053212_f3_8 | 526 | 2446 | 340 | 1023 | 1398 | 6.3e-143 |

| Protein name | Locus Name | Acc# |
|---|---|---|
| oligopeptidepermease | gp:SPOPPDACA | X89237 |

Description

S.pyogenes DNA for oppA, oppB, oppC, oppD, oppF, and dacA genes.

| ORF Name | NTID | AAID | NT Length | AA Length | Score | Probability |
|---|---|---|---|---|---|---|
| 12265658_c2_101 | 527 | 2447 | 221 | 666 | 753 | 1.4e-74 |

| Protein name | Locus Name | Acc# |
|---|---|---|
| | sp:DP3X_HAEIN | P43746 |

Description

DNA POLYMERASE III SUBUNIT GAMMA/TAU,

| ORF Name | NTID | AAID | NT Length | AA Length | Score | Probability |
|---|---|---|---|---|---|---|
| 12501562_c2_109 | 528 | 2448 | 214 | 645 | 254 | 3.5e-21 |

| Protein name | Locus Name | Acc# |
|---|---|---|
| hemolysin-related protein | pir:F72326 | F72326 |

Description

---

| ORF Name | NTID | AAID | NT Length | AA Length | Score | Probability |
|---|---|---|---|---|---|---|
| 12605253_c1_85 | 529 | 2449 | 967 | 2904 | 563 | 1.3e-65 |

| Protein name | Locus Name | Acc# |
|---|---|---|
| | sp:MLTD_ECOLI | |

Description (MUREIN HYDROLASE D) (REGULATORY PROTEIN DNIR)

---

| ORF Name | NTID | AAID | NT Length | AA Length | Score | Probability |
|---|---|---|---|---|---|---|
| 12891082_f3_51 | 530 | 2450 | 237 | 714 | 234 | 1.4e-19 |

| Protein name | Locus Name | Acc# |
|---|---|---|
| | sp:YBHD_ECOLI | |

Description

HYPOTHETICAL TRANSCRIPTIONAL REGULATOR IN MODC-BIOA INTERGENIC REGION

---

| ORF Name | NTID | AAID | NT Length | AA Length | Score | Probability |
|---|---|---|---|---|---|---|
| 13876010_f1_11 | 531 | 2451 | 135 | 408 | 156 | 7.0e-11 |

| Protein name | Locus Name | Acc# |
|---|---|---|
| | sp:RBCR_CHRVI | P25544 |

Description

RUBISCO OPERON TRANSCRIPTIONAL REGULATOR

---

| ORF Name | NTID | AAID | NT Length | AA Length | Score | Probability |
|---|---|---|---|---|---|---|
| 15870706_c1_68 | 532 | 2452 | 344 | 1035 | 1009 | 1.1e-101 |

| Protein name | Locus Name | Acc# |
|---|---|---|
| | sp:LEU2_ECOLI | |

Description (ISOPROPYLMALATE ISOMERASE) (ALPHA-IPM ISOMERASE) (IPMI)

| ORF Name | NTID | AAID | NT Length | AA Length | Score | Probability |
|---|---|---|---|---|---|---|
| 175062_c1_79 | 533 | 2453 | 219 | 660 | 740 | 3.4e-73 |

| Protein name | | | | Locus Name | | Acc# |
|---|---|---|---|---|---|---|
| | | | | sp:HPPD_PSESP | | P80064 |

Description

4-HYDROXYPHENYLPYRUVATE DIOXYGENASE, (4HPPD) (HPD)

| ORF Name | NTID | AAID | NT Length | AA Length | Score | Probability |
|---|---|---|---|---|---|---|
| 19769052_c1_74 | 534 | 2454 | 131 | 396 | 294 | 2.0e-25 |

| Protein name | | | | Locus Name | | Acc# |
|---|---|---|---|---|---|---|
| | | | | sp:SYK_ACICA | | Q43990 |

Description

LYSYL-TRNA SYNTHETASE, (LYSINE--TRNA LIGASE) (LYSRS)

| ORF Name | NTID | AAID | NT Length | AA Length | Score | Probability |
|---|---|---|---|---|---|---|
| 20178438_c1_80 | 535 | 2455 | 173 | 522 | 629 | 1.9e-61 |

| Protein name | | | | Locus Name | | Acc# |
|---|---|---|---|---|---|---|
| | | | | sp:HPPD_PSESP | | P80064 |

Description

4-HYDROXYPHENYLPYRUVATE DIOXYGENASE, (4HPPD) (HPD)

| ORF Name | NTID | AAID | NT Length | AA Length | Score | Probability |
|---|---|---|---|---|---|---|
| 21729513_c3_129 | 536 | 2456 | 61 | 186 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 21738306_f2_30 | 537 | 2457 | 100 | 303 | 185 | 4.9e-14 |

| Protein name | | | | Locus Name | | Acc# |
|---|---|---|---|---|---|---|
| | | | | sp:SECF_HAEIN | | P44590 |

Description

PROTEIN-EXPORT MEMBRANE PROTEIN SECF

| ORF_Name | NTID | AAID | NT Length | AA Length | Score | Probability |
|---|---|---|---|---|---|---|
| 22443750_c3_128 | 538 | 2458 | 201 | 606 | 166 | 8.1e-12 |

| Protein name | | | | Locus Name | | Acc# |
|---|---|---|---|---|---|---|
| | | | | sp:YC54_SYNY3 | | P74078 |

Description

HYPOTHETICAL 38.3 KD PROTEIN SLL1254

| ORF_Name | NTID | AAID | NT Length | AA Length | Score | Probability |
|---|---|---|---|---|---|---|
| 23572128_c1_92 | 539 | 2459 | 103 | 312 | 179 | 6.0e-13 |

| Protein name | | | | Locus Name | | Acc# |
|---|---|---|---|---|---|---|
| | | | | sp:RADA_PSEAE | | P96963 |

Description

DNA REPAIR PROTEIN RADA HOMOLOG (DNA REPAIR PROTEIN SMS HOMOLOG)

| ORF_Name | NTID | AAID | NT Length | AA Length | Score | Probability |
|---|---|---|---|---|---|---|
| 23614376_c3_119 | 540 | 2460 | 312 | 939 | 742 | 2.1e-73 |

| Protein name | | | | Locus Name | | Acc# |
|---|---|---|---|---|---|---|
| | | | | sp:EX3_HAEIN | | P44318 |

Description

EXODEOXYRIBONUCLEASE III, (EXONUCLEASE III) (EXO III)

| ORF_Name | NTID | AAID | NT Length | AA Length | Score | Probability |
|---|---|---|---|---|---|---|
| 23994182_f1_17 | 541 | 2461 | 171 | 516 | 175 | 2.5e-13 |

| Protein name | | | | Locus Name | | Acc# |
|---|---|---|---|---|---|---|
| orf1 | | | | gp:PAU39558 | | U39558 |

Description

Pseudomonas aeruginosa orf1, TolQ (tolQ), TolR (tolR), TolA (tolA),and TolB (tolB) genes, complete cds.

| ORF Name | NTID | AAID | NT Length | AA Length | Score | Probability |
|---|---|---|---|---|---|---|
| 24276625_c3_122 | 542 | 2462 | 293 | 882 | 337 | 1.7e-30 |

Protein name | | | | Locus Name | | Acc# |
| | | | | sp:YGIP_ECOLI | | P45463 |

Description

HYPOTHETICAL TRANSCRIPTIONAL REGULATOR IN BACA-TTDA INTERGENIC REGION

| ORF Name | NTID | AAID | NT Length | AA Length | Score | Probability |
|---|---|---|---|---|---|---|
| 24406575_c1_69 | 543 | 2463 | 227 | 684 | 780 | 1.9e-77 |

Protein name | | | | Locus Name | | Acc# |
| | | | | sp:LEUD_AZOVI | | P96196 |

Description (ISOPROPYLMALATE ISOMERASE) (ALPHA-IPM ISOMERASE)

| ORF Name | NTID | AAID | NT Length | AA Length | Score | Probability |
|---|---|---|---|---|---|---|
| 24415911_c3_115 | 544 | 2464 | 97 | 294 | 97 | 4.6e-05 |

Protein name: outer membrane protein H.8 precursor | Locus Name: pir:S04157 | Acc#: S04157

Description

| ORF Name | NTID | AAID | NT Length | AA Length | Score | Probability |
|---|---|---|---|---|---|---|
| 24417077_c3_121 | 545 | 2465 | 555 | 1668 | 229 | 9.9e-16 |

Protein name | | | | Locus Name | | Acc# |
| | | | | sp:DP3X_HAEIN | | P43746 |

Description

DNA POLYMERASE III SUBUNIT GAMMA/TAU,

| ORF Name | NTID | AAID | NT Length | AA Length | Score | Probability |
|---|---|---|---|---|---|---|
| 25584501_c2_110 | 546 | 2466 | 230 | 693 | | |

Protein name | | | | Locus Name | | Acc# |

Description

NO-HIT

| ORF Name | NTID | AAID | NT Length | AA Length | Score | Probability |
|---|---|---|---|---|---|---|
| 30198405_c2_100 | 547 | 2467 | 417 | 1254 | 1913 | 1.7e-197 |

| Protein name | | | | Locus Name | Acc# |
|---|---|---|---|---|---|
| | | | | sp:SYK_ACICA | Q43990 |

Description

LYSYL-TRNA SYNTHETASE, (LYSINE--TRNA LIGASE) (LYSRS)

| ORF Name | NTID | AAID | NT Length | AA Length | Score | Probability |
|---|---|---|---|---|---|---|
| 34406268_c1_70 | 548 | 2468 | 169 | 510 | | |

| Protein name | | | | Locus Name | Acc# |
|---|---|---|---|---|---|

Description

NO-HIT

| ORF Name | NTID | AAID | NT Length | AA Length | Score | Probability |
|---|---|---|---|---|---|---|
| 3912568_c2_105 | 549 | 2469 | 467 | 1404 | 819 | 1.4e-81 |

| Protein name | | | | Locus Name | Acc# |
|---|---|---|---|---|---|
| | | | | sp:NHAC_BACFI | P27611 |

Description

NA(+)/H(+) ANTIPORTER

| ORF Name | NTID | AAID | NT Length | AA Length | Score | Probability |
|---|---|---|---|---|---|---|
| 3953377_c3_117 | 550 | 2470 | 218 | 657 | 534 | 3.1e-51 |

| Protein name | | | | Locus Name | Acc# |
|---|---|---|---|---|---|
| | | | | sp:LEU2_CANMA | Q00464 |

Description

ISOMERASE) (ALPHA-IPM ISOMERASE) (IPMI)

| ORF Name | NTID | AAID | NT Length | AA Length | Score | Probability |
|---|---|---|---|---|---|---|
| 3988813_f1_4 | 551 | 2471 | 628 | 1887 | 1391 | 3.5e-142 |

| Protein name | Locus Name | Acc# |
|---|---|---|
| general protein secretion pathway subunit SecD | gp:AF179925 | AF179925 |

Description

Citrobacter freundii general protein secretion pathway subunit SecDgene, complete cds.

| ORF Name | NTID | AAID | NT Length | AA Length | Score | Probability |
|---|---|---|---|---|---|---|
| 4314068_c3_118 | 552 | 2472 | 359 | 1080 | 1356 | 1.8e-138 |

| Protein name | Locus Name | Acc# |
|---|---|---|
|  | sp:LEU3_NEILA | P50180 |

Description (IMDH) (3-IPM-DH) (FRAGMENT)

| ORF Name | NTID | AAID | NT Length | AA Length | Score | Probability |
|---|---|---|---|---|---|---|
| 4335328_c2_98 | 553 | 2473 | 62 | 189 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4487638_f1_1 | 554 | 2474 | 613 | 1842 | 1886 | 1.2e-194 |

| Protein name | Locus Name | Acc# |
|---|---|---|
|  | sp:PPCK_CHLLI | Q08262 |

Description (PHOSPHOENOLPYRUVATE CARBOXYLASE) (PEPCK)

| ORF Name | NTID | AAID | NT Length | AA Length | Score | Probability |
|---|---|---|---|---|---|---|
| 4771925_c2_94 | 555 | 2475 | 207 | 624 | 331 | 7.4e-30 |

| Protein name | | | | Locus Name | | Acc# |
|---|---|---|---|---|---|---|
| | | | | sp:RUVA_PSEAE | | Q51425 |

Description

HOLLIDAY JUNCTION DNA HELICASE RUVA

| ORF Name | NTID | AAID | NT Length | AA Length | Score | Probability |
|---|---|---|---|---|---|---|
| 4866427_f3_61 | 556 | 2476 | 289 | 870 | 247 | 5.9e-21 |

| Protein name | | | | Locus Name | | Acc# |
|---|---|---|---|---|---|---|
| hypothetical protein | | | | pir:S75235 | | S75235 |

Description

| ORF Name | NTID | AAID | NT Length | AA Length | Score | Probability |
|---|---|---|---|---|---|---|
| 4881338_f1_5 | 557 | 2477 | 287 | 864 | 420 | 2.7e-39 |

| Protein name | | | | Locus Name | | Acc# |
|---|---|---|---|---|---|---|
| | | | | sp:SECF_HAEIN | | P44590 |

Description

PROTEIN-EXPORT MEMBRANE PROTEIN SECF

| ORF Name | NTID | AAID | NT Length | AA Length | Score | Probability |
|---|---|---|---|---|---|---|
| 5084463_f2_28 | 558 | 2478 | 114 | 345 | 240 | 3.2e-20 |

| Protein name | | | | Locus Name | | Acc# |
|---|---|---|---|---|---|---|
| | | | | sp:YAJC_ECOLI | | P19677 |

Description

HYPOTHETICAL 11.9 KD PROTEIN IN TGT-SECD INTERGENIC REGION (ORF12)

| ORF Name | NTID | AAID | NT Length | AA Length | Score | Probability |
|---|---|---|---|---|---|---|
| 5111588_c3_116 | 559 | 2479 | 348 | 1047 | 1466 | 3.9e-150 |

| Protein name | | | | Locus Name | | Acc# |
|---|---|---|---|---|---|---|
| fructose-1,6-bisphosphate aldolase | | | | gp:PST011927 | | AJ011927 |

Description

Pseudomonas stutzeri fda gene and gene encoding hypothetical protein.

| ORF Name | NTID | AAID | NT Length | AA Length | Score | Probability |
|---|---|---|---|---|---|---|
| 978400_c1_83 | 560 | 2480 | 387 | 1164 | 503 | 4.4e-48 |

| Protein name | Locus Name | Acc# |
|---|---|---|
| penicillin-binding protein 4 | gp:AF156692 | AF156692 |

Description

Neisseria gonorrhoeae penicillin-binding protein 4 (pbp4) gene, complete cds.

| ORF Name | NTID | AAID | NT Length | AA Length | Score | Probability |
|---|---|---|---|---|---|---|
| 1053753_f3_63 | 561 | 2481 | 588 | 1767 | 801 | 1.2e-79 |

| Protein name | Locus Name | Acc# |
|---|---|---|
| putative membrane protein | gp:AF150928 | AF150928 |

Description

Acinetobacter sp. ADP1 BenP (benP) and AreR (areR) genes, completecds; are operon, complete sequence; SalD (salD), and SalE (salE)genes, complete cds; SalR (salR), SalA (salA), putative membraneprotein, putative 2-component regulatory protein, putativehistidine kinase of 2-component regulatory system, and carbonicanhydrase homolog genes, complete cds; and dihydropyrimidinasehomolog gene, partial cds.

| ORF Name | NTID | AAID | NT Length | AA Length | Score | Probability |
|---|---|---|---|---|---|---|
| 1058425_c2_108 | 562 | 2482 | 80 | 243 | 310 | 1.2e-27 |

| Protein name | Locus Name | Acc# |
|---|---|---|
| ribosomal protein S18 | pir:E64076 | E64076 |

Description

| ORF Name | NTID | AAID | NT Length | AA Length | Score | Probability |
|---|---|---|---|---|---|---|
| 1203450_f1_5 | 563 | 2483 | 530 | 1593 | 1297 | 3.2e-132 |

| Protein name | Locus Name | Acc# |
|---|---|---|
| | sp:YB2X_HAEIN | O86233 |

Description

HYPOTHETICAL PROTEIN HI1126.1

| ORF Name | NTID | AAID | NT Length | AA Length | Score | Probability |
|---|---|---|---|---|---|---|
| 12271926_c1_71 | 564 | 2484 | 143 | 432 | 197 | 1.2e-15 |

Protein name | | | | Locus Name | | Acc# |
| | | | | sp:YFFB_HAEIN | | P44515 |

Description

HYPOTHETICAL PROTEIN HI0103

| ORF Name | NTID | AAID | NT Length | AA Length | Score | Probability |
|---|---|---|---|---|---|---|
| 15635930_f3_61 | 565 | 2485 | 373 | 1122 | 842 | 5.2e-84 |

Protein name | | | | Locus Name | | Acc# |
| | | | | sp:QUEA_ECOLI | | P21516 |

Description (QUEUOSINE BIOSYNTHESIS PROTEIN QUEA)

| ORF Name | NTID | AAID | NT Length | AA Length | Score | Probability |
|---|---|---|---|---|---|---|
| 16134657_f2_24 | 566 | 2486 | 367 | 1104 | 895 | 1.3e-89 |

Protein name | | | | Locus Name | | Acc# |
| | | | | sp:GCST_ECOLI | | P27248 |

Description

PROTEIN)

| ORF Name | NTID | AAID | NT Length | AA Length | Score | Probability |
|---|---|---|---|---|---|---|
| 197211_c1_91 | 567 | 2487 | 240 | 723 | 304 | 5.4e-27 |

Protein name | | | | Locus Name | | Acc# |
| hypothetical protein | | | | gp:ACRBDOXN | | Z46863 |

Description

Acinetobacter sp. cysD, cobQ, sodM, lysS, rubA, rubB, estB, oxyR, ppk, mtgA, ORF2 and ORF3 genes.

| ORF Name | NTID | AAID | NT Length | AA Length | Score | Probability |
|---|---|---|---|---|---|---|
| 20890660_f3_56 | 568 | 2488 | 121 | 366 | | |

Protein name | | | | Locus Name | | Acc# |

Description

NO-HIT

| ORF Name | NTID | AAID | NT Length | AA Length | Score | Probability |
|---|---|---|---|---|---|---|
| 20915682_f1_1 | 569 | 2489 | 142 | 429 | 162 | 6.0e-12 |

| Protein name | Locus Name | Acc# |
|---|---|---|
| | sp:YIBN_ECOLI | P37688 |

Description

HYPOTHETICAL 15.6 KD PROTEIN IN SECB-TDH INTERGENIC REGION

| ORF Name | NTID | AAID | NT Length | AA Length | Score | Probability |
|---|---|---|---|---|---|---|
| 21759656_f1_8 | 570 | 2490 | 591 | 1776 | 630 | 1.6e-103 |

| Protein name | Locus Name | Acc# |
|---|---|---|
| Na(+):solute symporter (Ssf family) | pir:E70480 | E70480 |

Description

| ORF Name | NTID | AAID | NT Length | AA Length | Score | Probability |
|---|---|---|---|---|---|---|
| 22353380_f1_7 | 571 | 2491 | 89 | 270 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23438426_f2_26 | 572 | 2492 | 961 | 2886 | 2873 | 3.1e-299 |

| Protein name | Locus Name | Acc# |
|---|---|---|
| | sp:GCSP_ECOLI | P33195 |

Description (DECARBOXYLASE) (GLYCINE CLEAVAGE SYSTEM P-PROTEIN)

| ORF Name | NTID | AAID | NT Length | AA Length | Score | Probability |
|---|---|---|---|---|---|---|
| 23444531_f2_25 | 573 | 2493 | 138 | 417 | 411 | 2.5e-38 |

| Protein name | Locus Name | Acc# |
|---|---|---|
| glycine cleavage system protein H:aminomethyl carrier protein:glycine decarboxylase complex protein H | pir:A56623 | |

Description

| ORF Name | NTID | AAID | NT Length | AA Length | Score | Probability |
|---|---|---|---|---|---|---|
| 24391340_f3_47 | 574 | 2494 | 82 | 249 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 24397200_f2_32 | 575 | 2495 | 410 | 1233 | 1330 | 1.0e-135 |

| Protein name | | Locus Name | Acc# |
|---|---|---|---|
| | | sp:TGT_HAEIN | P44594 |

Description

TRANSGLYCOSYLASE) (GUANINE INSERTION ENZYME)

| ORF Name | NTID | AAID | NT Length | AA Length | Score | Probability |
|---|---|---|---|---|---|---|
| 25400263_c3_117 | 576 | 2496 | 399 | 1200 | 725 | 1.3e-71 |

| Protein name | | Locus Name | Acc# |
|---|---|---|---|
| | | sp:YCAB_PSEFR | P72190 |

Description

HYPOTHETICAL 30.2 KD PROTEIN IN CAPB 3'REGION

| ORF Name | NTID | AAID | NT Length | AA Length | Score | Probability |
|---|---|---|---|---|---|---|
| 25562762_f2_18 | 577 | 2497 | 109 | 330 | 199 | 7.2e-16 |

| Protein name | | Locus Name | Acc# |
|---|---|---|---|
| glutaredoxin 3 (grxC1) RP204 | | pir:F71731 | F71731 |

Description

| ORF Name | NTID | AAID | NT Length | AA Length | Score | Probability |
|---|---|---|---|---|---|---|
| 25626452_c3_125 | 578 | 2498 | 106 | 321 | 129 | 1.9e-08 |

| Protein name | | Locus Name | Acc# |
|---|---|---|---|
| | | sp:YCGL_ECOLI | P76003 |

Description

HYPOTHETICAL 12.4 KD PROTEIN IN MINC-SHEA INTERGENIC REGION

| ORF_Name | NTID | AAID | NT Length | AA Length | Score | Probability |
|---|---|---|---|---|---|---|
| 282550_c3_110 | 579 | 2499 | 316 | 951 | 127 | 2.3e-05 |

| Protein name | Locus Name | Acc# |
|---|---|---|
| hypothetical protein | gp:SFR236923 | AJ236923 |

Description

Shewanella frigidimarina ifcA gene and ORF2 (partial) and ORF1.

| ORF_Name | NTID | AAID | NT Length | AA Length | Score | Probability |
|---|---|---|---|---|---|---|
| 29314057_c1_90 | 580 | 2500 | 289 | 870 | 705 | 1.7e-69 |

| Protein name | Locus Name | Acc# |
|---|---|---|
| probable ion transporter | pir:E75470 | E75470 |

Description

| ORF_Name | NTID | AAID | NT Length | AA Length | Score | Probability |
|---|---|---|---|---|---|---|
| 29333458_f2_39 | 581 | 2501 | 143 | 432 | 196 | 2.7e-14 |

| Protein name | Locus Name | Acc# |
|---|---|---|
|  | sp:SYL_SYNY3 | P73274 |

Description

LEUCYL-TRNA SYNTHETASE, (LEUCINE--TRNA LIGASE) (LEURS)

| ORF_Name | NTID | AAID | NT Length | AA Length | Score | Probability |
|---|---|---|---|---|---|---|
| 30100432_f3_66 | 582 | 2502 | 361 | 1086 | 128 | 2.3e-05 |

| Protein name | Locus Name | Acc# |
|---|---|---|
|  | sp:HOLA_ECOLI | P28630 |

Description

DNA POLYMERASE III, DELTA SUBUNIT,

| ORF_Name | NTID | AAID | NT Length | AA Length | Score | Probability |
|---|---|---|---|---|---|---|
| 3298257_f1_16 | 583 | 2503 | 178 | 537 |  |  |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 35637_f2_30 | 584 | 2504 | 165 | 498 | 146 | 3.0e-10 |

Protein name: unknown
Locus Name: gp:AF064527
Acc#: AF064527

Description: Rhodocista centenaria PPH (pph) gene, complete cds; and unknown genes.

| ORF_Name | NTID | AAID | NT Length | AA Length | Score | Probability |
|---|---|---|---|---|---|---|
| 3907781_c3_126 | 585 | 2505 | 170 | 513 | | |

Protein name:
Locus Name:
Acc#:

Description: NO-HIT

| ORF_Name | NTID | AAID | NT Length | AA Length | Score | Probability |
|---|---|---|---|---|---|---|
| 3925443_c2_107 | 586 | 2506 | 136 | 411 | 369 | 6.9e-34 |

Protein name:
Locus Name: sp:RS6_ECOLI
Acc#: P02358

Description: 30S RIBOSOMAL PROTEIN S6

| ORF_Name | NTID | AAID | NT Length | AA Length | Score | Probability |
|---|---|---|---|---|---|---|
| 4003558_f1_2 | 587 | 2507 | 157 | 474 | 508 | 1.3e-48 |

Protein name:
Locus Name: sp:DUT_ECOLI
Acc#: P06968

Description: (DUTPASE) (DUTP PYROPHOSPHATASE)

| ORF_Name | NTID | AAID | NT Length | AA Length | Score | Probability |
|---|---|---|---|---|---|---|
| 4328443_f3_43 | 588 | 2508 | 151 | 456 | 393 | 2.0e-36 |

Protein name:
Locus Name: sp:SECB_ECOLI
Acc#: P15040

Description: PROTEIN-EXPORT PROTEIN SECB

| ORF Name | NTID | AAID | NT Length | AA Length | Score | Probability |
|---|---|---|---|---|---|---|
| 4860762_f3_64 | 589 | 2509 | 268 | 807 | | |

| Protein name | | | Locus Name | | Acc# |
|---|---|---|---|---|---|
| | | | | | |

Description

NO-HIT

| ORF Name | NTID | AAID | NT Length | AA Length | Score | Probability |
|---|---|---|---|---|---|---|
| 4860943_c1_89 | 590 | 2510 | 185 | 558 | 199 | 7.2e-16 |

| Protein name | | | Locus Name | | Acc# |
|---|---|---|---|---|---|
| NADPH:quinone oxidoreductase | | | gp:AF145234 | | AF145234 |

Description

Arabidopsis thaliana NADPH:quinone oxidoreductase (NQR) mRNA, complete cds.

| ORF Name | NTID | AAID | NT Length | AA Length | Score | Probability |
|---|---|---|---|---|---|---|
| 4897050_f3_44 | 591 | 2511 | 153 | 462 | 355 | 2.1e-32 |

| Protein name | | | Locus Name | | Acc# |
|---|---|---|---|---|---|
| acetylglutamate kinase | | | pir:D70477 | | D70477 |

Description

| ORF Name | NTID | AAID | NT Length | AA Length | Score | Probability |
|---|---|---|---|---|---|---|
| 50160_c1_75 | 592 | 2512 | 127 | 384 | 460 | 1.9e-42 |

| Protein name | | | Locus Name | | Acc# |
|---|---|---|---|---|---|
| haemoglobin-haptoglobin binding protein HhuA | | | gp:HIU43198 | | U43198 |

Description

Haemophilus influenzae haemoglobin-haptoglobin binding protein HhuA (hhuA) gene, complete cds.

| ORF Name | NTID | AAID | NT Length | AA Length | Score | Probability |
|---|---|---|---|---|---|---|
| 6650718_f2_40 | 593 | 2513 | 82 | 249 | | |

| Protein name | | | Locus Name | | Acc# |
|---|---|---|---|---|---|
| | | | | | |

Description

NO-HIT

| ORF_Name | NTID | AAID | NT Length | AA Length | Score | Probability |
|---|---|---|---|---|---|---|
| 6822152_c3_128 | 594 | 2514 | 160 | 483 | 438 | 3.4e-41 |

Protein name | Locus Name | Acc#
sp:RL9_ECOLI | P02418

Description
50S RIBOSOMAL PROTEIN L9

| ORF_Name | NTID | AAID | NT Length | AA Length | Score | Probability |
|---|---|---|---|---|---|---|
| 783426_f1_15 | 595 | 2515 | 766 | 2301 | 2022 | 4.8e-209 |

Protein name | Locus Name | Acc#
sp:SYL_ECOLI

Description
LEUCYL-TRNA SYNTHETASE, (LEUCINE--TRNA LIGASE) (LEURS)

| ORF_Name | NTID | AAID | NT Length | AA Length | Score | Probability |
|---|---|---|---|---|---|---|
| 860300_f2_29 | 596 | 2516 | 85 | 258 | | |

Protein name | Locus Name | Acc#

Description
NO-HIT

| ORF_Name | NTID | AAID | NT Length | AA Length | Score | Probability |
|---|---|---|---|---|---|---|
| 9803127_c1_88 | 597 | 2517 | 321 | 966 | 53 | 0.041 |

Protein name | Locus Name | Acc#
hypothetical protein (bpi 3' region) | pir:C37397 | C37397

Description

| ORF_Name | NTID | AAID | NT Length | AA Length | Score | Probability |
|---|---|---|---|---|---|---|
| 9898513_c2_101 | 598 | 2518 | 527 | 1584 | 600 | 1.3e-88 |

Protein name | Locus Name | Acc#
sp:YF67_HAEIN

Description
PROBABLE TONB-DEPENDENT RECEPTOR HI1567 PRECURSOR

| ORF Name | NTID | AAID | NT Length | AA Length | Score | Probability |
|---|---|---|---|---|---|---|
| 1040887_c1_72 | 599 | 2519 | 301 | 906 | 601 | 1.8e-58 |

| Protein name | | | | Locus Name | Acc# |
|---|---|---|---|---|---|
| | | | | gp:AB025342 | AB025342 |

Description

Moritella marina genes, complete cds, similar to eicosapentaenoicacid synthesis gene cluster.

| ORF Name | NTID | AAID | NT Length | AA Length | Score | Probability |
|---|---|---|---|---|---|---|
| 10648402_f3_46 | 600 | 2520 | 395 | 1188 | 953 | 9.0e-96 |

| Protein name | | | | Locus Name | Acc# |
|---|---|---|---|---|---|
| | | | | sp:AROF_ECOLI | P00888 |

Description

SYNTHETASE) (3-DEOXY-D-ARABINO-HEPTULOSONATE 7-PHOSPHATE SYNTHASE)

| ORF Name | NTID | AAID | NT Length | AA Length | Score | Probability |
|---|---|---|---|---|---|---|
| 10723543_f3_48 | 601 | 2521 | 73 | 222 | | |

| Protein name | | | | Locus Name | Acc# |
|---|---|---|---|---|---|

Description

NO-HIT

| ORF Name | NTID | AAID | NT Length | AA Length | Score | Probability |
|---|---|---|---|---|---|---|
| 10969087_f3_60 | 602 | 2522 | 1242 | 3729 | 2416 | 3.1e-286 |

| Protein name | | | | Locus Name | Acc# |
|---|---|---|---|---|---|
| DNA polymerase III | | | | gp:AF062919 | AF062919 |

Description

Pseudomonas fluorescens DNA polymerase III (dnaE) gene, completecds.

| ORF Name | NTID | AAID | NT Length | AA Length | Score | Probability |
|---|---|---|---|---|---|---|
| 19552252_c3_122 | 603 | 2523 | 111 | 336 | 238 | 5.3e-20 |

| Protein name | | | | Locus Name | Acc# |
|---|---|---|---|---|---|
| | | | | gp:D90863 | |

Description

E.coli genomic DNA, Kohara clone #407(52.4-52.8 min.).

205

| ORF Name | NTID | AAID | NT Length | AA Length | Score | Probability |
|---|---|---|---|---|---|---|
| 20180387_c2_104 | 604 | 2524 | 208 | 627 | 117 | 1.0e-05 |

Protein name | | | | Locus Name | | Acc#
sp:Y366_HAEIN — P43988

Description: HYPOTHETICAL PROTEIN HI0366 PRECURSOR

| ORF Name | NTID | AAID | NT Length | AA Length | Score | Probability |
|---|---|---|---|---|---|---|
| 20355003_f2_25 | 605 | 2525 | 173 | 522 | | |

Protein name | | | | Locus Name | | Acc#

Description: NO-HIT

| ORF Name | NTID | AAID | NT Length | AA Length | Score | Probability |
|---|---|---|---|---|---|---|
| 20486501_c3_115 | 606 | 2526 | 154 | 465 | 239 | 4.1e-20 |

Protein name: hypothetical protein PH0336 | Locus Name: pir:E71140 | Acc#: E71140

Description:

| ORF Name | NTID | AAID | NT Length | AA Length | Score | Probability |
|---|---|---|---|---|---|---|
| 2120263_c3_114 | 607 | 2527 | 200 | 603 | 217 | 8.9e-18 |

Protein name | | | | Locus Name: sp:YGGB_ECOLI | | Acc#: P11666

Description: (F286)

| ORF Name | NTID | AAID | NT Length | AA Length | Score | Probability |
|---|---|---|---|---|---|---|
| 22131925_c3_124 | 608 | 2528 | 387 | 1164 | 1176 | 2.1e-119 |

Protein name: AarC | Locus Name: gp:PSU67933 | Acc#: U67933

Description: Providencia stuartii AarC (aarC) gene, complete cds.

| ORF Name | NTID | AAID | NT Length | AA Length | Score | Probability |
|---|---|---|---|---|---|---|
| 24219200_f3_59 | 609 | 2529 | 413 | 1242 | 872 | 3.5e-87 |

Protein name | Locus Name | Acc#
sp:YCFD_HAEIN | P44683

Description: HYPOTHETICAL PROTEIN HI0396

| ORF Name | NTID | AAID | NT Length | AA Length | Score | Probability |
|---|---|---|---|---|---|---|
| 24412678_f2_27 | 610 | 2530 | 253 | 762 | 291 | 1.3e-25 |

Protein name | Locus Name | Acc#
sp:RNH2_VIBCH | P52021

Description: RIBONUCLEASE HII, (RNASE HII) (FRAGMENT)

| ORF Name | NTID | AAID | NT Length | AA Length | Score | Probability |
|---|---|---|---|---|---|---|
| 24423250_f3_53 | 611 | 2531 | 67 | 204 | | |

Protein name | Locus Name | Acc#

Description: NO-HIT

| ORF Name | NTID | AAID | NT Length | AA Length | Score | Probability |
|---|---|---|---|---|---|---|
| 25573802_f1_4 | 612 | 2532 | 446 | 1341 | 456 | 4.2e-43 |

Protein name: lipid-A-disaccharide synthase, | Locus Name: pir:E64180 | Acc#: E64180

Description:

| ORF Name | NTID | AAID | NT Length | AA Length | Score | Probability |
|---|---|---|---|---|---|---|
| 29407800_c1_80 | 613 | 2533 | 403 | 1212 | 1125 | 5.4e-114 |

Protein name | Locus Name | Acc#
sp:YFGB_PSEAE |

Description: HYPOTHETICAL 41.7 KD PROTEIN IN PILF-NDK INTERGENIC REGION (ORF1)

| ORF Name | NTID | AAID | NT Length | AA Length | Score | Probability |
|---|---|---|---|---|---|---|
| 3145438_c1_69 | 614 | 2534 | 485 | 1458 | 644 | 1.3e-66 |

| Protein name | | | | Locus Name | | Acc# |
|---|---|---|---|---|---|---|
| unknown | | | | gp:AF003741 | | AF003741 |

Description

Escherichia coli CFT073 pathogenicity island gene, complete cds.

| ORF Name | NTID | AAID | NT Length | AA Length | Score | Probability |
|---|---|---|---|---|---|---|
| 33882816_c1_79 | 615 | 2535 | 273 | 822 | 243 | 1.2e-41 |

| Protein name | | | | Locus Name | | Acc# |
|---|---|---|---|---|---|---|
| | | | | sp:YFCB_ECOLI | | |

Description (EC 2.1.1.72)

| ORF Name | NTID | AAID | NT Length | AA Length | Score | Probability |
|---|---|---|---|---|---|---|
| 3906293_f1_3 | 616 | 2536 | 110 | 333 | 146 | 3.0e-10 |

| Protein name | | | | Locus Name | | Acc# |
|---|---|---|---|---|---|---|
| | | | | sp:YDAL_ECOLI | | P76053 |

Description

HYPOTHETICAL 21.5 KD PROTEIN IN OGT-DBPA INTERGENIC REGION

| ORF Name | NTID | AAID | NT Length | AA Length | Score | Probability |
|---|---|---|---|---|---|---|
| 3907568_c2_105 | 617 | 2537 | 395 | 1188 | 386 | 1.1e-35 |

| Protein name | | | | Locus Name | | Acc# |
|---|---|---|---|---|---|---|
| | | | | sp:YFGL_ECOLI | | P77774 |

Description

HYPOTHETICAL 41.9 KD PROTEIN IN XSEA-HISS INTERGENIC REGION

| ORF Name | NTID | AAID | NT Length | AA Length | Score | Probability |
|---|---|---|---|---|---|---|
| 3912818_c3_125 | 618 | 2538 | 425 | 1278 | 1077 | 6.6e-109 |

Protein name:

Locus Name: sp:SYH_ECOLI

Acc#: P04804

Description: (HISRS)

| ORF Name | NTID | AAID | NT Length | AA Length | Score | Probability |
|---|---|---|---|---|---|---|
| 3945293_c3_113 | 619 | 2539 | 328 | 987 | 696 | 1.5e-68 |

Protein name:

Locus Name: sp:SOHB_HAEIN

Acc#: P45315

Description: POSSIBLE PROTEASE SOHB,

| ORF Name | NTID | AAID | NT Length | AA Length | Score | Probability |
|---|---|---|---|---|---|---|
| 3946892_c3_126 | 620 | 2540 | 280 | 843 | 164 | 6.3e-12 |

Protein name:

Locus Name: sp:Y370_HAEIN

Acc#: P43989

Description: HYPOTHETICAL PROTEIN HI0370

| ORF Name | NTID | AAID | NT Length | AA Length | Score | Probability |
|---|---|---|---|---|---|---|
| 3946917_f3_64 | 621 | 2541 | 205 | 618 | 508 | 1.3e-48 |

Protein name:

Locus Name: sp:3MGA_HAEIN

Acc#: P44321

Description: GLYCOSIDASE) (TAG)

| ORF Name | NTID | AAID | NT Length | AA Length | Score | Probability |
|---|---|---|---|---|---|---|
| 4148383_c1_83 | 622 | 2542 | 321 | 966 | 557 | 8.3e-54 |

Protein name: hypothetical protein HP0852

Locus Name: pir:D64626

Acc#: D64626

Description:

| ORF_Name | NTID | AAID | NT Length | AA Length | Score | Probability |
|---|---|---|---|---|---|---|
| 4181537_c1_88 | 623 | 2543 | 473 | 1422 | 952 | 2.2e-144 |

| Protein name | | | | Locus Name | | Acc# |
|---|---|---|---|---|---|---|
| | | | | sp:YFGK_ECOLI | | P77254 |

Description

HYPOTHETICAL GTP-BINDING PROTEIN IN XSEA-HISS INTERGENIC REGION

| ORF_Name | NTID | AAID | NT Length | AA Length | Score | Probability |
|---|---|---|---|---|---|---|
| 4460938_f2_37 | 624 | 2544 | 271 | 816 | 664 | 3.8e-65 |

| Protein name | | | | Locus Name | | Acc# |
|---|---|---|---|---|---|---|
| O-acetylserine synthase | | | | gp:AF010139 | | AF010139 |

Description

Azotobacter vinelandii iron-sulfur cluster assembly gene cluster, suhB, cysE2, iscS, iscU, iscA, hscB, hscA and fdx genes completecds; ndk gene, partial cds.

| ORF_Name | NTID | AAID | NT Length | AA Length | Score | Probability |
|---|---|---|---|---|---|---|
| 5114700_c1_86 | 625 | 2545 | 77 | 234 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 52138_c1_91 | 626 | 2546 | 109 | 330 | 199 | 1.2e-15 |

| Protein name | | | | Locus Name | | Acc# |
|---|---|---|---|---|---|---|
| solanesyl diphosphate synthase | | | | gp:AB001997 | | AB001997 |

Description

Rhodobacter capsulatus DNA for solanesyl diphosphate synthase, complete cds.

| ORF_Name | NTID | AAID | NT Length | AA Length | Score | Probability |
|---|---|---|---|---|---|---|
| 6140680_f2_36 | 627 | 2547 | 300 | 903 | 187 | 1.9e-29 |

| Protein name | | | | Locus Name | | Acc# |
|---|---|---|---|---|---|---|
| hypothetical protein b2532 | | | | pir:C65030 | | C65030 |

Description

| ORF Name | NTID | AAID | NT Length | AA Length | Score | Probability |
|---|---|---|---|---|---|---|
| 648425_c1_90 | 628 | 2548 | 87 | 264 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 10378_c2_184 | 629 | 2549 | 85 | 258 | 251 | 2.2e-21 |

| Protein name | | | | | Locus Name | Acc# |
|---|---|---|---|---|---|---|
| cold shock protein, CSPA | | | | | gp:VCCSPA | Y11908 |

Description

V.cholerae cspA gene.

| ORF Name | NTID | AAID | NT Length | AA Length | Score | Probability |
|---|---|---|---|---|---|---|
| 1063510_c2_198 | 630 | 2550 | 175 | 528 | 208 | 1.5e-15 |

| Protein name | | | | | Locus Name | Acc# |
|---|---|---|---|---|---|---|
| uridylyl transferase | | | | | gp:AB024601 | AB024601 |

Description

Pseudomonas aeruginosa dapD gene for tetrahydrodipicolinateN-succinyletransferase, complete cds, strain PAO1.

| ORF Name | NTID | AAID | NT Length | AA Length | Score | Probability |
|---|---|---|---|---|---|---|
| 1175012_c1_174 | 631 | 2551 | 411 | 1236 | 929 | 3.2e-93 |

| Protein name | | | | | Locus Name | Acc# |
|---|---|---|---|---|---|---|
| acetate kinase | | | | | pir:B75254 | B75254 |

Description

| ORF Name | NTID | AAID | NT Length | AA Length | Score | Probability |
|---|---|---|---|---|---|---|
| 11988812_c1_171 | 632 | 2552 | 161 | 486 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 12532562_c3_232 | 633 | 2553 | 299 | 900 | | |

Protein name | Locus Name | Acc#

Description

NO-HIT

| ORF Name | NTID | AAID | NT Length | AA Length | Score | Probability |
|---|---|---|---|---|---|---|
| 12542005_f3_130 | 634 | 2554 | 92 | 279 | | |

Protein name | Locus Name | Acc#

Description

NO-HIT

| ORF Name | NTID | AAID | NT Length | AA Length | Score | Probability |
|---|---|---|---|---|---|---|
| 13001052_f1_50 | 635 | 2555 | 62 | 189 | | |

Protein name | Locus Name | Acc#

Description

NO-HIT

| ORF Name | NTID | AAID | NT Length | AA Length | Score | Probability |
|---|---|---|---|---|---|---|
| 13852337_c2_202 | 636 | 2556 | 351 | 1056 | 515 | 2.3e-49 |

Protein name | Locus Name | Acc#
 | sp:APBE_HAEIN | P44550

Description

THIAMINE BIOSYNTHESIS LIPOPROTEIN APBE PRECURSOR

| ORF Name | NTID | AAID | NT Length | AA Length | Score | Probability |
|---|---|---|---|---|---|---|
| 14225300_c3_224 | 637 | 2557 | 123 | 372 | 440 | 2.1e-41 |

Protein name | Locus Name | Acc#
PII-protein | gp:AVU91902 | U91902

Description

Azotobacter vinelandii PII-protein (glnB) and methylammoniumtransport protein (amtB) genes, complete cds.

| ORF Name | NTID | AAID | NT Length | AA Length | Score | Probability |
|---|---|---|---|---|---|---|
| 15628127_f3_98 | 638 | 2558 | 72 | 219 | | |

Protein name     Locus Name     Acc#

Description

NO-HIT

| ORF Name | NTID | AAID | NT Length | AA Length | Score | Probability |
|---|---|---|---|---|---|---|
| 15630192_c3_217 | 639 | 2559 | 162 | 489 | 270 | 2.0e-25 |

Protein name     Locus Name: sp:UP04_ECOLI     Acc#

Description

UNKNOWN PROTEIN FROM 2D-PAGE (SPOT LM6)

| ORF Name | NTID | AAID | NT Length | AA Length | Score | Probability |
|---|---|---|---|---|---|---|
| 16597790_f3_131 | 640 | 2560 | 353 | 1062 | 232 | 2.6e-19 |

Protein name     Locus Name: sp:NUC1_CUNEE     Acc# P81203

Description

NUCLEASE C1,

| ORF Name | NTID | AAID | NT Length | AA Length | Score | Probability |
|---|---|---|---|---|---|---|
| 16603411_f2_85 | 641 | 2561 | 319 | 960 | 597 | 4.8e-58 |

Protein name     Locus Name: sp:YF56_HAEIN     Acc# P45250

Description

PUTATIVE 2-HYDROXYACID DEHYDROGENASE HI1556

| ORF Name | NTID | AAID | NT Length | AA Length | Score | Probability |
|---|---|---|---|---|---|---|
| 17036428_f3_138 | 642 | 2562 | 62 | 189 | | |

Protein name     Locus Name     Acc#

Description

NO-HIT

| ORF_Name | NTID | AAID | NT Length | AA Length | Score | Probability |
|---|---|---|---|---|---|---|
| 19564458_f2_55 | 643 | 2563 | 212 | 639 | 192 | 4.0e-15 |

Protein name: probable glpG protein
Locus Name: pir:D71258
Acc#: D71258

Description:

| ORF_Name | NTID | AAID | NT Length | AA Length | Score | Probability |
|---|---|---|---|---|---|---|
| 21766930_f3_100 | 644 | 2564 | 610 | 1833 | 554 | 1.7e-53 |

Protein name: hypothetical protein
Locus Name: pir:S75944
Acc#: S75944

Description:

| ORF_Name | NTID | AAID | NT Length | AA Length | Score | Probability |
|---|---|---|---|---|---|---|
| 22035932_c2_209 | 645 | 2565 | 416 | 1251 | 515 | 2.3e-49 |

Protein name: B1306.06c protein
Locus Name: gp:MLB1306
Acc#: Y13803

Description: Mycobacterium leprae cosmid B1306 DNA.

| ORF_Name | NTID | AAID | NT Length | AA Length | Score | Probability |
|---|---|---|---|---|---|---|
| 22775251_c1_144 | 646 | 2566 | 543 | 1632 | 1799 | 2.0e-185 |

Protein name: acetolactate synthase, III large chain:acetohydroxy-acid synthase III large chain
Locus Name: pir:YCEC3I
Acc#:

Description:

| ORF_Name | NTID | AAID | NT Length | AA Length | Score | Probability |
|---|---|---|---|---|---|---|
| 22890836_c2_214 | 647 | 2567 | 179 | 540 | 415 | 1.8e-41 |

Protein name:
Locus Name: gp:AHU56832
Acc#: U56832

Description: Aeromonas hydrophila FK506 binding protein (fkpA) gene, completecds in 3.9 kb fragment.

| ORF Name | NTID | AAID | NT Length | AA Length | Score | Probability |
|---|---|---|---|---|---|---|
| 23595787_c3_220 | 648 | 2568 | 150 | 453 | | |

Protein name | Locus Name | Acc#

Description

NO-HIT

| ORF Name | NTID | AAID | NT Length | AA Length | Score | Probability |
|---|---|---|---|---|---|---|
| 23718750_f2_93 | 649 | 2569 | 202 | 609 | 432 | 1.5e-40 |

Protein name | Locus Name | Acc#
| | sp:RUVC_HAEIN | P44633

Description

JUNCTION NUCLEASE RUVC) (HOLLIDAY JUCTION RESOLVASE RUVC)

| ORF Name | NTID | AAID | NT Length | AA Length | Score | Probability |
|---|---|---|---|---|---|---|
| 23727181_c2_215 | 650 | 2570 | 330 | 993 | | |

Protein name | Locus Name | Acc#

Description

NO-HIT

| ORF Name | NTID | AAID | NT Length | AA Length | Score | Probability |
|---|---|---|---|---|---|---|
| 23939008_c1_161 | 651 | 2571 | 123 | 372 | 141 | 1.0e-09 |

Protein name | Locus Name | Acc#
hypothetical protein | pir:T10511 | T10511

Description

| ORF Name | NTID | AAID | NT Length | AA Length | Score | Probability |
|---|---|---|---|---|---|---|
| 23942567_c2_212 | 652 | 2572 | 66 | 201 | | |

Protein name | Locus Name | Acc#

Description

NO-HIT

| ORF Name | NTID | AAID | NT Length | AA Length | Score | Probability |
|---|---|---|---|---|---|---|
| 23963325_f3_123 | 653 | 2573 | 403 | 1212 | 879 | 6.3e-88 |

Protein name | | | | Locus Name | | Acc# |
| | | | | sp:FADH_ECOLI | | P42593 |

Description

A REDUCTASE)

| ORF Name | NTID | AAID | NT Length | AA Length | Score | Probability |
|---|---|---|---|---|---|---|
| 24353427_c2_200 | 654 | 2574 | 546 | 1641 | 2074 | 1.5e-214 |

Protein name | | | | Locus Name | | Acc# |
| | | | | sp:CH60_YEREN | | P48219 |

Description 60) (CROSS-REACTING PROTEIN ANTIGEN)

| ORF Name | NTID | AAID | NT Length | AA Length | Score | Probability |
|---|---|---|---|---|---|---|
| 24612761_c3_246 | 655 | 2575 | 259 | 780 | 467 | 2.9e-44 |

Protein name | | | | Locus Name | | Acc# |
| | | | | sp:YMFC_HAEIN | | P44827 |

Description

HYPOTHETICAL PROTEIN HI0694

| ORF Name | NTID | AAID | NT Length | AA Length | Score | Probability |
|---|---|---|---|---|---|---|
| 24648387_c1_170 | 656 | 2576 | 282 | 849 | 926 | 6.6e-93 |

Protein name | | | | Locus Name | | Acc# |
thymidylate synthase | | | | gp:L78665 | | L78665 |

Description

Methylobacillus flagellatum aspartate aminotransferase (aat),membrane protein (orf-1), homoserine dehydrogenase (hom), andthreonine synthase (thrC) thymidylate sythase (thyA) genes,complete cds.

| ORF Name | NTID | AAID | NT Length | AA Length | Score | Probability |
|---|---|---|---|---|---|---|
| 24796885_c2_197 | 657 | 2577 | 268 | 807 | 801 | 1.2e-79 |

Protein name: | Locus Name | Acc# |
| sp:AMPM_ECOLI | P07906 |

Description: METHIONINE AMINOPEPTIDASE, (MAP) (PEPTIDASE M)

| ORF Name | NTID | AAID | NT Length | AA Length | Score | Probability |
|---|---|---|---|---|---|---|
| 25390711_c1_153 | 658 | 2578 | 414 | 1245 | 593 | 2.8e-60 |

Protein name: | Locus Name | Acc# |
| sp:MUTY_ECOLI | P17802 |

Description: A/G-SPECIFIC ADENINE GLYCOSYLASE,

| ORF Name | NTID | AAID | NT Length | AA Length | Score | Probability |
|---|---|---|---|---|---|---|
| 25412907_f1_37 | 659 | 2579 | 95 | 288 | 74 | 0.044 |

Protein name: hypothetical protein | Locus Name: gp:AP000363 | Acc#: AP000363

Description: Bacteriophage VT2-Sa, complete genome sequence.

| ORF Name | NTID | AAID | NT Length | AA Length | Score | Probability |
|---|---|---|---|---|---|---|
| 25566577_f1_23 | 660 | 2580 | 83 | 252 | | |

Protein name: | Locus Name | Acc# |

Description: NO-HIT

| ORF Name | NTID | AAID | NT Length | AA Length | Score | Probability |
|---|---|---|---|---|---|---|
| 25585263_f2_64 | 661 | 2581 | 311 | 936 | 790 | 1.7e-78 |

Protein name: diaminopimelate epimerase, | Locus Name: pir:S01913 | Acc# |

Description:

| ORF Name | NTID | AAID | NT Length | AA Length | Score | Probability |
|---|---|---|---|---|---|---|
| 26213386_c3_242 | 662 | 2582 | 404 | 1215 | 393 | 2.0e-36 |

Protein name | Locus Name | Acc#
sp:UBIH_ECOLI | P25534

Description
UBIH PROTEIN,

| ORF Name | NTID | AAID | NT Length | AA Length | Score | Probability |
|---|---|---|---|---|---|---|
| 26214428_c2_201 | 663 | 2583 | 296 | 891 | 719 | 5.7e-71 |

Protein name | Locus Name | Acc#
sp:LGT_SALTY | Q07293

Description
PROLIPOPROTEIN DIACYLGLYCERYL TRANSFERASE,

| ORF Name | NTID | AAID | NT Length | AA Length | Score | Probability |
|---|---|---|---|---|---|---|
| 29303578_f2_74 | 664 | 2584 | 69 | 210 | | |

Protein name | Locus Name | Acc#

Description
NO-HIT

| ORF Name | NTID | AAID | NT Length | AA Length | Score | Probability |
|---|---|---|---|---|---|---|
| 29380307_c2_199 | 665 | 2585 | 166 | 501 | | |

Protein name | Locus Name | Acc#

Description
NO-HIT

| ORF Name | NTID | AAID | NT Length | AA Length | Score | Probability |
|---|---|---|---|---|---|---|
| 30268885_c3_234 | 666 | 2586 | 63 | 192 | | |

Protein name | Locus Name | Acc#

Description
NO-HIT

| ORF Name | NTID | AAID | NT Length | AA Length | Score | Probability |
|---|---|---|---|---|---|---|
| 33626535_f1_51 | 667 | 2587 | 141 | 426 | | |

Protein name Locus Name Acc#

Description

NO-HIT

| ORF Name | NTID | AAID | NT Length | AA Length | Score | Probability |
|---|---|---|---|---|---|---|
| 34416075_c3_231 | 668 | 2588 | 803 | 2412 | 1247 | 6.3e-127 |

Protein name Locus Name Acc#
 sp:NFRX_AZOVI P36223

Description

TRANSFERASE) (URIDYLYL REMOVING ENZYME)

| ORF Name | NTID | AAID | NT Length | AA Length | Score | Probability |
|---|---|---|---|---|---|---|
| 35425918_c3_241 | 669 | 2589 | 176 | 531 | 302 | 8.7e-27 |

Protein name Locus Name Acc#
dihydrofolate reductase, pir:S52336 S52336

Description

| ORF Name | NTID | AAID | NT Length | AA Length | Score | Probability |
|---|---|---|---|---|---|---|
| 36051061_f2_78 | 670 | 2590 | 327 | 984 | 930 | 2.5e-93 |

Protein name Locus Name Acc#
probable 2 pir:G70875 G70875

Description

| ORF Name | NTID | AAID | NT Length | AA Length | Score | Probability |
|---|---|---|---|---|---|---|
| 3910943_c1_146 | 671 | 2591 | 343 | 1032 | 1278 | 3.3e-130 |

Protein name Locus Name Acc#
ketol-acid reductoisomerase gp:AF125563 AF125563

Description

Neisseria meningitidis NMB putative aconitate hydratase (acn), ornithine carbomyltransferase (argF), and ketol-acidreductoisomerase (ilvC) genes, complete cds.

| ORF Name | NTID | AAID | NT Length | AA Length | Score | Probability |
|---|---|---|---|---|---|---|
| 3914002_f3_114 | 672 | 2592 | 253 | 762 | | |

Protein name · Locus Name · Acc#

Description

NO-HIT

| ORF Name | NTID | AAID | NT Length | AA Length | Score | Probability |
|---|---|---|---|---|---|---|
| 3939063_f2_89 | 673 | 2593 | 469 | 1410 | 627 | 3.2e-61 |

Protein name · Locus Name: sp:MURD_ECOLI · Acc#: P14900

Description

ADDING ENZYME)

| ORF Name | NTID | AAID | NT Length | AA Length | Score | Probability |
|---|---|---|---|---|---|---|
| 3947713_f1_5 | 674 | 2594 | 260 | 783 | 594 | 1.0e-57 |

Protein name · Locus Name: sp:YAAA_HAEIN · Acc#: P43908

Description

HYPOTHETICAL PROTEIN HI0984

| ORF Name | NTID | AAID | NT Length | AA Length | Score | Probability |
|---|---|---|---|---|---|---|
| 3954638_f2_63 | 675 | 2595 | 438 | 1317 | 1067 | 7.5e-108 |

Protein name · Locus Name: sp:DCDA_PSEAE · Acc#: P19572

Description

DIAMINOPIMELATE DECARBOXYLASE, (DAP DECARBOXYLASE)

| ORF Name | NTID | AAID | NT Length | AA Length | Score | Probability |
|---|---|---|---|---|---|---|
| 3962885_c3_219 | 676 | 2596 | 181 | 546 | 486 | 2.8e-46 |

Protein name: acetolactate synthase, III small chain:acetohydroxy-acid synthase III small chain · Locus Name: pir:YCEC3H · Acc#

Description

| ORF_Name | NTID | AAID | NT Length | AA Length | Score | Probability |
|---|---|---|---|---|---|---|
| 3992035_c1_175 | 677 | 2597 | 500 | 1503 | 1163 | 4.6e-127 |

| Protein name | Locus Name | Acc# |
|---|---|---|
| | sp:PTA_HAEIN | P45107 |

Description

PHOSPHATE ACETYLTRANSFERASE, (PHOSPHOTRANSACETYLASE)

| ORF_Name | NTID | AAID | NT Length | AA Length | Score | Probability |
|---|---|---|---|---|---|---|
| 4140881_f1_40 | 678 | 2598 | 467 | 1404 | 710 | 5.1e-70 |

| Protein name | Locus Name | Acc# |
|---|---|---|
| NorM | gp:AB010463 | AB010463 |

Description

Vibrio parahaemolyticus gene for NorM, complete cds.

| ORF_Name | NTID | AAID | NT Length | AA Length | Score | Probability |
|---|---|---|---|---|---|---|
| 4147562_c1_159 | 679 | 2599 | 523 | 1572 | 1209 | 6.7e-123 |

| Protein name | Locus Name | Acc# |
|---|---|---|
| | sp:YIFB_HAEIN | P45049 |

Description

HYPOTHETICAL PROTEIN HI1117

| ORF_Name | NTID | AAID | NT Length | AA Length | Score | Probability |
|---|---|---|---|---|---|---|
| 4471887_f3_135 | 680 | 2600 | 415 | 1248 | 637 | 2.8e-62 |

| Protein name | Locus Name | Acc# |
|---|---|---|
| FtsW | gp:AF123260 | AF123260 |

Description

Coxiella burnetii FtsW (ftsW) gene, complete cds.

| ORF Name | NTID | AAID | NT Length | AA Length | Score | Probability |
|---|---|---|---|---|---|---|
| 4720313_c1_180 | 681 | 2601 | 149 | 450 | 161 | 1.2e-10 |

| Protein name | Locus Name | Acc# |
|---|---|---|
| | sp:METE_ECOLI | P25665 |

Description (COBALAMIN-INDEPENDENT METHIONINE SYNTHASE)

| ORF Name | NTID | AAID | NT Length | AA Length | Score | Probability |
|---|---|---|---|---|---|---|
| 4770887_f2_72 | 682 | 2602 | 176 | 531 | 130 | 2.7e-14 |

| Protein name | Locus Name | Acc# |
|---|---|---|
| hypothetical protein | gp:SSU18930 | Y18930 |

Description

Sulfolobus solfataricus 281 kb genomic DNA fragment, strain P2.

| ORF Name | NTID | AAID | NT Length | AA Length | Score | Probability |
|---|---|---|---|---|---|---|
| 5100010_f1_7 | 683 | 2603 | 333 | 1002 | 581 | 2.4e-56 |

| Protein name | Locus Name | Acc# |
|---|---|---|
| | sp:XERC_HAEIN | P44818 |

Description

INTEGRASE/RECOMBINASE XERC

| ORF Name | NTID | AAID | NT Length | AA Length | Score | Probability |
|---|---|---|---|---|---|---|
| 5275250_c3_235 | 684 | 2604 | 202 | 609 | 328 | 1.5e-29 |

| Protein name | Locus Name | Acc# |
|---|---|---|
| Trp repressor binding protein | gp:AF067083 | AF067083 |

Description

Vitreoscilla sp. outer membrane protein homolog gene, complete cds;Trp repressor binding protein gene, partial cds; and unknown genes.

| ORF Name | NTID | AAID | NT Length | AA Length | Score | Probability |
|---|---|---|---|---|---|---|
| 593802_f2_71 | 685 | 2605 | 506 | 1521 | 433 | 1.1e-40 |

| Protein name | Locus Name | Acc# |
|---|---|---|
| | sp:RBN_HAEIN | P44608 |

Description

RIBONUCLEASE BN, (RNASE BN)

| ORF Name | NTID | AAID | NT Length | AA Length | Score | Probability |
|---|---|---|---|---|---|---|
| 5970933_f1_15 | 686 | 2606 | 105 | 318 | 249 | 3.6e-21 |

| Protein name | Locus Name | Acc# |
|---|---|---|
| unknown protein | gp:MSGTCWPA | M15467 |

Description

M.tuberculosis 65 kDa antigen (cell wall protein a) gene.

| ORF Name | NTID | AAID | NT Length | AA Length | Score | Probability |
|---|---|---|---|---|---|---|
| 5988327_c3_227 | 687 | 2607 | 927 | 2784 | 1588 | 4.6e-163 |

| Protein name | Locus Name | Acc# |
|---|---|---|
| | sp:HEPA_ECOLI | |

Description

RNA POLYMERASE ASSOCIATED PROTEIN (ATP-DEPENDENT HELICASE HEPA)

| ORF Name | NTID | AAID | NT Length | AA Length | Score | Probability |
|---|---|---|---|---|---|---|
| 6488910_f2_94 | 688 | 2608 | 66 | 201 | 85 | 0.0050 |

| Protein name | Locus Name | Acc# |
|---|---|---|
| | sp:YIHR_ECOLI | P32139 |

Description

HYPOTHETICAL 34.0 KD PROTEIN IN GLNA-RBN INTERGENIC REGION

| ORF Name | NTID | AAID | NT Length | AA Length | Score | Probability |
|---|---|---|---|---|---|---|
| 6516885_c2_185 | 689 | 2609 | 213 | 642 | 140 | 3.5e-09 |

Protein name: putative membrane protein.
Locus Name: gp:SC6D7
Acc#: AL133213

Description: Streptomyces coelicolor cosmid 6D7.

| ORF Name | NTID | AAID | NT Length | AA Length | Score | Probability |
|---|---|---|---|---|---|---|
| 665876_c3_245 | 690 | 2610 | 552 | 1659 | 215 | 1.1e-16 |

Protein name:
Locus Name: sp:OMPA_BORAV
Acc#: Q05146

Description: OUTER MEMBRANE PROTEIN A PRECURSOR

| ORF Name | NTID | AAID | NT Length | AA Length | Score | Probability |
|---|---|---|---|---|---|---|
| 8575_c3_236 | 691 | 2611 | 140 | 423 | 343 | 4.0e-31 |

Protein name:
Locus Name: sp:CH10_PSEST
Acc#: O33499

Description: 10)

| ORF Name | NTID | AAID | NT Length | AA Length | Score | Probability |
|---|---|---|---|---|---|---|
| 859388_f2_86 | 692 | 2612 | 342 | 1029 | 537 | 1.1e-51 |

Protein name:
Locus Name: sp:ISPA_HAEIN
Acc#: P45204

Description: (FPP SYNTHASE)

| ORF Name | NTID | AAID | NT Length | AA Length | Score | Probability |
|---|---|---|---|---|---|---|
| 970625_c1_145 | 693 | 2613 | 68 | 207 | 197 | 1.1e-14 |

| Protein name | | | | Locus Name | | Acc# |
|---|---|---|---|---|---|---|
| | | | | sp:ILVI_ECOLI | | |

Description

III) (ACETOHYDROXY-ACID SYNTHASE III LARGE SUBUNIT) (ALS-III)

| ORF Name | NTID | AAID | NT Length | AA Length | Score | Probability |
|---|---|---|---|---|---|---|
| 9957828_f2_88 | 694 | 2614 | 149 | 450 | 85 | 0.00086 |

| Protein name | | | | Locus Name | | Acc# |
|---|---|---|---|---|---|---|
| transposase | | | | gp:CETC2 | | |

Description

Caenorhabditis elegans transposon Tc2.

| ORF Name | NTID | AAID | NT Length | AA Length | Score | Probability |
|---|---|---|---|---|---|---|
| 21736625_c2_11 | 695 | 2615 | 290 | 870 | 508 | 1.3e-48 |

| Protein name | | | | Locus Name | | Acc# |
|---|---|---|---|---|---|---|
| | | | | sp:APAH_HAEIN | | P44751 |

Description (DIADENOSINE TETRAPHOSPHATASE)

| ORF Name | NTID | AAID | NT Length | AA Length | Score | Probability |
|---|---|---|---|---|---|---|
| 26053825_f1_4 | 696 | 2616 | 528 | 1587 | 1002 | 5.8e-101 |

| Protein name | | | | Locus Name | | Acc# |
|---|---|---|---|---|---|---|
| | | | | sp:DNAB_ECOLI | | P03005 |

Description

REPLICATIVE DNA HELICASE,

| ORF Name | NTID | AAID | NT Length | AA Length | Score | Probability |
|---|---|---|---|---|---|---|
| 33984677_f3_6 | 697 | 2617 | 382 | 1146 | 555 | 1.4e-53 |

| Protein name | Locus Name | Acc# |
|---|---|---|
| biosynthetic alanine racemase | gp:AF165882 | AF165882 |

Description

Pseudomonas aeruginosa biosynthetic alanine racemase (alr) gene, complete cds.

| ORF Name | NTID | AAID | NT Length | AA Length | Score | Probability |
|---|---|---|---|---|---|---|
| 5181430_c3_14 | 698 | 2618 | 327 | 984 | 617 | 3.6e-60 |

| Protein name | Locus Name | Acc# |
|---|---|---|
| | sp:PDXA_ECOLI | P19624 |

Description

PYRIDOXAL PHOSPHATE BIOSYNTHETIC PROTEIN PDXA

| ORF Name | NTID | AAID | NT Length | AA Length | Score | Probability |
|---|---|---|---|---|---|---|
| 7680_c3_15 | 699 | 2619 | 295 | 888 | 603 | 1.1e-58 |

| Protein name | Locus Name | Acc# |
|---|---|---|
| | sp:KSGA_ECOLI | P06992 |

Description

DIMETHYLTRANSFERASE)

| ORF Name | NTID | AAID | NT Length | AA Length | Score | Probability |
|---|---|---|---|---|---|---|
| 10547156_c1_79 | 700 | 2620 | 1096 | 3291 | 4176 | 0.0 |

| Protein name | Locus Name | Acc# |
|---|---|---|
| carbamoylphosphate synthetase large subunit | gp:PAU81259 | |

Description

Pseudomonas aeruginosa dihydrodipicolinate reductase (dapB) gene, partial cds, carbamoylphosphate synthetase small subunit (carA) and carbamoylphosphate synthetase large subunit (carB) genes, complete cds, and FtsJ homolog (ftsJ) gene, partial cds.

| ORF Name | NTID | AAID | NT Length | AA Length | Score | Probability |
|---|---|---|---|---|---|---|
| 11915953_c1_76 | 701 | 2621 | 138 | 417 | 312 | 7.6e-28 |

Protein name: probable oxidoreductase
Locus Name: pir:T35853
Acc#: T35853

Description

| ORF Name | NTID | AAID | NT Length | AA Length | Score | Probability |
|---|---|---|---|---|---|---|
| 13947152_f2_37 | 702 | 2622 | 126 | 381 | | |

Protein name:
Locus Name:
Acc#:

Description

NO-HIT

| ORF Name | NTID | AAID | NT Length | AA Length | Score | Probability |
|---|---|---|---|---|---|---|
| 14094052_f1_20 | 703 | 2623 | 111 | 336 | 160 | 9.7e-12 |

Protein name:
Locus Name: sp:YCCK_ECOLI
Acc#:

Description

HYPOTHETICAL 12.4 KD PROTEIN IN HELD-SERT INTERGENIC REGION

| ORF Name | NTID | AAID | NT Length | AA Length | Score | Probability |
|---|---|---|---|---|---|---|
| 16601077_f2_30 | 704 | 2624 | 93 | 282 | 103 | 1.1e-05 |

Protein name: hypothetical protein
Locus Name: gp:SSU18930
Acc#: Y18930

Description

Sulfolobus solfataricus 281 kb genomic DNA fragment, strain P2.

| ORF Name | NTID | AAID | NT Length | AA Length | Score | Probability |
|---|---|---|---|---|---|---|
| 19562686_f3_66 | 705 | 2625 | 309 | 930 | 530 | 6.0e-51 |

Protein name:
Locus Name: sp:CBL_ECOLI
Acc#:

Description

TRANSCRIPTIONAL REGULATOR CBL

| ORF_Name | NTID | AAID | NT Length | AA Length | Score | Probability |
|---|---|---|---|---|---|---|
| 19571925_c3_117 | 706 | 2626 | 70 | 213 | | |

Protein name | Locus Name | Acc#

Description

NO-HIT

| ORF_Name | NTID | AAID | NT Length | AA Length | Score | Probability |
|---|---|---|---|---|---|---|
| 20313326_f2_40 | 707 | 2627 | 65 | 198 | | |

Protein name | Locus Name | Acc#

Description

NO-HIT

| ORF_Name | NTID | AAID | NT Length | AA Length | Score | Probability |
|---|---|---|---|---|---|---|
| 20488827_f1_10 | 708 | 2628 | 558 | 1677 | 1638 | 2.3e-168 |

| Protein name | Locus Name | Acc# |
|---|---|---|
| sulfite reductase | gp:AF026066 | AF026066 |

Description

Pseudomonas aeruginosa sulfite reductase (cysI) gene, complete cds.

| ORF_Name | NTID | AAID | NT Length | AA Length | Score | Probability |
|---|---|---|---|---|---|---|
| 20953402_c2_103 | 709 | 2629 | 328 | 987 | 213 | 3.2e-15 |

| Protein name | Locus Name | Acc# |
|---|---|---|
| | sp:LPPB_HAEIN | P44833 |

Description

OUTER MEMBRANE ANTIGENIC LIPOPROTEIN B PRECURSOR

| ORF_Name | NTID | AAID | NT Length | AA Length | Score | Probability |
|---|---|---|---|---|---|---|
| 21907078_f3_55 | 710 | 2630 | 66 | 201 | | |

Protein name | Locus Name | Acc#

Description

NO-HIT

| ORF Name | NTID | AAID | NT Length | AA Length | Score | Probability |
|---|---|---|---|---|---|---|
| 22766067_f1_21 | 711 | 2631 | 478 | 1437 | 96 | 0.012 |

| Protein name | Locus Name | Acc# |
|---|---|---|
| | sp:THDF_MYCGE | |

Description

POSSIBLE THIOPHENE AND FURAN OXIDATION PROTEIN THDF

| ORF Name | NTID | AAID | NT Length | AA Length | Score | Probability |
|---|---|---|---|---|---|---|
| 24251510_c2_88 | 712 | 2632 | 364 | 1095 | 746 | 7.8e-74 |

| Protein name | Locus Name | Acc# |
|---|---|---|
| hypothetical protein Rv3629c | pir:F70561 | F70561 |

Description

| ORF Name | NTID | AAID | NT Length | AA Length | Score | Probability |
|---|---|---|---|---|---|---|
| 24259555_f2_39 | 713 | 2633 | 219 | 660 | 375 | 1.6e-34 |

| Protein name | Locus Name | Acc# |
|---|---|---|
| similar to glutathione-s-transferase | gp:AF036940 | |

Description

Pseudomonas sp. U2 plasmid pWWU2, ferredoxin reductase (nagAa),salicylate-5-hydroxylase large oxygenase component (nagG),salicylate-5-hydroxylase small oxygenase component (nagH),ferredoxin (nagAb), naphthalene dioxygenase large oxygenasecomponent (nagAc), naphthalene dioxygenase small oxygenasecomponent (nagAd), cis-naphthalene dihydrodiol dehydrogenase(nagB), salicylaldehyde dehydrogenase

| ORF Name | NTID | AAID | NT Length | AA Length | Score | Probability |
|---|---|---|---|---|---|---|
| 24801562_c2_82 | 714 | 2634 | 554 | 1665 | 506 | 8.0e-73 |

| Protein name | Locus Name | Acc# |
|---|---|---|
| permease for AmpC beta-lactamase expression | gp:AF082985 | AF082985 |

Description

Pseudomonas aeruginosa permease for AmpC beta-lactamase expressionAmpG (ampG) gene, complete cds; and unknown gene.

| ORF Name | NTID | AAID | NT Length | AA Length | Score | Probability |
|---|---|---|---|---|---|---|
| 25448412_c2_95 | 715 | 2635 | 98 | 297 | 186 | 1.7e-14 |

| Protein name | Locus Name | Acc# |
|---|---|---|
| unknown | gp:AF033858 | AF033858 |

Description

Pediococcus pentosaceus strain ATCC43200 plasmid pMD136, completeplasmid sequence.

| ORF Name | NTID | AAID | NT Length | AA Length | Score | Probability |
|---|---|---|---|---|---|---|
| 29429590_f2_44 | 716 | 2636 | 162 | 489 | 241 | 2.5e-20 |

| Protein name | Locus Name | Acc# |
|---|---|---|
|  | sp:VDLD_HELPY | O05729 |

Description

PROTEIN VDLD

| ORF Name | NTID | AAID | NT Length | AA Length | Score | Probability |
|---|---|---|---|---|---|---|
| 30181587_f1_9 | 717 | 2637 | 76 | 231 | 43 | 0.037 |

| Protein name | Locus Name | Acc# |
|---|---|---|
| bone morphogenetic protein 2 | pir:A61387 | A61387 |

Description

| ORF Name | NTID | AAID | NT Length | AA Length | Score | Probability |
|---|---|---|---|---|---|---|
| 3129637_c2_94 | 718 | 2638 | 323 | 972 | 577 | 6.3e-56 |

| Protein name | Locus Name | Acc# |
|---|---|---|
| mrr restriction system protein | pir:F75508 | F75508 |

Description

| ORF Name | NTID | AAID | NT Length | AA Length | Score | Probability |
|---|---|---|---|---|---|---|
| 31375212_f3_54 | 719 | 2639 | 615 | 1848 | 1278 | 3.3e-130 |

| Protein name | Locus Name | Acc# |
|---|---|---|
|  | sp:YFBQ_ECOLI | P77727 |

Description

PROBABLE AMINOTRANSFERASE YFBQ,

| ORF_Name | NTID | AAID | NT Length | AA Length | Score | Probability |
|---|---|---|---|---|---|---|
| 32878_f2_25 | 720 | 2640 | 349 | 1050 | 176 | 1.2e-10 |

| Protein name | | | | Locus Name | Acc# |
|---|---|---|---|---|---|
| | | | | gp:ECO110K | |

Description

E.coli K12 genome, 0-2.4min. region.

| ORF_Name | NTID | AAID | NT Length | AA Length | Score | Probability |
|---|---|---|---|---|---|---|
| 33788387_c3_108 | 721 | 2641 | 66 | 201 | 87 | 0.00053 |

| Protein name | | | | Locus Name | Acc# |
|---|---|---|---|---|---|
| hypothetical protein SPCP31B10.02 | | | | pir:T41692 | T41692 |

Description

| ORF_Name | NTID | AAID | NT Length | AA Length | Score | Probability |
|---|---|---|---|---|---|---|
| 3915688_c1_78 | 722 | 2642 | 200 | 603 | 482 | 7.4e-46 |

| Protein name | | | | Locus Name | Acc# |
|---|---|---|---|---|---|
| | | | | sp:Y318_HAEIN | P43984 |

Description

HYPOTHETICAL PROTEIN HI0318

| ORF_Name | NTID | AAID | NT Length | AA Length | Score | Probability |
|---|---|---|---|---|---|---|
| 40875_f1_18 | 723 | 2643 | 126 | 381 | 189 | 8.2e-15 |

| Protein name | | | | Locus Name | Acc# |
|---|---|---|---|---|---|
| | | | | sp:YHEN_ECOLI | P45532 |

Description

HYPOTHETICAL 13.6 KD PROTEIN IN RPSL-FKPA INTERGENIC REGION

| ORF_Name | NTID | AAID | NT Length | AA Length | Score | Probability |
|---|---|---|---|---|---|---|
| 4490902_c2_101 | 724 | 2644 | 166 | 501 | 522 | 4.3e-50 |

| Protein name | | | | Locus Name | Acc# |
|---|---|---|---|---|---|
| | | | | sp:GREA_ECOLI | |

Description (GREA)

| ORF Name | NTID | AAID | NT Length | AA Length | Score | Probability |
|---|---|---|---|---|---|---|
| 4536668_c3_107 | 725 | 2645 | 940 | 2823 | 1554 | 1.9e-159 |

| Protein name | | | | Locus Name | | Acc# |
|---|---|---|---|---|---|---|
| | | | | sp:GLNE_ECOLI | | |

Description

SYNTHETASE ADENYLYLTRANSFERASE) (ATASE)

| ORF Name | NTID | AAID | NT Length | AA Length | Score | Probability |
|---|---|---|---|---|---|---|
| 4572125_c1_72 | 726 | 2646 | 311 | 936 | 820 | 1.1e-81 |

| Protein name | | | | Locus Name | | Acc# |
|---|---|---|---|---|---|---|
| unknown | | | | gp:PAU63816 | | U63816 |

Description

Pseudomonas aeruginosa glnE gene, partial cds; ilvE, ADP-heptose:LPS heptosyltransferase homolog (waaF), lipopolysaccharide heptosyltransferase I homolog (waaC), glucosyltransferase I homolog (waaG), RfaP protein (waaP), andunknown protein (waaX) genes, complete cds; and inaA gene, partialcds.

| ORF Name | NTID | AAID | NT Length | AA Length | Score | Probability |
|---|---|---|---|---|---|---|
| 5084827_f3_48 | 727 | 2647 | 163 | 492 | 193 | 1.5e-14 |

| Protein name | | | | Locus Name | | Acc# |
|---|---|---|---|---|---|---|
| | | | | sp:SURA_ECOLI | | |

Description (SURA), (PPIASE) (ROTAMASE C)

| ORF Name | NTID | AAID | NT Length | AA Length | Score | Probability |
|---|---|---|---|---|---|---|
| 5287555_c2_102 | 728 | 2648 | 125 | 378 | 125 | 5.0e-08 |

| Protein name | | | | Locus Name | | Acc# |
|---|---|---|---|---|---|---|
| | | | | sp:YC53_HAEIN | | P44139 |

Description

HYPOTHETICAL PROTEIN HI1253

| ORF Name | NTID | AAID | NT Length | AA Length | Score | Probability |
|---|---|---|---|---|---|---|
| 5322062_c1_69 | 729 | 2649 | 265 | 798 | 449 | 2.3e-42 |

| Protein name | Locus Name | Acc# |
|---|---|---|
| | sp:MOEB_ECOLI | P12282 |

Description

MOLYBDOPTERIN BIOSYNTHESIS MOEB PROTEIN

| ORF Name | NTID | AAID | NT Length | AA Length | Score | Probability |
|---|---|---|---|---|---|---|
| 6822208_c2_83 | 730 | 2650 | 296 | 891 | 502 | 5.6e-48 |

| Protein name | Locus Name | Acc# |
|---|---|---|
| | sp:HEMK_ECOLI | |

Description

HEMK PROTEIN

| ORF Name | NTID | AAID | NT Length | AA Length | Score | Probability |
|---|---|---|---|---|---|---|
| 6829637_f2_38 | 731 | 2651 | 455 | 1368 | 926 | 6.6e-93 |

| Protein name | Locus Name | Acc# |
|---|---|---|
| | sp:CYSG_ECOLI | |

Description

| ORF Name | NTID | AAID | NT Length | AA Length | Score | Probability |
|---|---|---|---|---|---|---|
| 7117182_c3_114 | 732 | 2652 | 115 | 348 | 200 | 5.6e-16 |

| Protein name | Locus Name | Acc# |
|---|---|---|
| unknown | gp:AF033858 | AF033858 |

Description

Pediococcus pentosaceus strain ATCC43200 plasmid pMD136, completeplasmid sequence.

| ORF Name | NTID | AAID | NT Length | AA Length | Score | Probability |
|---|---|---|---|---|---|---|
| 7281562_c1_77 | 733 | 2653 | 416 | 1251 | 739 | 6.4e-130 |

| Protein name | Locus Name | Acc# |
|---|---|---|
| | sp:CARA_PSEAE | P38098 |

Description

PHOSPHATE SYNTHETASE GLUTAMINE CHAIN)

| ORF Name | NTID | AAID | NT Length | AA Length | Score | Probability |
|---|---|---|---|---|---|---|
| 953181_c3_106 | 734 | 2654 | 450 | 1353 | 449 | 2.3e-42 |

| Protein name | | | | Locus Name | | Acc# |
|---|---|---|---|---|---|---|
| | | | | sp:Y16S_MYCTU | | P96936 |

Description

HYPOTHETICAL 54.8 KD PROTEIN CY20H10.28C

| ORF Name | NTID | AAID | NT Length | AA Length | Score | Probability |
|---|---|---|---|---|---|---|
| 978465_f1_19 | 735 | 2655 | 102 | 309 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 16985642_c2_43 | 736 | 2656 | 69 | 210 | 127 | 9.7e-08 |

| Protein name | | | | Locus Name | | Acc# |
|---|---|---|---|---|---|---|
| | | | | sp:MURI_SYNY3 | | P73737 |

Description

GLUTAMATE RACEMASE,

| ORF Name | NTID | AAID | NT Length | AA Length | Score | Probability |
|---|---|---|---|---|---|---|
| 189186_c3_54 | 737 | 2657 | 233 | 702 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 23628411_f1_6 | 738 | 2658 | 295 | 888 | 379 | 6.1e-35 |

| Protein name | | | | Locus Name | | Acc# |
|---|---|---|---|---|---|---|
| | | | | sp:YCHB_ECOLI | | P24209 |

Description

HYPOTHETICAL 30.9 KD PROTEIN IN HEMM-PRSA INTERGENIC REGION

| ORF Name | NTID | AAID | NT Length | AA Length | Score | Probability |
|---|---|---|---|---|---|---|
| 29494003_f2_13 | 739 | 2659 | 672 | 2019 | 241 | 6.6e-17 |

Protein name | Locus Name | Acc#
sp:YHE3_PSEAE | P42810

Description

HYPOTHETICAL 64.8 KD PROTEIN IN HEMM-HEMA INTERGENIC REGION (ORF3)

| ORF Name | NTID | AAID | NT Length | AA Length | Score | Probability |
|---|---|---|---|---|---|---|
| 29960761_c1_30 | 740 | 2660 | 468 | 1407 | 731 | 3.0e-72 |

Protein name | Locus Name | Acc#
sp:HEM1_PASMU | P95525

Description

GLUTAMYL-TRNA REDUCTASE, (GLUTR)

| ORF Name | NTID | AAID | NT Length | AA Length | Score | Probability |
|---|---|---|---|---|---|---|
| 31291251_f2_15 | 741 | 2661 | 265 | 798 | 924 | 1.1e-92 |

Protein name | Locus Name | Acc#
gp:ECOPRS | M13174

Description

E.coli prs gene encoding phosphoribosylpyrophosphate synthetase, complete cds.

| ORF Name | NTID | AAID | NT Length | AA Length | Score | Probability |
|---|---|---|---|---|---|---|
| 34641308_f3_23 | 742 | 2662 | 196 | 591 | 160 | 9.7e-12 |

Protein name | Locus Name | Acc#
sp:LOLB_PSEAE | P42812

Description

OUTER MEMBRANE LIPOPROTEIN LOLB PRECURSOR

| ORF Name | NTID | AAID | NT Length | AA Length | Score | Probability |
|---|---|---|---|---|---|---|
| 4869025_f3_19 | 743 | 2663 | 554 | 1665 | 1876 | 1.4e-193 |

| Protein name | | | | Locus Name | | Acc# |
|---|---|---|---|---|---|---|
| | | | | sp:ETFD_ACICA | | P94132 |

Description

DEHYDROGENASE) (ELECTRON-TRANSFERRING-FLAVOPROTEIN DEHYDROGENASE)

| ORF Name | NTID | AAID | NT Length | AA Length | Score | Probability |
|---|---|---|---|---|---|---|
| 10552153_f1_31 | 744 | 2664 | 74 | 225 | 168 | 7.1e-12 |

| Protein name | | | | Locus Name | | Acc# |
|---|---|---|---|---|---|---|
| | | | | gp:AB028868 | | AB028868 |

Description

Mus musculus P4(21)n mRNA, partial cds.

| ORF Name | NTID | AAID | NT Length | AA Length | Score | Probability |
|---|---|---|---|---|---|---|
| 10722125_f2_65 | 745 | 2665 | 161 | 486 | 165 | 2.9e-12 |

| Protein name | | | | Locus Name | | Acc# |
|---|---|---|---|---|---|---|
| | | | | sp:SMPA_ECOLI | | P23089 |

Description

SMALL PROTEIN A

| ORF Name | NTID | AAID | NT Length | AA Length | Score | Probability |
|---|---|---|---|---|---|---|
| 117037_f3_138 | 746 | 2666 | 218 | 657 | 375 | 1.6e-34 |

| Protein name | | | | Locus Name | | Acc# |
|---|---|---|---|---|---|---|
| | | | | sp:Y787_HAEIN | | P44052 |

Description

HYPOTHETICAL PROTEIN HI0787

| ORF Name | NTID | AAID | NT Length | AA Length | Score | Probability |
|---|---|---|---|---|---|---|
| 11885927_f1_51 | 747 | 2667 | 76 | 231 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 12297203_c3_236 | 748 | 2668 | 78 | 237 | 138 | 2.1e-09 |

| Protein name | Locus Name | Acc# |
|---|---|---|
| hypothetical protein APE2061 | pir:G72510 | G72510 |

Description

| ORF Name | NTID | AAID | NT Length | AA Length | Score | Probability |
|---|---|---|---|---|---|---|
| 12506635_f2_83 | 749 | 2669 | 66 | 201 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 12697037_c2_201 | 750 | 2670 | 111 | 336 | 99 | 2.8e-05 |

| Protein name | Locus Name | Acc# |
|---|---|---|
| | gp:PADLDH | X70925 |

Description

P.acidilactici gene for d-lactate dehydrogenase.

| ORF Name | NTID | AAID | NT Length | AA Length | Score | Probability |
|---|---|---|---|---|---|---|
| 13078416_c3_233 | 751 | 2671 | 167 | 504 | 210 | 4.9e-17 |

| Protein name | Locus Name | Acc# |
|---|---|---|
| ribosomal-protein-serine N-acetyltransferase, rimL homolog ydaF | pir:F69768 | F69768 |

Description

| ORF Name | NTID | AAID | NT Length | AA Length | Score | Probability |
|---|---|---|---|---|---|---|
| 134635_c2_226 | 752 | 2672 | 147 | 444 | 539 | 6.7e-52 |

| Protein name | Locus Name | Acc# |
|---|---|---|
| ferric uptake regulator | gp:ABDNAFUR | Y14980 |

Description

Acinetobacter baumannii fur gene.

| ORF Name | NTID | AAID | NT Length | AA Length | Score | Probability |
|---|---|---|---|---|---|---|
| 13726003_c2_196 | 753 | 2673 | 349 | 1050 | 736 | 8.9e-73 |

| Protein name | Locus Name | Acc# |
|---|---|---|
| iron transport protein:protein slr1295:protein slr1295 | pir:S74691 | S74691 |

Description

---

| ORF Name | NTID | AAID | NT Length | AA Length | Score | Probability |
|---|---|---|---|---|---|---|
| 13870462_f3_144 | 754 | 2674 | 81 | 246 | 117 | 3.5e-07 |

| Protein name | Locus Name | Acc# |
|---|---|---|
| hypothetical protein jhp1163 | pir:B71840 | B71840 |

Description

---

| ORF Name | NTID | AAID | NT Length | AA Length | Score | Probability |
|---|---|---|---|---|---|---|
| 14553432_f2_67 | 755 | 2675 | 303 | 912 | 647 | 2.4e-63 |

| Protein name | Locus Name | Acc# |
|---|---|---|
|  | sp:METR_SALTY | P05984 |

Description

TRANSCRIPTIONAL ACTIVATOR PROTEIN METR

---

| ORF Name | NTID | AAID | NT Length | AA Length | Score | Probability |
|---|---|---|---|---|---|---|
| 15820312_c2_223 | 756 | 2676 | 867 | 2604 | 1893 | 2.2e-195 |

| Protein name | Locus Name | Acc# |
|---|---|---|
| UspA2 | gp:AF113611 | AF113611 |

Description

Moraxella catarrhalis strain V1171 UspA2 (uspA2) gene, completecds.

---

| ORF Name | NTID | AAID | NT Length | AA Length | Score | Probability |
|---|---|---|---|---|---|---|
| 16016926_f3_137 | 757 | 2677 | 237 | 714 | 197 | 3.1e-15 |

| Protein name | Locus Name | Acc# |
|---|---|---|
| growth factor-responsive protein, vascular smooth muscle:SM-20 | pir:A53770 | A53770 |

Description

| ORF Name | NTID | AAID | NT Length | AA Length | Score | Probability |
|---|---|---|---|---|---|---|
| 16064061_c2_187 | 758 | 2678 | 397 | 1194 | 738 | 5.5e-73 |

| Protein name | | | | Locus Name | | Acc# |
|---|---|---|---|---|---|---|
| | | | | sp:MURG_HAEIN | | P45065 |

Description (EC 2.4.1.-)

| ORF Name | NTID | AAID | NT Length | AA Length | Score | Probability |
|---|---|---|---|---|---|---|
| 16171905_c2_202 | 759 | 2679 | 74 | 225 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 16585933_f1_11 | 760 | 2680 | 765 | 2298 | 2390 | 4.8e-248 |

| Protein name | | | | Locus Name | | Acc# |
|---|---|---|---|---|---|---|
| | | | | sp:IDH_AZOVI | | P16100 |

Description

DECARBOXYLASE) (IDH)

| ORF Name | NTID | AAID | NT Length | AA Length | Score | Probability |
|---|---|---|---|---|---|---|
| 16678186_c3_251 | 761 | 2681 | 488 | 1467 | 1057 | 8.6e-107 |

| Protein name | | | | Locus Name | | Acc# |
|---|---|---|---|---|---|---|
| hypothetical protein F32D8.4 | | | | pir:T21659 | | T21659 |

Description

| ORF Name | NTID | AAID | NT Length | AA Length | Score | Probability |
|---|---|---|---|---|---|---|
| 20080051_c1_171 | 762 | 2682 | 299 | 900 | 330 | 9.4e-30 |

| Protein name | | | | Locus Name | | Acc# |
|---|---|---|---|---|---|---|
| | | | | sp:YJJV_ECOLI | | |

Description

HYPOTHETICAL 28.9 KD PROTEIN IN OSMY-DEOC INTERGENIC REGION

| ORF_Name | NTID | AAID | NT Length | AA Length | Score | Probability |
|---|---|---|---|---|---|---|
| 20509628_c2_204 | 763 | 2683 | 378 | 1137 | 891 | 3.4e-89 |

Protein name | | | | Locus_Name | | Acc#
sp:FTSZ_ECOLI

Description
CELL DIVISION PROTEIN FTSZ

| ORF_Name | NTID | AAID | NT Length | AA Length | Score | Probability |
|---|---|---|---|---|---|---|
| 2132006_c2_218 | 764 | 2684 | 132 | 399 | 153 | 2.4e-10 |

Protein name | | | | Locus_Name | | Acc#
hypothetical protein sll1830 | | | | pir:S75232 | | S75232

Description

| ORF_Name | NTID | AAID | NT Length | AA Length | Score | Probability |
|---|---|---|---|---|---|---|
| 22048442_f2_95 | 765 | 2685 | 402 | 1209 | 1010 | 8.2e-102 |

Protein name | | | | Locus_Name | | Acc#
 | | | | sp:DAPE_HAEIN | | P44514

Description
SUCCINYL-DIAMINOPIMELATE DESUCCINYLASE, (SDAP)

| ORF_Name | NTID | AAID | NT Length | AA Length | Score | Probability |
|---|---|---|---|---|---|---|
| 22323956_f3_130 | 766 | 2686 | 61 | 186 | 109 | 6.5e-06 |

Protein name | | | | Locus_Name | | Acc#
hypothetical protein PH0221 | | | | pir:D71245 | | D71245

Description

| ORF_Name | NTID | AAID | NT Length | AA Length | Score | Probability |
|---|---|---|---|---|---|---|
| 22463311_f3_128 | 767 | 2687 | 103 | 312 | | |

Protein name | | | | Locus_Name | | Acc#

Description
NO-HIT

| ORF Name | NTID | AAID | NT Length | AA Length | Score | Probability |
|---|---|---|---|---|---|---|
| 22734807_f1_40 | 768 | 2688 | 97 | 294 | | |

Protein name | Locus Name | Acc#

Description

NO-HIT

| ORF Name | NTID | AAID | NT Length | AA Length | Score | Probability |
|---|---|---|---|---|---|---|
| 22930306_c1_170 | 769 | 2689 | 354 | 1065 | 427 | 5.0e-40 |

Protein name: 5'-nucleotidase | Locus Name: gp:CLI131243 | Acc#: AJ131243

Description

Columba livia mRNA for 5'-nucleotidase.

| ORF Name | NTID | AAID | NT Length | AA Length | Score | Probability |
|---|---|---|---|---|---|---|
| 23445136_f2_60 | 770 | 2690 | 583 | 1752 | 752 | 4.3e-120 |

Protein name: NH(3)-dependent NAD(+) synthetase | Locus Name: pir:G72277 | Acc#: G72277

Description

| ORF Name | NTID | AAID | NT Length | AA Length | Score | Probability |
|---|---|---|---|---|---|---|
| 23532300_c1_165 | 771 | 2691 | 78 | 237 | | |

Protein name | Locus Name | Acc#

Description

NO-HIT

| ORF Name | NTID | AAID | NT Length | AA Length | Score | Probability |
|---|---|---|---|---|---|---|
| 23556625_c3_245 | 772 | 2692 | 241 | 726 | 185 | 2.2e-14 |

Protein name | Locus Name: sp:FTSQ_ECOLI | Acc#: P06136

Description

CELL DIVISION PROTEIN FTSQ

| ORF Name | NTID | AAID | NT Length | AA Length | Score | Probability |
|---|---|---|---|---|---|---|
| 23615832_f1_16 | 773 | 2693 | 334 | 1005 | 125 | 9.1e-09 |

Protein name | Locus Name | Acc#
lysophospholipase homolog | pir:T02661 | T02661

Description

| ORF Name | NTID | AAID | NT Length | AA Length | Score | Probability |
|---|---|---|---|---|---|---|
| 24111015_c3_269 | 774 | 2694 | 154 | 465 | 274 | 8.1e-24 |

Protein name | Locus Name | Acc#
 | sp:RIBF_ECOLI |

Description

| ORF Name | NTID | AAID | NT Length | AA Length | Score | Probability |
|---|---|---|---|---|---|---|
| 24219056_c1_184 | 775 | 2695 | 246 | 741 | 512 | 4.9e-49 |

Protein name | Locus Name | Acc#
 | sp:YPT5_PSEAE | P24562

Description
HYPOTHETICAL 24.5 KD PROTEIN IN PILT 5'REGION (ORF5)

| ORF Name | NTID | AAID | NT Length | AA Length | Score | Probability |
|---|---|---|---|---|---|---|
| 24220786_f1_4 | 776 | 2696 | 370 | 1113 | 835 | 2.9e-83 |

Protein name | Locus Name | Acc#
 | sp:PILT_PSEAE | P24559

Description
TWITCHING MOBILITY PROTEIN

| ORF Name | NTID | AAID | NT Length | AA Length | Score | Probability |
|---|---|---|---|---|---|---|
| 24250928_c1_153 | 777 | 2697 | 78 | 237 | 207 | 1.0e-16 |

Protein name | Locus Name | Acc#
 | sp:YFHJ_ECOLI | P37096

Description
HYPOTHETICAL 7.7 KD PROTEIN IN PPEB-FDX INTERGENIC REGION

242

| ORF_Name | NTID | AAID | NT Length | AA Length | Score | Probability |
|---|---|---|---|---|---|---|
| 24255260_c2_229 | 778 | 2698 | 115 | 348 | | |// 
| Protein name | | | | | Locus Name | Acc# |

Description

NO-HIT

| ORF_Name | NTID | AAID | NT Length | AA Length | Score | Probability |
|---|---|---|---|---|---|---|
| 24412562_c2_189 | 779 | 2699 | 314 | 945 | 740 | 3.4e-73 |
| Protein name | | | | | Locus Name | Acc# |
| | | | | | sp:DDL_HAEIN | P44405 |

Description

D-ALANINE--D-ALANINE LIGASE, (D-ALANYLALANINE SYNTHETASE)

| ORF_Name | NTID | AAID | NT Length | AA Length | Score | Probability |
|---|---|---|---|---|---|---|
| 24415875_c1_174 | 780 | 2700 | 322 | 969 | 832 | 6.0e-83 |
| Protein name | | | | | Locus Name | Acc# |
| | | | | | sp:HEMZ_ECOLI | |

Description

SYNTHETASE)

| ORF_Name | NTID | AAID | NT Length | AA Length | Score | Probability |
|---|---|---|---|---|---|---|
| 24644577_f2_96 | 781 | 2701 | 535 | 1608 | 923 | 1.4e-92 |
| Protein name | | | | | Locus Name | Acc# |
| hypothetical protein | | | | | pir:S76051 | S76051 |

Description

| ORF_Name | NTID | AAID | NT Length | AA Length | Score | Probability |
|---|---|---|---|---|---|---|
| 24813161_f3_143 | 782 | 2702 | 344 | 1035 | 650 | 1.2e-63 |
| Protein name | | | | | Locus Name | Acc# |
| MsmX | | | | | gp:AB013374 | AB013374 |

Description

Bacillus halodurans C-125 mamX, yjdA, ykoK and yvfK genes, partial and complete cds.

| ORF Name | NTID | AAID | NT Length | AA Length | Score | Probability |
|---|---|---|---|---|---|---|
| 25579510_f3_109 | 783 | 2703 | 156 | 471 | 99 | 0.0018 |

| Protein name | Locus Name | Acc# |
|---|---|---|
| myosin alpha heavy chain, masticatory muscle | pir:S33732 | S33732 |

Description

| ORF Name | NTID | AAID | NT Length | AA Length | Score | Probability |
|---|---|---|---|---|---|---|
| 26212750_c2_205 | 784 | 2704 | 329 | 990 | 285 | 7.8e-25 |

| Protein name | Locus Name | Acc# |
|---|---|---|
| | gp:ATAC006436 | AC006436 |

Description

Arabidopsis thaliana chromosome II BAC F13J11 genomic sequence, complete sequence.

| ORF Name | NTID | AAID | NT Length | AA Length | Score | Probability |
|---|---|---|---|---|---|---|
| 26678567_c1_164 | 785 | 2705 | 63 | 192 | 88 | 0.00042 |

| Protein name | Locus Name | Acc# |
|---|---|---|
| hypothetical protein 29.1 | pir:S59084 | S59084 |

Description

| ORF Name | NTID | AAID | NT Length | AA Length | Score | Probability |
|---|---|---|---|---|---|---|
| 26813135_c2_192 | 786 | 2706 | 524 | 1575 | 1287 | 3.7e-131 |

| Protein name | Locus Name | Acc# |
|---|---|---|
| alkyl hydroperoxide reductase, F52A protein | pir:D64794 | D64794 |

Description

| ORF Name | NTID | AAID | NT Length | AA Length | Score | Probability |
|---|---|---|---|---|---|---|
| 273427_c3_263 | 787 | 2707 | 224 | 675 | 583 | 1.5e-56 |

| Protein name | Locus Name | Acc# |
|---|---|---|
| | sp:DEDA_ECOLI | P09548 |

Description

DEDA PROTEIN (DSG-1 PROTEIN)

| ORF_Name | NTID | AAID | NT Length | AA Length | Score | Probability |
|---|---|---|---|---|---|---|
| 29337825_f2_62 | 788 | 2708 | 67 | 204 | 131 | 1.2e-08 |

| Protein name | | Locus_Name | Acc# |
|---|---|---|---|
| | | sp:YPT1_PSEAE | P24560 |

Description

HYPOTHETICAL 17.0 KD PROTEIN IN PILT 5'REGION (ORF1)

| ORF_Name | NTID | AAID | NT Length | AA Length | Score | Probability |
|---|---|---|---|---|---|---|
| 31252614_c3_231 | 789 | 2709 | 68 | 207 | 85 | 0.0054 |

| Protein name | | Locus_Name | Acc# |
|---|---|---|---|
| glutathione synthetase | | gp:D88540 | D88540 |

Description

Synechococcus sp. DNA for glutathione synthetase, complete cds.

| ORF_Name | NTID | AAID | NT Length | AA Length | Score | Probability |
|---|---|---|---|---|---|---|
| 3236505_c2_217 | 790 | 2710 | 119 | 360 | 127 | 1.7e-07 |

| Protein name | | Locus_Name | Acc# |
|---|---|---|---|
| hypothetical protein sll1830 | | pir:S75232 | S75232 |

Description

| ORF_Name | NTID | AAID | NT Length | AA Length | Score | Probability |
|---|---|---|---|---|---|---|
| 32593750_f1_27 | 791 | 2711 | 366 | 1101 | 1382 | 3.1e-141 |

| Protein name | | Locus_Name | Acc# |
|---|---|---|---|
| | | sp:RECA_ACICA | P42438 |

Description

RECA PROTEIN

| ORF_Name | NTID | AAID | NT Length | AA Length | Score | Probability |
|---|---|---|---|---|---|---|
| 33788286_c2_188 | 792 | 2712 | 493 | 1482 | 1448 | 3.2e-148 |

| Protein name | | Locus_Name | Acc# |
|---|---|---|---|
| UDP-N-acetylmuramate:L-alanine ligase MurC | | gp:AF110740 | AF110740 |

Description

Pseudomonas aeruginosa UDP-N-acetylmuramate:L-alanine ligase MurC(murC) gene, complete cds.

| ORF Name | NTID | AAID | NT Length | AA Length | Score | Probability |
|---|---|---|---|---|---|---|
| 34040777_c1_169 | 793 | 2713 | 196 | 591 | 93 | 0.00011 |

| Protein name | | | | Locus Name | | Acc# |
|---|---|---|---|---|---|---|
| | | | | sp:PPDD_ECOLI | | P36647 |

Description

PREPILIN PEPTIDASE DEPENDENT PROTEIN D PRECURSOR

| ORF Name | NTID | AAID | NT Length | AA Length | Score | Probability |
|---|---|---|---|---|---|---|
| 34159412_f1_53 | 794 | 2714 | 330 | 993 | 497 | 1.9e-47 |

| Protein name | | | | Locus Name | | Acc# |
|---|---|---|---|---|---|---|
| oxidative stress transcriptional regulator | | | | gp:XCU94336 | | U94336 |

Description

Xanthomonas campestris alkyl hydroperoxide reductase subunits C(ahpC) and F (ahpF) and oxidative stress transcriptional regulator(oxyR) genes, complete cds.

| ORF Name | NTID | AAID | NT Length | AA Length | Score | Probability |
|---|---|---|---|---|---|---|
| 35276891_f3_132 | 795 | 2715 | 80 | 243 | 88 | 0.00042 |

| Protein name | | | | Locus Name | | Acc# |
|---|---|---|---|---|---|---|
| hypothetical protein | | | | pir:D75542 | | D75542 |

Description

| ORF Name | NTID | AAID | NT Length | AA Length | Score | Probability |
|---|---|---|---|---|---|---|
| 3907311_f3_110 | 796 | 2716 | 74 | 225 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 3928750_c3_242 | 797 | 2717 | 298 | 897 | 412 | 1.9e-38 |

| Protein name | | | | Locus Name | | Acc# |
|---|---|---|---|---|---|---|
| | | | | sp:YHIR_HAEIN | | P31777 |

Description

HYPOTHETICAL PROTEIN HI0441 (ORFJ)

| ORF Name | NTID | AAID | NT Length | AA Length | Score | Probability |
|---|---|---|---|---|---|---|
| 3940943_f2_59 | 798 | 2718 | 118 | 357 | 93 | 0.00012 |
| Protein name | | | | Locus Name | | Acc# |
| | | | | sp:YGFE_ECOLI | | P45580 |

Description

HYPOTHETICAL 12.6 KD PROTEIN IN PEPP-SSR INTERGENIC REGION (O109)

| ORF Name | NTID | AAID | NT Length | AA Length | Score | Probability |
|---|---|---|---|---|---|---|
| 3947318_f3_116 | 799 | 2719 | 276 | 831 | 1038 | 8.9e-105 |
| Protein name | | | | Locus Name | | Acc# |
| | | | | sp:DAPD_MYCBO | | P56220 |

Description (THP SUCCINYLTRANSFERASE) (TETRAHYDROPICOLINATE SUCCINYLASE)

| ORF Name | NTID | AAID | NT Length | AA Length | Score | Probability |
|---|---|---|---|---|---|---|
| 4017832_f2_85 | 800 | 2720 | 211 | 636 | 525 | 2.0e-50 |
| Protein name | | | | Locus Name | | Acc# |
| DedA family protein | | | | pir:B75253 | | B75253 |

Description

| ORF Name | NTID | AAID | NT Length | AA Length | Score | Probability |
|---|---|---|---|---|---|---|
| 4023342_c1_186 | 801 | 2721 | 215 | 648 | 145 | 3.8e-10 |
| Protein name | | | | Locus Name | | Acc# |
| | | | | sp:YGFB_ECOLI | | P25533 |

Description (F194)

| ORF Name | NTID | AAID | NT Length | AA Length | Score | Probability |
|---|---|---|---|---|---|---|
| 402336_f2_89 | 802 | 2722 | 83 | 252 | | |
| Protein name | | | | Locus Name | | Acc# |

Description

NO-HIT

| ORF Name | NTID | AAID | NT Length | AA Length | Score | Probability |
|---|---|---|---|---|---|---|
| 4140943_f2_73 | 803 | 2723 | 157 | 474 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4331430_f1_28 | 804 | 2724 | 313 | 942 | 124 | 2.4e-16 |

| Protein name | | | | | Locus Name | Acc# |
|---|---|---|---|---|---|---|
| | | | | | sp:RECX_VIBCH | Q56647 |

Description

REGULATORY PROTEIN RECX

| ORF Name | NTID | AAID | NT Length | AA Length | Score | Probability |
|---|---|---|---|---|---|---|
| 4332837_c3_256 | 805 | 2725 | 105 | 318 | 149 | 6.7e-10 |

| Protein name | | | | | Locus Name | Acc# |
|---|---|---|---|---|---|---|
| hypothetical protein sll1830 | | | | | pir:S75232 | S75232 |

Description

| ORF Name | NTID | AAID | NT Length | AA Length | Score | Probability |
|---|---|---|---|---|---|---|
| 4348813_c3_259 | 806 | 2726 | 350 | 1053 | 1035 | 1.8e-104 |

| Protein name | | | | | Locus Name | Acc# |
|---|---|---|---|---|---|---|
| | | | | | sp:GCP_HAEIN | P43764 |

Description (GLYCOPROTEASE)

| ORF Name | NTID | AAID | NT Length | AA Length | Score | Probability |
|---|---|---|---|---|---|---|
| 4694427_f3_114 | 807 | 2727 | 362 | 1089 | 884 | 1.9e-88 |

| Protein name | | | | | Locus Name | Acc# |
|---|---|---|---|---|---|---|
| | | | | | sp:LIPA_HAEIN | P44463 |

Description

LIPOIC ACID SYNTHETASE (LIP-SYN) (LIPOATE SYNTHASE)

| ORF Name | NTID | AAID | NT Length | AA Length | Score | Probability |
|---|---|---|---|---|---|---|
| 4773260_f2_79 | 808 | 2728 | 79 | 240 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4798536_c2_191 | 809 | 2729 | 212 | 639 | 685 | 2.3e-67 |

| Protein name | Locus Name | Acc# |
|---|---|---|
| alkyl hydroperoxide reductase subunit C | gp:AF129406 | AF129406 |

Description

Bacteroides fragilis alkyl hydroperoxide reductase subunit C (ahpC)and alkyl hydroperoxide reductase subunit F (ahpF) genes, completecds.

| ORF Name | NTID | AAID | NT Length | AA Length | Score | Probability |
|---|---|---|---|---|---|---|
| 4824062_c2_200 | 810 | 2730 | 273 | 822 | 353 | 3.4e-32 |

| Protein name | Locus Name | Acc# |
|---|---|---|
| | sp:PSS_HELPY | |

Description (PHOSPHATIDYLSERINE SYNTHASE)

| ORF Name | NTID | AAID | NT Length | AA Length | Score | Probability |
|---|---|---|---|---|---|---|
| 6110943_c2_203 | 811 | 2731 | 435 | 1308 | 303 | 3.5e-26 |

| Protein name | Locus Name | Acc# |
|---|---|---|
| | sp:FTSA_BUCAP | O51928 |

Description

CELL DIVISION PROTEIN FTSA

| ORF Name | NTID | AAID | NT Length | AA Length | Score | Probability |
|---|---|---|---|---|---|---|
| 659686_c2_210 | 812 | 2732 | 278 | 837 | 485 | 3.5e-46 |

| Protein name | Locus Name | Acc# |
|---|---|---|
| | sp:YGDL_HAEIN | |

Description

HYPOTHETICAL PROTEIN HI0118

249

| ORF Name | NTID | AAID | NT Length | AA Length | Score | Probability |
|---|---|---|---|---|---|---|
| 6754081_c3_235 | 813 | 2733 | 254 | 765 | 169 | 1.1e-12 |
| Protein name | | | | Locus Name | | Acc# |
| hypothetical protein MTH939 | | | | pir:G69225 | | G69225 |

Description

| ORF Name | NTID | AAID | NT Length | AA Length | Score | Probability |
|---|---|---|---|---|---|---|
| 681453_f3_127 | 814 | 2734 | 84 | 255 | 76 | 0.038 |
| Protein name | | | | Locus Name | | Acc# |
| | | | | sp:YXEH_BACSU | | P54947 |

Description

HYPOTHETICAL 30.2 KD PROTEIN IN IDH-DEOR INTERGENIC REGION

| ORF Name | NTID | AAID | NT Length | AA Length | Score | Probability |
|---|---|---|---|---|---|---|
| 682641_f1_42 | 815 | 2735 | 86 | 261 | 100 | 2.2e-05 |
| Protein name | | | | Locus Name | | Acc# |
| hypothetical protein PH0217 | | | | pir:G71244 | | G71244 |

Description

| ORF Name | NTID | AAID | NT Length | AA Length | Score | Probability |
|---|---|---|---|---|---|---|
| 7222187_f1_35 | 816 | 2736 | 245 | 738 | 287 | 3.4e-25 |
| Protein name | | | | Locus Name | | Acc# |
| conserved hypothetical protein ykrA | | | | pir:C69862 | | C69862 |

Description

| ORF Name | NTID | AAID | NT Length | AA Length | Score | Probability |
|---|---|---|---|---|---|---|
| 781563_c2_227 | 817 | 2737 | 113 | 342 | 265 | 7.3e-23 |
| Protein name | | | | Locus Name | | Acc# |
| | | | | sp:YPT6_PSEAE | | P24564 |

Description

HYPOTHETICAL 19.5 KD PROTEIN IN PILT REGION (ORF6)

| ORF Name | NTID | AAID | NT Length | AA Length | Score | Probability |
|---|---|---|---|---|---|---|
| 812535_f1_43 | 818 | 2738 | 77 | 234 | | |

Protein name                                              Locus Name              Acc#

Description

NO-HIT

| ORF Name | NTID | AAID | NT Length | AA Length | Score | Probability |
|---|---|---|---|---|---|---|
| 10625252_f1_3 | 819 | 2739 | 581 | 1746 | 1790 | 1.8e-184 |

Protein name                                              Locus Name              Acc#
                                                          sp:SYP_HAEIN            P43830

Description

PROLYL-TRNA SYNTHETASE, (PROLINE--TRNA LIGASE) (PRORS)

| ORF Name | NTID | AAID | NT Length | AA Length | Score | Probability |
|---|---|---|---|---|---|---|
| 20496062_c2_30 | 820 | 2740 | 408 | 1227 | 1522 | 4.6e-156 |

Protein name                                              Locus Name              Acc#
                                                          sp:TRPB_ACICA           P16706

Description

TRYPTOPHAN SYNTHASE BETA CHAIN,

| ORF Name | NTID | AAID | NT Length | AA Length | Score | Probability |
|---|---|---|---|---|---|---|
| 22847180_c1_17 | 821 | 2741 | 213 | 642 | 568 | 5.7e-55 |

Protein name                                              Locus Name              Acc#
                                                          sp:YADG_ECOLI           P36879

Description

HYPOTHETICAL ABC TRANSPORTER ATP-BINDING PROTEIN YADG

| ORF Name | NTID | AAID | NT Length | AA Length | Score | Probability |
|---|---|---|---|---|---|---|
| 24642268_c3_37 | 822 | 2742 | 213 | 642 | 510 | 7.9e-49 |

Protein name                                              Locus Name              Acc#
                                                          sp:TRPF_ACICA           P16923

Description

N-(5'-PHOSPHORIBOSYL)ANTHRANILATE ISOMERASE, (PRAI)

| ORF Name | NTID | AAID | NT Length | AA Length | Score | Probability |
|---|---|---|---|---|---|---|
| 24814125_c2_31 | 823 | 2743 | 285 | 858 | 541 | 4.1e-52 |

| Protein name | | | | Locus Name | | Acc# |
|---|---|---|---|---|---|---|
| tryptophan synthase alpha chain | | | | gp:AF107094 | | AF107094 |

Description

Rhodobacter sphaeroides thiamine biosynthetic protein (thi) gene, partial cds; and tryptophan synthase alpha chain (trpA) gene, complete cds.

| ORF Name | NTID | AAID | NT Length | AA Length | Score | Probability |
|---|---|---|---|---|---|---|
| 30727194_c2_24 | 824 | 2744 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 3941642_c2_25 | 825 | 2745 | 100 | 303 | 224 | 1.6e-18 |

| Protein name | | | | Locus Name | | Acc# |
|---|---|---|---|---|---|---|
| | | | | sp:YADG_ECOLI | | P36879 |

Description

HYPOTHETICAL ABC TRANSPORTER ATP-BINDING PROTEIN YADG

| ORF Name | NTID | AAID | NT Length | AA Length | Score | Probability |
|---|---|---|---|---|---|---|
| 4181557_c1_19 | 826 | 2746 | 281 | 846 | 553 | 2.2e-53 |

| Protein name | | | | Locus Name | | Acc# |
|---|---|---|---|---|---|---|
| | | | | sp:YQCD_ECOLI | | Q46920 |

Description

HYPOTHETICAL 32.6 KD PROTEIN IN SYD-SDAC INTERGENIC REGION

| ORF Name | NTID | AAID | NT Length | AA Length | Score | Probability |
|---|---|---|---|---|---|---|
| 4426338_c2_26 | 827 | 2747 | 260 | 783 | 744 | 1.3e-73 |

| Protein name | | | | Locus Name | | Acc# |
|---|---|---|---|---|---|---|
| | | | | sp:YADH_ECOLI | | |

Description

HYPOTHETICAL 28.5 KD PROTEIN IN HPT-PAND INTERGENIC REGION

| ORF Name | NTID | AAID | NT Length | AA Length | Score | Probability |
|---|---|---|---|---|---|---|
| 5120412_c3_32 | 828 | 2748 | 186 | 561 | 196 | 1.5e-15 |

| Protein name | Locus Name | Acc# |
|---|---|---|
| cytochrome c5 | gp:AVU94420 | U94420 |

Description

Azotobacter vinelandii aldehyde dehydrogenase (aldh) gene, partialcds, cytochrome c5 (cycB) gene, complete cds, and xanthinephosphoribosyltransferase-like protein (xrpt) gene, partial cds.

| ORF Name | NTID | AAID | NT Length | AA Length | Score | Probability |
|---|---|---|---|---|---|---|
| 7031312_c3_33 | 829 | 2749 | 66 | 201 | 129 | 7.5e-08 |

| Protein name | Locus Name | Acc# |
|---|---|---|
| | sp:YADG_ECOLI | P36879 |

Description

HYPOTHETICAL ABC TRANSPORTER ATP-BINDING PROTEIN YADG

| ORF Name | NTID | AAID | NT Length | AA Length | Score | Probability |
|---|---|---|---|---|---|---|
| 11198430_c3_60 | 830 | 2750 | 692 | 2079 | 3292 | 0.0 |

| Protein name | Locus Name | Acc# |
|---|---|---|
| lactoferrin binding protein B | gp:AF043131 | AF043131 |

Description

Moraxella catarrhalis strain 4223 lactoferrin binding protein B(lbpB) and lactoferrin binding protein A (lbpA) genes, completecds; and unknown genes.

| ORF Name | NTID | AAID | NT Length | AA Length | Score | Probability |
|---|---|---|---|---|---|---|
| 16128933_c2_53 | 831 | 2751 | 159 | 480 | 377 | 9.9e-35 |

| Protein name | Locus Name | Acc# |
|---|---|---|
| apolipoprotein N-acyltransferase | gp:AF038595 | AF038595 |

Description

Pseudomonas aeruginosa apolipoprotein N-acyltransferase (cutE)gene, complete cds.

| ORF Name | NTID | AAID | NT Length | AA Length | Score | Probability |
|---|---|---|---|---|---|---|
| 19704378_c3_64 | 832 | 2752 | 606 | 1821 | 1227 | 8.3e-125 |

| Protein name | Locus Name | Acc# |
|---|---|---|
| unknown | gp:AF043132 | AF043132 |

Description

Moraxella catarrhalis strain Q8 lactoferrin binding protein B(lbpB) and lactoferrin binding protein A (lbpA) genes, completecds; and unknown genes.

| ORF Name | NTID | AAID | NT Length | AA Length | Score | Probability |
|---|---|---|---|---|---|---|
| 24337826_c3_67 | 833 | 2753 | 718 | 2157 | 278 | 2.9e-21 |

| Protein name | Locus Name | Acc# |
|---|---|---|
| hypothetical protein K08H10.2a | pir:T23512 | |

Description

| ORF Name | NTID | AAID | NT Length | AA Length | Score | Probability |
|---|---|---|---|---|---|---|
| 34164812_c2_54 | 834 | 2754 | 198 | 597 | 712 | 1.6e-80 |

| Protein name | Locus Name | Acc# |
|---|---|---|
| lactoferrin binding protein B | gp:AF043133 | AF043133 |

Description

Moraxella catarrhalis strain VH19 lactoferrin binding protein B(lbpB) gene, complete cds.

| ORF Name | NTID | AAID | NT Length | AA Length | Score | Probability |
|---|---|---|---|---|---|---|
| 35837503_f2_26 | 835 | 2755 | 61 | 186 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 35945257_c1_46 | 836 | 2756 | 67 | 204 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3906263_c2_55 | 837 | 2757 | 1003 | 3012 | 5252 | 0.0 |

| Protein name | Locus Name | Acc# |
|---|---|---|
| lactoferrin binding protein A | gp:AF043131 | AF043131 |

Description

Moraxella catarrhalis strain 4223 lactoferrin binding protein B(lbpB) and lactoferrin binding protein A (lbpA) genes, completecds; and unknown genes.

| ORF Name | NTID | AAID | NT Length | AA Length | Score | Probability |
|---|---|---|---|---|---|---|
| 3945388_f3_30 | 838 | 2758 | 413 | 1242 | 1219 | 5.9e-124 |

| Protein name | Locus Name | Acc# |
|---|---|---|
| beta-ketoacyl-ACP synthase I | gp:PAU70470 | U70470 |

Description

Pseudomonas aeruginosa lemA-type sensor kinase/response regulatorhomolog gene, partial cds, beta-hydroxy-ACP dehydrase (fabA) andbeta-ketoacyl-ACP synthase I (fabB) genes, complete cds.

| ORF Name | NTID | AAID | NT Length | AA Length | Score | Probability |
|---|---|---|---|---|---|---|
| 4005250_c3_68 | 839 | 2759 | 163 | 492 | 572 | 2.1e-55 |

| Protein name | Locus Name | Acc# |
|---|---|---|
| ribosomal protein S12:streptomycin resistance protein | pir:A42939 | |

Description

| ORF Name | NTID | AAID | NT Length | AA Length | Score | Probability |
|---|---|---|---|---|---|---|
| 4093767_c3_63 | 840 | 2760 | 544 | 1635 | 2854 | 3.2e-297 |

| Protein name | Locus Name | Acc# |
|---|---|---|
| unknown | gp:AF043131 | AF043131 |

Description

Moraxella catarrhalis strain 4223 lactoferrin binding protein B(lbpB) and lactoferrin binding protein A (lbpA) genes, completecds; and unknown genes.

| ORF Name | NTID | AAID | NT Length | AA Length | Score | Probability |
|---|---|---|---|---|---|---|
| 4804632_f2_17 | 841 | 2761 | 485 | 1458 | 572 | 2.1e-55 |

| Protein name | | | | Locus Name | | Acc# |
|---|---|---|---|---|---|---|
| | | | | sp:PABB_SALTY | | P12680 |

Description

PARA-AMINOBENZOATE SYNTHASE COMPONENT I, (ADC SYNTHASE)

| ORF Name | NTID | AAID | NT Length | AA Length | Score | Probability |
|---|---|---|---|---|---|---|
| 1018_c1_12 | 842 | 2762 | 229 | 690 | 163 | 4.7e-12 |

| Protein name | | | | Locus Name | | Acc# |
|---|---|---|---|---|---|---|
| | | | | gp:BPMB78P21 | | X87092 |

Description

Bacteriophage MB78 ORFs p21, p11.5, p26 & p28.

| ORF Name | NTID | AAID | NT Length | AA Length | Score | Probability |
|---|---|---|---|---|---|---|
| 12303577_c1_11 | 843 | 2763 | 105 | 318 | | |

| Protein name | | | | Locus Name | | Acc# |

Description

NO-HIT

| ORF Name | NTID | AAID | NT Length | AA Length | Score | Probability |
|---|---|---|---|---|---|---|
| 19557893_c2_17 | 844 | 2764 | 126 | 381 | | |

| Protein name | | | | Locus Name | | Acc# |

Description

NO-HIT

| ORF Name | NTID | AAID | NT Length | AA Length | Score | Probability |
|---|---|---|---|---|---|---|
| 20038305_c2_15 | 845 | 2765 | 75 | 228 | | |

| Protein name | | | | Locus Name | | Acc# |

Description

NO-HIT

| ORF Name | NTID | AAID | NT Length | AA Length | Score | Probability |
|---|---|---|---|---|---|---|
| 2134555_c1_13 | 846 | 2766 | 169 | 510 | | |

Protein name      Locus Name      Acc#

Description

NO-HIT

| ORF Name | NTID | AAID | NT Length | AA Length | Score | Probability |
|---|---|---|---|---|---|---|
| 23470625_c3_19 | 847 | 2767 | 189 | 570 | 287 | 5.9e-25 |

Protein name      Locus Name      Acc#
     gp:RP4TRANOKF      L10330

Description

Plasmid RP4 traN gene, complete cds; traO gene, complete cds; kfrAgene, complete cds.

| ORF Name | NTID | AAID | NT Length | AA Length | Score | Probability |
|---|---|---|---|---|---|---|
| 23632818_c3_25 | 848 | 2768 | 97 | 291 | | |

Protein name      Locus Name      Acc#

Description

NO-HIT

| ORF Name | NTID | AAID | NT Length | AA Length | Score | Probability |
|---|---|---|---|---|---|---|
| 31555_c3_20 | 849 | 2769 | 333 | 1002 | 225 | 2.0e-17 |

Protein name      Locus Name      Acc#
coat protein      pir:S58142

Description

| ORF Name | NTID | AAID | NT Length | AA Length | Score | Probability |
|---|---|---|---|---|---|---|
| 34381286_c3_21 | 850 | 2770 | 140 | 423 | | |

Protein name      Locus Name      Acc#

Description

NO-HIT

| ORF Name | NTID | AAID | NT Length | AA Length | Score | Probability |
|---|---|---|---|---|---|---|
| 34485637_c3_22 | 851 | 2771 | 137 | 414 | | |

Protein name | | | | | Locus Name | Acc#

Description

NO-HIT

| ORF Name | NTID | AAID | NT Length | AA Length | Score | Probability |
|---|---|---|---|---|---|---|
| 3907963_c3_23 | 852 | 2772 | 81 | 246 | | |

Protein name | | | | | Locus Name | Acc#

Description

NO-HIT

| ORF Name | NTID | AAID | NT Length | AA Length | Score | Probability |
|---|---|---|---|---|---|---|
| 4804763_c2_16 | 853 | 2773 | 122 | 369 | | |

Protein name | | | | | Locus Name | Acc#

Description

NO-HIT

| ORF Name | NTID | AAID | NT Length | AA Length | Score | Probability |
|---|---|---|---|---|---|---|
| 6928168_c2_18 | 854 | 2774 | 308 | 927 | | |

Protein name | | | | | Locus Name | Acc#

Description

NO-HIT

| ORF Name | NTID | AAID | NT Length | AA Length | Score | Probability |
|---|---|---|---|---|---|---|
| 12625177_f1_2 | 855 | 2775 | 148 | 447 | 435 | 7.0e-41 |

Protein name | | | | | Locus Name | Acc#
 | | | | | sp:DKSA_ECOLI | P18274

Description

DNAK SUPPRESSOR PROTEIN

| ORF Name | NTID | AAID | NT Length | AA Length | Score | Probability |
|---|---|---|---|---|---|---|
| 14241635_c2_80 | 856 | 2776 | 130 | 393 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14876881_c2_82 | 857 | 2777 | 256 | 771 | 350 | 7.2e-32 |

| Protein name | | | | | Locus Name | Acc# |
|---|---|---|---|---|---|---|
| | | | | | sp:FMCH_BACNO | P17419 |

Description

POSSIBLE FIMBRIAL ASSEMBLY PROTEIN FIMC (SEROGROUP H1)

| ORF Name | NTID | AAID | NT Length | AA Length | Score | Probability |
|---|---|---|---|---|---|---|
| 16181301_f3_63 | 858 | 2778 | 203 | 612 | 126 | 2.6e-06 |

| Protein name | | | | | Locus Name | Acc# |
|---|---|---|---|---|---|---|
| | | | | | sp:YGGH_ECOLI | P32049 |

Description

HYPOTHETICAL 27.3 KD PROTEIN IN ANSB-MUTY INTERGENIC REGION (F239)

| ORF Name | NTID | AAID | NT Length | AA Length | Score | Probability |
|---|---|---|---|---|---|---|
| 16898413_c1_77 | 859 | 2779 | 100 | 303 | 286 | 9.1e-24 |

| Protein name | | | | | Locus Name | Acc# |
|---|---|---|---|---|---|---|
| | | | | | sp:Y712_HAEIN | P44836 |

Description

PROBABLE TONB-DEPENDENT RECEPTOR HI0712 PRECURSOR

| ORF Name | NTID | AAID | NT Length | AA Length | Score | Probability |
|---|---|---|---|---|---|---|
| 21517252_f1_3 | 860 | 2780 | 621 | 1866 | 1417 | 6.1e-145 |

| Protein name | | | | | Locus Name | Acc# |
|---|---|---|---|---|---|---|
| | | | | | sp:UVRC_PSEFL | P32966 |

Description

EXCINUCLEASE ABC SUBUNIT C

| ORF_Name | NTID | AAID | NT Length | AA Length | Score | Probability |
|---|---|---|---|---|---|---|
| 22004587_f2_24 | 861 | 2781 | 333 | 1002 | 436 | 5.5e-41 |

| Protein name | | | | Locus Name | Acc# |
|---|---|---|---|---|---|
| | | | | sp:YADB_ECOLI | |

Description

HYPOTHETICAL 34.9 KD PROTEIN IN PCNB-DKSA INTERGENIC REGION

| ORF_Name | NTID | AAID | NT Length | AA Length | Score | Probability |
|---|---|---|---|---|---|---|
| 23597187_f3_61 | 862 | 2782 | 769 | 2310 | 539 | 3.0e-100 |

| Protein name | | | | Locus Name | Acc# |
|---|---|---|---|---|---|
| | | | | sp:PRIA_RHORU | P05445 |

Description

PRIMOSOMAL PROTEIN N' (REPLICATION FACTOR Y)

| ORF_Name | NTID | AAID | NT Length | AA Length | Score | Probability |
|---|---|---|---|---|---|---|
| 23865681_f3_58 | 863 | 2783 | 739 | 2220 | 789 | 2.2e-78 |

| Protein name | | | | Locus Name | Acc# |
|---|---|---|---|---|---|
| | | | | sp:SPOT_HAEIN | P43811 |

Description ((PPGPP)ASE) (PENTA-PHOSPHATE GUANOSINE-3'-PYROPHOSPHOHYDROLASE)

| ORF_Name | NTID | AAID | NT Length | AA Length | Score | Probability |
|---|---|---|---|---|---|---|
| 24412817_c2_92 | 864 | 2784 | 84 | 255 | | |

| Protein name | | | | Locus Name | Acc# |
|---|---|---|---|---|---|

Description

NO-HIT

| ORF_Name | NTID | AAID | NT Length | AA Length | Score | Probability |
|---|---|---|---|---|---|---|
| 2510887_c1_76 | 865 | 2785 | 60 | 183 | | |

| Protein name | | | | Locus Name | Acc# |
|---|---|---|---|---|---|

Description

NO-HIT

| ORF Name | NTID | AAID | NT Length | AA Length | Score | Probability |
|---|---|---|---|---|---|---|
| 26594686_f1_14 | 866 | 2786 | 215 | 648 | 355 | 2.1e-32 |

Protein name | | | | Locus Name | | Acc# |
| | | | | sp:YICG_ECOLI | | |

Description

HYPOTHETICAL 22.0 KD PROTEIN IN RPH-GMK INTERGENIC REGION PRECURSOR

| ORF Name | NTID | AAID | NT Length | AA Length | Score | Probability |
|---|---|---|---|---|---|---|
| 29304827_c2_94 | 867 | 2787 | 63 | 192 | 286 | 9.1e-24 |

Protein name | | | | Locus Name | | Acc# |
| | | | | sp:Y712_HAEIN | | P44836 |

Description

PROBABLE TONB-DEPENDENT RECEPTOR HI0712 PRECURSOR

| ORF Name | NTID | AAID | NT Length | AA Length | Score | Probability |
|---|---|---|---|---|---|---|
| 29484418_c2_95 | 868 | 2788 | 566 | 1701 | 710 | 1.6e-118 |

Protein name | | | | Locus Name | | Acc# |
| methyltransferase | | | | gp:AF060119 | | AF060119 |

Description

Pasteurella haemolytica methyltransferase (mod) and restrictionendonuclease (res) genes, complete cds.

| ORF Name | NTID | AAID | NT Length | AA Length | Score | Probability |
|---|---|---|---|---|---|---|
| 30281911_c3_114 | 869 | 2789 | 79 | 240 | 286 | 9.1e-24 |

Protein name | | | | Locus Name | | Acc# |
| | | | | sp:Y712_HAEIN | | P44836 |

Description

PROBABLE TONB-DEPENDENT RECEPTOR HI0712 PRECURSOR

| ORF Name | NTID | AAID | NT Length | AA Length | Score | Probability |
|---|---|---|---|---|---|---|
| 34017010_f2_35 | 870 | 2790 | 307 | 924 | 708 | 8.3e-70 |

Protein name | | | | Locus Name | | Acc# |
| hypothetical protein b2431 | | | | pir:F65017 | | F65017 |

Description

| ORF Name | NTID | AAID | NT Length | AA Length | Score | Probability |
|---|---|---|---|---|---|---|
| 34407905_c2_93 | 871 | 2791 | 460 | 1383 | 1801 | 1.2e-185 |

| Protein name | Locus Name | Acc# |
|---|---|---|
| L-2,4-diaminobutyrate:2-ketoglutarate | gp:AB001599 | AB001599 |

Description

Acinetobacter baumannii DNA for L-2,4-diaminobutyrate:2-ketoglutarate 4-aminotransferase, complete cds.

| ORF Name | NTID | AAID | NT Length | AA Length | Score | Probability |
|---|---|---|---|---|---|---|
| 34641550_c3_119 | 872 | 2792 | 186 | 561 | 126 | 1.2e-07 |

| Protein name | Locus Name | Acc# |
|---|---|---|
| | sp:AIL_YEREN | P16454 |

Description

ATTACHMENT INVASION LOCUS PROTEIN PRECURSOR

| ORF Name | NTID | AAID | NT Length | AA Length | Score | Probability |
|---|---|---|---|---|---|---|
| 3923818_f2_34 | 873 | 2793 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4306455_c1_65 | 874 | 2794 | 323 | 972 | 122 | 4.9e-07 |

| Protein name | Locus Name | Acc# |
|---|---|---|
| | sp:FMP1_PSEAE | P17838 |

Description

FIMBRIAL PROTEIN PRECURSOR (PILIN) (STRAIN P1)

| ORF Name | NTID | AAID | NT Length | AA Length | Score | Probability |
|---|---|---|---|---|---|---|
| 4329518_f3_56 | 875 | 2795 | 212 | 639 | 541 | 4.1e-52 |

| Protein name | Locus Name | Acc# |
|---|---|---|
| | sp:KGUA_ECOLI | P24234 |

Description

GUANYLATE KINASE, (GMP KINASE)

| ORF Name | NTID | AAID | NT Length | AA Length | Score | Probability |
|---|---|---|---|---|---|---|
| 4428413_c1_78 | 876 | 2796 | 517 | 1554 | 2128 | 2.8e-220 |

| Protein name | Locus Name | Acc# |
|---|---|---|
| L-2,4-diaminobutyrate decarboxylase | gp:ACCL24DD | D55724 |

Description

Acinetobacter baumannii gene for L-2,4-diaminobutyratedecarboxylase, complete cds.

| ORF Name | NTID | AAID | NT Length | AA Length | Score | Probability |
|---|---|---|---|---|---|---|
| 4538558_f3_51 | 877 | 2797 | 270 | 813 | 611 | 1.6e-59 |

| Protein name | Locus Name | Acc# |
|---|---|---|
| hypothetical protein | gp:PPPAL1 | X74218 |

Description

Pseudomonas putida ruvB, tolQ, tolR, tolA, tolB and oprL genes.

| ORF Name | NTID | AAID | NT Length | AA Length | Score | Probability |
|---|---|---|---|---|---|---|
| 4570318_f3_44 | 878 | 2798 | 228 | 687 | 448 | 3.0e-42 |

| Protein name | Locus Name | Acc# |
|---|---|---|
|  | sp:GPH_HAEIN | P44755 |

Description

PHOSPHOGLYCOLATE PHOSPHATASE, (PGP)

| ORF Name | NTID | AAID | NT Length | AA Length | Score | Probability |
|---|---|---|---|---|---|---|
| 4902305_c2_96 | 879 | 2799 | 869 | 2610 | 2182 | 5.3e-226 |

| Protein name | Locus Name | Acc# |
|---|---|---|
| restriction endonuclease | gp:AF060119 | AF060119 |

Description

Pasteurella haemolytica methyltransferase (mod) and restrictionendonuclease (res) genes, complete cds.

| ORF_Name | NTID | AAID | NT Length | AA Length | Score | Probability |
|---|---|---|---|---|---|---|
| 4964000_f3_57 | 880 | 2800 | 95 | 288 | 187 | 1.3e-14 |

Protein name | Locus Name | Acc#
sp:RPOZ_HAEIN | P43740

Description

OMEGA CHAIN) (RNA POLYMERASE OMEGA SUBUNIT)

| ORF_Name | NTID | AAID | NT Length | AA Length | Score | Probability |
|---|---|---|---|---|---|---|
| 5079408_f3_60 | 881 | 2801 | 151 | 456 | 367 | 1.1e-33 |

Protein name | Locus Name | Acc#
hypothetical protein 1 (vnfA 5' region) | pir:B44514 | B44514

Description

| ORF_Name | NTID | AAID | NT Length | AA Length | Score | Probability |
|---|---|---|---|---|---|---|
| 5080293_c2_89 | 882 | 2802 | 592 | 1779 | 1142 | 8.5e-116 |

Protein name | Locus Name | Acc#
 | sp:RECJ_HAEIN | P45112

Description

SINGLE-STRANDED-DNA-SPECIFIC EXONUCLEASE RECJ,

| ORF_Name | NTID | AAID | NT Length | AA Length | Score | Probability |
|---|---|---|---|---|---|---|
| 5339762_c3_109 | 883 | 2803 | 325 | 978 | 1184 | 3.0e-120 |

Protein name | Locus Name | Acc#
LytB | gp:AF027189 | AF027189

Description

Acinetobacter sp. BD413 lytB, comB, comC, comE, and comF genes, complete cds; and unknown genes.

| ORF_Name | NTID | AAID | NT Length | AA Length | Score | Probability |
|---|---|---|---|---|---|---|
| 97582_f3_42 | 884 | 2804 | 289 | 870 | 291 | 1.3e-25 |

Protein name | Locus Name | Acc#
 | sp:ICC_ECOLI | P36650

Description

ICC PROTEIN

| ORF Name | NTID | AAID | NT Length | AA Length | Score | Probability |
|---|---|---|---|---|---|---|
| 13673437_c2_39 | 885 | 2805 | 597 | 1791 | 150 | 3.5e-13 |

| Protein name | | | | Locus Name | | Acc# |
|---|---|---|---|---|---|---|
| putative terminase | | | | gp:AF147978 | | AF147978 |

Description

Bacteriophage D3 putative terminase, putative portal protein, putative ClpP protease, and major head protein genes, complete cds; and unknown genes.

| ORF Name | NTID | AAID | NT Length | AA Length | Score | Probability |
|---|---|---|---|---|---|---|
| 14181292_c3_43 | 886 | 2806 | 101 | 306 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 19953125_c2_36 | 887 | 2807 | 215 | 648 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 25665952_c1_33 | 888 | 2808 | 128 | 387 | 88 | 0.0036 |

| Protein name | | | | Locus Name | | Acc# |
|---|---|---|---|---|---|---|
| 1.7 protein | | | | gp:BPH251805 | | AJ251805 |

Description

Bacteriophage phi-YeO3-12 complete genome.

| ORF Name | NTID | AAID | NT Length | AA Length | Score | Probability |
|---|---|---|---|---|---|---|
| 26675311_c2_37 | 889 | 2809 | 107 | 324 | 145 | 3.8e-10 |

| Protein name | | | | Locus Name | | Acc# |
|---|---|---|---|---|---|---|
| hypothetical protein | | | | gp:XNE133022 | | AJ133022 |

Description

Xenorhabdus nematophilus proviral ORF1 to ORF8.

| ORF Name | NTID | AAID | NT Length | AA Length | Score | Probability |
|---|---|---|---|---|---|---|
| 32657262_c2_35 | 890 | 2810 | 150 | 453 | 209 | 6.7e-18 |

| Protein name | | | | Locus Name | | Acc# |
|---|---|---|---|---|---|---|
| DNA primase | | | | pir:C41830 | | C41830 |

Description

| ORF Name | NTID | AAID | NT Length | AA Length | Score | Probability |
|---|---|---|---|---|---|---|
| 3941887_c1_32 | 891 | 2811 | 185 | 558 | 88 | 0.019 |

| Protein name | | | | Locus Name | | Acc# |
|---|---|---|---|---|---|---|
| | | | | gp:PFA53C6 | | X17490 |

Description

Plasmodium falciparum mRNA for asparagine-rich antigen (clone53C6).

| ORF Name | NTID | AAID | NT Length | AA Length | Score | Probability |
|---|---|---|---|---|---|---|
| 5916253_c1_28 | 892 | 2812 | 257 | 774 | 259 | 3.1e-22 |

| Protein name | | | | Locus Name | | Acc# |
|---|---|---|---|---|---|---|
| | | | | sp:YE22_HAEIN | | P44193 |

Description

HYPOTHETICAL PROTEIN HI1422

| ORF Name | NTID | AAID | NT Length | AA Length | Score | Probability |
|---|---|---|---|---|---|---|
| 900215_c3_41 | 893 | 2813 | 797 | 2394 | 330 | 4.7e-27 |

| Protein name | | | | Locus Name | | Acc# |
|---|---|---|---|---|---|---|
| putative DNA primase | | | | gp:AF139719 | | AF139719 |

Description

Klebsiella oxytoca plasmid pACM1 putative DNA primase (pri) gene, complete cds; and unknown genes.

| ORF Name | NTID | AAID | NT Length | AA Length | Score | Probability |
|---|---|---|---|---|---|---|
| 10959627_f2_14 | 894 | 2814 | 294 | 885 | 513 | 3.8e-49 |

| Protein name | | | | Locus Name | | Acc# |
|---|---|---|---|---|---|---|
| | | | | sp:YBEX_ECOLI | | P77392 |

Description

HYPOTHETICAL 33.3 KD PROTEIN IN CUTE-ASNB INTERGENIC REGION

| ORF Name | NTID | AAID | NT Length | AA Length | Score | Probability |
|---|---|---|---|---|---|---|
| 1178127_f3_20 | 895 | 2815 | 963 | 2892 | 2605 | 1.9e-281 |

| Protein name | Locus Name | Acc# |
|---|---|---|
| SecA | gp:AB012226 | AB012226 |

Description

Vibrio alginolyticus gene for SecA, complete cds.

| ORF Name | NTID | AAID | NT Length | AA Length | Score | Probability |
|---|---|---|---|---|---|---|
| 12298468_f1_13 | 896 | 2816 | 102 | 309 | 82 | 0.017 |

| Protein name | Locus Name | Acc# |
|---|---|---|
| probable membrane protein L549.12 | pir:T02800 | T02800 |

Description

| ORF Name | NTID | AAID | NT Length | AA Length | Score | Probability |
|---|---|---|---|---|---|---|
| 12985393_f3_16 | 897 | 2817 | 270 | 813 | 537 | 1.1e-51 |

| Protein name | Locus Name | Acc# |
|---|---|---|
|  | sp:PEPD_HAEIN | P44817 |

Description (PEPTIDASE D)

| ORF Name | NTID | AAID | NT Length | AA Length | Score | Probability |
|---|---|---|---|---|---|---|
| 14538262_c2_40 | 898 | 2818 | 69 | 210 | 109 | 2.5e-06 |

| Protein name | Locus Name | Acc# |
|---|---|---|
| hypothetical protein APE0458 | pir:A72741 | A72741 |

Description

| ORF Name | NTID | AAID | NT Length | AA Length | Score | Probability |
|---|---|---|---|---|---|---|
| 14548260_c1_34 | 899 | 2819 | 244 | 735 | 265 | 7.3e-23 |

| Protein name | Locus Name | Acc# |
|---|---|---|
| hypothetical protein D1022.4 | pir:T34190 | T34190 |

Description

| ORF_Name | NTID | AAID | NT Length | AA Length | Score | Probability |
|---|---|---|---|---|---|---|
| 21640900_f1_8 | 900 | 2820 | 442 | 1329 | 1361 | 5.3e-139 |

| Protein name | | | | Locus Name | | Acc# |
|---|---|---|---|---|---|---|
| | | | | sp:GSA_PSEAE | | P48247 |

Description (GLUTAMATE-1-SEMIALDEHYDE AMINOTRANSFERASE) (GSA-AT)

| ORF_Name | NTID | AAID | NT Length | AA Length | Score | Probability |
|---|---|---|---|---|---|---|
| 24609561_c3_56 | 901 | 2821 | 241 | 726 | 147 | 2.4e-19 |

| Protein name | | | | Locus Name | | Acc# |
|---|---|---|---|---|---|---|
| | | | | sp:UP14_ECOLI | | |

Description

UNKNOWN PROTEIN FROM 2D-PAGE (SPOT PR51)

| ORF_Name | NTID | AAID | NT Length | AA Length | Score | Probability |
|---|---|---|---|---|---|---|
| 36329806_f1_2 | 902 | 2822 | 80 | 243 | 60 | 0.019 |

| Protein name | | | | Locus Name | | Acc# |
|---|---|---|---|---|---|---|
| thyroid hormone sulfotransferase, B2 | | | | pir:JC5885 | | JC5885 |

Description

| ORF_Name | NTID | AAID | NT Length | AA Length | Score | Probability |
|---|---|---|---|---|---|---|
| 4188811_f1_6 | 903 | 2823 | 159 | 480 | 310 | 1.2e-27 |

| Protein name | | | | Locus Name | | Acc# |
|---|---|---|---|---|---|---|
| conserved hypothetical protein | | | | pir:T03501 | | T03501 |

Description

| ORF_Name | NTID | AAID | NT Length | AA Length | Score | Probability |
|---|---|---|---|---|---|---|
| 4336018_f1_7 | 904 | 2824 | 115 | 348 | 349 | 9.1e-32 |

| Protein name | | | | Locus Name | | Acc# |
|---|---|---|---|---|---|---|
| | | | | sp:PHNA_ECOLI | | P16680 |

Description

PHNA PROTEIN

| ORF_Name | NTID | AAID | NT Length | AA Length | Score | Probability |
|---|---|---|---|---|---|---|
| 4689143_f2_15 | 905 | 2825 | 175 | 528 | 132 | 9.0e-08 |

| Protein name | Locus Name | Acc# |
|---|---|---|
| apolipoprotein N-acyltransferase | gp:AF038595 | AF038595 |

Description

Pseudomonas aeruginosa apolipoprotein N-acyltransferase (cutE)gene, complete cds.

| ORF_Name | NTID | AAID | NT Length | AA Length | Score | Probability |
|---|---|---|---|---|---|---|
| 5205312_f3_21 | 906 | 2826 | 69 | 210 | | |

Protein name

Locus Name    Acc#

Description

NO-HIT

| ORF_Name | NTID | AAID | NT Length | AA Length | Score | Probability |
|---|---|---|---|---|---|---|
| 22382752_c1_11 | 907 | 2827 | 117 | 354 | 100 | 2.2e-05 |

| Protein name | Locus Name | Acc# |
|---|---|---|
| hypothetical protein | pir:T10511 | T10511 |

Description

| ORF_Name | NTID | AAID | NT Length | AA Length | Score | Probability |
|---|---|---|---|---|---|---|
| 26251376_c1_8 | 908 | 2828 | 82 | 249 | | |

Protein name    Locus Name    Acc#

Description

NO-HIT

| ORF_Name | NTID | AAID | NT Length | AA Length | Score | Probability |
|---|---|---|---|---|---|---|
| 35188942_c3_14 | 909 | 2829 | 255 | 768 | 248 | 4.6e-21 |

| Protein name | Locus Name | Acc# |
|---|---|---|
| hypothetical protein slr1971 | pir:S75639 | S75639 |

Description

| ORF Name | NTID | AAID | NT Length | AA Length | Score | Probability |
|---|---|---|---|---|---|---|
| 35337805_c1_10 | 910 | 2830 | 185 | 558 | 152 | 5.9e-12 |

| Protein name | Locus Name | Acc# |
|---|---|---|
| sulfate transporter | gp:D89631 | D89631 |

Description

Arabidopsis thaliana mRNA for sulfate transporter, complete cds.

| ORF Name | NTID | AAID | NT Length | AA Length | Score | Probability |
|---|---|---|---|---|---|---|
| 35801416_f1_1 | 911 | 2831 | 255 | 768 | 379 | 6.1e-35 |

| Protein name | Locus Name | Acc# |
|---|---|---|
| | sp:RLUA_ECOLI | P39219 |

Description (PSEUDOURIDYLATE SYNTHASE) (URACIL HYDROLYASE)

| ORF Name | NTID | AAID | NT Length | AA Length | Score | Probability |
|---|---|---|---|---|---|---|
| 4328403_c2_13 | 912 | 2832 | 109 | 330 | 191 | 5.1e-15 |

| Protein name | Locus Name | Acc# |
|---|---|---|
| BolA protein | gp:PFL243174 | AJ243174 |

Description

Pseudomonas fluorescens partial Fumarase C gene, bolA gene and ORF1.

| ORF Name | NTID | AAID | NT Length | AA Length | Score | Probability |
|---|---|---|---|---|---|---|
| 4572206_c1_9 | 913 | 2833 | 380 | 1143 | 391 | 1.5e-35 |

| Protein name | Locus Name | Acc# |
|---|---|---|
| sulfate transporter | gp:AB008782 | AB008782 |

Description

Arabidopsis thaliana mRNA for sulfate transporter, complete cds.

| ORF Name | NTID | AAID | NT Length | AA Length | Score | Probability |
|---|---|---|---|---|---|---|
| 16990667_f1_7 | 914 | 2834 | 61 | 186 | 109 | 8.8e-06 |

| Protein name | Locus Name | Acc# |
|---|---|---|
| hemV protein | pir:S54440 | S54440 |

Description

| ORF Name | NTID | AAID | NT Length | AA Length | Score | Probability |
|---|---|---|---|---|---|---|
| 19534511_c3_45 | 915 | 2835 | 70 | 213 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 19573425_c1_31 | 916 | 2836 | 150 | 453 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 20408375_c2_34 | 917 | 2837 | 60 | 183 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 20930_c3_42 | 918 | 2838 | 144 | 435 | 87 | 0.0070 |

| Protein name | | Locus Name | Acc# |
|---|---|---|---|
| | | sp:ATPZ_PSEPU | P25760 |

Description

ATP SYNTHASE PROTEIN I

| ORF Name | NTID | AAID | NT Length | AA Length | Score | Probability |
|---|---|---|---|---|---|---|
| 20991307_c2_35 | 919 | 2839 | 302 | 909 | 128 | 8.0e-14 |

| Protein name | | Locus Name | Acc# |
|---|---|---|---|
| periplasmic zinc transporter ZnuA | | gp:AF141971 | AF141971 |

Description

Haemophilus ducreyi HI0318 homolog gene, partial cds;oxidoreductase homolog and periplasmic zinc transporter ZnuA (znuA)genes, complete cds; and ribose-5-phosphate isomerase A homologgene, partial cds.

271

| ORF Name | NTID | AAID | NT Length | AA Length | Score | Probability |
|---|---|---|---|---|---|---|
| 22129692_c2_37 | 920 | 2840 | 496 | 1491 | 1866 | 1.6e-192 |

Protein name: H+-transporting ATP synthase, beta chain
Locus Name: pir:D64071
Acc#: D64071

Description:

| ORF Name | NTID | AAID | NT Length | AA Length | Score | Probability |
|---|---|---|---|---|---|---|
| 24507777_c3_43 | 921 | 2841 | 520 | 1563 | 1979 | 1.7e-204 |

Protein name:
Locus Name: sp:ATPA_ECOLI
Acc#: P00822

Description: ATP SYNTHASE ALPHA CHAIN,

| ORF Name | NTID | AAID | NT Length | AA Length | Score | Probability |
|---|---|---|---|---|---|---|
| 25680186_c1_28 | 922 | 2842 | 160 | 483 | 371 | 4.3e-34 |

Protein name:
Locus Name: sp:ATPF_VIBAL
Acc#: P12989

Description: ATP SYNTHASE B CHAIN,

| ORF Name | NTID | AAID | NT Length | AA Length | Score | Probability |
|---|---|---|---|---|---|---|
| 34023378_c1_26 | 923 | 2843 | 296 | 891 | 745 | 9.9e-74 |

Protein name:
Locus Name: sp:ATP6_ECOLI
Acc#:

Description: ATP SYNTHASE A CHAIN, (PROTEIN 6)

| ORF Name | NTID | AAID | NT Length | AA Length | Score | Probability |
|---|---|---|---|---|---|---|
| 35159406_c3_39 | 924 | 2844 | 65 | 198 | 65 | 0.0045 |

Protein name: extensin homolog F2401.18
Locus Name: pir:T01456
Acc#: T01456

Description:

| ORF Name | NTID | AAID | NT Length | AA Length | Score | Probability |
|---|---|---|---|---|---|---|
| 3953587_f3_23 | 925 | 2845 | 174 | 525 | 236 | 8.6e-20 |

| Protein name | | | | Locus Name | | Acc# |
|---|---|---|---|---|---|---|
| | | | | sp:ZUR_ECOLI | | |

Description

ZINC UPTAKE REGULATION PROTEIN (ZINC UPTAKE REGULATOR)

| ORF Name | NTID | AAID | NT Length | AA Length | Score | Probability |
|---|---|---|---|---|---|---|
| 4120425_c1_29 | 926 | 2846 | 202 | 609 | 268 | 3.5e-23 |

| Protein name | | | | Locus Name | | Acc# |
|---|---|---|---|---|---|---|
| | | | | sp:ATPD_VIBAL | | P12987 |

Description

ATP SYNTHASE DELTA CHAIN,

| ORF Name | NTID | AAID | NT Length | AA Length | Score | Probability |
|---|---|---|---|---|---|---|
| 4332943_c1_27 | 927 | 2847 | 84 | 255 | 261 | 1.9e-22 |

| Protein name | | | | Locus Name | | Acc# |
|---|---|---|---|---|---|---|
| | | | | sp:ATPL_HAEIN | | P43721 |

Description (DICYCLOHEXYLCARBODIIMIDE-BINDING PROTEIN)

| ORF Name | NTID | AAID | NT Length | AA Length | Score | Probability |
|---|---|---|---|---|---|---|
| 56333_c3_44 | 928 | 2848 | 309 | 930 | 894 | 1.6e-89 |

| Protein name | | | | Locus Name | | Acc# |
|---|---|---|---|---|---|---|
| | | | | sp:ATPG_ECOLI | | |

Description

ATP SYNTHASE GAMMA CHAIN,

| ORF Name | NTID | AAID | NT Length | AA Length | Score | Probability |
|---|---|---|---|---|---|---|
| 7056441_c2_38 | 929 | 2849 | 139 | 417 | 300 | 1.4e-26 |

Protein name | | | | Locus Name | | Acc#
sp:ATPE_HAEIN — P43718

Description

ATP SYNTHASE EPSILON CHAIN,

| ORF Name | NTID | AAID | NT Length | AA Length | Score | Probability |
|---|---|---|---|---|---|---|
| 9928433_f2_17 | 930 | 2850 | 71 | 216 | | |

Protein name | | | | Locus Name | | Acc#

Description

NO-HIT

| ORF Name | NTID | AAID | NT Length | AA Length | Score | Probability |
|---|---|---|---|---|---|---|
| 3235950_c2_28 | 931 | 2851 | 561 | 1686 | 2096 | 6.8e-217 |

Protein name: urocanase | | | | Locus Name: gp:PSEHUTUU | | Acc#

Description

Pseudomonas putida urocanase (hutU) gene, complete cds.

| ORF Name | NTID | AAID | NT Length | AA Length | Score | Probability |
|---|---|---|---|---|---|---|
| 3940938_c2_30 | 932 | 2852 | 357 | 1074 | 366 | 1.4e-33 |

Protein name | | | | Locus Name | | Acc#
sp:HUTG_KLEAE — P19452

Description (HISTIDINE UTILIZATION PROTEIN G) (FRAGMENT)

| ORF Name | NTID | AAID | NT Length | AA Length | Score | Probability |
|---|---|---|---|---|---|---|
| 3953181_c3_34 | 933 | 2853 | 434 | 1305 | 1007 | 1.7e-101 |

Protein name | | | | Locus Name | | Acc#
gp:YP102KB — AL031866

Description

Yersinia pestis 102 kbases unstable region: from 1 to 119443.

| ORF Name | NTID | AAID | NT Length | AA Length | Score | Probability |
|---|---|---|---|---|---|---|
| 4822181_f3_14 | 934 | 2854 | 78 | 237 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 789037_c3_33 | 935 | 2855 | 525 | 1578 | 1486 | 3.0e-152 |

| Protein name | Locus Name | Acc# |
|---|---|---|
| histidine ammonia-lyase,:histidase | pir:A35251 | |

Description

| ORF Name | NTID | AAID | NT Length | AA Length | Score | Probability |
|---|---|---|---|---|---|---|
| 828942_f1_1 | 936 | 2856 | 296 | 891 | 180 | 7.0e-12 |

| Protein name | Locus Name | Acc# |
|---|---|---|
| | sp:YYAM_BACSU | P37511 |

Description

HYPOTHETICAL 32.9 KD PROTEIN IN TETB-EXOA INTERGENIC REGION

| ORF Name | NTID | AAID | NT Length | AA Length | Score | Probability |
|---|---|---|---|---|---|---|
| 10978400_c3_163 | 937 | 2857 | 253 | 762 | 186 | 1.7e-14 |

| Protein name | Locus Name | Acc# |
|---|---|---|
| | sp:HEM4_PSEAE | P48246 |

Description

)

| ORF Name | NTID | AAID | NT Length | AA Length | Score | Probability |
|---|---|---|---|---|---|---|
| 1259626_c2_127 | 938 | 2858 | 614 | 1845 | 1756 | 7.3e-181 |

| Protein name | Locus Name | Acc# |
|---|---|---|
| | sp:YA51_HAEIN | |

Description

HYPOTHETICAL ABC TRANSPORTER ATP-BINDING PROTEIN HI1051

275

| ORF Name | NTID | AAID | NT Length | AA Length | Score | Probability |
|---|---|---|---|---|---|---|
| 12672305_c2_140 | 939 | 2859 | 110 | 333 | 144 | 4.8e-10 |

Protein name | Locus Name | Acc#
sp:YGGX_HAEIN | P44048

Description

HYPOTHETICAL PROTEIN HI0760

| ORF Name | NTID | AAID | NT Length | AA Length | Score | Probability |
|---|---|---|---|---|---|---|
| 13131890_f3_71 | 940 | 2860 | 169 | 510 | 147 | 2.7e-10 |

Protein name | Locus Name | Acc#
sp:DSBC_ERWCH | P39691

Description

THIOL:DISULFIDE INTERCHANGE PROTEIN DSBC PRECURSOR

| ORF Name | NTID | AAID | NT Length | AA Length | Score | Probability |
|---|---|---|---|---|---|---|
| 14847290_f3_89 | 941 | 2861 | 61 | 186 | | |

Protein name | Locus Name | Acc#

Description

NO-HIT

| ORF Name | NTID | AAID | NT Length | AA Length | Score | Probability |
|---|---|---|---|---|---|---|
| 15875832_f3_92 | 942 | 2862 | 75 | 228 | | |

Protein name | Locus Name | Acc#

Description

NO-HIT

| ORF Name | NTID | AAID | NT Length | AA Length | Score | Probability |
|---|---|---|---|---|---|---|
| 16493891_c3_165 | 943 | 2863 | 118 | 357 | | |

Protein name | Locus Name | Acc#

Description

NO-HIT

| ORF Name | NTID | AAID | NT Length | AA Length | Score | Probability |
|---|---|---|---|---|---|---|
| 16610052_c3_183 | 944 | 2864 | 93 | 282 | | |

Protein name | Locus Name | Acc#

Description

NO-HIT

| ORF Name | NTID | AAID | NT Length | AA Length | Score | Probability |
|---|---|---|---|---|---|---|
| 1957701_f1_30 | 945 | 2865 | 277 | 834 | 329 | 1.2e-29 |

Protein name | Locus Name | Acc#
| | sp:GRPE_HAEIN | P43732

Description

GRPE PROTEIN

| ORF Name | NTID | AAID | NT Length | AA Length | Score | Probability |
|---|---|---|---|---|---|---|
| 19720930_f3_74 | 946 | 2866 | 276 | 831 | 597 | 4.8e-58 |

Protein name | Locus Name | Acc#
| | sp:DAPB_ECOLI | P04036

Description

DIHYDRODIPICOLINATE REDUCTASE,

| ORF Name | NTID | AAID | NT Length | AA Length | Score | Probability |
|---|---|---|---|---|---|---|
| 21489390_f2_59 | 947 | 2867 | 67 | 204 | | |

Protein name | Locus Name | Acc#

Description

NO-HIT

| ORF Name | NTID | AAID | NT Length | AA Length | Score | Probability |
|---|---|---|---|---|---|---|
| 21689063_f1_10 | 948 | 2868 | 414 | 1245 | 328 | 1.5e-29 |

| Protein name | Locus Name | Acc# |
|---|---|---|
| SrpJ | gp:AF176824 | AF176824 |

Description

Synechococcus PCC7942 plasmid pANL O-acetylserine(thiol)-lyase SrpD(srpD), gamma-glutamyltranspeptidase SrpE (srpE), alpha-helical coiled-coil protein SrpF (srpF), SrpJ (srpJ), ATP-binding protein of ABC transporter SrpK (srpK), membrane lipoprotein SrpL (srpL), and cytoplasmic membrane protein SrpM (srpM) genes, complete cds.

| ORF Name | NTID | AAID | NT Length | AA Length | Score | Probability |
|---|---|---|---|---|---|---|
| 22042177_f2_65 | 949 | 2869 | 493 | 1482 | 1203 | 2.9e-122 |

| Protein name | Locus Name | Acc# |
|---|---|---|
| argininosuccinate lyase argH | pir:C69589 | C69589 |

Description

| ORF Name | NTID | AAID | NT Length | AA Length | Score | Probability |
|---|---|---|---|---|---|---|
| 22070191_f1_5 | 950 | 2870 | 409 | 1230 | 486 | 2.8e-46 |

| Protein name | Locus Name | Acc# |
|---|---|---|
| cystathionine-gamma-lyase | gp:AF180145 | AF180145 |

Description

Zymomonas mobilis GTP-binding protein CgpA (cgpA), 60KD inner-membrane protein yidC (yidC), hypothetical protein, glutamine-pyruvate aminotransferase gltB (gltB), glutamate synthase small subunit gltS (gltS), undecaprenol kinase udk (udk), hypothetical protein, NADH dehydrogenase, hypothetical protein; zm12orf5, hypothetical protein, aspartate aminotransferase A, beta-hydroxysteroid dehydrogenase, phosphomannomutase pmm

| ORF Name | NTID | AAID | NT Length | AA Length | Score | Probability |
|---|---|---|---|---|---|---|
| 22922082_c2_138 | 951 | 2871 | 319 | 960 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 234701_c3_187 | 952 | 2872 | 73 | 222 | 115 | 5.1e-07 |

| Protein name | Locus Name | Acc# |
|---|---|---|
| extensin | pir:S22697 | |

Description

| ORF Name | NTID | AAID | NT Length | AA Length | Score | Probability |
|---|---|---|---|---|---|---|
| 23572127_f1_31 | 953 | 2873 | 636 | 1911 | 2307 | 3.0e-239 |

| Protein name | Locus Name | Acc# |
|---|---|---|
| | sp:DNAK_FRATU | P48205 |

Description

DNAK PROTEIN (HEAT SHOCK PROTEIN 70) (HSP70)

| ORF Name | NTID | AAID | NT Length | AA Length | Score | Probability |
|---|---|---|---|---|---|---|
| 23909688_f3_77 | 954 | 2874 | 466 | 1401 | 456 | 4.2e-43 |

| Protein name | Locus Name | Acc# |
|---|---|---|
| rubredoxin--NAD+ reductase,:hypothetical protein hydA 3'-region | pir:C65051 | C65051 |

Description

| ORF Name | NTID | AAID | NT Length | AA Length | Score | Probability |
|---|---|---|---|---|---|---|
| 24073762_c3_158 | 955 | 2875 | 220 | 663 | 681 | 6.0e-67 |

| Protein name | Locus Name | Acc# |
|---|---|---|
| AvtA | gp:AF014804 | AF014804 |

Description

Neisseria meningitidis PglB (pglB), PglC (pglC), PglD (pglD), andAvtA (avtA) genes, complete cds.

| ORF Name | NTID | AAID | NT Length | AA Length | Score | Probability |
|---|---|---|---|---|---|---|
| 24100465_f2_46 | 956 | 2876 | 321 | 966 | 639 | 1.3e-64 |

| Protein name | Locus Name | Acc# |
|---|---|---|
| intrinsic membrane protein | gp:AB000100 | AB000100 |

Description

Synechococcus sp. DNA for intrinsic membrane protein, malK-likeprotein, cyanase, complete cds.

| ORF Name | NTID | AAID | NT Length | AA Length | Score | Probability |
|---|---|---|---|---|---|---|
| 24391877_c1_109 | 957 | 2877 | 329 | 990 | 927 | 5.1e-93 |

Protein name | | | | Locus Name | | Acc#
| | | | | sp:HEM3_ECOLI | | |

Description

SYNTHASE) (HMBS) (PRE-UROPORPHYRINOGEN SYNTHASE)

| ORF Name | NTID | AAID | NT Length | AA Length | Score | Probability |
|---|---|---|---|---|---|---|
| 24417807_f3_76 | 958 | 2878 | 185 | 558 | 263 | 1.2e-22 |

Protein name | | | | Locus Name | | Acc#
Mip | | | | gp:S71704 | | S71704

Description

| ORF Name | NTID | AAID | NT Length | AA Length | Score | Probability |
|---|---|---|---|---|---|---|
| 24619003_f3_79 | 959 | 2879 | 287 | 864 | 625 | 5.2e-61 |

Protein name | | | | Locus Name | | Acc#
| | | | | sp:NRTC_SYNY3 | | P73450

Description

NITRATE TRANSPORT ATP-BINDING PROTEIN NRTC

| ORF Name | NTID | AAID | NT Length | AA Length | Score | Probability |
|---|---|---|---|---|---|---|
| 26053250_c1_112 | 960 | 2880 | 268 | 807 | | |

Protein name | | | | Locus Name | | Acc#

Description

NO-HIT

| ORF Name | NTID | AAID | NT Length | AA Length | Score | Probability |
|---|---|---|---|---|---|---|
| 26053250_c2_134 | 961 | 2881 | 116 | 351 | | |

Protein name | | | | Locus Name | | Acc#

Description

NO-HIT

| ORF Name | NTID | AAID | NT Length | AA Length | Score | Probability |
|---|---|---|---|---|---|---|
| 26362680_c2_129 | 962 | 2882 | 296 | 891 | 480 | 1.2e-45 |

| Protein name | | | | Locus Name | | Acc# |
|---|---|---|---|---|---|---|
| | | | | sp:YJFH_HAEIN | | P44906 |

Description

HYPOTHETICAL TRNA/RRNA METHYLTRANSFERASE HI0860,

| ORF Name | NTID | AAID | NT Length | AA Length | Score | Probability |
|---|---|---|---|---|---|---|
| 2928382_f2_40 | 963 | 2883 | 323 | 972 | 895 | 1.3e-89 |

| Protein name | | | | Locus Name | | Acc# |
|---|---|---|---|---|---|---|
| sodium-dependent transporter homolog yocS | | | | pir:E69902 | | E69902 |

Description

| ORF Name | NTID | AAID | NT Length | AA Length | Score | Probability |
|---|---|---|---|---|---|---|
| 29339432_c3_166 | 964 | 2884 | 322 | 969 | 92 | 4.2e-06 |

| Protein name | | | | Locus Name | | Acc# |
|---|---|---|---|---|---|---|
| hypothetical protein b2755 | | | | pir:G65056 | | G65056 |

Description

| ORF Name | NTID | AAID | NT Length | AA Length | Score | Probability |
|---|---|---|---|---|---|---|
| 29962837_c3_181 | 965 | 2885 | 288 | 867 | 117 | 9.9e-13 |

| Protein name | | | | Locus Name | | Acc# |
|---|---|---|---|---|---|---|
| | | | | sp:DNAJ_SYNP7 | | P50026 |

Description

DNAJ PROTEIN

| ORF Name | NTID | AAID | NT Length | AA Length | Score | Probability |
|---|---|---|---|---|---|---|
| 32629186_c2_139 | 966 | 2886 | 223 | 672 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 3307_f2_47 | 967 | 2887 | 119 | 360 | 349 | 9.1e-32 |

| Protein name | | | | Locus_Name | | Acc# |
|---|---|---|---|---|---|---|
| | | | | sp:YADR_HAEIN | | P45344 |

Description

HYPOTHETICAL PROTEIN HI1723

| ORF_Name | NTID | AAID | NT Length | AA Length | Score | Probability |
|---|---|---|---|---|---|---|
| 34492161_c3_168 | 968 | 2888 | 353 | 1062 | | |

| Protein name | | | | Locus_Name | | Acc# |
|---|---|---|---|---|---|---|

Description

NO-HIT

| ORF_Name | NTID | AAID | NT Length | AA Length | Score | Probability |
|---|---|---|---|---|---|---|
| 3940925_c3_182 | 969 | 2889 | 341 | 1026 | 466 | 3.7e-44 |

| Protein name | | | | Locus_Name | | Acc# |
|---|---|---|---|---|---|---|
| | | | | sp:YHET_ECOLI | | P45524 |

Description

HYPOTHETICAL 38.5 KD PROTEIN IN KIFB-PRKB INTERGENIC REGION

| ORF_Name | NTID | AAID | NT Length | AA Length | Score | Probability |
|---|---|---|---|---|---|---|
| 4095443_c3_170 | 970 | 2890 | 161 | 486 | 147 | 2.3e-10 |

| Protein name | | | | Locus_Name | | Acc# |
|---|---|---|---|---|---|---|
| hypothetical protein Rv0163 | | | | pir:G70903 | | G70903 |

Description

| ORF_Name | NTID | AAID | NT Length | AA Length | Score | Probability |
|---|---|---|---|---|---|---|
| 4187538_f2_50 | 971 | 2891 | 473 | 1422 | 1141 | 1.1e-115 |

| Protein name | | | | Locus_Name | | Acc# |
|---|---|---|---|---|---|---|
| | | | | sp:MPL_HAEIN | | P43948 |

Description

LIGASE,

| ORF Name | NTID | AAID | NT Length | AA Length | Score | Probability |
|---|---|---|---|---|---|---|
| 4328135_f1_13 | 972 | 2892 | 474 | 1425 | 812 | 7.9e-81 |

| Protein name | Locus Name | Acc# |
|---|---|---|
| periplasmic substrate binding protein | gp:AF001333 | AF001333 |

Description

Synechococcus PCC7942 periplasmic substrate binding protein (cynA), integral membrane protein (cynB) and ATP-binding protein (cynD) genes, complete cds.

| ORF Name | NTID | AAID | NT Length | AA Length | Score | Probability |
|---|---|---|---|---|---|---|
| 4328965_f3_99 | 973 | 2893 | 132 | 399 | 282 | 1.2e-24 |

| Protein name | Locus Name | Acc# |
|---|---|---|
| | sp:Y117_HAEDU | O30825 |

Description

HYPOTHETICAL PROTEIN HYP0117

| ORF Name | NTID | AAID | NT Length | AA Length | Score | Probability |
|---|---|---|---|---|---|---|
| 4423318_c3_160 | 974 | 2894 | 626 | 1881 | 2307 | 3.0e-239 |

| Protein name | Locus Name | Acc# |
|---|---|---|
| 93% identity over 631 amino acids with E. coli | gp:STYSTMF1 | AF170176 |

Description

Salmonella typhimurium fragment STMF1.

| ORF Name | NTID | AAID | NT Length | AA Length | Score | Probability |
|---|---|---|---|---|---|---|
| 4454512_f1_32 | 975 | 2895 | 111 | 336 | 113 | 9.3e-07 |

| Protein name | Locus Name | Acc# |
|---|---|---|
| | sp:Y173_HAEIN | P43960 |

Description

HYPOTHETICAL PROTEIN HI0173

| ORF Name | NTID | AAID | NT Length | AA Length | Score | Probability |
|---|---|---|---|---|---|---|
| 4548188_f1_38 | 976 | 2896 | 421 | 1266 | 1342 | 5.4e-137 |

| Protein name | | | | Locus Name | | Acc# |
|---|---|---|---|---|---|---|
| | | | | sp:DADA_ECOLI | | P29011 |

Description

D-AMINO ACID DEHYDROGENASE SMALL SUBUNIT,

| ORF Name | NTID | AAID | NT Length | AA Length | Score | Probability |
|---|---|---|---|---|---|---|
| 5119127_c2_153 | 977 | 2897 | 651 | 1956 | 1464 | 6.4e-150 |

| Protein name | | | | Locus Name | | Acc# |
|---|---|---|---|---|---|---|
| | | | | sp:YHES_ECOLI | | P45535 |

Description

HYPOTHETICAL ABC TRANSPORTER ATP-BINDING PROTEIN YHES

| ORF Name | NTID | AAID | NT Length | AA Length | Score | Probability |
|---|---|---|---|---|---|---|
| 6727086_f1_17 | 978 | 2898 | 563 | 1692 | 879 | 6.3e-88 |

| Protein name | | | Locus Name | | Acc# |
|---|---|---|---|---|---|
| putative gamma-glutamylcysteine synthetase | | | gp:PSP243941 | | AJ243941 |

Description

Pseudomonas sp. strain HR199 partial vanB, fdh, gcs, ehyA and ehyBgenes.

| ORF Name | NTID | AAID | NT Length | AA Length | Score | Probability |
|---|---|---|---|---|---|---|
| 673253_f3_72 | 979 | 2899 | 407 | 1224 | 1146 | 3.2e-116 |

| Protein name | | | | Locus Name | | Acc# |
|---|---|---|---|---|---|---|
| | | | | sp:DNAJ_SALTY | | Q60004 |

Description

DNAJ PROTEIN

| ORF Name | NTID | AAID | NT Length | AA Length | Score | Probability |
|---|---|---|---|---|---|---|
| 6854677_c3_167 | 980 | 2900 | 462 | 1389 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 801452_f2_60 | 981 | 2901 | 76 | 231 | | |

Protein name | | | | Locus Name | Acc#

Description

NO-HIT

| ORF_Name | NTID | AAID | NT Length | AA Length | Score | Probability |
|---|---|---|---|---|---|---|
| 884712_c1_113 | 982 | 2902 | 1191 | 3576 | 79 | 0.0031 |

Protein name: hypothetical protein PH1246 | Locus Name: pir:A71069 | Acc#: A71069

Description

| ORF_Name | NTID | AAID | NT Length | AA Length | Score | Probability |
|---|---|---|---|---|---|---|
| 915633_c1_115 | 983 | 2903 | 74 | 225 | | |

Protein name | | | | Locus Name | Acc#

Description

NO-HIT

| ORF_Name | NTID | AAID | NT Length | AA Length | Score | Probability |
|---|---|---|---|---|---|---|
| 9766888_f1_18 | 984 | 2904 | 182 | 549 | 229 | 4.8e-19 |

Protein name | | | | Locus Name: sp:YA21_PSEAE | Acc#: P21482

Description

HYPOTHETICAL 17.8 KD PROTEIN IN ALGR2 5'REGION

| ORF_Name | NTID | AAID | NT Length | AA Length | Score | Probability |
|---|---|---|---|---|---|---|
| 10329680_f1_3 | 985 | 2905 | 544 | 1635 | 587 | 5.5e-57 |

Protein name | | | | Locus Name: gp:PSEOPRC | Acc#: D28119

Description

Pseudomonas aeruginosa oprC gene for outer membrane protein C, complete cds.

| ORF Name | NTID | AAID | NT Length | AA Length | Score | Probability |
|---|---|---|---|---|---|---|
| 10626550_c3_128 | 986 | 2906 | 65 | 198 | | |

Protein name | Locus Name | Acc#

Description

NO-HIT

| ORF Name | NTID | AAID | NT Length | AA Length | Score | Probability |
|---|---|---|---|---|---|---|
| 11017010_c3_139 | 987 | 2907 | 247 | 744 | | |

Protein name | Locus Name | Acc#

Description

NO-HIT

| ORF Name | NTID | AAID | NT Length | AA Length | Score | Probability |
|---|---|---|---|---|---|---|
| 12894752_f1_13 | 988 | 2908 | 69 | 210 | 84 | 0.016 |

Protein name | Locus Name | Acc#
conserved hypothetical protein | pir:A72221 | A72221

Description

| ORF Name | NTID | AAID | NT Length | AA Length | Score | Probability |
|---|---|---|---|---|---|---|
| 13759627_c3_138 | 989 | 2909 | 88 | 267 | | |

Protein name | Locus Name | Acc#

Description

NO-HIT

| ORF Name | NTID | AAID | NT Length | AA Length | Score | Probability |
|---|---|---|---|---|---|---|
| 14633433_f3_55 | 990 | 2910 | 122 | 369 | | |

Protein name | Locus Name | Acc#

Description

NO-HIT

| ORF Name | NTID | AAID | NT Length | AA Length | Score | Probability |
|---|---|---|---|---|---|---|
| 16023402_c3_125 | 991 | 2911 | 887 | 2664 | 1410 | 6.3e-160 |

| Protein name | Locus Name | Acc# |
|---|---|---|
| | sp:FTSK_COXBU | P39920 |

Description

CELL DIVISION PROTEIN FTSK HOMOLOG

| ORF Name | NTID | AAID | NT Length | AA Length | Score | Probability |
|---|---|---|---|---|---|---|
| 19537930_f1_1 | 992 | 2912 | 97 | 294 | 116 | 4.5e-07 |

| Protein name | Locus Name | Acc# |
|---|---|---|
| hypothetical protein APE0900 | pir:D72685 | D72685 |

Description

| ORF Name | NTID | AAID | NT Length | AA Length | Score | Probability |
|---|---|---|---|---|---|---|
| 19812500_f1_14 | 993 | 2913 | 974 | 2925 | 2125 | 5.8e-220 |

| Protein name | Locus Name | Acc# |
|---|---|---|
| | sp:DPO1_HAEIN | P43741 |

Description

DNA POLYMERASE I, (POL I)

| ORF Name | NTID | AAID | NT Length | AA Length | Score | Probability |
|---|---|---|---|---|---|---|
| 2008433_c1_102 | 994 | 2914 | 287 | 864 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 20506502_c2_105 | 995 | 2915 | 62 | 189 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 20581377_c3_127 | 996 | 2916 | 888 | 2667 | 2717 | 1.1e-282 |

| Protein name | Locus Name | Acc# |
|---|---|---|
| DNA topoisomerase, | pir:G64119 | G64119 |

Description

---

| ORF Name | NTID | AAID | NT Length | AA Length | Score | Probability |
|---|---|---|---|---|---|---|
| 2131550_f1_9 | 997 | 2917 | 115 | 348 | 153 | 5.4e-11 |

| Protein name | Locus Name | Acc# |
|---|---|---|
| pterin-4-alpha-carbinolamine dehydratase:protein ssl2296:protein ssl2296 | pir:S74881 | S74881 |

Description

---

| ORF Name | NTID | AAID | NT Length | AA Length | Score | Probability |
|---|---|---|---|---|---|---|
| 22119402_f3_77 | 998 | 2918 | 262 | 789 | 491 | 8.2e-47 |

| Protein name | Locus Name | Acc# |
|---|---|---|
|  | sp:OCCM_AGRT1 | P35115 |

Description

OCTOPINE TRANSPORT SYSTEM PERMEASE PROTEIN OCCM

---

| ORF Name | NTID | AAID | NT Length | AA Length | Score | Probability |
|---|---|---|---|---|---|---|
| 234408_c2_111 | 999 | 2919 | 129 | 390 | 275 | 6.3e-24 |

| Protein name | Locus Name | Acc# |
|---|---|---|
|  | sp:RRMA_ECOLI | P36999 |

Description

METHYLTRANSFERASE)

---

| ORF Name | NTID | AAID | NT Length | AA Length | Score | Probability |
|---|---|---|---|---|---|---|
| 23928130_f3_66 | 1000 | 2920 | 63 | 192 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24256553_f2_31 | 1001 | 2921 | 751 | 2256 | 2080 | 3.4e-215 |

| Protein name | | | | Locus Name | | Acc# |
|---|---|---|---|---|---|---|
| DNA topoisomerase IV | | | | gp:AB023570 | | AB023570 |

Description

Vibrio parahaemolyticus parC gene for DNA topoisomerase IV, complete cds.

| ORF Name | NTID | AAID | NT Length | AA Length | Score | Probability |
|---|---|---|---|---|---|---|
| 24645763_c1_91 | 1002 | 2922 | 296 | 891 | 255 | 8.4e-22 |

| Protein name | | | | Locus Name | | Acc# |
|---|---|---|---|---|---|---|
| hypothetical protein jhp1155 | | | | pir:G71841 | | G71841 |

Description

| ORF Name | NTID | AAID | NT Length | AA Length | Score | Probability |
|---|---|---|---|---|---|---|
| 24881313_f2_32 | 1003 | 2923 | 70 | 213 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 25417950_c3_134 | 1004 | 2924 | 162 | 489 | 214 | 1.8e-17 |

| Protein name | | | | Locus Name | | Acc# |
|---|---|---|---|---|---|---|
| | | | | sp:RRMA_ECOLI | | P36999 |

Description

METHYLTRANSFERASE)

| ORF Name | NTID | AAID | NT Length | AA Length | Score | Probability |
|---|---|---|---|---|---|---|
| 31406308_c2_113 | 1005 | 2925 | 114 | 345 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 31485625_f3_72 | 1006 | 2926 | 275 | 828 | 427 | 5.0e-40 |

| Protein name | | | | Locus Name | | Acc# |
|---|---|---|---|---|---|---|
| | | | | gp:AB032934 | | AB032934 |

Description

Vibrio alginolyticus pfsA, orfC, orfD genes for PF60 and hypothetical proteins, complete cds.

| ORF Name | NTID | AAID | NT Length | AA Length | Score | Probability |
|---|---|---|---|---|---|---|
| 34025462_c1_104 | 1007 | 2927 | 69 | 210 | | |

| Protein name | | | | Locus Name | | Acc# |

Description

NO-HIT

| ORF Name | NTID | AAID | NT Length | AA Length | Score | Probability |
|---|---|---|---|---|---|---|
| 34086012_c1_97 | 1008 | 2928 | 138 | 417 | | |

| Protein name | | | | Locus Name | | Acc# |

Description

NO-HIT

| ORF Name | NTID | AAID | NT Length | AA Length | Score | Probability |
|---|---|---|---|---|---|---|
| 35360075_f1_2 | 1009 | 2929 | 166 | 501 | 73 | 0.032 |

| Protein name | | | | Locus Name | | Acc# |
|---|---|---|---|---|---|---|
| nef protein | | | | gp:AF169778 | | AF169778 |

Description

HIV-1 isolate G221 from India nef protein (nef) gene, partial cds; and 3' long terminal repeat, partial sequence.

| ORF Name | NTID | AAID | NT Length | AA Length | Score | Probability |
|---|---|---|---|---|---|---|
| 36110253_f2_36 | 1010 | 2930 | 108 | 327 | 76 | 0.0077 |

| Protein name | | | | Locus Name | | Acc# |
|---|---|---|---|---|---|---|
| outer surface protein A | | | | gp:BBPWUDII | | X68539 |

Description

B.burgdorferi (PWudII) plasmid OspA gene for outer surface proteinA.

290

| ORF Name | NTID | AAID | NT Length | AA Length | Score | Probability |
|---|---|---|---|---|---|---|
| 3945893_f3_71 | 1011 | 2931 | 286 | 861 | 825 | 3.3e-82 |

| Protein name | | | | Locus Name | | Acc# |
|---|---|---|---|---|---|---|
| | | | | gp:AB032934 | | AB032934 |

Description

Vibrio alginolyticus pfsA, orfC, orfD genes for PF60 and hypothetical proteins, complete cds.

| ORF Name | NTID | AAID | NT Length | AA Length | Score | Probability |
|---|---|---|---|---|---|---|
| 4337963_f2_51 | 1012 | 2932 | 268 | 807 | 434 | 9.0e-41 |

| Protein name | | | | Locus Name | | Acc# |
|---|---|---|---|---|---|---|
| | | | | gp:AB032934 | | AB032934 |

Description

Vibrio alginolyticus pfsA, orfC, orfD genes for PF60 and hypothetical proteins, complete cds.

| ORF Name | NTID | AAID | NT Length | AA Length | Score | Probability |
|---|---|---|---|---|---|---|
| 4691525_f1_7 | 1013 | 2933 | 78 | 237 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4735333_c2_110 | 1014 | 2934 | 570 | 1713 | 1749 | 4.0e-180 |

| Protein name | | | | Locus Name | | Acc# |
|---|---|---|---|---|---|---|
| | | | | sp:RF3_HAEIN | | P43928 |

Description

PEPTIDE CHAIN RELEASE FACTOR 3 (RF-3)

| ORF Name | NTID | AAID | NT Length | AA Length | Score | Probability |
|---|---|---|---|---|---|---|
| 5102193_f2_54 | 1015 | 2935 | 372 | 1119 | 897 | 7.8e-90 |

| Protein name | | | | | Locus Name | Acc# |
|---|---|---|---|---|---|---|
| | | | | | sp:GLMU_HAEIN | P43889 |

Description

ACETYLGLUCOSAMINE-1-PHOSPHATE URIDYLTRANSFERASE)

| ORF Name | NTID | AAID | NT Length | AA Length | Score | Probability |
|---|---|---|---|---|---|---|
| 5111013_c3_126 | 1016 | 2936 | 201 | 606 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 6516518_f1_25 | 1017 | 2937 | 243 | 732 | 499 | 1.2e-47 |

| Protein name | | | | | Locus Name | Acc# |
|---|---|---|---|---|---|---|
| | | | | | sp:NOCQ_AGRT5 | P35118 |

Description

NOPALINE TRANSPORT SYSTEM PERMEASE PROTEIN NOCQ

| ORF Name | NTID | AAID | NT Length | AA Length | Score | Probability |
|---|---|---|---|---|---|---|
| 6820875_c1_100 | 1018 | 2938 | 345 | 1038 | 159 | 8.8e-09 |

| Protein name | | | | | Locus Name | Acc# |
|---|---|---|---|---|---|---|
| apolipoprotein A-IV precursor | | | | | pir:C40892 | C40892 |

Description

| ORF Name | NTID | AAID | NT Length | AA Length | Score | Probability |
|---|---|---|---|---|---|---|
| 807692_c3_137 | 1019 | 2939 | 563 | 1692 | 171 | 1.2e-08 |

| Protein name | | | | | Locus Name | Acc# |
|---|---|---|---|---|---|---|
| Trip230 | | | | | gp:AF007217 | AF007217 |

Description

Homo sapiens Trip230 mRNA, complete cds.

| ORF Name | NTID | AAID | NT Length | AA Length | Score | Probability |
|---|---|---|---|---|---|---|
| 978502_f2_52 | 1020 | 2940 | 266 | 801 | 430 | 2.4e-40 |

| Protein name | | | | Locus Name | | Acc# |
|---|---|---|---|---|---|---|
| | | | | gp:AB032934 | | AB032934 |

Description

Vibrio alginolyticus pfsA, orfC, orfD genes for PF60 and hypothetical proteins, complete cds.

| ORF Name | NTID | AAID | NT Length | AA Length | Score | Probability |
|---|---|---|---|---|---|---|
| 10056500_f1_3 | 1021 | 2941 | 78 | 237 | 163 | 4.7e-12 |

| Protein name | | | | Locus Name | | Acc# |
|---|---|---|---|---|---|---|
| hypothetical protein HI0187 | | | | pir:B64145 | | B64145 |

Description

| ORF Name | NTID | AAID | NT Length | AA Length | Score | Probability |
|---|---|---|---|---|---|---|
| 10656456_c3_200 | 1022 | 2942 | 463 | 1392 | 831 | 7.7e-83 |

| Protein name | | | | Locus Name | | Acc# |
|---|---|---|---|---|---|---|
| | | | | sp:YWBN_BACSU | | P39597 |

Description

HYPOTHETICAL 45.7 KD PROTEIN IN EPR-GALK INTERGENIC REGION PRECURSOR

| ORF Name | NTID | AAID | NT Length | AA Length | Score | Probability |
|---|---|---|---|---|---|---|
| 12603450_f1_20 | 1023 | 2943 | 558 | 1677 | 1262 | 1.6e-128 |

| Protein name | | | | Locus Name | | Acc# |
|---|---|---|---|---|---|---|
| | | | | sp:PILB_PSEAE | | P22608 |

Description

FIMBRIAL ASSEMBLY PROTEIN PILB

| ORF Name | NTID | AAID | NT Length | AA Length | Score | Probability |
|---|---|---|---|---|---|---|
| 12978955_f2_43 | 1024 | 2944 | 274 | 825 | 609 | 2.6e-59 |

| Protein name | | | | Locus Name | | Acc# |
|---|---|---|---|---|---|---|
| | | | | sp:YH25_AZOCH | | P54085 |

Description (ORF5)

| ORF Name | NTID | AAID | NT Length | AA Length | Score | Probability |
|---|---|---|---|---|---|---|
| 13679786_f3_112 | 1025 | 2945 | 110 | 333 | 105 | 1.2e-05 |

| Protein name | Locus Name | Acc# |
|---|---|---|
| hypothetical protein | gp:BSZ75208 | Z75208 |

Description

B.subtilis genomic sequence 89009bp.

| ORF Name | NTID | AAID | NT Length | AA Length | Score | Probability |
|---|---|---|---|---|---|---|
| 13712643_c3_187 | 1026 | 2946 | 215 | 648 | 113 | 0.00040 |

| Protein name | Locus Name | Acc# |
|---|---|---|
| conserved hypothetical protein | pir:B75483 | B75483 |

Description

| ORF Name | NTID | AAID | NT Length | AA Length | Score | Probability |
|---|---|---|---|---|---|---|
| 14191915_f2_69 | 1027 | 2947 | 365 | 1098 | 329 | 2.5e-34 |

| Protein name | Locus Name | Acc# |
|---|---|---|
| conserved hypothetical protein ylbK | pir:H69874 | H69874 |

Description

| ORF Name | NTID | AAID | NT Length | AA Length | Score | Probability |
|---|---|---|---|---|---|---|
| 14251568_f2_72 | 1028 | 2948 | 118 | 357 | 207 | 1.0e-16 |

| Protein name | Locus Name | Acc# |
|---|---|---|
| hypothetical protein APE1486 | pir:F72628 | F72628 |

Description

| ORF Name | NTID | AAID | NT Length | AA Length | Score | Probability |
|---|---|---|---|---|---|---|
| 14492180_c2_149 | 1029 | 2949 | 67 | 204 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14511561_c3_197 | 1030 | 2950 | 1319 | 3960 | 3473 | 0.0 |

Protein name: phosphoribosylformylglycinamidine synthase,:formylglycinamide ribonucleotide synthetase:phosphoribosylformylglycinamidine Locus Name: pir:SYECPG    Acc#:

Description

| ORF Name | NTID | AAID | NT Length | AA Length | Score | Probability |
|---|---|---|---|---|---|---|
| 14878927_f2_42 | 1031 | 2951 | 271 | 816 | 294 | 4.8e-39 |

Protein name

Locus Name: sp:HIS2_AQUAE    Acc#: O67780

Description

| ORF Name | NTID | AAID | NT Length | AA Length | Score | Probability |
|---|---|---|---|---|---|---|
| 14882750_c2_164 | 1032 | 2952 | 409 | 1230 | 585 | 9.0e-57 |

Protein name: putative membrane transport protein.

Locus Name: gp:SCC75A    Acc#: AL133220

Description: Streptomyces coelicolor cosmid C75A.

| ORF Name | NTID | AAID | NT Length | AA Length | Score | Probability |
|---|---|---|---|---|---|---|
| 14970637_c3_176 | 1033 | 2953 | 237 | 714 | 791 | 1.3e-78 |

Protein name

Locus Name: sp:CLPP_ECOLI    Acc#: P19245

Description: PROTEIN F21.5)

| ORF Name | NTID | AAID | NT Length | AA Length | Score | Probability |
|---|---|---|---|---|---|---|
| 15831636_c2_158 | 1034 | 2954 | 127 | 384 | 236 | 1.5e-19 |

Protein name: Acriflavin resistance protein D.

Locus Name: gp:D90846    Acc#:

Description: E.coli genomic DNA, Kohara clone #357(46.5-46.8 min.).

295

| ORF_Name | NTID | AAID | NT Length | AA Length | Score | Probability |
|---|---|---|---|---|---|---|
| 165842_c2_157 | 1035 | 2955 | 205 | 618 | 332 | 5.8e-30 |

Protein name | Locus Name | Acc#
sp:NOLH_RHIME | P25198

Description
NODULATION PROTEIN NOLH PRECURSOR

| ORF_Name | NTID | AAID | NT Length | AA Length | Score | Probability |
|---|---|---|---|---|---|---|
| 16687526_f1_10 | 1036 | 2956 | 448 | 1347 | 1082 | 1.9e-109 |

Protein name | Locus Name | Acc#
sp:ARGA_ECOLI

Description
SYNTHASE) (AGS)

| ORF_Name | NTID | AAID | NT Length | AA Length | Score | Probability |
|---|---|---|---|---|---|---|
| 191675_c2_150 | 1037 | 2957 | 251 | 756 | 698 | 9.5e-69 |

Protein name | Locus Name | Acc#
5' adenylylsulfate APS reductase | gp:AF170343 | AF170343

Description
Burkholderia cepacia 5' adenylylsulfate APS reductase (cysH) gene, complete cds; and ATP sulfurylase small subunit (cysD) gene, partial cds.

| ORF_Name | NTID | AAID | NT Length | AA Length | Score | Probability |
|---|---|---|---|---|---|---|
| 19821942_c3_205 | 1038 | 2958 | 64 | 195 | | |

Protein name | Locus Name | Acc#

Description
NO-HIT

| ORF_Name | NTID | AAID | NT Length | AA Length | Score | Probability |
|---|---|---|---|---|---|---|
| 20203302_c3_185 | 1039 | 2959 | 226 | 681 | 141 | 4.0e-08 |

Protein name | Locus Name | Acc#
DnrE protein | gp:PST131716 | AJ131716

Description
Pseudomonas stutzeri dnrE gene and ORF235 (partial).

| ORF Name | NTID | AAID | NT Length | AA Length | Score | Probability |
|---|---|---|---|---|---|---|
| 20570385_c2_159 | 1040 | 2960 | 193 | 582 | | |

Protein name | Locus Name | Acc#

Description

NO-HIT

| ORF Name | NTID | AAID | NT Length | AA Length | Score | Probability |
|---|---|---|---|---|---|---|
| 21494010_c2_174 | 1041 | 2961 | 455 | 1368 | 1377 | 1.1e-140 |

Protein name: nitric oxide reductase | Locus Name: gp:AF002217 | Acc#: AF002217

Description

Ralstonia eutropha megaplasmid pHG1 nitric oxide reductase (norB) gene, complete cds.

| ORF Name | NTID | AAID | NT Length | AA Length | Score | Probability |
|---|---|---|---|---|---|---|
| 21676712_c1_120 | 1042 | 2962 | 130 | 393 | 395 | 1.2e-36 |

Protein name: sulfate adenylyltransferase subunit CysN | Locus Name: gp:AF130466 | Acc#: AF130466

Description

Campylobacter jejuni peptide chain release factor 2 (prfB) gene, partial cds; alpha-2,3-sialyltransferase (cst-I) and sulfateadenylyltransferase subunit CysD (cysD) genes, complete cds; andsulfate adenylyltransferase subunit CysN (cysN) gene, partial cds.

| ORF Name | NTID | AAID | NT Length | AA Length | Score | Probability |
|---|---|---|---|---|---|---|
| 22078812_c2_154 | 1043 | 2963 | 727 | 2184 | 1636 | 3.8e-168 |

Protein name | Locus Name: sp:RECG_ECOLI | Acc#

Description

ATP-DEPENDENT DNA HELICASE RECG,

| ORF_Name | NTID | AAID | NT Length | AA Length | Score | Probability |
|---|---|---|---|---|---|---|
| 22350926_c1_115 | 1044 | 2964 | 724 | 2175 | 2193 | 3.6e-227 |

Protein name | Locus Name | Acc#
| | sp:FAOB_PSEFR | P28793 |

Description

| ORF_Name | NTID | AAID | NT Length | AA Length | Score | Probability |
|---|---|---|---|---|---|---|
| 23556252_c3_203 | 1045 | 2965 | 600 | 1803 | 709 | 6.0e-85 |

Protein name: glutamate synthase (ferredoxin) homolog yerD | Locus Name: pir:C69794 | Acc#: C69794

Description

| ORF_Name | NTID | AAID | NT Length | AA Length | Score | Probability |
|---|---|---|---|---|---|---|
| 23593830_c3_199 | 1046 | 2966 | 340 | 1023 | 462 | 9.7e-44 |

Protein name | Locus Name: sp:YWBM_BACSU | Acc#: P39596

Description: HYPOTHETICAL 42.8 KD PROTEIN IN EPR-GALK INTERGENIC REGION

| ORF_Name | NTID | AAID | NT Length | AA Length | Score | Probability |
|---|---|---|---|---|---|---|
| 23651900_f2_48 | 1047 | 2967 | 328 | 987 | 634 | 5.8e-62 |

Protein name | Locus Name: sp:YOHI_HAEIN | Acc#: P44606

Description: HYPOTHETICAL PROTEIN HI0270

| ORF_Name | NTID | AAID | NT Length | AA Length | Score | Probability |
|---|---|---|---|---|---|---|
| 23862576_c1_124 | 1048 | 2968 | 153 | 462 | 182 | 4.5e-14 |

Protein name: probable antibiotic resistance protein mtrC | Locus Name: pir:S42418 | Acc#

Description

| ORF Name | NTID | AAID | NT Length | AA Length | Score | Probability |
|---|---|---|---|---|---|---|
| 24042500_c3_183 | 1049 | 2969 | 313 | 942 | 608 | 3.3e-59 |

| Protein name | | | | Locus Name | | Acc# |
|---|---|---|---|---|---|---|
| | | | | sp:CYSN_MYCTU | | Q10600 |

Description

SULFURYLASE)

| ORF Name | NTID | AAID | NT Length | AA Length | Score | Probability |
|---|---|---|---|---|---|---|
| 24302260_c3_179 | 1050 | 2970 | 410 | 1233 | 1331 | 8.0e-136 |

| Protein name | | | | Locus Name | | Acc# |
|---|---|---|---|---|---|---|
| 3-oxoacyl-CoA thiolase | | | | gp:AF150672 | | AF150672 |

Description

Pseudomonas putida 3-oxoacyl-CoA thiolase (fadA) gene, completecds.

| ORF Name | NTID | AAID | NT Length | AA Length | Score | Probability |
|---|---|---|---|---|---|---|
| 25584438_c3_189 | 1051 | 2971 | 143 | 432 | 174 | 7.6e-12 |

| Protein name | | | | Locus Name | | Acc# |
|---|---|---|---|---|---|---|
| CeoB | | | | gp:BCU97042 | | U97042 |

Description

Burkholderia cepacia CeoA (ceoA) and CeoB (ceoB) genes, completecds.

| ORF Name | NTID | AAID | NT Length | AA Length | Score | Probability |
|---|---|---|---|---|---|---|
| 25984558_c3_188 | 1052 | 2972 | 134 | 405 | 133 | 1.8e-07 |

| Protein name | | | | Locus Name | | Acc# |
|---|---|---|---|---|---|---|
| acriflavin resistance protein D (acrD) RP170 | | | | pir:F71727 | | F71727 |

Description

| ORF Name | NTID | AAID | NT Length | AA Length | Score | Probability |
|---|---|---|---|---|---|---|
| 26741556_c1_135 | 1053 | 2973 | 198 | 597 | 101 | 0.0011 |

| Protein name | | | | Locus Name | | Acc# |
|---|---|---|---|---|---|---|
| | | | | sp:HA34_BRELC | | Q99074 |

Description

HAM34 PROTEIN

| ORF Name | NTID | AAID | NT Length | AA Length | Score | Probability |
|---|---|---|---|---|---|---|
| 3245640_c3_190 | 1054 | 2974 | 425 | 1278 | 265 | 9.4e-20 |

Protein name: probable cation efflux system protein
Locus Name: pir:E71874
Acc#: E71874

Description:

| ORF Name | NTID | AAID | NT Length | AA Length | Score | Probability |
|---|---|---|---|---|---|---|
| 3375052_c1_125 | 1055 | 2975 | 144 | 435 | 177 | 3.6e-12 |

Protein name: probable efflux transporter
Locus Name: pir:H71918
Acc#: H71918

Description:

| ORF Name | NTID | AAID | NT Length | AA Length | Score | Probability |
|---|---|---|---|---|---|---|
| 34027092_c2_175 | 1056 | 2976 | 74 | 222 | 60 | 0.025 |

Protein name: tonoplast intrinsic protein
Locus Name: gp:AF037061
Acc#: AF037061

Description: Zea mays tonoplast intrinsic protein (ZmTIP1) mRNA, complete cds.

| ORF Name | NTID | AAID | NT Length | AA Length | Score | Probability |
|---|---|---|---|---|---|---|
| 35197126_f3_79 | 1057 | 2977 | 179 | 540 | 155 | 3.3e-11 |

Protein name: TatB protein
Locus Name: gp:ECO5830
Acc#: AJ005830

Description: Escherichia coli tatABCD operon.

| ORF Name | NTID | AAID | NT Length | AA Length | Score | Probability |
|---|---|---|---|---|---|---|
| 35339135_f2_61 | 1058 | 2978 | 264 | 795 | 308 | 2.9e-35 |

Protein name:
Locus Name: sp:LEP3_AERHY
Acc#: P45794

Description: TYPE 4 PREPILIN-LIKE PROTEIN SPECIFIC LEADER PEPTIDASE,

| ORF_Name | NTID | AAID | NT Length | AA Length | Score | Probability |
|---|---|---|---|---|---|---|
| 35395926_f1_6 | 1059 | 2979 | 511 | 1536 | 325 | 2.2e-35 |

| Protein name | | | | Locus_Name | | Acc# |
|---|---|---|---|---|---|---|
| probable helicase | | | | pir:T40239 | | T40239 |

Description

| ORF_Name | NTID | AAID | NT Length | AA Length | Score | Probability |
|---|---|---|---|---|---|---|
| 36047308_f2_50 | 1060 | 2980 | 105 | 318 | | |

| Protein name | | | | Locus_Name | | Acc# |
|---|---|---|---|---|---|---|

Description

NO-HIT

| ORF_Name | NTID | AAID | NT Length | AA Length | Score | Probability |
|---|---|---|---|---|---|---|
| 3939838_c2_173 | 1061 | 2981 | 66 | 201 | 189 | 8.2e-15 |

| Protein name | | | | Locus_Name | | Acc# |
|---|---|---|---|---|---|---|
| | | | | sp:RL35_PSESY | | P52830 |

Description

50S RIBOSOMAL PROTEIN L35

| ORF_Name | NTID | AAID | NT Length | AA Length | Score | Probability |
|---|---|---|---|---|---|---|
| 3947675_f2_46 | 1062 | 2982 | 250 | 753 | 375 | 1.6e-34 |

| Protein name | | | | Locus_Name | | Acc# |
|---|---|---|---|---|---|---|
| | | | | sp:HUTC_KLEAE | | P12380 |

Description

HISTIDINE UTILIZATION REPRESSOR

| ORF_Name | NTID | AAID | NT Length | AA Length | Score | Probability |
|---|---|---|---|---|---|---|
| 3954218_c3_177 | 1063 | 2983 | 441 | 1326 | 1252 | 7.6e-140 |

| Protein name | | | | Locus_Name | | Acc# |
|---|---|---|---|---|---|---|
| | | | | sp:CLPX_HAEIN | | P44838 |

Description

ATP-DEPENDENT CLP PROTEASE ATP-BINDING SUBUNIT CLPX

| ORF Name | NTID | AAID | NT Length | AA Length | Score | Probability |
|---|---|---|---|---|---|---|
| 4328428_c1_119 | 1064 | 2984 | 310 | 933 | 911 | 2.6e-91 |

Protein name: 
Locus Name: sp:CYSD_MYCTU
Acc#: Q10599

Description: SULFURYLASE)

| ORF Name | NTID | AAID | NT Length | AA Length | Score | Probability |
|---|---|---|---|---|---|---|
| 4485963_c3_206 | 1065 | 2985 | 121 | 366 | 469 | 1.8e-44 |

Protein name: ribosomal protein L20
Locus Name: pir:R5EC20
Acc#:

Description:

| ORF Name | NTID | AAID | NT Length | AA Length | Score | Probability |
|---|---|---|---|---|---|---|
| 5120443_f3_94 | 1066 | 2986 | 214 | 645 | 363 | 3.0e-33 |

Protein name: 
Locus Name: sp:YACE_VIBVU
Acc#: Q56741

Description: HYPOTHETICAL 22.5 KD PROTEIN IN VVPD 3'REGION (ORFX)

| ORF Name | NTID | AAID | NT Length | AA Length | Score | Probability |
|---|---|---|---|---|---|---|
| 5890643_f2_73 | 1067 | 2987 | 380 | 1143 | 131 | 7.7e-07 |

Protein name: dnaJ protein homolog
Locus Name: pir:S34632
Acc#: S34632

Description:

| ORF Name | NTID | AAID | NT Length | AA Length | Score | Probability |
|---|---|---|---|---|---|---|
| 7277_f3_93 | 1068 | 2988 | 423 | 1272 | 664 | 3.8e-65 |

Protein name: pilus assembly protein PilC
Locus Name: gp:AF038655
Acc#: AF038655

Description: Legionella pneumophila pilus assembly protein PilB (pilB), pilusassembly protein PilC (pilC), and type IV prepilin-like proteinspecific leader peptidase PilD (pilD) genes, complete cds.

| ORF_Name | NTID | AAID | NT Length | AA Length | Score | Probability |
|---|---|---|---|---|---|---|
| 978517_c2_166 | 1069 | 2989 | 433 | 1302 | 615 | 5.8e-112 |

Protein name | Locus Name | Acc#
sp:GLTS_HAEIN | P45240

Description
SODIUM/GLUTAMATE SYMPORT CARRIER PROTEIN (GLUTAMATE PERMEASE)

| ORF_Name | NTID | AAID | NT Length | AA Length | Score | Probability |
|---|---|---|---|---|---|---|
| 10547711_c2_8 | 1070 | 2990 | 275 | 828 | 933 | 1.2e-93 |

Protein name | Locus Name | Acc#
sp:ABC_HAEIN | P44785

Description
ATP-BINDING PROTEIN ABC

| ORF_Name | NTID | AAID | NT Length | AA Length | Score | Probability |
|---|---|---|---|---|---|---|
| 188807_c2_10 | 1071 | 2991 | 118 | 354 | 320 | 1.1e-28 |

Protein name | Locus Name | Acc#
sp:PLPA_PASHA |

Description
OUTER MEMBRANE LIPOPROTEIN 1 PRECURSOR (PLP1)

| ORF_Name | NTID | AAID | NT Length | AA Length | Score | Probability |
|---|---|---|---|---|---|---|
| 19589635_c1_7 | 1072 | 2992 | 99 | 300 | 190 | 6.5e-15 |

Protein name | Locus Name | Acc#
ORF120 | gp:ECORRNHK12 | D15061

Description
E.coli genomic DNA, 5'flanking region of rrnH gene.

| ORF_Name | NTID | AAID | NT Length | AA Length | Score | Probability |
|---|---|---|---|---|---|---|
| 24353193_f1_1 | 1073 | 2993 | 95 | 288 | 113 | 9.3e-07 |

Protein name | Locus Name | Acc#
hypothetical protein PH0133 | pir:C71234 | C71234

Description

| ORF_Name | NTID | AAID | NT Length | AA Length | Score | Probability |
|---|---|---|---|---|---|---|
| 35582056_c3_11 | 1074 | 2994 | 240 | 723 | 631 | 1.2e-61 |

| Protein name | Locus Name | Acc# |
|---|---|---|
| | sp:YAEE_HAEIN | P46492 |

Description

HYPOTHETICAL ABC TRANSPORTER PERMEASE PROTEIN HI0620.1

| ORF_Name | NTID | AAID | NT Length | AA Length | Score | Probability |
|---|---|---|---|---|---|---|
| 4144442_f2_6 | 1075 | 2995 | 131 | 396 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 16924127_f1_1 | 1076 | 2996 | 367 | 1104 | 137 | 7.2e-06 |

| Protein name | Locus Name | Acc# |
|---|---|---|
| | gp:PSENOSA | M60717 |

Description

P.stutzeri NosA protein (nosA) gene, complete cds.

| ORF_Name | NTID | AAID | NT Length | AA Length | Score | Probability |
|---|---|---|---|---|---|---|
| 5109792_f2_3 | 1077 | 2997 | 122 | 369 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 16681688_c1_3 | 1078 | 2998 | 60 | 183 | 55 | 0.044 |

| Protein name | Locus Name | Acc# |
|---|---|---|
| | sp:RNH_HELPY | P56120 |

Description

RIBONUCLEASE H, (RNASE H)

| ORF Name | NTID | AAID | NT Length | AA Length | Score | Probability |
|---|---|---|---|---|---|---|
| 24039143_f1_1 | 1079 | 2999 | 345 | 1038 | 637 | 2.8e-62 |

Protein name: ornithine decarboxylase
Locus Name: pir:D72200
Acc#: D72200

Description

| ORF Name | NTID | AAID | NT Length | AA Length | Score | Probability |
|---|---|---|---|---|---|---|
| 29337840_f2_2 | 1080 | 3000 | 150 | 450 | 95 | 0.014 |

Protein name: AvtA
Locus Name: gp:AF014804
Acc#: AF014804

Description: Neisseria meningitidis PglB (pglB), PglC (pglC), PglD (pglD), and AvtA (avtA) genes, complete cds.

| ORF Name | NTID | AAID | NT Length | AA Length | Score | Probability |
|---|---|---|---|---|---|---|
| 11900461_f2_7 | 1081 | 3001 | 69 | 210 | | |

Protein name
Locus Name
Acc#

Description: NO-HIT

| ORF Name | NTID | AAID | NT Length | AA Length | Score | Probability |
|---|---|---|---|---|---|---|
| 14573562_f1_2 | 1082 | 3002 | 341 | 1026 | 1075 | 1.1e-108 |

Protein name
Locus Name: sp:TRMU_ECOLI
Acc#

Description: (EC 2.1.1.61)

| ORF Name | NTID | AAID | NT Length | AA Length | Score | Probability |
|---|---|---|---|---|---|---|
| 30270465_f1_3 | 1083 | 3003 | 249 | 750 | 185 | 5.7e-14 |

Protein name
Locus Name: sp:YYAD_BACSU
Acc#: P37520

Description: HYPOTHETICAL 37.7 KD PROTEIN IN RPSF-SPO0J INTERGENIC REGION

| ORF Name | NTID | AAID | NT Length | AA Length | Score | Probability |
|---|---|---|---|---|---|---|
| 6365936_f2_6 | 1084 | 3004 | 108 | 327 | 170 | 8.5e-13 |
| Protein name | | | | Locus Name | | Acc# |
| | | | | gp:ECPURB | | X59307 |

Description

E.coli ORF-15, ORF-23, purB and phoP (5'end) genes.

| ORF Name | NTID | AAID | NT Length | AA Length | Score | Probability |
|---|---|---|---|---|---|---|
| 6537957_c1_11 | 1085 | 3005 | 200 | 603 | 454 | 6.8e-43 |
| Protein name | | | | Locus Name | | Acc# |
| | | | | sp:YGBB_ECOLI | | P36663 |

Description

HYPOTHETICAL 16.9 KD PROTEIN IN SURE-CYSC INTERGENIC REGION (ORF0)

| ORF Name | NTID | AAID | NT Length | AA Length | Score | Probability |
|---|---|---|---|---|---|---|
| 173187_f3_5 | 1086 | 3006 | 66 | 201 | | |
| Protein name | | | | Locus Name | | Acc# |

Description

NO-HIT

| ORF Name | NTID | AAID | NT Length | AA Length | Score | Probability |
|---|---|---|---|---|---|---|
| 34407827_f2_2 | 1087 | 3007 | 366 | 1101 | 786 | 4.5e-78 |
| Protein name | | | | Locus Name | | Acc# |
| | | | | sp:LCFA_ECOLI | | P29212 |

Description

SYNTHETASE)

| ORF Name | NTID | AAID | NT Length | AA Length | Score | Probability |
|---|---|---|---|---|---|---|
| 7285152_f1_1 | 1088 | 3008 | 69 | 207 | | |
| Protein name | | | | Locus Name | | Acc# |

Description

NO-HIT

| ORF Name | NTID | AAID | NT Length | AA Length | Score | Probability |
|---|---|---|---|---|---|---|
| 16056563_c2_63 | 1089 | 3009 | 141 | 426 | 90 | 0.020 |

| Protein name | Locus Name | Acc# |
|---|---|---|
| hypothetical wtfw protein | pir:T41252 | T41252 |

Description

---

| ORF Name | NTID | AAID | NT Length | AA Length | Score | Probability |
|---|---|---|---|---|---|---|
| 1986087_f3_30 | 1090 | 3010 | 412 | 1239 | 1316 | 3.1e-134 |

| Protein name | Locus Name | Acc# |
|---|---|---|
| | sp:SERA_HAEIN | P43885 |

Description

D-3-PHOSPHOGLYCERATE DEHYDROGENASE, (PGDH)

---

| ORF Name | NTID | AAID | NT Length | AA Length | Score | Probability |
|---|---|---|---|---|---|---|
| 2072762_f1_10 | 1091 | 3011 | 1220 | 3663 | 524 | 4.4e-93 |

| Protein name | Locus Name | Acc# |
|---|---|---|
| chromosome segregation SMC protein:minichromosome stabilizing protein SMC | pir:G69708 | |

Description

---

| ORF Name | NTID | AAID | NT Length | AA Length | Score | Probability |
|---|---|---|---|---|---|---|
| 21531252_f3_36 | 1092 | 3012 | 303 | 912 | 722 | 2.7e-71 |

| Protein name | Locus Name | Acc# |
|---|---|---|
| translation elongation factor EF-Ts | pir:EFECS | |

Description

---

| ORF Name | NTID | AAID | NT Length | AA Length | Score | Probability |
|---|---|---|---|---|---|---|
| 23406_f1_11 | 1093 | 3013 | 278 | 837 | 898 | 6.1e-90 |

| Protein name | Locus Name | Acc# |
|---|---|---|
| | sp:RS2_SPIPL | P34831 |

Description

30S RIBOSOMAL PROTEIN S2

| ORF Name | NTID | AAID | NT Length | AA Length | Score | Probability |
|---|---|---|---|---|---|---|
| 23437562_f1_7 | 1094 | 3014 | 253 | 762 | 186 | 3.2e-18 |

| Protein name | | Locus Name | Acc# |
|---|---|---|---|
| hypothetical protein HP0862 | | pir:F64627 | F64627 |

Description

---

| ORF Name | NTID | AAID | NT Length | AA Length | Score | Probability |
|---|---|---|---|---|---|---|
| 23613510_c2_70 | 1095 | 3015 | 374 | 1125 | 700 | 5.8e-69 |

| Protein name | | Locus Name | Acc# |
|---|---|---|---|
| | | sp:YCFO_ECOLI | P75949 |

Description

HYPOTHETICAL 37.6 KD PROTEIN IN FHUE-NDH INTERGENIC REGION

---

| ORF Name | NTID | AAID | NT Length | AA Length | Score | Probability |
|---|---|---|---|---|---|---|
| 23861686_f3_35 | 1096 | 3016 | 180 | 543 | 526 | 1.6e-50 |

| Protein name | | Locus Name | Acc# |
|---|---|---|---|
| invasion protein homolog | | gp:AF116285 | AF116285 |

Description

Pseudomonas aeruginosa invasion protein homolog andphosphoenolpyruvate-protein phosphotransferase PtsP (ptsP) genes,complete cds.

---

| ORF Name | NTID | AAID | NT Length | AA Length | Score | Probability |
|---|---|---|---|---|---|---|
| 2460181_f1_1 | 1097 | 3017 | 987 | 2964 | 3662 | 0.0 |

| Protein name | | Locus Name | Acc# |
|---|---|---|---|
| | | sp:RPOB_PSEPU | P19175 |

Description

BETA CHAIN) (RNA POLYMERASE BETA SUBUNIT)

| ORF Name | NTID | AAID | NT Length | AA Length | Score | Probability |
|---|---|---|---|---|---|---|
| 25401687_c3_88 | 1098 | 3018 | 141 | 426 | 372 | 3.3e-34 |

Protein name | Locus Name | Acc#
gp:PAU89892 | U89892

Description

Pseudomonas aeruginosa virulence factor regulator (vfr) gene, partial cds.

| ORF Name | NTID | AAID | NT Length | AA Length | Score | Probability |
|---|---|---|---|---|---|---|
| 26064760_c3_93 | 1099 | 3019 | 66 | 201 | | |

Protein name | Locus Name | Acc#

Description

NO-HIT

| ORF Name | NTID | AAID | NT Length | AA Length | Score | Probability |
|---|---|---|---|---|---|---|
| 29890701_f3_31 | 1100 | 3020 | 469 | 1410 | 1678 | 1.3e-172 |

Protein name | Locus Name | Acc#
sp:GSHR_HAEIN | P43783

Description

GLUTATHIONE REDUCTASE, (GR) (GRASE)

| ORF Name | NTID | AAID | NT Length | AA Length | Score | Probability |
|---|---|---|---|---|---|---|
| 32287567_f2_16 | 1101 | 3021 | 1422 | 4269 | 4932 | 0.0 |

Protein name: 99% identity over 1407 amino acids with E. coli | Locus Name: gp:STYSTMF1 | Acc#: AF170176

Description

Salmonella typhimurium fragment STMF1.

| ORF Name | NTID | AAID | NT Length | AA Length | Score | Probability |
|---|---|---|---|---|---|---|
| 3907166_f1_6 | 1102 | 3022 | 309 | 930 | 117 | 1.6e-06 |

Protein name: putative biotin protein ligase
Locus Name: gp:AF016461
Acc#: AF016461

Description: Bordetella pertussis putative biotin protein ligase (birA) gene, complete cds and Bvg accessory factor (baf) gene, partial cds.

| ORF Name | NTID | AAID | NT Length | AA Length | Score | Probability |
|---|---|---|---|---|---|---|
| 4507138_f1_5 | 1103 | 3023 | 727 | 2184 | 736 | 2.5e-88 |

Protein name:
Locus Name: sp:PRC_ECOLI
Acc#: P23865

Description: PROTEIN)

| ORF Name | NTID | AAID | NT Length | AA Length | Score | Probability |
|---|---|---|---|---|---|---|
| 4959501_c1_46 | 1104 | 3024 | 83 | 252 | | |

Protein name:
Locus Name:
Acc#:

Description: NO-HIT

| ORF Name | NTID | AAID | NT Length | AA Length | Score | Probability |
|---|---|---|---|---|---|---|
| 5119452_c3_92 | 1105 | 3025 | 267 | 804 | 398 | 5.9e-37 |

Protein name:
Locus Name: sp:Y902_HAEIN
Acc#: P44070

Description: HYPOTHETICAL PROTEIN HI0902

| ORF Name | NTID | AAID | NT Length | AA Length | Score | Probability |
|---|---|---|---|---|---|---|
| 11955251_c2_26 | 1106 | 3026 | 915 | 2748 | 2735 | 1.3e-284 |

Protein name:
Locus Name: sp:SYA_ECOLI
Acc#:

Description: ALANYL-TRNA SYNTHETASE, (ALANINE--TRNA LIGASE) (ALARS)

| ORF Name | NTID | AAID | NT Length | AA Length | Score | Probability |
|---|---|---|---|---|---|---|
| 16523292_c2_25 | 1107 | 3027 | 488 | 1467 | 1534 | 2.4e-157 |

Protein name | Locus Name | Acc#
sp:PUR8_HAEIN | P44797

Description
ADENYLOSUCCINATE LYASE, (ADENYLOSUCCINASE) (ASL)

| ORF Name | NTID | AAID | NT Length | AA Length | Score | Probability |
|---|---|---|---|---|---|---|
| 23475417_f3_18 | 1108 | 3028 | 73 | 222 | | |

Protein name | Locus Name | Acc#

Description
NO-HIT

| ORF Name | NTID | AAID | NT Length | AA Length | Score | Probability |
|---|---|---|---|---|---|---|
| 24308500_c1_22 | 1109 | 3029 | 155 | 468 | 282 | 1.2e-24 |

Protein name | Locus Name | Acc#
erythroid differentiation-related factor 2 | gp:AF040248 | AF040248

Description
Homo sapiens erythroid differentiation-related factor 2 mRNA, partial cds.

| ORF Name | NTID | AAID | NT Length | AA Length | Score | Probability |
|---|---|---|---|---|---|---|
| 31444625_c3_34 | 1110 | 3030 | 452 | 1359 | 646 | 3.1e-63 |

Protein name | Locus Name | Acc#
 | sp:YCLF_BACSU | P94408

Description
HYPOTHETICAL 53.3 KD PROTEIN IN SFP-GERKA INTERGENIC REGION

| ORF Name | NTID | AAID | NT Length | AA Length | Score | Probability |
|---|---|---|---|---|---|---|
| 33632752_c2_27 | 1111 | 3031 | 285 | 855 | 679 | 9.8e-67 |

Protein name | Locus Name | Acc#
aspartate kinase, II precursor:lysine-sensitive aspartokinase II | pir:A48946 |

Description

| ORF Name | NTID | AAID | NT Length | AA Length | Score | Probability |
|---|---|---|---|---|---|---|
| 33829043_c3_33 | 1112 | 3032 | 106 | 321 | | |

Protein name — Locus Name — Acc#

Description

NO-HIT

| ORF Name | NTID | AAID | NT Length | AA Length | Score | Probability |
|---|---|---|---|---|---|---|
| 4400283_c1_23 | 1113 | 3033 | 95 | 288 | | |

Protein name — Locus Name — Acc#

Description

NO-HIT

| ORF Name | NTID | AAID | NT Length | AA Length | Score | Probability |
|---|---|---|---|---|---|---|
| 6852262_c1_21 | 1114 | 3034 | 61 | 186 | | |

Protein name — Locus Name — Acc#

Description

NO-HIT

| ORF Name | NTID | AAID | NT Length | AA Length | Score | Probability |
|---|---|---|---|---|---|---|
| 9933552_f1_3 | 1115 | 3035 | 82 | 249 | | |

Protein name — Locus Name — Acc#

Description

NO-HIT

| ORF Name | NTID | AAID | NT Length | AA Length | Score | Probability |
|---|---|---|---|---|---|---|
| 9975052_c2_24 | 1116 | 3036 | 132 | 399 | | |

Protein name — Locus Name — Acc#

Description

NO-HIT

| ORF Name | NTID | AAID | NT Length | AA Length | Score | Probability |
|---|---|---|---|---|---|---|
| 1036637_c3_276 | 1117 | 3037 | 61 | 186 | | |

Protein name | Locus Name | Acc#

Description

NO-HIT

| ORF Name | NTID | AAID | NT Length | AA Length | Score | Probability |
|---|---|---|---|---|---|---|
| 1038885_f1_26 | 1118 | 3038 | 416 | 1251 | 1526 | 1.7e-156 |

Protein name: lactate dehydrogenase
Locus Name: gp:NMU58911
Acc#: U58911

Description

Neisseria meningitidis lactate dehydrogenase (lldA), HI0379 homologgenes, complete cds, HI1054 homolog gene, partial cds.

| ORF Name | NTID | AAID | NT Length | AA Length | Score | Probability |
|---|---|---|---|---|---|---|
| 10547558_c1_180 | 1119 | 3039 | 176 | 531 | 123 | 8.1e-08 |

Protein name: hypothetical protein APE1165
Locus Name: pir:H72586
Acc#: H72586

Description

| ORF Name | NTID | AAID | NT Length | AA Length | Score | Probability |
|---|---|---|---|---|---|---|
| 11711_c3_265 | 1120 | 3040 | 434 | 1305 | 489 | 1.3e-46 |

Protein name: HisX
Locus Name: gp:AF010189
Acc#: AF010189

Description

Pseudomonas stutzeri HflC (hflC) gene, partial cds; HisX (hisX)gene, complete cds; and PurA (purA) gene, partial cds.

| ORF Name | NTID | AAID | NT Length | AA Length | Score | Probability |
|---|---|---|---|---|---|---|
| 11991552_f3_108 | 1121 | 3041 | 286 | 861 | 614 | 7.6e-60 |

Protein name:
Locus Name: sp:TRPC_PSEPU
Acc#: P20578

Description

INDOLE-3-GLYCEROL PHOSPHATE SYNTHASE, (IGPS)

| ORF_Name | NTID | AAID | NT Length | AA Length | Score | Probability |
|---|---|---|---|---|---|---|
| 12222077_f2_53 | 1122 | 3042 | 198 | 597 | 469 | 1.8e-44 |

| Protein name | | | | Locus Name | Acc# |
|---|---|---|---|---|---|
| | | | | sp:RECR_HAEIN | P44712 |

Description

RECOMBINATION PROTEIN RECR

| ORF_Name | NTID | AAID | NT Length | AA Length | Score | Probability |
|---|---|---|---|---|---|---|
| 136302_c1_167 | 1123 | 3043 | 154 | 465 | 95 | 0.0012 |

| Protein name | | | | Locus Name | Acc# |
|---|---|---|---|---|---|
| hypothetical protein sll1675 | | | | pir:S74649 | S74649 |

Description

| ORF_Name | NTID | AAID | NT Length | AA Length | Score | Probability |
|---|---|---|---|---|---|---|
| 13678763_c1_182 | 1124 | 3044 | 223 | 672 | 194 | 2.4e-15 |

| Protein name | | | | Locus Name | Acc# |
|---|---|---|---|---|---|
| hypothetical protein RP471 | | | | pir:D71706 | D71706 |

Description

| ORF_Name | NTID | AAID | NT Length | AA Length | Score | Probability |
|---|---|---|---|---|---|---|
| 14094452_c3_267 | 1125 | 3045 | 60 | 183 | | |

| Protein name | | | | Locus Name | Acc# |
|---|---|---|---|---|---|

Description

NO-HIT

| ORF_Name | NTID | AAID | NT Length | AA Length | Score | Probability |
|---|---|---|---|---|---|---|
| 14103402_f1_7 | 1126 | 3046 | 286 | 861 | 265 | 7.3e-23 |

| Protein name | | | | Locus Name | Acc# |
|---|---|---|---|---|---|
| | | | | sp:YPUG_BACSU | P35154 |

Description

HYPOTHETICAL 29.6 KD PROTEIN IN RIBT-DACB INTERGENIC REGION (ORFX7)

| ORF Name | NTID | AAID | NT Length | AA Length | Score | Probability |
|---|---|---|---|---|---|---|
| 14273586_f2_57 | 1127 | 3047 | 451 | 1356 | 1508 | 1.4e-154 |

| Protein name | Locus Name | Acc# |
|---|---|---|
| | sp:ACCC_PSEAE | P37798 |

Description

CARBOXYLASE,) (ACC)

| ORF Name | NTID | AAID | NT Length | AA Length | Score | Probability |
|---|---|---|---|---|---|---|
| 14572132_f3_135 | 1128 | 3048 | 238 | 717 | 736 | 8.9e-73 |

| Protein name | Locus Name | Acc# |
|---|---|---|
| | sp:END3_HAEIN | P44319 |

Description

LYASE)

| ORF Name | NTID | AAID | NT Length | AA Length | Score | Probability |
|---|---|---|---|---|---|---|
| 14875305_f3_113 | 1129 | 3049 | 139 | 420 | 141 | 1.2e-09 |

| Protein name | Locus Name | Acc# |
|---|---|---|
| Ribonuclease D (EC 3.1.13.-) | gp:D90825 | |

Description

E.coli genomic DNA, Kohara clone #334(40.6-41.0 min.).

| ORF Name | NTID | AAID | NT Length | AA Length | Score | Probability |
|---|---|---|---|---|---|---|
| 16507827_c3_256 | 1130 | 3050 | 519 | 1560 | 1030 | 6.3e-104 |

| Protein name | Locus Name | Acc# |
|---|---|---|
| | sp:NADB_PSEAE | |

Description

L-ASPARTATE OXIDASE, (QUINOLINATE SYNTHETASE B)

| ORF Name | NTID | AAID | NT Length | AA Length | Score | Probability |
|---|---|---|---|---|---|---|
| 16510254_c1_154 | 1131 | 3051 | 308 | 927 | 1063 | 2.0e-107 |

| Protein name | | | | Locus Name | | Acc# |
|---|---|---|---|---|---|---|
| | | | | sp:RF1_ECOLI | | |

Description

PEPTIDE CHAIN RELEASE FACTOR 1 (RF-1)

| ORF Name | NTID | AAID | NT Length | AA Length | Score | Probability |
|---|---|---|---|---|---|---|
| 16829177_c1_172 | 1132 | 3052 | 95 | 288 | 83 | 0.041 |

| Protein name | | | | Locus Name | | Acc# |
|---|---|---|---|---|---|---|
| F1N21.17 | | | | gp:AC002130 | | AC002130 |

Description

The sequence of BAC F1N21 from Arabidopsis thaliana chromosome 1, complete sequence.

| ORF Name | NTID | AAID | NT Length | AA Length | Score | Probability |
|---|---|---|---|---|---|---|
| 19562800_f2_52 | 1133 | 3053 | 120 | 363 | 273 | 1.0e-23 |

| Protein name | | | | Locus Name | | Acc# |
|---|---|---|---|---|---|---|
| | | | | sp:YBAB_HAEIN | | P44711 |

Description

HYPOTHETICAL PROTEIN HI0442

| ORF Name | NTID | AAID | NT Length | AA Length | Score | Probability |
|---|---|---|---|---|---|---|
| 20312551_f1_8 | 1134 | 3054 | 202 | 609 | 243 | 1.6e-20 |

| Protein name | | | | Locus Name | | Acc# |
|---|---|---|---|---|---|---|
| | | | | sp:YPUH_BACSU | | P35155 |

Description

HYPOTHETICAL 22.0 KD PROTEIN IN RIBT-DACB INTERGENIC REGION (ORFX8)

| ORF_Name | NTID | AAID | NT Length | AA Length | Score | Probability |
|---|---|---|---|---|---|---|
| 20573252_c2_229 | 1135 | 3055 | 205 | 618 | 309 | 1.6e-27 |

| Protein name | | | | Locus Name | Acc# |
|---|---|---|---|---|---|
| | | | | sp:YDJA_ECOLI | P24250 |

Description

HYPOTHETICAL 20.1 KD PROTEIN IN SELD-SPPA INTERGENIC REGION (ORF183)

| ORF_Name | NTID | AAID | NT Length | AA Length | Score | Probability |
|---|---|---|---|---|---|---|
| 21667027_f2_89 | 1136 | 3056 | 832 | 2499 | 2093 | 1.4e-216 |

| Protein name | | | | Locus Name | Acc# |
|---|---|---|---|---|---|
| | | | | sp:LON_ERWAM | P46067 |

Description

ATP-DEPENDENT PROTEASE LA,

| ORF_Name | NTID | AAID | NT Length | AA Length | Score | Probability |
|---|---|---|---|---|---|---|
| 21681503_f1_9 | 1137 | 3057 | 329 | 990 | 758 | 4.2e-75 |

| Protein name | | | | Locus Name | Acc# |
|---|---|---|---|---|---|
| | | | | sp:YCIL_HAEIN | P45104 |

Description

HYPOTHETICAL PROTEIN HI1199

| ORF_Name | NTID | AAID | NT Length | AA Length | Score | Probability |
|---|---|---|---|---|---|---|
| 21754681_f3_119 | 1138 | 3058 | 197 | 594 | 284 | 7.1e-25 |

| Protein name | | | | Locus Name | Acc# |
|---|---|---|---|---|---|
| | | | | sp:YBEY_ECOLI | P77385 |

Description

HYPOTHETICAL 17.5 KD PROTEIN IN CUTE-ASNB INTERGENIC REGION

| ORF_Name | NTID | AAID | NT Length | AA Length | Score | Probability |
|---|---|---|---|---|---|---|
| 22128380_f1_41 | 1139 | 3059 | 87 | 264 | | |

| Protein name | | | | Locus Name | Acc# |
|---|---|---|---|---|---|
| | | | | | |

Description

NO-HIT

| ORF Name | NTID | AAID | NT Length | AA Length | Score | Probability |
|---|---|---|---|---|---|---|
| 22384635_f1_31 | 1140 | 3060 | 190 | 573 | 604 | 8.7e-59 |

Protein name: HemO
Locus Name: gp:AF133695
Acc#: AF133695

Description: Neisseria meningitidis HemO (hemO) gene, complete cds; and HmbR(hmbR) gene, partial cds.

| ORF Name | NTID | AAID | NT Length | AA Length | Score | Probability |
|---|---|---|---|---|---|---|
| 23444377_c1_199 | 1141 | 3061 | 492 | 1479 | 2364 | 2.7e-245 |

Protein name: outer membrane protein E
Locus Name: gp:MBOOMPE
Acc#: L31788

Description: Moraxella catarrhalis outer membrane protein E gene, complete cds.

| ORF Name | NTID | AAID | NT Length | AA Length | Score | Probability |
|---|---|---|---|---|---|---|
| 234700_c3_268 | 1142 | 3062 | 344 | 1035 | 1002 | 5.8e-101 |

Protein name: unknown
Locus Name: gp:AF109131
Acc#: AF109131

Description: Sinorhizobium meliloti homogentisate dioxygenase (hmgA) andmaleylacetoacetate isomerase (maiA) genes, complete cds; andunknown gene.

| ORF Name | NTID | AAID | NT Length | AA Length | Score | Probability |
|---|---|---|---|---|---|---|
| 23620263_c3_271 | 1143 | 3063 | 267 | 804 | 534 | 2.3e-51 |

Protein name:
Locus Name: sp:KDSB_ECOLI
Acc#: P04951

Description: SYNTHETASE) (CMP-2-KETO-3-DEOXYOCTULOSONIC ACID SYNTHETASE) (CKS)

| ORF Name | NTID | AAID | NT Length | AA Length | Score | Probability |
|---|---|---|---|---|---|---|
| 23651513_f1_43 | 1144 | 3064 | 259 | 780 | 589 | 3.4e-57 |
| Protein name | | | | Locus Name | | Acc# |
| | | | | sp:NADC_RHORU | | P77938 |

Description (QAPRTASE)

| ORF Name | NTID | AAID | NT Length | AA Length | Score | Probability |
|---|---|---|---|---|---|---|
| 24031586_f1_5 | 1145 | 3065 | 383 | 1152 | 976 | 3.3e-98 |
| Protein name | | | | Locus Name | | Acc# |
| | | | | sp:TRPD_ACICA | | P00500 |

Description

ANTHRANILATE PHOSPHORIBOSYLTRANSFERASE,

| ORF Name | NTID | AAID | NT Length | AA Length | Score | Probability |
|---|---|---|---|---|---|---|
| 24397555_f3_140 | 1146 | 3066 | 219 | 660 | 165 | 1.2e-11 |
| Protein name | | | | Locus Name | | Acc# |
| probable corA protein | | | | pir:F70952 | | F70952 |

Description

| ORF Name | NTID | AAID | NT Length | AA Length | Score | Probability |
|---|---|---|---|---|---|---|
| 24415782_f3_106 | 1147 | 3067 | 61 | 186 | 87 | 0.0079 |
| Protein name | | | | Locus Name | | Acc# |
| UUP protein | | | | gp:ECUUP | | Y09439 |

Description

E.coli uup gene, partial.

| ORF Name | NTID | AAID | NT Length | AA Length | Score | Probability |
|---|---|---|---|---|---|---|
| 24721962_c3_282 | 1148 | 3068 | 77 | 234 | | |
| Protein name | | | | Locus Name | | Acc# |

Description

NO-HIT

| ORF Name | NTID | AAID | NT Length | AA Length | Score | Probability |
|---|---|---|---|---|---|---|
| 24801937_c2_236 | 1149 | 3069 | 63 | 192 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26756325_f1_1 | 1150 | 3070 | 314 | 945 | 1021 | 5.6e-103 |

| Protein name | | | | | Locus Name | Acc# |
|---|---|---|---|---|---|---|
| | | | | | sp:OTCA_PSESH | Q02047 |

Description (EC 2.1.3.3) (OTCASE)

| ORF Name | NTID | AAID | NT Length | AA Length | Score | Probability |
|---|---|---|---|---|---|---|
| 26757790_c3_255 | 1151 | 3071 | 376 | 1131 | 1065 | 1.2e-107 |

| Protein name | | | | | Locus Name | Acc# |
|---|---|---|---|---|---|---|
| | | | | | sp:NADA_ECOLI | |

Description

QUINOLINATE SYNTHETASE A

| ORF Name | NTID | AAID | NT Length | AA Length | Score | Probability |
|---|---|---|---|---|---|---|
| 2742036_f1_3 | 1152 | 3072 | 144 | 435 | 426 | 6.3e-40 |

| Protein name | | | | | Locus Name | Acc# |
|---|---|---|---|---|---|---|
| | | | | | sp:PAND_BACSU | P52999 |

Description (DECARBOXYLASE)

| ORF Name | NTID | AAID | NT Length | AA Length | Score | Probability |
|---|---|---|---|---|---|---|
| 29301691_f1_14 | 1153 | 3073 | 248 | 747 | 140 | 4.7e-07 |

| Protein name | | | | | Locus Name | Acc# |
|---|---|---|---|---|---|---|
| | | | | | sp:RND_HAEIN | P44442 |

Description

RIBONUCLEASE D, (RNASE D)

| ORF Name | NTID | AAID | NT Length | AA Length | Score | Probability |
|---|---|---|---|---|---|---|
| 29355287_f2_99 | 1154 | 3074 | 74 | 225 | 79 | 0.013 |

| Protein name | | | | Locus Name | | Acc# |
|---|---|---|---|---|---|---|
| MutT/nudix family protein | | | | pir:A75550 | | A75550 |

Description

---

| ORF Name | NTID | AAID | NT Length | AA Length | Score | Probability |
|---|---|---|---|---|---|---|
| 29484626_c1_173 | 1155 | 3075 | 356 | 1071 | 555 | 2.4e-57 |

| Protein name | | | | Locus Name | | Acc# |
|---|---|---|---|---|---|---|
| | | | | sp:YGI2_PSEPU | | P31857 |

Description

HYPOTHETICAL 32.4 KD PROTEIN IN GIDB-UNCI INTERGENIC REGION

---

| ORF Name | NTID | AAID | NT Length | AA Length | Score | Probability |
|---|---|---|---|---|---|---|
| 29531392_f1_40 | 1156 | 3076 | 124 | 375 | 173 | 1.5e-11 |

| Protein name | | | | Locus Name | | Acc# |
|---|---|---|---|---|---|---|
| Iustrin A | | | | pir:T08852 | | T08852 |

Description

---

| ORF Name | NTID | AAID | NT Length | AA Length | Score | Probability |
|---|---|---|---|---|---|---|
| 29572155_f2_49 | 1157 | 3077 | 343 | 1032 | 406 | 8.3e-38 |

| Protein name | | | | Locus Name | | Acc# |
|---|---|---|---|---|---|---|
| | | | | sp:HTRB_HAEIN | | |

Description

PROTEIN B)

---

| ORF Name | NTID | AAID | NT Length | AA Length | Score | Probability |
|---|---|---|---|---|---|---|
| 29890631_f2_56 | 1158 | 3078 | 157 | 474 | 259 | 3.1e-22 |

| Protein name | | | | Locus Name | | Acc# |
|---|---|---|---|---|---|---|
| | | | | sp:BCCP_HAEIN | | P43874 |

Description

BIOTIN CARBOXYL CARRIER PROTEIN OF ACETYL-COA CARBOXYLASE (BCCP)

| ORF Name | NTID | AAID | NT Length | AA Length | Score | Probability |
|---|---|---|---|---|---|---|
| 30204837_c2_230 | 1159 | 3079 | 447 | 1344 | 628 | 2.5e-61 |

| Protein name | Locus Name | Acc# |
|---|---|---|
| | sp:GPDA_ECOLI | P37606 |

Description

| ORF Name | NTID | AAID | NT Length | AA Length | Score | Probability |
|---|---|---|---|---|---|---|
| 30330056_f2_48 | 1160 | 3080 | 233 | 702 | 506 | 2.1e-48 |

| Protein name | Locus Name | Acc# |
|---|---|---|
| putative ATP-binding protein | gp:NME242841 | AJ242841 |

Description

Neisseria meningitidis DNA for opcA region, strain Z2491.

| ORF Name | NTID | AAID | NT Length | AA Length | Score | Probability |
|---|---|---|---|---|---|---|
| 32878_c2_250 | 1161 | 3081 | 80 | 243 | 89 | 0.00033 |

| Protein name | Locus Name | Acc# |
|---|---|---|
| | sp:SLYX_ECOLI | P30857 |

Description

SLYX PROTEIN

| ORF Name | NTID | AAID | NT Length | AA Length | Score | Probability |
|---|---|---|---|---|---|---|
| 34180317_f1_22 | 1162 | 3082 | 115 | 348 | 420 | 2.7e-39 |

| Protein name | Locus Name | Acc# |
|---|---|---|
| | sp:YCHF_HAEIN | P44681 |

Description

PROBABLE GTP-BINDING PROTEIN HI0393

| ORF Name | NTID | AAID | NT Length | AA Length | Score | Probability |
|---|---|---|---|---|---|---|
| 34417090_f3_151 | 1163 | 3083 | 76 | 231 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 35196902_f3_129 | 1164 | 3084 | 616 | 1851 | 631 | 1.2e-61 |

| Protein name | | | | Locus Name | | Acc# |
|---|---|---|---|---|---|---|
| L-lactate permease (lctP) homolog | | | | pir:F69350 | | F69350 |

Description

| ORF Name | NTID | AAID | NT Length | AA Length | Score | Probability |
|---|---|---|---|---|---|---|
| 35335137_c1_175 | 1165 | 3085 | 330 | 993 | 302 | 8.7e-27 |

| Protein name | | | | Locus Name | | Acc# |
|---|---|---|---|---|---|---|
|  | | | | sp:HOLB_PSEAE | | P52024 |

Description

DNA POLYMERASE III, DELTA' SUBUNIT,

| ORF Name | NTID | AAID | NT Length | AA Length | Score | Probability |
|---|---|---|---|---|---|---|
| 35353443_c2_215 | 1166 | 3086 | 347 | 1044 | 1128 | 2.6e-114 |

| Protein name | | | | Locus Name | | Acc# |
|---|---|---|---|---|---|---|
|  | | | | sp:PURA_VIBPA | | P40607 |

Description

ADENYLOSUCCINATE SYNTHETASE, (IMP--ASPARTATE LIGASE)

| ORF Name | NTID | AAID | NT Length | AA Length | Score | Probability |
|---|---|---|---|---|---|---|
| 35603128_f3_150 | 1167 | 3087 | 80 | 243 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 3914143_c2_209 | 1168 | 3088 | 185 | 558 | 256 | 2.1e-29 |

| Protein name | | | | Locus Name | | Acc# |
|---|---|---|---|---|---|---|
| ExbB protein | | | | gp:BPE132741 | | AJ132741 |

Description

Bordetella pertussis hupB, tonB, exbB, exbD and basR genes and ORF1(partial).

| ORF Name | NTID | AAID | NT Length | AA Length | Score | Probability |
|---|---|---|---|---|---|---|
| 3914811_c3_280 | 1169 | 3089 | 370 | 1113 | 873 | 2.7e-87 |

| Protein name | Locus Name | Acc# |
|---|---|---|
| | sp:YHCM_ECOLI | P46442 |

Description

HYPOTHETICAL 43.1 KD PROTEIN IN RPLM-HHOA INTERGENIC REGION (F375)

| ORF Name | NTID | AAID | NT Length | AA Length | Score | Probability |
|---|---|---|---|---|---|---|
| 3937518_c1_171 | 1170 | 3090 | 264 | 795 | 618 | 2.9e-60 |

| Protein name | Locus Name | Acc# |
|---|---|---|
| | sp:YGI1_PSEPU | P31856 |

Description

HYPOTHETICAL 28.9 KD PROTEIN IN GIDB-UNCI INTERGENIC REGION

| ORF Name | NTID | AAID | NT Length | AA Length | Score | Probability |
|---|---|---|---|---|---|---|
| 3938818_c1_166 | 1171 | 3091 | 65 | 198 | 228 | 6.1e-19 |

| Protein name | Locus Name | Acc# |
|---|---|---|
| PurA | gp:AF010189 | AF010189 |

Description

Pseudomonas stutzeri HflC (hflC) gene, partial cds; HisX (hisX) gene, complete cds; and PurA (purA) gene, partial cds.

| ORF Name | NTID | AAID | NT Length | AA Length | Score | Probability |
|---|---|---|---|---|---|---|
| 3946931_f3_114 | 1172 | 3092 | 216 | 651 | 560 | 4.0e-54 |

| Protein name | Locus Name | Acc# |
|---|---|---|
| | gp:ECU89166 | U89166 |

Description

Eikenella corrodens lysine decarboxylase (ECORLD) gene, complete cds.

| ORF Name | NTID | AAID | NT Length | AA Length | Score | Probability |
|---|---|---|---|---|---|---|
| 3960260_f1_23 | 1173 | 3093 | 253 | 762 | 282 | 1.2e-24 |

| Protein name | Locus Name | Acc# |
|---|---|---|
| probable transcription regulator | pir:T34763 | T34763 |

Description

| ORF Name | NTID | AAID | NT Length | AA Length | Score | Probability |
|---|---|---|---|---|---|---|
| 4022217_f2_68 | 1174 | 3094 | 160 | 483 | 86 | 0.00087 |

Protein name: hypothetical protein F53A9.8
Locus Name: pir:T16439
Acc#: T16439

Description:

| ORF Name | NTID | AAID | NT Length | AA Length | Score | Probability |
|---|---|---|---|---|---|---|
| 4023443_c3_278 | 1175 | 3095 | 146 | 441 | 498 | 1.5e-47 |

Protein name:
Locus Name: sp:NDK_PSEAE
Acc#: Q59636

Description: NUCLEOSIDE DIPHOSPHATE KINASE, (NDK) (NDP KINASE)

| ORF Name | NTID | AAID | NT Length | AA Length | Score | Probability |
|---|---|---|---|---|---|---|
| 4101387_f1_4 | 1176 | 3096 | 219 | 660 | 710 | 5.1e-70 |

Protein name:
Locus Name: sp:TRPG_PSEAE
Acc#: P20576

Description: TRANSFERASE

| ORF Name | NTID | AAID | NT Length | AA Length | Score | Probability |
|---|---|---|---|---|---|---|
| 4145000_f2_47 | 1177 | 3097 | 415 | 1248 | 962 | 1.0e-96 |

Protein name:
Locus Name: sp:UUP1_HAEIN
Acc#:

Description: ABC TRANSPORTER ATP-BINDING PROTEIN UUP-1

| ORF Name | NTID | AAID | NT Length | AA Length | Score | Probability |
|---|---|---|---|---|---|---|
| 4181502_f3_149 | 1178 | 3098 | 130 | 393 | | |

Protein name:
Locus Name:
Acc#:

Description: NO-HIT

| ORF Name | NTID | AAID | NT Length | AA Length | Score | Probability |
|---|---|---|---|---|---|---|
| 4182762_f2_51 | 1179 | 3099 | 358 | 1077 | 374 | 1.9e-49 |

| Protein name | Locus Name | Acc# |
|---|---|---|
| tryptophan--tRNA ligase, | pir:H70385 | H70385 |

Description

---

| ORF Name | NTID | AAID | NT Length | AA Length | Score | Probability |
|---|---|---|---|---|---|---|
| 424203_f1_24 | 1180 | 3100 | 350 | 1053 | 542 | 3.2e-52 |

| Protein name | Locus Name | Acc# |
|---|---|---|
| putative exodeoxyribonuclease (EC 3.1.11.2). | gp:SCE87 | AL132674 |

Description

Streptomyces coelicolor cosmid E87.

---

| ORF Name | NTID | AAID | NT Length | AA Length | Score | Probability |
|---|---|---|---|---|---|---|
| 4331262_f3_141 | 1181 | 3101 | 222 | 669 | 402 | 2.2e-37 |

| Protein name | Locus Name | Acc# |
|---|---|---|
| probable corA protein | pir:F70952 | F70952 |

Description

---

| ORF Name | NTID | AAID | NT Length | AA Length | Score | Probability |
|---|---|---|---|---|---|---|
| 4506930_c1_174 | 1182 | 3102 | 356 | 1071 | 504 | 3.4e-48 |

| Protein name | Locus Name | Acc# |
|---|---|---|
|  | sp:LPXK_HAEIN | P44491 |

Description

TETRAACYLDISACCHARIDE 4'-KINASE, (LIPID A 4'-KINASE)

---

| ORF Name | NTID | AAID | NT Length | AA Length | Score | Probability |
|---|---|---|---|---|---|---|
| 4537837_f3_145 | 1183 | 3103 | 216 | 651 | 477 | 2.5e-45 |

| Protein name | Locus Name | Acc# |
|---|---|---|
| YciB homolog | gp:AF114793 | AF114793 |

Description

Vitreoscilla sp. YciB homolog, putative transcriptional activator, putative outer membrane protein, BioA homolog, and glutaminesynthetase homolog genes, complete cds; and unknown genes.

| ORF Name | NTID | AAID | NT Length | AA Length | Score | Probability |
|---|---|---|---|---|---|---|
| 4571880_f1_16 | 1184 | 3104 | 216 | 651 | 437 | 4.3e-41 |

| Protein name | Locus Name | Acc# |
|---|---|---|
| YbeZ protein | gp:STY249116 | AJ249116 |

Description

Salmonella typhimurium yleB (partial), miaB, ybeZ and ybeY(partial) genes.

| ORF Name | NTID | AAID | NT Length | AA Length | Score | Probability |
|---|---|---|---|---|---|---|
| 4722125_c2_211 | 1185 | 3105 | 465 | 1398 | 1197 | 1.3e-121 |

| Protein name | Locus Name | Acc# |
|---|---|---|
| | sp:Y325_HAEIN | P44640 |

Description

HYPOTHETICAL PROTEIN HI0325

| ORF Name | NTID | AAID | NT Length | AA Length | Score | Probability |
|---|---|---|---|---|---|---|
| 4798763_c1_155 | 1186 | 3106 | 141 | 426 | 274 | 8.1e-24 |

| Protein name | Locus Name | Acc# |
|---|---|---|
| ExbD protein | gp:BPE132741 | AJ132741 |

Description

Bordetella pertussis hupB, tonB, exbB, exbD and basR genes and ORF1(partial).

| ORF Name | NTID | AAID | NT Length | AA Length | Score | Probability |
|---|---|---|---|---|---|---|
| 4876005_f1_30 | 1187 | 3107 | 828 | 2487 | 1231 | 3.1e-125 |

| Protein name | Locus Name | Acc# |
|---|---|---|
| hypothetical protein TM1869 | pir:F72202 | F72202 |

Description

| ORF Name | NTID | AAID | NT Length | AA Length | Score | Probability |
|---|---|---|---|---|---|---|
| 4978375_c3_293 | 1188 | 3108 | 382 | 1149 | 261 | 7.7e-26 |

| Protein name | Locus Name | Acc# |
|---|---|---|
| beta-ketoacyl-acyl carrier protein synthase III | pir:B64545 | B64545 |

Description

| ORF_Name | NTID | AAID | NT Length | AA Length | Score | Probability |
|---|---|---|---|---|---|---|
| 5194068_f1_35 | 1189 | 3109 | 620 | 1863 | 1268 | 3.8e-129 |

| Protein name | | | | Locus Name | | Acc# |
|---|---|---|---|---|---|---|
| | | | | sp:KEFX_HAEIN | | P44933 |

Description (ANTIPORTER)

| ORF_Name | NTID | AAID | NT Length | AA Length | Score | Probability |
|---|---|---|---|---|---|---|
| 5976555_f3_111 | 1190 | 3110 | 769 | 2310 | 3096 | 0.0 |

| Protein name | | | | Locus Name | | Acc# |
|---|---|---|---|---|---|---|
| | | | | sp:RIR1_ECOLI | | |

Description (RIBONUCLEOTIDE REDUCTASE 1) (B1 PROTEIN) (R1 PROTEIN)

| ORF_Name | NTID | AAID | NT Length | AA Length | Score | Probability |
|---|---|---|---|---|---|---|
| 636513_f3_126 | 1191 | 3111 | 81 | 246 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 6516_f2_45 | 1192 | 3112 | 361 | 1086 | 176 | 7.2e-13 |

| Protein name | | | | Locus Name | | Acc# |
|---|---|---|---|---|---|---|
| hypothetical protein | | | | pir:S76259 | | S76259 |

Description

| ORF_Name | NTID | AAID | NT Length | AA Length | Score | Probability |
|---|---|---|---|---|---|---|
| 6828128_c2_223 | 1193 | 3113 | 201 | 606 | 105 | 0.00066 |

| Protein name | | | | Locus Name | | Acc# |
|---|---|---|---|---|---|---|
| phosphoglycerate mutase | | | | pir:G72260 | | G72260 |

Description

| ORF Name | NTID | AAID | NT Length | AA Length | Score | Probability |
|---|---|---|---|---|---|---|
| 6837827_c1_183 | 1194 | 3114 | 165 | 498 | 145 | 3.8e-10 |

| Protein name | Locus Name | Acc# |
|---|---|---|
| | sp:Y400_SYNY3 | Q55129 |

Description

HYPOTHETICAL 18.3 KD PROTEIN SLL0400

| ORF Name | NTID | AAID | NT Length | AA Length | Score | Probability |
|---|---|---|---|---|---|---|
| 786578_c3_259 | 1195 | 3115 | 86 | 261 | 99 | 2.8e-05 |

| Protein name | Locus Name | Acc# |
|---|---|---|
| unknown | gp:AF114793 | AF114793 |

Description

Vitreoscilla sp. YciB homolog, putative transcriptional activator, putative outer membrane protein, BioA homolog, and glutaminesynthetase homolog genes, complete cds; and unknown genes.

| ORF Name | NTID | AAID | NT Length | AA Length | Score | Probability |
|---|---|---|---|---|---|---|
| 969200_c3_270 | 1196 | 3116 | 234 | 705 | 360 | 6.2e-33 |

| Protein name | Locus Name | Acc# |
|---|---|---|
| | sp:GIDB_ECOLI | P17113 |

Description

GLUCOSE INHIBITED DIVISION PROTEIN B

| ORF Name | NTID | AAID | NT Length | AA Length | Score | Probability |
|---|---|---|---|---|---|---|
| 970375_f2_67 | 1197 | 3117 | 279 | 840 | 921 | 2.2e-92 |

| Protein name | Locus Name | Acc# |
|---|---|---|
| probable GTP-binding protein HI0393 | pir:I64150 | I64150 |

Description

| ORF Name | NTID | AAID | NT Length | AA Length | Score | Probability |
|---|---|---|---|---|---|---|
| 976531_f2_59 | 1198 | 3118 | 171 | 516 | 437 | 4.3e-41 |

| Protein name | Locus Name | Acc# |
|---|---|---|
| YbeZ protein | gp:STY249116 | AJ249116 |

Description

Salmonella typhimurium yleB (partial), miaB, ybeZ and ybeY(partial) genes.

| ORF Name | NTID | AAID | NT Length | AA Length | Score | Probability |
|---|---|---|---|---|---|---|
| 985925_f3_124 | 1199 | 3119 | 128 | 387 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 9954828_c2_208 | 1200 | 3120 | 322 | 969 | 170 | 3.9e-14 |

| Protein name | Locus Name | Acc# |
|---|---|---|
| TonB2 | gp:AF190125 | AF190125 |

Description

Pseudomonas aeruginosa TonB2 (tonB2), ExbB (exbB), and ExbD (exbD)genes, complete cds.

| ORF Name | NTID | AAID | NT Length | AA Length | Score | Probability |
|---|---|---|---|---|---|---|
| 10975667_c2_74 | 1201 | 3121 | 376 | 1131 | 524 | 2.6e-50 |

| Protein name | Locus Name | Acc# |
|---|---|---|
| thiamine-monophosphate kinase | gp:D17333 | D17333 |

Description

E. Coli thiL gene, complete cds.

| ORF Name | NTID | AAID | NT Length | AA Length | Score | Probability |
|---|---|---|---|---|---|---|
| 12500081_c3_90 | 1202 | 3122 | 270 | 813 | 855 | 2.2e-85 |

| Protein name | Locus Name | Acc# |
|---|---|---|
| | sp:HIS6_AZOBR | P26721 |

Description

HISF PROTEIN (CYCLASE)

| ORF Name | NTID | AAID | NT Length | AA Length | Score | Probability |
|---|---|---|---|---|---|---|
| 14572127_c1_50 | 1203 | 3123 | 165 | 498 | 433 | 1.1e-40 |

| Protein name | | | | | Locus Name | Acc# |
|---|---|---|---|---|---|---|
| | | | | | sp:RISB_ECOLI | |

Description (LUMAZINE SYNTHASE) (RIBOFLAVIN SYNTHASE BETA CHAIN)

| ORF Name | NTID | AAID | NT Length | AA Length | Score | Probability |
|---|---|---|---|---|---|---|
| 197212_c1_54 | 1204 | 3124 | 284 | 852 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 21767011_f3_32 | 1205 | 3125 | 317 | 954 | 736 | 8.9e-73 |

| Protein name | | | | | Locus Name | Acc# |
|---|---|---|---|---|---|---|
| YafJ | | | | | gp:NGAJ2783 | AJ002783 |

Description

Neisseria gonorrhoeae aroK, aroB, yafJ genes and open readingframe.

| ORF Name | NTID | AAID | NT Length | AA Length | Score | Probability |
|---|---|---|---|---|---|---|
| 23645263_c3_93 | 1206 | 3126 | 201 | 606 | 190 | 2.4e-30 |

| Protein name | | | | | Locus Name | Acc# |
|---|---|---|---|---|---|---|
| | | | | | sp:PGPA_HAEIN | P44157 |

Description

PHOSPHATIDYLGLYCEROPHOSPHATASE A,

| ORF Name | NTID | AAID | NT Length | AA Length | Score | Probability |
|---|---|---|---|---|---|---|
| 23916007_c3_94 | 1207 | 3127 | 196 | 591 | 273 | 1.0e-23 |

| Protein name | | | | | Locus Name | Acc# |
|---|---|---|---|---|---|---|
| methylase | | | | | gp:LLCPJW565 | Y12736 |

Description

Lactococcus lactis cremoris plasmid pJW565 DNA, abiIM, abiIR genesand orfX.

| ORF Name | NTID | AAID | NT Length | AA Length | Score | Probability |
|---|---|---|---|---|---|---|
| 23947167_f3_37 | 1208 | 3128 | 653 | 1962 | 756 | 6.0e-87 |

| Protein name | Locus Name | Acc# |
|---|---|---|
| penicillin-binding protein 3 | pir:S54872 | S54872 |

Description

| ORF Name | NTID | AAID | NT Length | AA Length | Score | Probability |
|---|---|---|---|---|---|---|
| 24256687_f2_23 | 1209 | 3129 | 501 | 1506 | 537 | 1.8e-79 |

| Protein name | Locus Name | Acc# |
|---|---|---|
|  | sp:MURF_ECOLI |  |

Description (D-ALANYL-D-ALANINE-ADDING ENZYME)

| ORF Name | NTID | AAID | NT Length | AA Length | Score | Probability |
|---|---|---|---|---|---|---|
| 24353377_c1_45 | 1210 | 3130 | 225 | 678 | 155 | 3.3e-11 |

| Protein name | Locus Name | Acc# |
|---|---|---|
| hypothetical protein PAB0131 | pir:D75209 | D75209 |

Description

| ORF Name | NTID | AAID | NT Length | AA Length | Score | Probability |
|---|---|---|---|---|---|---|
| 26369016_f2_18 | 1211 | 3131 | 299 | 900 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3397336_c1_49 | 1212 | 3132 | 65 | 198 | 50 | 0.037 |

| Protein name | Locus Name | Acc# |
|---|---|---|
|  | sp:DHSD_PORPU | P80479 |

Description

DEHYDROGENASE, SUBUNIT IV)

| ORF Name | NTID | AAID | NT Length | AA Length | Score | Probability |
|---|---|---|---|---|---|---|
| 35968792_f2_24 | 1213 | 3133 | 201 | 606 | 346 | 1.9e-31 |

| Protein name | | | | Locus Name | | Acc# |
|---|---|---|---|---|---|---|
| | | | | sp:TPIS_MORSP | | Q01893 |

Description

TRIOSEPHOSPHATE ISOMERASE, (TIM)

| ORF Name | NTID | AAID | NT Length | AA Length | Score | Probability |
|---|---|---|---|---|---|---|
| 3907500_f1_5 | 1214 | 3134 | 341 | 1026 | 227 | 9.2e-18 |

| Protein name | | | | Locus Name | | Acc# |
|---|---|---|---|---|---|---|
| homoserine kinase homolog | | | | pir:T33726 | | T33726 |

Description

| ORF Name | NTID | AAID | NT Length | AA Length | Score | Probability |
|---|---|---|---|---|---|---|
| 3939665_c1_51 | 1215 | 3135 | 183 | 552 | 204 | 2.1e-16 |

| Protein name | | | | Locus Name | | Acc# |
|---|---|---|---|---|---|---|
| | | | | sp:NUSB_HAEIN | | P45150 |

Description

N UTILIZATION SUBSTANCE PROTEIN B HOMOLOG (NUSB PROTEIN)

| ORF Name | NTID | AAID | NT Length | AA Length | Score | Probability |
|---|---|---|---|---|---|---|
| 3953191_c1_44 | 1216 | 3136 | 502 | 1509 | 1501 | 7.7e-154 |

| Protein name | | | | Locus Name | | Acc# |
|---|---|---|---|---|---|---|
| glutamyl-tRNA synthetase | | | | gp:AF139107 | | AF139107 |

Description

Pseudomonas aeruginosa hypothetical multidrug resistance protein(mdr) gene, partial cds; hypothetical transcriptional activator(act) and glutamyl-tRNA synthetase (gltX) genes, complete cds; andtRNA-Ala and tRNA-Glu genes, complete sequence.

| ORF_Name | NTID | AAID | NT Length | AA Length | Score | Probability |
|---|---|---|---|---|---|---|
| 41703_f3_36 | 1217 | 3137 | 120 | 363 | | |

| Protein name | | | | | Locus Name | Acc# |
|---|---|---|---|---|---|---|
| | | | | | | |

Description

NO-HIT

| ORF_Name | NTID | AAID | NT Length | AA Length | Score | Probability |
|---|---|---|---|---|---|---|
| 4301943_f1_13 | 1218 | 3138 | 368 | 1107 | 1018 | 1.2e-102 |

| Protein name | | | | | Locus Name | Acc# |
|---|---|---|---|---|---|---|
| | | | | | sp:MRAY_HAEIN | P45062 |

Description (UDP-MURNAC-PENTAPEPTIDE PHOSPHOTRANSFERASE)

| ORF_Name | NTID | AAID | NT Length | AA Length | Score | Probability |
|---|---|---|---|---|---|---|
| 5111318_f2_22 | 1219 | 3139 | 523 | 1572 | 756 | 6.8e-75 |

| Protein name | | | | | Locus Name | Acc# |
|---|---|---|---|---|---|---|
| probable | | | | | gp:AF141867 | AF141867 |

Description

Vibrio cholerae probableUDP-N-acetylmuramoylalanyl-D-glutamate--2,6-diaminopimelate ligase(murE) gene, complete cds.

| ORF_Name | NTID | AAID | NT Length | AA Length | Score | Probability |
|---|---|---|---|---|---|---|
| 6754052_f3_35 | 1220 | 3140 | 336 | 1011 | 695 | 2.0e-68 |

| Protein name | | | | | Locus Name | Acc# |
|---|---|---|---|---|---|---|
| | | | | | sp:YABC_ECOLI | P18595 |

Description

HYPOTHETICAL 34.9 KD PROTEIN IN FRUR-FTSL INTERGENIC REGION (ORFB)

| ORF_Name | NTID | AAID | NT Length | AA Length | Score | Probability |
|---|---|---|---|---|---|---|
| 111552_f1_10 | 1221 | 3141 | 73 | 222 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 1189035_c3_48 | 1222 | 3142 | 179 | 540 | 616 | 4.7e-60 |

| Protein name | Locus Name | Acc# |
|---|---|---|
| adenylate kinase | gp:AB024426 | AB024426 |

Description

Pseudomonas putida adk gene for adenylate kinase, complete cds.

| ORF Name | NTID | AAID | NT Length | AA Length | Score | Probability |
|---|---|---|---|---|---|---|
| 12578208_f2_15 | 1223 | 3143 | 386 | 1161 | 1244 | 1.3e-126 |

| Protein name | Locus Name | Acc# |
|---|---|---|
| | sp:DHAS_PSEAE | Q51344 |

Description (DEHYDROGENASE)

| ORF Name | NTID | AAID | NT Length | AA Length | Score | Probability |
|---|---|---|---|---|---|---|
| 23444507_c3_45 | 1224 | 3144 | 452 | 1359 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23536511_f2_16 | 1225 | 3145 | 338 | 1017 | 210 | 4.1e-15 |

| Protein name | Locus Name | Acc# |
|---|---|---|
| | sp:ASG1_ECOLI | P18840 |

Description (L-ASNASE I)

| ORF Name | NTID | AAID | NT Length | AA Length | Score | Probability |
|---|---|---|---|---|---|---|
| 245682_f1_8 | 1226 | 3146 | 303 | 912 | 689 | 8.5e-68 |

| Protein name | Locus Name | Acc# |
|---|---|---|
| | sp:TRUA_ECOLI | P07649 |

Description

I) (PSEUDOURIDINE SYNTHASE I) (URACIL HYDROLYASE) (PSU-I)

| ORF Name | NTID | AAID | NT Length | AA Length | Score | Probability |
|---|---|---|---|---|---|---|
| 34157662_c2_41 | 1227 | 3147 | 203 | 612 | 321 | 8.5e-29 |

| Protein name | | | | Locus Name | Acc# |
|---|---|---|---|---|---|
| | | | | sp:TIPB_PSEFL | P52237 |

Description

BIOGENESIS PROTEIN TIPB)

| ORF Name | NTID | AAID | NT Length | AA Length | Score | Probability |
|---|---|---|---|---|---|---|
| 4042131_c1_33 | 1228 | 3148 | 70 | 213 | | |

| Protein name | | | | Locus Name | Acc# |

Description

NO-HIT

| ORF Name | NTID | AAID | NT Length | AA Length | Score | Probability |
|---|---|---|---|---|---|---|
| 4112793_c1_37 | 1229 | 3149 | 423 | 1272 | 175 | 3.1e-10 |

| Protein name | | | | Locus Name | Acc# |
|---|---|---|---|---|---|
| | | | | sp:CCMH_HAEIN | P46458 |

Description

CYTOCHROME C-TYPE BIOGENESIS PROTEIN CCMH PRECURSOR

| ORF Name | NTID | AAID | NT Length | AA Length | Score | Probability |
|---|---|---|---|---|---|---|
| 4484436_c2_40 | 1230 | 3150 | 692 | 2079 | 1743 | 1.7e-179 |

| Protein name | | | | Locus Name | Acc# |
|---|---|---|---|---|---|
| | | | | sp:CCMF_PSEFL | P52225 |

Description

CYTOCHROME C-TYPE BIOGENESIS PROTEIN CYCK

| ORF Name | NTID | AAID | NT Length | AA Length | Score | Probability |
|---|---|---|---|---|---|---|
| 5265800_f1_9 | 1231 | 3151 | 77 | 234 | 274 | 8.1e-24 |

| Protein name | | | | Locus Name | Acc# |
|---|---|---|---|---|---|
| | | | | sp:IF1_BACSU | P20458 |

Description

TRANSLATION INITIATION FACTOR IF-1

| ORF Name | NTID | AAID | NT Length | AA Length | Score | Probability |
|---|---|---|---|---|---|---|
| 587775_c1_36 | 1232 | 3152 | 172 | 519 | 299 | 1.8e-26 |

Protein name | Locus Name | Acc#
| | sp:CCMH_ECOLI | P33925 |

Description

CYTOCHROME C-TYPE BIOGENESIS PROTEIN CCMH PRECURSOR

| ORF Name | NTID | AAID | NT Length | AA Length | Score | Probability |
|---|---|---|---|---|---|---|
| 5894082_f1_7 | 1233 | 3153 | 206 | 621 | 309 | 1.6e-27 |

Protein name | Locus Name | Acc#
| | sp:YHHF_ECOLI | P10120 |

Description 21.7 KD PROTEIN IN FTSY-NIKA INTERGENIC REGION

| ORF Name | NTID | AAID | NT Length | AA Length | Score | Probability |
|---|---|---|---|---|---|---|
| 1058462_c3_105 | 1234 | 3154 | 283 | 852 | 77 | 0.032 |

Protein name | Locus Name | Acc#
| 15 kDa vesicular-like antigen | gp:PFAVLAP | M94732 |

Description

Plasmodium falciparum 15 kDa vesicular-like antigen gene, exons 1 through 4.

| ORF Name | NTID | AAID | NT Length | AA Length | Score | Probability |
|---|---|---|---|---|---|---|
| 13688802_c2_101 | 1235 | 3155 | 76 | 231 | | |

Protein name | Locus Name | Acc#

Description

NO-HIT

| ORF Name | NTID | AAID | NT Length | AA Length | Score | Probability |
|---|---|---|---|---|---|---|
| 14644586_f2_28 | 1236 | 3156 | 391 | 1176 | 465 | 4.7e-44 |

Protein name | Locus Name | Acc#
| 36 kDa protein | gp:HPU86610 | U86610 |

Description

Helicobacter pylori 36 kDa protein gene, complete cds.

| ORF Name | NTID | AAID | NT Length | AA Length | Score | Probability |
|---|---|---|---|---|---|---|
| 16132787_f3_50 | 1237 | 3157 | 105 | 318 | 197 | 1.2e-15 |

| Protein name | Locus Name | Acc# |
|---|---|---|
| | sp:YDCQ_ECOLI | P76107 |

Description

HYPOTHETICAL 16.1 KD PROTEIN IN TEHB-ANSP INTERGENIC REGION

| ORF Name | NTID | AAID | NT Length | AA Length | Score | Probability |
|---|---|---|---|---|---|---|
| 19532661_f2_33 | 1238 | 3158 | 77 | 234 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 20335427_c2_78 | 1239 | 3159 | 657 | 1974 | 239 | 2.0e-17 |

| Protein name | Locus Name | Acc# |
|---|---|---|
| minor tail protein gp26-related protein | pir:F75605 | F75605 |

Description

| ORF Name | NTID | AAID | NT Length | AA Length | Score | Probability |
|---|---|---|---|---|---|---|
| 21642510_c2_77 | 1240 | 3160 | 69 | 210 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 21909377_f2_29 | 1241 | 3161 | 401 | 1206 | 261 | 3.0e-21 |

| Protein name | Locus Name | Acc# |
|---|---|---|
| hypothetical protein jhp1380 | pir:G71815 | G71815 |

Description

| ORF Name | NTID | AAID | NT Length | AA Length | Score | Probability |
|---|---|---|---|---|---|---|
| 22266577_f2_21 | 1242 | 3162 | 220 | 663 | 233 | 1.8e-19 |

| Protein name | Locus Name | Acc# |
|---|---|---|
| thiamine-phosphate pyrophosphorylase | gp:AF180145 | AF180145 |

Description

Zymomonas mobilis GTP-binding protein CgpA (cgpA), 60KDinner-membrane protein yidC (yidC), hypothetical protein,glutamine-pyruvate aminotransferase gltB (gltB), glutamate synthasesmall subunit gltS (gltS), undecaprenol kinase udk (udk),hypothetical protein, NADH dehydrogenase, hypothetical protein;zm12orf5, hypothetical protein, aspartate aminotransferase A,beta-hydroxysteroid dehydrogenase, phosphomannomutase pmm

| ORF Name | NTID | AAID | NT Length | AA Length | Score | Probability |
|---|---|---|---|---|---|---|
| 22894061_c3_119 | 1243 | 3163 | 165 | 498 | 222 | 2.6e-18 |

| Protein name | Locus Name | Acc# |
|---|---|---|
|  | sp:TOLR_PSEAE | P50599 |

Description

TOLR PROTEIN

| ORF Name | NTID | AAID | NT Length | AA Length | Score | Probability |
|---|---|---|---|---|---|---|
| 23444426_f3_45 | 1244 | 3164 | 419 | 1260 | 642 | 8.3e-94 |

| Protein name | Locus Name | Acc# |
|---|---|---|
| ATP-dependent helicase HrpA homolog. | gp:D90779 |  |

Description

E.coli genomic DNA, Kohara clone #268(31.6-32.0 min.).

| ORF Name | NTID | AAID | NT Length | AA Length | Score | Probability |
|---|---|---|---|---|---|---|
| 24021016_f3_43 | 1245 | 3165 | 1195 | 3588 | 2225 | 1.6e-266 |

| Protein name | Locus Name | Acc# |
|---|---|---|
|  | sp:MFD_HAEIN | P45128 |

Description

TRANSCRIPTION-REPAIR COUPLING FACTOR (TRCF)

| ORF Name | NTID | AAID | NT Length | AA Length | Score | Probability |
|---|---|---|---|---|---|---|
| 24401887_c1_62 | 1246 | 3166 | 114 | 345 | 165 | 2.9e-12 |

| Protein name | | | | Locus Name | | Acc# |
|---|---|---|---|---|---|---|
| | | | | gp:AB030825 | | AB030825 |

Description

Pseudomonas aeruginosa genomic DNA, partial sequence, strain:PAO1.

| ORF Name | NTID | AAID | NT Length | AA Length | Score | Probability |
|---|---|---|---|---|---|---|
| 25554561_f2_20 | 1247 | 3167 | 151 | 456 | 94 | 0.0015 |

| Protein name | | | | Locus Name | | Acc# |
|---|---|---|---|---|---|---|
| hypothetical protein PH1001 | | | | pir:D71092 | | D71092 |

Description

| ORF Name | NTID | AAID | NT Length | AA Length | Score | Probability |
|---|---|---|---|---|---|---|
| 2994032_c2_82 | 1248 | 3168 | 264 | 795 | 307 | 9.6e-35 |

| Protein name | | | | Locus Name | | Acc# |
|---|---|---|---|---|---|---|
| minor tail protein gp19 | | | | pir:T13105 | | T13105 |

Description

| ORF Name | NTID | AAID | NT Length | AA Length | Score | Probability |
|---|---|---|---|---|---|---|
| 31916632_f1_8 | 1249 | 3169 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 3320327_c2_76 | 1250 | 3170 | 94 | 285 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34188892_c1_61 | 1251 | 3171 | 673 | 2022 | 227 | 4.5e-15 |

| Protein name | Locus Name | Acc# |
|---|---|---|
| | sp:VG26_BPMD2 | O64220 |

Description

MINOR TAIL PROTEIN GP26

| ORF Name | NTID | AAID | NT Length | AA Length | Score | Probability |
|---|---|---|---|---|---|---|
| 34415711_f1_10 | 1252 | 3172 | 368 | 1107 | 288 | 2.7e-25 |

| Protein name | Locus Name | Acc# |
|---|---|---|
| conserved hypothetical integral membrane protein HP1486 | pir:F64705 | F64705 |

Description

| ORF Name | NTID | AAID | NT Length | AA Length | Score | Probability |
|---|---|---|---|---|---|---|
| 35367058_f3_51 | 1253 | 3173 | 76 | 231 | 151 | 8.8e-11 |

| Protein name | Locus Name | Acc# |
|---|---|---|
| | sp:YDCQ_ECOLI | P76107 |

Description

HYPOTHETICAL 16.1 KD PROTEIN IN TEHB-ANSP INTERGENIC REGION

| ORF Name | NTID | AAID | NT Length | AA Length | Score | Probability |
|---|---|---|---|---|---|---|
| 35942905_f2_19 | 1254 | 3174 | 156 | 471 | 278 | 3.1e-24 |

| Protein name | Locus Name | Acc# |
|---|---|---|
| | sp:YIBK_ECOLI | P33899 |

Description

HYPOTHETICAL TRNA/RRNA METHYLTRANSFERASE YIBK,

| ORF Name | NTID | AAID | NT Length | AA Length | Score | Probability |
|---|---|---|---|---|---|---|
| 36118750_c2_104 | 1255 | 3175 | 77 | 234 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 36328956_f2_23 | 1256 | 3176 | 108 | 327 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 3944450_c2_93 | 1257 | 3177 | 232 | 699 | 422 | 1.7e-39 |

| Protein name | | Locus Name | Acc# |
|---|---|---|---|
| TolQ protein | | gp:PPPAL1 | X74218 |

Description

Pseudomonas putida ruvB, tolQ, tolR, tolA, tolB and oprL genes.

| ORF Name | NTID | AAID | NT Length | AA Length | Score | Probability |
|---|---|---|---|---|---|---|
| 4460387_f1_9 | 1258 | 3178 | 514 | 1545 | 240 | 3.4e-17 |

| Protein name | | Locus Name | Acc# |
|---|---|---|---|
| hypothetical protein jhp1382 | | pir:A71816 | A71816 |

Description

| ORF Name | NTID | AAID | NT Length | AA Length | Score | Probability |
|---|---|---|---|---|---|---|
| 4507703_c2_103 | 1259 | 3179 | 102 | 309 | 157 | 2.0e-11 |

| Protein name | | Locus Name | Acc# |
|---|---|---|---|
| | | sp:YO14_BPHP1 | P51716 |

Description

HYPOTHETICAL 14.9 KD PROTEIN IN REP-HOL INTERGENIC REGION (ORF14)

| ORF Name | NTID | AAID | NT Length | AA Length | Score | Probability |
|---|---|---|---|---|---|---|
| 4728415_c3_120 | 1260 | 3180 | 276 | 831 | 103 | 0.030 |

| Protein name | | Locus Name | Acc# |
|---|---|---|---|
| ras interacting protein RIPA | | gp:AF159241 | AF159241 |

Description

Dictyostelium discoideum ras interacting protein RIPA (ripA) mRNA, complete cds.

| ORF_Name | NTID | AAID | NT Length | AA Length | Score | Probability |
|---|---|---|---|---|---|---|
| 4730050_c1_73 | 1261 | 3181 | 439 | 1320 | 375 | 1.6e-34 |

| Protein name | Locus Name | Acc# |
|---|---|---|
| TolB | gp:HIU32470 | U32470 |

Description

Haemophilus influenzae tolQRAB gene cluster, inner membrane protein(tolQ) gene, partial cds, inner membrane protein (tolR), outermembrane integrity protein (tolA) and colicin tolerance protein(tolB) genes, complete cds.

| ORF_Name | NTID | AAID | NT Length | AA Length | Score | Probability |
|---|---|---|---|---|---|---|
| 5282805_c1_63 | 1262 | 3182 | 227 | 684 | 329 | 1.2e-29 |

| Protein name | Locus Name | Acc# |
|---|---|---|
| minor tail protein L homolog:protein gp18 | pir:T13104 | T13104 |

Description

| ORF_Name | NTID | AAID | NT Length | AA Length | Score | Probability |
|---|---|---|---|---|---|---|
| 5348393_c2_83 | 1263 | 3183 | 79 | 240 | | |

| Protein name | Locus Name | Acc# |
|---|---|---|
| | | |

Description

NO-HIT

| ORF_Name | NTID | AAID | NT Length | AA Length | Score | Probability |
|---|---|---|---|---|---|---|
| 682777_c2_79 | 1264 | 3184 | 139 | 420 | | |

| Protein name | Locus Name | Acc# |
|---|---|---|
| | | |

Description

NO-HIT

| ORF_Name | NTID | AAID | NT Length | AA Length | Score | Probability |
|---|---|---|---|---|---|---|
| 7265950_f1_7 | 1265 | 3185 | 1014 | 3045 | 726 | 3.1e-134 |

| Protein name | Locus Name | Acc# |
|---|---|---|
| | sp:HRPA_ECOLI | |

Description

ATP-DEPENDENT HELICASE HRPA

| ORF Name | NTID | AAID | NT Length | AA Length | Score | Probability |
|---|---|---|---|---|---|---|
| 24113927_f2_1 | 1266 | 3186 | 334 | 1005 | 116 | 0.0012 |

Protein name: STARP antigen
Locus Name: gp:PRSTARPA
Acc#: Z30339

Description: P.reichenowi STARP gene for STARP antigen.

| ORF Name | NTID | AAID | NT Length | AA Length | Score | Probability |
|---|---|---|---|---|---|---|
| 25673906_f1_1 | 1267 | 3187 | 206 | 621 | 435 | 7.0e-41 |

Protein name:
Locus Name: sp:YYCF_BACSU
Acc#: P37478

Description: INTERGENIC REGION

| ORF Name | NTID | AAID | NT Length | AA Length | Score | Probability |
|---|---|---|---|---|---|---|
| 29927207_f3_4 | 1268 | 3188 | 230 | 693 | 88 | 2.4e-05 |

Protein name: probable two component sensor protein
Locus Name: pir:C70624
Acc#: C70624

Description:

| ORF Name | NTID | AAID | NT Length | AA Length | Score | Probability |
|---|---|---|---|---|---|---|
| 35210305_f1_2 | 1269 | 3189 | 300 | 903 | 155 | 2.3e-08 |

Protein name: SmeS
Locus Name: gp:AF173226
Acc#: AF173226

Description: Stenotrophomonas maltophilia multidrug efflux system SmeR (smeR), SmeS (smeS), SmeA (smeA), SmeB (smeB), and SmeC (smeC) genes, complete cds.

| ORF Name | NTID | AAID | NT Length | AA Length | Score | Probability |
|---|---|---|---|---|---|---|
| 12938586_c3_89 | 1270 | 3190 | 152 | 459 | 296 | 3.8e-26 |

Protein name:
Locus Name: sp:PAL_PSEPU
Acc#: P43036

Description: PEPTIDOGLYCAN-ASSOCIATED LIPOPROTEIN PRECURSOR

344

| ORF Name | NTID | AAID | NT Length | AA Length | Score | Probability |
|---|---|---|---|---|---|---|
| 14237656_c1_39 | 1271 | 3191 | 85 | 258 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 14492157_f3_31 | 1272 | 3192 | 276 | 831 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 14875327_f2_18 | 1273 | 3193 | 867 | 2604 | 1592 | 1.7e-163 |

| Protein name | Locus Name | Acc# |
|---|---|---|
| membrane alanyl aminopeptidase | gp:AF157493 | AF157493 |

Description

Zymomonas mobilis ZM4 fosmid clone 42D7, complete sequence.

| ORF Name | NTID | AAID | NT Length | AA Length | Score | Probability |
|---|---|---|---|---|---|---|
| 156258_c3_90 | 1274 | 3194 | 199 | 600 | 126 | 2.6e-06 |

| Protein name | Locus Name | Acc# |
|---|---|---|
| NrpG | gp:PMU46488 | U46488 |

Description

Proteus mirabilis NrpS (nrpS) gene, partial cds, NrpU (nrpU), NrpT(nrpT), NrpA (nrpA), NrpB (nrpB), NrpG (nrpG) and IrpP (irpP)genes, complete cds.

| ORF Name | NTID | AAID | NT Length | AA Length | Score | Probability |
|---|---|---|---|---|---|---|
| 16180387_f3_36 | 1275 | 3195 | 384 | 1155 | 143 | 3.8e-07 |

| Protein name | Locus Name | Acc# |
|---|---|---|
| hypothetical protein RP367 | pir:H71693 | H71693 |

Description

| ORF Name | NTID | AAID | NT Length | AA Length | Score | Probability |
|---|---|---|---|---|---|---|
| 16507676_c2_64 | 1276 | 3196 | 338 | 1017 | 445 | 6.1e-42 |

Protein name | Locus Name | Acc#
| | sp:SMTA_ECOLI | |

Description

SMTA PROTEIN

| ORF Name | NTID | AAID | NT Length | AA Length | Score | Probability |
|---|---|---|---|---|---|---|
| 22116326_f2_14 | 1277 | 3197 | 109 | 330 | 205 | 1.7e-16 |

Protein name | Locus Name | Acc#
| | sp:PA1_KLEPN | P37446 |

Description (ACYLHYDROLASE) (OUTER MEMBRANE PHOSPHOLIPASE A) (OM PLA)

| ORF Name | NTID | AAID | NT Length | AA Length | Score | Probability |
|---|---|---|---|---|---|---|
| 22694056_f1_11 | 1278 | 3198 | 637 | 1914 | 1865 | 2.1e-192 |

Protein name | Locus Name | Acc#
| | sp:CLPB_HAEIN | P44403 |

Description

CLPB PROTEIN

| ORF Name | NTID | AAID | NT Length | AA Length | Score | Probability |
|---|---|---|---|---|---|---|
| 23495633_f2_15 | 1279 | 3199 | 349 | 1050 | 105 | 0.0072 |

Protein name | Locus Name | Acc#
| ComB | gp:AF027189 | AF027189 |

Description

Acinetobacter sp. BD413 lytB, comB, comC, comE, and comF genes, complete cds; and unknown genes.

| ORF Name | NTID | AAID | NT Length | AA Length | Score | Probability |
|---|---|---|---|---|---|---|
| 2376890_c2_56 | 1280 | 3200 | 90 | 273 | | |

Protein name | Locus Name | Acc#

Description

NO-HIT

| ORF Name | NTID | AAID | NT Length | AA Length | Score | Probability |
|---|---|---|---|---|---|---|
| 24395640_f3_38 | 1281 | 3201 | 282 | 849 | 291 | 1.3e-25 |

| Protein name | Locus Name | Acc# |
|---|---|---|
| ABC transporter potG | pir:B71694 | B71694 |

Description

---

| ORF Name | NTID | AAID | NT Length | AA Length | Score | Probability |
|---|---|---|---|---|---|---|
| 24643831_f1_3 | 1282 | 3202 | 346 | 1041 | 213 | 3.2e-16 |

| Protein name | Locus Name | Acc# |
|---|---|---|
| phospholipase A | gp:CCPLDA | Y11031 |

Description

C.coli pldA gene.

| ORF Name | NTID | AAID | NT Length | AA Length | Score | Probability |
|---|---|---|---|---|---|---|
| 24783453_f2_25 | 1283 | 3203 | 224 | 675 | 738 | 5.5e-73 |

| Protein name | Locus Name | Acc# |
|---|---|---|
|  | sp:CLPB_BACNO | P17422 |

Description

CLPB PROTEIN

| ORF Name | NTID | AAID | NT Length | AA Length | Score | Probability |
|---|---|---|---|---|---|---|
| 25817157_f3_34 | 1284 | 3204 | 250 | 753 | 319 | 1.4e-28 |

| Protein name | Locus Name | Acc# |
|---|---|---|
| hypothetical protein | gp:AHWAAA179 | Z96927 |

Description

Acinetobacter haemolyticus waaA gene, strain ATCC 17906.

| ORF Name | NTID | AAID | NT Length | AA Length | Score | Probability |
|---|---|---|---|---|---|---|
| 2995252_f3_37 | 1285 | 3205 | 342 | 1029 | 198 | 1.4e-13 |

| Protein name | Locus Name | Acc# |
|---|---|---|
| ct391 hypothetical protein | pir:G72072 | G72072 |

Description

| ORF Name | NTID | AAID | NT Length | AA Length | Score | Probability |
|---|---|---|---|---|---|---|
| 32703126_f2_22 | 1286 | 3206 | 304 | 915 | 369 | 6.9e-34 |

| Protein name | Locus Name | Acc# |
|---|---|---|
| hypothetical protein RP368 | pir:A71694 | A71694 |

Description

---

| ORF Name | NTID | AAID | NT Length | AA Length | Score | Probability |
|---|---|---|---|---|---|---|
| 35368941_f1_4 | 1287 | 3207 | 285 | 858 | 152 | 4.5e-09 |

| Protein name | Locus Name | Acc# |
|---|---|---|
| competence protein ComF | gp:PST249742 | AJ249742 |

Description

Pseudomonas stutzeri JM300 bioB (partial), comF and dof (partial) genes.

---

| ORF Name | NTID | AAID | NT Length | AA Length | Score | Probability |
|---|---|---|---|---|---|---|
| 35943885_c2_66 | 1288 | 3208 | 413 | 1242 | | |

| Protein name | Locus Name | Acc# |
|---|---|---|
| | | |

Description

NO-HIT

---

| ORF Name | NTID | AAID | NT Length | AA Length | Score | Probability |
|---|---|---|---|---|---|---|
| 4111633_f2_13 | 1289 | 3209 | 154 | 465 | | |

| Protein name | Locus Name | Acc# |
|---|---|---|
| | | |

Description

NO-HIT

---

| ORF Name | NTID | AAID | NT Length | AA Length | Score | Probability |
|---|---|---|---|---|---|---|
| 4142186_f1_2 | 1290 | 3210 | 246 | 741 | 777 | 4.0e-77 |

| Protein name | Locus Name | Acc# |
|---|---|---|
| | sp:RNPH_PSEAE | P50597 |

Description

NUCLEOTIDYLTRANSFERASE)

| ORF Name | NTID | AAID | NT Length | AA Length | Score | Probability |
|---|---|---|---|---|---|---|
| 4572203_f1_9 | 1291 | 3211 | 329 | 990 | 117 | 5.7e-05 |

| Protein name | | | | Locus Name | Acc# |
|---|---|---|---|---|---|
| merozoite surface antigen 2 | | | | gp:U91655 | U91655 |

Description

Plasmodium falciparum isolate V310, merozoite surface antigen 2(MSP-2) gene, partial cds.

| ORF Name | NTID | AAID | NT Length | AA Length | Score | Probability |
|---|---|---|---|---|---|---|
| 4797282_c2_74 | 1292 | 3212 | 67 | 204 | | |

| Protein name | | | | Locus Name | Acc# |
|---|---|---|---|---|---|

Description

NO-HIT

| ORF Name | NTID | AAID | NT Length | AA Length | Score | Probability |
|---|---|---|---|---|---|---|
| 5082637_f3_33 | 1293 | 3213 | 440 | 1323 | 635 | 4.5e-62 |

| Protein name | | | | Locus Name | Acc# |
|---|---|---|---|---|---|
| WaaA | | | | gp:AF026386 | AF026386 |

Description

Salmonella typhimurium strain LT2 LPS core oligosaccharidebiosynthesis region, WaaY (waaY) gene, partial cds; WaaJ (waaJ),WaaI (waaI), WaaB (waaB), WaaP (waaP), WaaG (waaG), and WaaQ (waaQ)genes, complete cds; and WaaA (waaA) gene, partial cds.

| ORF Name | NTID | AAID | NT Length | AA Length | Score | Probability |
|---|---|---|---|---|---|---|
| 5132838_f1_5 | 1294 | 3214 | 255 | 768 | | |

| Protein name | | | | Locus Name | Acc# |
|---|---|---|---|---|---|

Description

NO-HIT

| ORF Name | NTID | AAID | NT Length | AA Length | Score | Probability |
|---|---|---|---|---|---|---|
| 5867075_f3_29 | 1295 | 3215 | 202 | 609 | 105 | 0.00049 |

| Protein name | Locus Name | Acc# |
|---|---|---|
| pilV protein | pir:S77594 | S77594 |

Description

| ORF Name | NTID | AAID | NT Length | AA Length | Score | Probability |
|---|---|---|---|---|---|---|
| 790700_c2_65 | 1296 | 3216 | 379 | 1140 | 151 | 9.2e-08 |

| Protein name | Locus Name | Acc# |
|---|---|---|
| hypothetical protein TP0565 | pir:C71308 | C71308 |

Description

| ORF Name | NTID | AAID | NT Length | AA Length | Score | Probability |
|---|---|---|---|---|---|---|
| 9775283_c1_46 | 1297 | 3217 | 499 | 1500 | 469 | 1.8e-44 |

| Protein name | Locus Name | Acc# |
|---|---|---|
| probable alginate O-acetylation protein (algI) | pir:D71308 | D71308 |

Description

| ORF Name | NTID | AAID | NT Length | AA Length | Score | Probability |
|---|---|---|---|---|---|---|
| 115827_c1_7 | 1298 | 3218 | 330 | 993 | 877 | 1.0e-87 |

| Protein name | Locus Name | Acc# |
|---|---|---|
|  | sp:GLMU_HAEIN | P43889 |

Description

ACETYLGLUCOSAMINE-1-PHOSPHATE URIDYLTRANSFERASE)

| ORF Name | NTID | AAID | NT Length | AA Length | Score | Probability |
|---|---|---|---|---|---|---|
| 16828178_f1_2 | 1299 | 3219 | 616 | 1851 | 2166 | 2.6e-224 |

| Protein name | Locus Name | Acc# |
|---|---|---|
|  | sp:TYPA_HAEIN | P44910 |

Description

GTP-BINDING PROTEIN TYPA/BIPA HOMOLOG

350

| ORF Name | NTID | AAID | NT Length | AA Length | Score | Probability |
|---|---|---|---|---|---|---|
| 32656465_c2_10 | 1300 | 3220 | 78 | 237 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 3336053_f1_1 | 1301 | 3221 | 133 | 402 | 618 | 2.9e-60 |

| Protein name | | Locus Name | Acc# |
|---|---|---|---|
| outer membrane protein CD precursor | | pir:S39866 | S39866 |

Description

| ORF Name | NTID | AAID | NT Length | AA Length | Score | Probability |
|---|---|---|---|---|---|---|
| 10975831_c3_12 | 1302 | 3222 | 92 | 279 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 15912757_c1_8 | 1303 | 3223 | 123 | 372 | 86 | 0.048 |

| Protein name | | Locus Name | Acc# |
|---|---|---|---|
| FIP2 | | gp:AF061034 | AF061034 |

Description

Homo sapiens FIP2 alternatively translated mRNA, complete cds.

| ORF Name | NTID | AAID | NT Length | AA Length | Score | Probability |
|---|---|---|---|---|---|---|
| 22457187_f3_5 | 1304 | 3224 | 250 | 753 | 888 | 7.0e-89 |

| Protein name | | Locus Name | Acc# |
|---|---|---|---|
| | | sp:Y882_HAEIN | P44068 |

Description

HYPOTHETICAL PROTEIN HI0882

| ORF Name | NTID | AAID | NT Length | AA Length | Score | Probability |
|---|---|---|---|---|---|---|
| 35271883_f1_4 | 1305 | 3225 | 60 | 183 | | |

Protein name              Locus_Name      Acc#

Description

NO-HIT

| ORF Name | NTID | AAID | NT Length | AA Length | Score | Probability |
|---|---|---|---|---|---|---|
| 22848457_f2_3 | 1306 | 3226 | 134 | 405 | | |

Protein name              Locus_Name      Acc#

Description

NO-HIT

| ORF Name | NTID | AAID | NT Length | AA Length | Score | Probability |
|---|---|---|---|---|---|---|
| 22853376_f3_5 | 1307 | 3227 | 239 | 720 | | |

Protein name              Locus_Name      Acc#

Description

NO-HIT

| ORF Name | NTID | AAID | NT Length | AA Length | Score | Probability |
|---|---|---|---|---|---|---|
| 29296968_c3_9 | 1308 | 3228 | 77 | 234 | | |

Protein name              Locus_Name      Acc#

Description

NO-HIT

| ORF Name | NTID | AAID | NT Length | AA Length | Score | Probability |
|---|---|---|---|---|---|---|
| 976678_c3_10 | 1309 | 3229 | 190 | 570 | 265 | 7.3e-23 |

Protein name              Locus_Name      Acc#
                                         sp:PRTR_PSEAE     Q06553

Description

TRANSCRIPTION REGULATORY PROTEIN PRTR (PYOSIN REPRESSOR PROTEIN)

| ORF Name | NTID | AAID | NT Length | AA Length | Score | Probability |
|---|---|---|---|---|---|---|
| 989077_f1_1 | 1310 | 3230 | 122 | 369 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1062575_c3_34 | 1311 | 3231 | 109 | 330 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 11125280_f3_13 | 1312 | 3232 | 146 | 441 | 538 | 8.6e-52 |

| Protein name | Locus Name | Acc# |
|---|---|---|
| nifU protein homolog HI0377 | pir:C64064 | C64064 |

Description

| ORF Name | NTID | AAID | NT Length | AA Length | Score | Probability |
|---|---|---|---|---|---|---|
| 1297092_c1_20 | 1313 | 3233 | 111 | 336 | 174 | 3.9e-12 |

| Protein name | Locus Name | Acc# |
|---|---|---|
| probable gamma-glutamyltranspeptidase precursor | pir:E70682 | E70682 |

Description

| ORF Name | NTID | AAID | NT Length | AA Length | Score | Probability |
|---|---|---|---|---|---|---|
| 15892918_c3_35 | 1314 | 3234 | 110 | 333 | 222 | 2.4e-17 |

| Protein name | Locus Name | Acc# |
|---|---|---|
| probable gamma-glutamyltranspeptidase | pir:T34901 | T34901 |

Description

| ORF Name | NTID | AAID | NT Length | AA Length | Score | Probability |
|---|---|---|---|---|---|---|
| 20727194_c2_24 | 1315 | 3235 | 91 | 276 | 318 | 1.8e-28 |

| Protein name | Locus Name | Acc# |
|---|---|---|
| | gp:AF017750 | AF017750 |

Description

Haemophilus ducreyi cytochrome C-type biogenesis protein (ccmH), recombinational DNA repair protein (recR), manganese superoxidedismutase (sodA), and CitG protein homolog (citG) genes, completecds.

| ORF Name | NTID | AAID | NT Length | AA Length | Score | Probability |
|---|---|---|---|---|---|---|
| 21679025_f1_1 | 1316 | 3236 | 420 | 1263 | 1516 | 2.0e-155 |

| Protein name | Locus Name | Acc# |
|---|---|---|
| | sp:NIFS_ECOLI | |

Description

NIFS PROTEIN HOMOLOG

| ORF Name | NTID | AAID | NT Length | AA Length | Score | Probability |
|---|---|---|---|---|---|---|
| 31797152_f3_14 | 1317 | 3237 | 186 | 561 | 224 | 1.6e-18 |

| Protein name | Locus Name | Acc# |
|---|---|---|
| | sp:HSCB_ECOLI | P36540 |

Description

CHAPERONE PROTEIN HSCB (HSC20)

| ORF Name | NTID | AAID | NT Length | AA Length | Score | Probability |
|---|---|---|---|---|---|---|
| 32244203_c2_26 | 1318 | 3238 | 72 | 219 | 125 | 5.0e-08 |

| Protein name | Locus Name | Acc# |
|---|---|---|
| | gp:VCH231122 | AJ231122 |

Description

Vibrio cholerae z61f gene.

| ORF_Name | NTID | AAID | NT Length | AA Length | Score | Probability |
|---|---|---|---|---|---|---|
| 33398287_f2_5 | 1319 | 3239 | 178 | 537 | 396 | 9.6e-37 |

Protein name | Locus_Name | Acc#
sp:YFHP_HAEIN | P44675

Description

HYPOTHETICAL PROTEIN HI0379

| ORF_Name | NTID | AAID | NT Length | AA Length | Score | Probability |
|---|---|---|---|---|---|---|
| 36129678_f1_2 | 1320 | 3240 | 112 | 339 | 384 | 1.8e-35 |

Protein name | Locus_Name | Acc#
sp:YFHF_HAEIN | P44672

Description

HYPOTHETICAL PROTEIN HI0376

| ORF_Name | NTID | AAID | NT Length | AA Length | Score | Probability |
|---|---|---|---|---|---|---|
| 36220382_c2_25 | 1321 | 3241 | 120 | 363 | 174 | 3.2e-12 |

Protein name | Locus_Name | Acc#
sp:GGT_PIG | P20735

Description

GLUTAMYLTRANSFERASE) (GGT)

| ORF_Name | NTID | AAID | NT Length | AA Length | Score | Probability |
|---|---|---|---|---|---|---|
| 4331938_f2_9 | 1322 | 3242 | 622 | 1869 | 1435 | 7.6e-147 |

Protein name | Locus_Name | Acc#
sp:HSCA_HAEIN | P44669

Description

CHAPERONE PROTEIN HSCA (HSC66)

| ORF Name | NTID | AAID | NT Length | AA Length | Score | Probability |
|---|---|---|---|---|---|---|
| 4332838_f2_10 | 1323 | 3243 | 115 | 348 | 397 | 7.5e-37 |

| Protein name | Locus Name | Acc# |
|---|---|---|
| ferredoxin | gp:AF096864 | AF096864 |

Description

Pseudomonas aeruginosa heat shock protein (hscB), heat shockprotein 66-KDa (hscA), ferredoxin (fdx), and nucleoside diphosphatekinase (ndk) genes, complete cds.

| ORF Name | NTID | AAID | NT Length | AA Length | Score | Probability |
|---|---|---|---|---|---|---|
| 5898593_c2_28 | 1324 | 3244 | 119 | 360 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 7070215_c2_27 | 1325 | 3245 | 161 | 486 | 351 | 5.6e-32 |

| Protein name | Locus Name | Acc# |
|---|---|---|
| putative gamma-glutamyltranspeptidase precursor | gp:PST249741 | AJ249741 |

Description

Pseudomonas stutzeri JM300 gacS (partial) and ggtB (partial) genes.

| ORF Name | NTID | AAID | NT Length | AA Length | Score | Probability |
|---|---|---|---|---|---|---|
| 12915808_f3_10 | 1326 | 3246 | 200 | 603 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 20737503_f3_8 | 1327 | 3247 | 371 | 1116 | 418 | 4.5e-39 |

| Protein name | Locus Name | Acc# |
|---|---|---|
| probable permease perM homolog (perM) RP630 | pir:E71668 | E71668 |

Description

| ORF Name | NTID | AAID | NT Length | AA Length | Score | Probability |
|---|---|---|---|---|---|---|
| 22000293_c2_13 | 1328 | 3248 | 97 | 294 | 348 | 1.2e-31 |

| Protein name | Locus Name | Acc# |
|---|---|---|
| 50S ribosomal protein homolog | gp:AF153712 | AF153712 |

Description

Pseudomonas sp. BG33R strain BG33R 50S ribosomal protein homologgene, complete cds.

| ORF Name | NTID | AAID | NT Length | AA Length | Score | Probability |
|---|---|---|---|---|---|---|
| 23863307_f3_9 | 1329 | 3249 | 261 | 786 | 194 | 2.4e-15 |

| Protein name | Locus Name | Acc# |
|---|---|---|
|  | sp:YFGE_HAEIN | O86235 |

Description

HYPOTHETICAL PROTEIN HI1225.1

| ORF Name | NTID | AAID | NT Length | AA Length | Score | Probability |
|---|---|---|---|---|---|---|
| 24308561_c3_17 | 1330 | 3250 | 182 | 549 | 710 | 5.1e-70 |

| Protein name | Locus Name | Acc# |
|---|---|---|
| phosphoribosylformylglycinamidine cyclo-ligase,:5'-phosphoribosyl-5-aminoimidazole synthetase | pir:AJECPC |  |

Description

| ORF Name | NTID | AAID | NT Length | AA Length | Score | Probability |
|---|---|---|---|---|---|---|
| 26277251_c3_18 | 1331 | 3251 | 131 | 396 | 352 | 4.4e-32 |

| Protein name | Locus Name | Acc# |
|---|---|---|
|  | sp:PUR5_ECOLI | P08178 |

Description (PHOSPHORIBOSYL-AMINOIMIDAZOLE SYNTHETASE) (AIR SYNTHASE)

357

| ORF Name | NTID | AAID | NT Length | AA Length | Score | Probability |
|---|---|---|---|---|---|---|
| 6142915_c2_14 | 1332 | 3252 | 228 | 687 | 382 | 2.9e-35 |

| Protein name | Locus Name | Acc# |
|---|---|---|
| 5'-phosphoribosylglycinamide transformylase | gp:STU68765 | U68765 |

Description

Salmonella typhimurium 5'-phosphoribosylglycinamide transformylase(purN) and 5'-phosphoribosyl-5-aminoimidazole synthetase (purI)genes, complete cds.

| ORF Name | NTID | AAID | NT Length | AA Length | Score | Probability |
|---|---|---|---|---|---|---|
| 10744000_c3_102 | 1333 | 3253 | 309 | 930 | 1094 | 1.0e-110 |

| Protein name | Locus Name | Acc# |
|---|---|---|
| probable Mn transport protein | pir:G64063 | |

Description

| ORF Name | NTID | AAID | NT Length | AA Length | Score | Probability |
|---|---|---|---|---|---|---|
| 1181631_f1_2 | 1334 | 3254 | 558 | 1677 | 1333 | 4.9e-136 |

| Protein name | Locus Name | Acc# |
|---|---|---|
| | sp:60IM_PSEPU | P25754 |

Description

60 KD INNER-MEMBRANE PROTEIN

| ORF Name | NTID | AAID | NT Length | AA Length | Score | Probability |
|---|---|---|---|---|---|---|
| 13703378_c3_117 | 1335 | 3255 | 95 | 288 | 163 | 4.7e-12 |

| Protein name | Locus Name | Acc# |
|---|---|---|
| | sp:YEAQ_ECOLI | P76246 |

Description

HYPOTHETICAL 8.7 KD PROTEIN IN GAPA-RND INTERGENIC REGION

| ORF Name | NTID | AAID | NT Length | AA Length | Score | Probability |
|---|---|---|---|---|---|---|
| 15031513_f3_43 | 1336 | 3256 | 479 | 1440 | 1390 | 4.5e-142 |

| Protein name | Locus Name | Acc# |
|---|---|---|
| | sp:THRC_METGL | P37145 |

Description

THREONINE SYNTHASE,

| ORF Name | NTID | AAID | NT Length | AA Length | Score | Probability |
|---|---|---|---|---|---|---|
| 15039077_cl_64 | 1337 | 3257 | 266 | 801 | 196 | 1.5e-15 |

Protein name | Locus Name | Acc#
gp:DNINTREG | X98546

Description

D.nodosus intB, regA, gepA, gepB, and gepC genes.

| ORF Name | NTID | AAID | NT Length | AA Length | Score | Probability |
|---|---|---|---|---|---|---|
| 15665903_cl_59 | 1338 | 3258 | 281 | 846 | 1074 | 1.4e-108 |

Protein name | Locus Name | Acc#
sp:Y360_HAEIN | P44661

Description

HYPOTHETICAL PROTEIN HI0360

| ORF Name | NTID | AAID | NT Length | AA Length | Score | Probability |
|---|---|---|---|---|---|---|
| 15798825_cl_65 | 1339 | 3259 | 165 | 498 | | |

Protein name | Locus Name | Acc#

Description

NO-HIT

| ORF Name | NTID | AAID | NT Length | AA Length | Score | Probability |
|---|---|---|---|---|---|---|
| 19538327_cl_72 | 1340 | 3260 | 213 | 642 | 218 | 7.0e-18 |

Protein name | Locus Name | Acc#
sp:Y882_METJA | Q58292

Description

HYPOTHETICAL PROTEIN MJ0882

| ORF Name | NTID | AAID | NT Length | AA Length | Score | Probability |
|---|---|---|---|---|---|---|
| 197188_f3_42 | 1341 | 3261 | 345 | 1038 | 659 | 1.3e-64 |

Protein name | Locus Name | Acc#
sp:FMT_PSEAE | O85732

Description

METHIONYL-TRNA FORMYLTRANSFERASE,

359

| ORF Name | NTID | AAID | NT Length | AA Length | Score | Probability |
|---|---|---|---|---|---|---|
| 20197175_f3_44 | 1342 | 3262 | 415 | 1248 | 453 | 5.0e-47 |

Protein name | Locus Name | Acc#
sp:SMF_HAEIN | P43862

Description

SMF PROTEIN (DNA PROCESSING CHAIN A)

| ORF Name | NTID | AAID | NT Length | AA Length | Score | Probability |
|---|---|---|---|---|---|---|
| 23440886_f2_27 | 1343 | 3263 | 602 | 1809 | 241 | 2.1e-19 |

Protein name | Locus Name | Acc#
sp:Y678_METJA | Q58091

Description

HYPOTHETICAL PROTEIN MJ0678

| ORF Name | NTID | AAID | NT Length | AA Length | Score | Probability |
|---|---|---|---|---|---|---|
| 241290_f2_31 | 1344 | 3264 | 65 | 198 | | |

Protein name | Locus Name | Acc#

Description

NO-HIT

| ORF Name | NTID | AAID | NT Length | AA Length | Score | Probability |
|---|---|---|---|---|---|---|
| 24244010_c3_106 | 1345 | 3265 | 83 | 252 | 69 | 0.042 |

Protein name | Locus Name | Acc#
hypothetical protein Y105C5B.x | pir:T26400 | T26400

Description

| ORF Name | NTID | AAID | NT Length | AA Length | Score | Probability |
|---|---|---|---|---|---|---|
| 24253187_c3_107 | 1346 | 3266 | 66 | 201 | | |

Protein name | Locus Name | Acc#

Description

NO-HIT

| ORF Name | NTID | AAID | NT Length | AA Length | Score | Probability |
|---|---|---|---|---|---|---|
| 24255262_c2_96 | 1347 | 3267 | 430 | 1293 | 873 | 2.7e-87 |

| Protein name | Locus Name | Acc# |
|---|---|---|
| conserved hypothetical protein | pir:C75339 | C75339 |

Description

---

| ORF Name | NTID | AAID | NT Length | AA Length | Score | Probability |
|---|---|---|---|---|---|---|
| 24256550_f3_40 | 1348 | 3268 | 165 | 498 | 465 | 4.7e-44 |

| Protein name | Locus Name | Acc# |
|---|---|---|
| | sp:YBAD_ECOLI | P25538 |

Description

HYPOTHETICAL 17.2 KD PROTEIN IN TSX-RIBG INTERGENIC REGION (ORF1)

---

| ORF Name | NTID | AAID | NT Length | AA Length | Score | Probability |
|---|---|---|---|---|---|---|
| 24337786_f3_48 | 1349 | 3269 | 311 | 936 | 657 | 2.1e-64 |

| Protein name | Locus Name | Acc# |
|---|---|---|
| | sp:ARGI_BRUAB | Q59174 |

Description

ARGINASE,

---

| ORF Name | NTID | AAID | NT Length | AA Length | Score | Probability |
|---|---|---|---|---|---|---|
| 24417762_f1_18 | 1350 | 3270 | 62 | 189 | 74 | 0.030 |

| Protein name | Locus Name | Acc# |
|---|---|---|
| | sp:FM1A_SERMA | P22595 |

Description

TYPE-1 FIMBRIAL PROTEIN SUBUNIT PRECURSOR

---

| ORF Name | NTID | AAID | NT Length | AA Length | Score | Probability |
|---|---|---|---|---|---|---|
| 24489626_f2_21 | 1351 | 3271 | 474 | 1425 | 1058 | 6.8e-107 |

| Protein name | Locus Name | Acc# |
|---|---|---|
| | sp:THDF_PSEPU | P25755 |

Description

POSSIBLE THIOPHENE AND FURAN OXIDATION PROTEIN THDF

| ORF_Name | NTID | AAID | NT Length | AA Length | Score | Probability |
|---|---|---|---|---|---|---|
| 24643777_f2_22 | 1352 | 3272 | 352 | 1059 | 682 | 4.3e-78 |

Protein name     Locus_Name     Acc#
    sp:RIBD_ECOLI     P25539

Description

RIBOFLAVIN-SPECIFIC DEAMINASE,

| ORF_Name | NTID | AAID | NT Length | AA Length | Score | Probability |
|---|---|---|---|---|---|---|
| 24643937_f1_4 | 1353 | 3273 | 450 | 1353 | 695 | 2.0e-68 |

Protein name     Locus_Name     Acc#
    sp:SUN_HAEIN     P44788

Description

SUN PROTEIN (FMU PROTEIN)

| ORF_Name | NTID | AAID | NT Length | AA Length | Score | Probability |
|---|---|---|---|---|---|---|
| 26603562_c2_86 | 1354 | 3274 | 303 | 912 | 1047 | 9.9e-106 |

Protein name     Locus_Name     Acc#
    sp:FECE_HAEIN     P44662

Description

IRON(III) DICITRATE TRANSPORT ATP-BINDING PROTEIN FECE HOMOLOG

| ORF_Name | NTID | AAID | NT Length | AA Length | Score | Probability |
|---|---|---|---|---|---|---|
| 2738783_f2_37 | 1355 | 3275 | 60 | 183 | | |

Protein name     Locus_Name     Acc#

Description

NO-HIT

| ORF_Name | NTID | AAID | NT Length | AA Length | Score | Probability |
|---|---|---|---|---|---|---|
| 2750262_f1_1 | 1356 | 3276 | 103 | 312 | 193 | 3.1e-15 |

Protein name     Locus_Name     Acc#
hypothetical protein SCH24.04     pir:T36569     T36569

Description

| ORF Name | NTID | AAID | NT Length | AA Length | Score | Probability |
|---|---|---|---|---|---|---|
| 29539015_c1_62 | 1357 | 3277 | 417 | 1254 | 666 | 2.3e-65 |

| Protein name | | | | Locus Name | | Acc# |
|---|---|---|---|---|---|---|
| | | | | sp:YDHH_ECOLI | | P77570 |

Description

HYPOTHETICAL 39.5 KD PROTEIN IN PDXH-SLYB INTERGENIC REGION

| ORF Name | NTID | AAID | NT Length | AA Length | Score | Probability |
|---|---|---|---|---|---|---|
| 30739700_f1_7 | 1358 | 3278 | 211 | 636 | 244 | 1.2e-20 |

| Protein name | | | | Locus Name | | Acc# |
|---|---|---|---|---|---|---|
| | | | | sp:YRDC_ECOLI | | P45748 |

Description

HYPOTHETICAL 20.8 KD PROTEIN IN AROE-SMG INTERGENIC REGION

| ORF Name | NTID | AAID | NT Length | AA Length | Score | Probability |
|---|---|---|---|---|---|---|
| 34088143_f3_55 | 1359 | 3279 | 106 | 321 | | |

| Protein name | | | | Locus Name | | Acc# |

Description

NO-HIT

| ORF Name | NTID | AAID | NT Length | AA Length | Score | Probability |
|---|---|---|---|---|---|---|
| 3913215_f2_26 | 1360 | 3280 | 165 | 498 | | |

| Protein name | | | | Locus Name | | Acc# |

Description

NO-HIT

| ORF Name | NTID | AAID | NT Length | AA Length | Score | Probability |
|---|---|---|---|---|---|---|
| 3939063_f2_23 | 1361 | 3281 | 225 | 678 | 519 | 8.8e-50 |

| Protein name | | | | Locus Name | | Acc# |
|---|---|---|---|---|---|---|
| | | | | sp:RISA_PHOPO | | P51961 |

Description

RIBOFLAVIN SYNTHASE ALPHA CHAIN,

| ORF Name | NTID | AAID | NT Length | AA Length | Score | Probability |
|---|---|---|---|---|---|---|
| 3942213_c2_97 | 1362 | 3282 | 367 | 1104 | 930 | 2.5e-93 |

| Protein name | | | | Locus Name | | Acc# |
|---|---|---|---|---|---|---|
| | | | | sp:GCH2_PHOLE | | Q02008 |

Description

| ORF Name | NTID | AAID | NT Length | AA Length | Score | Probability |
|---|---|---|---|---|---|---|
| 4785911_f2_29 | 1363 | 3283 | 435 | 1308 | 1321 | 9.1e-135 |

| Protein name | | | | Locus Name | | Acc# |
|---|---|---|---|---|---|---|
| | | | | sp:OAT_DROAN | | P49724 |

Description

ACID AMINOTRANSFERASE)

| ORF Name | NTID | AAID | NT Length | AA Length | Score | Probability |
|---|---|---|---|---|---|---|
| 5214052_f3_53 | 1364 | 3284 | 411 | 1236 | 1096 | 6.4e-111 |

| Protein name | | | | Locus Name | | Acc# |
|---|---|---|---|---|---|---|
| | | | | sp:SYY_HAEIN | | P43836 |

Description

TYROSYL-TRNA SYNTHETASE, (TYROSINE--TRNA LIGASE) (TYRRS)

| ORF Name | NTID | AAID | NT Length | AA Length | Score | Probability |
|---|---|---|---|---|---|---|
| 5282562_c1_63 | 1365 | 3285 | 265 | 798 | 693 | 3.2e-68 |

| Protein name | | | | Locus Name | | Acc# |
|---|---|---|---|---|---|---|
| hypothetical protein jhp0330 | | | | pir:B71947 | | B71947 |

Description

| ORF Name | NTID | AAID | NT Length | AA Length | Score | Probability |
|---|---|---|---|---|---|---|
| 6070166_f2_20 | 1366 | 3286 | 71 | 216 | | |

| Protein name | | | | Locus Name | | Acc# |
|---|---|---|---|---|---|---|

Description

NO-HIT

| ORF_Name | NTID | AAID | NT Length | AA Length | Score | Probability |
|---|---|---|---|---|---|---|
| 6147028_c1_60 | 1367 | 3287 | 292 | 879 | 870 | 5.6e-87 |

| Protein name | Locus Name | Acc# |
|---|---|---|
| | sp:YFED_YERPE | Q56955 |

Description

CHELATED IRON TRANSPORT SYSTEM MEMBRANE PROTEIN YFED

| ORF_Name | NTID | AAID | NT Length | AA Length | Score | Probability |
|---|---|---|---|---|---|---|
| 839752_f1_19 | 1368 | 3288 | 60 | 183 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 867183_c1_68 | 1369 | 3289 | 128 | 387 | 107 | 2.7e-05 |

| Protein name | Locus Name | Acc# |
|---|---|---|
| | sp:YRAM_BACSU | O07931 |

Description

HYPOTHETICAL 39.5 KD PROTEIN IN SIGZ-CSN INTERGENIC REGION

| ORF_Name | NTID | AAID | NT Length | AA Length | Score | Probability |
|---|---|---|---|---|---|---|
| 1197077_f3_44 | 1370 | 3290 | 375 | 1128 | 178 | 8.2e-11 |

| Protein name | Locus Name | Acc# |
|---|---|---|
| hypothetical protein TM0342 | pir:D72388 | D72388 |

Description

| ORF_Name | NTID | AAID | NT Length | AA Length | Score | Probability |
|---|---|---|---|---|---|---|
| 14641008_f3_46 | 1371 | 3291 | 271 | 816 | 360 | 6.2e-33 |

| Protein name | Locus Name | Acc# |
|---|---|---|
| putative thiol:disulfide interchange protein | gp:AF057031 | AF057031 |

Description

Pseudomonas aeruginosa putative thiol:disulfide interchange proteinprecursor (dsbC) gene, complete cds.

| ORF Name | NTID | AAID | NT Length | AA Length | Score | Probability |
|---|---|---|---|---|---|---|
| 15058126_f1_9 | 1372 | 3292 | 204 | 615 | 183 | 3.6e-14 |

| Protein name | Locus Name | Acc# |
|---|---|---|
| hypothetical protein | gp:AF088857 | AF088857 |

Description

Vogesella indigofera indigoidine biosynthesis regulatory locus, complete sequence.

| ORF Name | NTID | AAID | NT Length | AA Length | Score | Probability |
|---|---|---|---|---|---|---|
| 158638_c3_82 | 1373 | 3293 | 89 | 270 | 350 | 7.2e-32 |

| Protein name | Locus Name | Acc# |
|---|---|---|
| | sp:IMDH_ACICA | P31002 |

Description

DEHYDROGENASE) (IMPDH) (IMPD)

| ORF Name | NTID | AAID | NT Length | AA Length | Score | Probability |
|---|---|---|---|---|---|---|
| 16992775_f2_22 | 1374 | 3294 | 61 | 186 | 85 | 0.00086 |

| Protein name | Locus Name | Acc# |
|---|---|---|
| gamma-carboxymuconolactone decarboxylase | pir:B69129 | B69129 |

Description

| ORF Name | NTID | AAID | NT Length | AA Length | Score | Probability |
|---|---|---|---|---|---|---|
| 20353465_f2_21 | 1375 | 3295 | 167 | 504 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 20734687_c2_78 | 1376 | 3296 | 297 | 894 | 642 | 8.2e-63 |

| Protein name | Locus Name | Acc# |
|---|---|---|
| | sp:YAAJ_HAEIN | P44555 |

Description

HYPOTHETICAL PROTEIN HI0183

| ORF Name | NTID | AAID | NT Length | AA Length | Score | Probability |
|---|---|---|---|---|---|---|
| 21672011_c1_54 | 1377 | 3297 | 61 | 186 | 55 | 0.0095 |

| Protein name | | | | Locus Name | | Acc# |
|---|---|---|---|---|---|---|
| | | | | sp:YY10_METJA | | Q60309 |

Description

HYPOTHETICAL PROTEIN MJECS10

| ORF Name | NTID | AAID | NT Length | AA Length | Score | Probability |
|---|---|---|---|---|---|---|
| 23439077_f1_5 | 1378 | 3298 | 177 | 534 | 103 | 0.0035 |

| Protein name | | | | Locus Name | | Acc# |
|---|---|---|---|---|---|---|
| ORF MSV035 hypothetical protein | | | | gp:AF063866 | | AF063866 |

Description

Melanoplus sanguinipes entomopoxvirus, complete genome.

| ORF Name | NTID | AAID | NT Length | AA Length | Score | Probability |
|---|---|---|---|---|---|---|
| 2347156_f1_8 | 1379 | 3299 | 1105 | 3318 | 1839 | 2.0e-286 |

| Protein name | | | | Locus Name | | Acc# |
|---|---|---|---|---|---|---|
| isoleucine--tRNA ligase,:isoleucyl-tRNA synthetase | | | | pir:SYECIT | | |

Description

| ORF Name | NTID | AAID | NT Length | AA Length | Score | Probability |
|---|---|---|---|---|---|---|
| 23652183_c1_56 | 1380 | 3300 | 777 | 2334 | 3955 | 0.0 |

| Protein name | | | | Locus Name | | Acc# |
|---|---|---|---|---|---|---|
| outer membrane protein CopB | | | | gp:U69981 | | U69981 |

Description

Moraxella catarrhalis strain O12E outer membrane protein CopB gene, complete cds.

| ORF Name | NTID | AAID | NT Length | AA Length | Score | Probability |
|---|---|---|---|---|---|---|
| 23865660_c2_77 | 1381 | 3301 | 87 | 264 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 25506316_f1_14 | 1382 | 3302 | 228 | 687 | 554 | 1.7e-53 |

| Protein name | Locus Name | Acc# |
|---|---|---|
| | sp:YIHA_ECOLI | |

Description

HYPOTHETICAL GTP-BINDING PROTEIN IN POLA-HEMN INTERGENIC REGION

| ORF Name | NTID | AAID | NT Length | AA Length | Score | Probability |
|---|---|---|---|---|---|---|
| 2584717_f3_43 | 1383 | 3303 | 87 | 264 | 127 | 3.1e-08 |

| Protein name | Locus Name | Acc# |
|---|---|---|
| gamma-carboxymuconolactone decarboxylase | pir:B69129 | B69129 |

Description

| ORF Name | NTID | AAID | NT Length | AA Length | Score | Probability |
|---|---|---|---|---|---|---|
| 25942137_f2_29 | 1384 | 3304 | 185 | 558 | 296 | 3.8e-26 |

| Protein name | Locus Name | Acc# |
|---|---|---|
| | sp:FKBX_PSEFL | P21863 |

Description (EC 5.2.1.8) (PPIASE) (ROTAMASE)

| ORF Name | NTID | AAID | NT Length | AA Length | Score | Probability |
|---|---|---|---|---|---|---|
| 26364431_c1_49 | 1385 | 3305 | 117 | 354 | 300 | 1.4e-26 |

| Protein name | Locus Name | Acc# |
|---|---|---|
| | pir:FEKRV | |

Description

| ORF Name | NTID | AAID | NT Length | AA Length | Score | Probability |
|---|---|---|---|---|---|---|
| 32056506_c3_81 | 1386 | 3306 | 401 | 1206 | 1486 | 3.0e-152 |

| Protein name | Locus Name | Acc# |
|---|---|---|
| | sp:IMDH_ACICA | P31002 |

Description

DEHYDROGENASE) (IMPDH) (IMPD)

| ORF Name | NTID | AAID | NT Length | AA Length | Score | Probability |
|---|---|---|---|---|---|---|
| 32477250_c1_65 | 1387 | 3307 | 443 | 1332 | 1422 | 1.8e-145 |

| Protein name | | | | Locus Name | | Acc# |
|---|---|---|---|---|---|---|
| | | | | sp:YCDG_ECOLI | | P75892 |

Description

HYPOTHETICAL 48.1 KD PROTEIN IN WRBA-PUTA INTERGENIC REGION

| ORF Name | NTID | AAID | NT Length | AA Length | Score | Probability |
|---|---|---|---|---|---|---|
| 34665952_f2_28 | 1388 | 3308 | 177 | 534 | 371 | 4.3e-34 |

| Protein name | | | | Locus Name | | Acc# |
|---|---|---|---|---|---|---|
| | | | | sp:LSPA_PSEFL | | P17942 |

Description

PEPTIDASE) (SIGNAL PEPTIDASE II) (SPASE II)

| ORF Name | NTID | AAID | NT Length | AA Length | Score | Probability |
|---|---|---|---|---|---|---|
| 4775762_f1_15 | 1389 | 3309 | 252 | 759 | 593 | 1.3e-57 |

| Protein name | | | | Locus Name | | Acc# |
|---|---|---|---|---|---|---|
| | | | | sp:YRAL_ECOLI | | P45528 |

Description

HYPOTHETICAL 31.3 KD PROTEIN IN AGAI-MTR INTERGENIC REGION (F286)

| ORF Name | NTID | AAID | NT Length | AA Length | Score | Probability |
|---|---|---|---|---|---|---|
| 5910313_f2_30 | 1390 | 3310 | 392 | 1179 | 895 | 1.3e-89 |

| Protein name | | | | Locus Name | | Acc# |
|---|---|---|---|---|---|---|
| homoserine O-acetyltransferase | | | | gp:LMMETYX | | Y10744 |

Description

L.meyeri metY and metX genes.

| ORF_Name | NTID | AAID | NT Length | AA Length | Score | Probability |
|---|---|---|---|---|---|---|
| 5976592_f2_41 | 1391 | 3311 | 152 | 459 | 276 | 5.0e-24 |

| Protein name | Locus Name | Acc# |
|---|---|---|
| LporfX | gp:LPU63641 | U63641 |

Description

Legionella pneumophila rpoD operon LporfX, LpdnaG, and LprpoDgenes, complete cds.

| ORF_Name | NTID | AAID | NT Length | AA Length | Score | Probability |
|---|---|---|---|---|---|---|
| 818765_f1_7 | 1392 | 3312 | 98 | 297 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 9765832_f2_38 | 1393 | 3313 | 458 | 1377 | 1102 | 1.5e-111 |

| Protein name | Locus Name | Acc# |
|---|---|---|
| homoserine dehydrogenase | gp:L78665 | L78665 |

Description

Methylobacillus flagellatum aspartate aminotransferase (aat),membrane protein (orf-1), homoserine dehydrogenase (hom), andthreonine synthase (thrC) thymidylate sythase (thyA) genes,complete cds.

| ORF_Name | NTID | AAID | NT Length | AA Length | Score | Probability |
|---|---|---|---|---|---|---|
| 9773436_f2_31 | 1394 | 3314 | 215 | 648 | 117 | 0.00011 |

| Protein name | Locus Name | Acc# |
|---|---|---|
| probable 24-sterol C-methyltransferase, | pir:T03845 | T03845 |

Description

| ORF_Name | NTID | AAID | NT Length | AA Length | Score | Probability |
|---|---|---|---|---|---|---|
| 10423125_c2_44 | 1395 | 3315 | 124 | 375 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1069202_f2_13 | 1396 | 3316 | 65 | 198 | | |

Protein name | Locus Name | Acc#

Description

NO-HIT

| ORF Name | NTID | AAID | NT Length | AA Length | Score | Probability |
|---|---|---|---|---|---|---|
| 12933427_f2_5 | 1397 | 3317 | 131 | 396 | 239 | 4.1e-20 |

Protein name | Locus Name | Acc#
 | sp:DHSC_ECOLI | P10446

Description

SUCCINATE DEHYDROGENASE CYTOCHROME B-556 SUBUNIT

| ORF Name | NTID | AAID | NT Length | AA Length | Score | Probability |
|---|---|---|---|---|---|---|
| 20330461_f3_19 | 1398 | 3318 | 229 | 690 | 714 | 1.9e-70 |

Protein name | Locus Name | Acc#
fumarate reductase flavoprotein subunit | gp:AB015757 | AB015757

Description

Rhodoferax fermentans genes for fumarate reductase subunits,complete cds.

| ORF Name | NTID | AAID | NT Length | AA Length | Score | Probability |
|---|---|---|---|---|---|---|
| 214128_f2_9 | 1399 | 3319 | 763 | 2292 | 2566 | 1.1e-266 |

Protein name | Locus Name | Acc#
 | sp:ODO1_AZOVI | P20707

Description (KETOGLUTARATE DEHYDROGENASE)

| ORF Name | NTID | AAID | NT Length | AA Length | Score | Probability |
|---|---|---|---|---|---|---|
| 21501557_f3_27 | 1400 | 3320 | 80 | 243 | | |

Protein name | Locus Name | Acc#

Description

NO-HIT

| ORF Name | NTID | AAID | NT Length | AA Length | Score | Probability |
|---|---|---|---|---|---|---|
| 21510931_f2_6 | 1401 | 3321 | 381 | 1146 | 1445 | 6.6e-148 |

Protein name: fumarate reductase flavoprotein subunit
Locus Name: gp:AB015757
Acc#: AB015757

Description: Rhodoferax fermentans genes for fumarate reductase subunits, complete cds.

| ORF Name | NTID | AAID | NT Length | AA Length | Score | Probability |
|---|---|---|---|---|---|---|
| 23469010_f3_25 | 1402 | 3322 | 62 | 189 | | |

Protein name:
Locus Name:
Acc#:

Description: NO-HIT

| ORF Name | NTID | AAID | NT Length | AA Length | Score | Probability |
|---|---|---|---|---|---|---|
| 23855067_c3_53 | 1403 | 3323 | 183 | 552 | 76 | 0.018 |

Protein name: putative adhesin MAA1
Locus Name: gp:AF154922
Acc#: AF154922

Description: Mycoplasma arthritidis strain 158 putative adhesin MAA1 (maa1) gene, complete cds.

| ORF Name | NTID | AAID | NT Length | AA Length | Score | Probability |
|---|---|---|---|---|---|---|
| 24241463_f2_10 | 1404 | 3324 | 68 | 207 | 131 | 2.6e-07 |

Protein name:
Locus Name: sp:ODO1_HAEIN
Acc#: P45303

Description: KETOGLUTARATE DEHYDROGENASE)

| ORF Name | NTID | AAID | NT Length | AA Length | Score | Probability |
|---|---|---|---|---|---|---|
| 24251441_f1_4 | 1405 | 3325 | 375 | 1128 | 129 | 5.8e-05 |

Protein name: heme receptor
Locus Name: gp:VIBHUTA
Acc#: L27149

Description: Vibrio cholerae heme receptor (hutA) gene, complete cds.

| ORF Name | NTID | AAID | NT Length | AA Length | Score | Probability |
|---|---|---|---|---|---|---|
| 24427262_f2_8 | 1406 | 3326 | 123 | 372 | 234 | 2.6e-18 |

| Protein name | Locus Name | Acc# |
|---|---|---|
| alpha-ketoglutarate dehydrogenase | gp:AF068740 | AF068740 |

Description

Pseudomonas putida dihydrolipoamide succinyltransferase (kgdB) andalpha-ketoglutarate dehydrogenase (kgdA) genes, complete cds.

| ORF Name | NTID | AAID | NT Length | AA Length | Score | Probability |
|---|---|---|---|---|---|---|
| 26367192_f1_2 | 1407 | 3327 | 488 | 1467 | 1401 | 3.0e-143 |

| Protein name | Locus Name | Acc# |
|---|---|---|
| dihydrolipoamide dehydrogenase | gp:PSELPDA | M28356 |

Description

P.fluorescens dihydrolipoamide dehydrogenase (lpd) gene, completecds.

| ORF Name | NTID | AAID | NT Length | AA Length | Score | Probability |
|---|---|---|---|---|---|---|
| 26377042_f2_7 | 1408 | 3328 | 192 | 579 | 790 | 1.7e-78 |

| Protein name | Locus Name | Acc# |
|---|---|---|
| succinate dehydrogenase putative iron sulphur | gp:SPSDH | Y13760 |

Description

Shewanella frigidimarina NCIMB400 sdhA, sdhB, sdhC, sdhD and sucAgenes.

| ORF Name | NTID | AAID | NT Length | AA Length | Score | Probability |
|---|---|---|---|---|---|---|
| 31439375_f1_1 | 1409 | 3329 | 135 | 408 | 275 | 6.3e-24 |

| Protein name | Locus Name | Acc# |
|---|---|---|
|  | sp:DHSD_ECOLI | P10445 |

Description

SUCCINATE DEHYDROGENASE HYDROPHOBIC MEMBRANE ANCHOR PROTEIN

| ORF Name | NTID | AAID | NT Length | AA Length | Score | Probability |
|---|---|---|---|---|---|---|
| 4064425_f3_26 | 1410 | 3330 | 599 | 1800 | 123 | 8.1e-05 |

| Protein name | Locus Name | Acc# |
|---|---|---|
|  | sp:FOXA_SALTY | Q56145 |

Description

FERRIOXAMINE B RECEPTOR PRECURSOR (FRAGMENT)

| ORF Name | NTID | AAID | NT Length | AA Length | Score | Probability |
|---|---|---|---|---|---|---|
| 584625_f2_11 | 1411 | 3331 | 420 | 1263 | 1194 | 2.6e-121 |

| Protein name | Locus Name | Acc# |
|---|---|---|
| dihydrolipoamide S-succinyltransferase,:2-oxogluturate dehydrogenase complex chain E2:succinyl | pir:S07779 |  |

Description

| ORF Name | NTID | AAID | NT Length | AA Length | Score | Probability |
|---|---|---|---|---|---|---|
| 9928130_c1_34 | 1412 | 3332 | 141 | 426 | 116 | 8.6e-07 |

| Protein name | Locus Name | Acc# |
|---|---|---|
| microfilarial sheath protein SHP3 precursor | gp:AF030944 |  |

Description

Brugia malayi microfilarial sheath protein SHP3a (Bmshp3a) andmicrofilarial sheath protein SHP3 precursor (Bmshp3) genes,complete cds.

| ORF Name | NTID | AAID | NT Length | AA Length | Score | Probability |
|---|---|---|---|---|---|---|
| 12619081_c3_114 | 1413 | 3333 | 147 | 444 | 205 | 1.7e-16 |

| Protein name | Locus Name | Acc# |
|---|---|---|
|  | sp:YBAN_ECOLI |  |

Description

HYPOTHETICAL 14.8 KD PROTEIN IN PRIC-APT INTERGENIC REGION

| ORF Name | NTID | AAID | NT Length | AA Length | Score | Probability |
|---|---|---|---|---|---|---|
| 12897562_c1_73 | 1414 | 3334 | 78 | 237 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1359776_c2_91 | 1415 | 3335 | 67 | 204 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14064028_c2_105 | 1416 | 3336 | 269 | 810 | 182 | 4.5e-14 |

| Protein name | | | | | Locus Name | Acc# |
|---|---|---|---|---|---|---|
| | | | | | sp:YEAB_ECOLI | P43337 |

Description

HYPOTHETICAL 21.4 KD PROTEIN IN PABB-SDAA INTERGENIC REGION

| ORF Name | NTID | AAID | NT Length | AA Length | Score | Probability |
|---|---|---|---|---|---|---|
| 14657782_c2_104 | 1417 | 3337 | 173 | 522 | 333 | 4.5e-30 |

| Protein name | | | | | Locus Name | Acc# |
|---|---|---|---|---|---|---|
| | | | | | sp:BID2_HAEIN | P45248 |

Description 2) (DTB SYNTHETASE 2) (DTBS 2)

| ORF Name | NTID | AAID | NT Length | AA Length | Score | Probability |
|---|---|---|---|---|---|---|
| 14719437_f1_22 | 1418 | 3338 | 63 | 192 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14882713_c3_116 | 1419 | 3339 | 287 | 864 | 289 | 8.1e-30 |

| Protein name | | | | | Locus Name | Acc# |
|---|---|---|---|---|---|---|
| | | | | | sp:BIOC_HAEIN | P45249 |

Description

PUTATIVE BIOTIN SYNTHESIS PROTEIN BIOC

| ORF Name | NTID | AAID | NT Length | AA Length | Score | Probability |
|---|---|---|---|---|---|---|
| 16464750_c2_86 | 1420 | 3340 | 326 | 981 | 123 | 6.0e-05 |

| Protein name | | | | Locus Name | | Acc# |
|---|---|---|---|---|---|---|
| | | | | sp:ZIPA_ECOLI | | P77173 |

Description

CELL DIVISION PROTEIN ZIPA

| ORF Name | NTID | AAID | NT Length | AA Length | Score | Probability |
|---|---|---|---|---|---|---|
| 16532256_f1_1 | 1421 | 3341 | 80 | 243 | 95 | 0.0015 |

| Protein name | | | | Locus Name | | Acc# |
|---|---|---|---|---|---|---|
| ubiquitin protein ligase | | | | pir:T39585 | | T39585 |

Description

| ORF Name | NTID | AAID | NT Length | AA Length | Score | Probability |
|---|---|---|---|---|---|---|
| 19572130_f3_58 | 1422 | 3342 | 310 | 933 | 1010 | 8.2e-102 |

| Protein name | | | | Locus Name | | Acc# |
|---|---|---|---|---|---|---|
| | | | | sp:CYSM_ECOLI | | P16703 |

Description (O-ACETYLSERINE (THIOL)-LYASE B) (CSASE B)

| ORF Name | NTID | AAID | NT Length | AA Length | Score | Probability |
|---|---|---|---|---|---|---|
| 19734630_f2_40 | 1423 | 3343 | 533 | 1602 | 400 | 3.1e-57 |

| Protein name | | | | Locus Name | | Acc# |
|---|---|---|---|---|---|---|
| | | | | sp:YGCA_HAEIN | | P44643 |

Description

HYPOTHETICAL RNA METHYLTRANSFERASE HI0333,

| ORF Name | NTID | AAID | NT Length | AA Length | Score | Probability |
|---|---|---|---|---|---|---|
| 20507762_f1_13 | 1424 | 3344 | 290 | 873 | 548 | 7.5e-53 |

| Protein name | | | | Locus Name | | Acc# |
|---|---|---|---|---|---|---|
| | | | | sp:DPSD_ECOLI | | P10740 |

Description

PHOSPHATIDYLSERINE DECARBOXYLASE PROENZYME,

| ORF Name | NTID | AAID | NT Length | AA Length | Score | Probability |
|---|---|---|---|---|---|---|
| 20839062_c2_92 | 1425 | 3345 | 444 | 1335 | 482 | 1.3e-48 |

| Protein name | | | | Locus Name | | Acc# |
|---|---|---|---|---|---|---|
| | | | | sp:DEAD_HAEIN | | P44586 |

Description

ATP-DEPENDENT RNA HELICASE DEAD HOMOLOG

| ORF Name | NTID | AAID | NT Length | AA Length | Score | Probability |
|---|---|---|---|---|---|---|
| 22144026_f1_26 | 1426 | 3346 | 284 | 855 | 443 | 4.3e-41 |

| Protein name | | | | Locus Name | | Acc# |
|---|---|---|---|---|---|---|
| | | | | sp:RELA_HAEIN | | P44644 |

Description (PPGPP SYNTHETASE I)

| ORF Name | NTID | AAID | NT Length | AA Length | Score | Probability |
|---|---|---|---|---|---|---|
| 22147806_f3_47 | 1427 | 3347 | 421 | 1266 | 866 | 1.5e-86 |

| Protein name | | | | Locus Name | | Acc# |
|---|---|---|---|---|---|---|
| | | | | sp:YGIC_ECOLI | | P24196 |

Description (O386)

| ORF Name | NTID | AAID | NT Length | AA Length | Score | Probability |
|---|---|---|---|---|---|---|
| 22691300_c2_99 | 1428 | 3348 | 612 | 1839 | 688 | 7.1e-72 |

| Protein name | | | | Locus Name | | Acc# |
|---|---|---|---|---|---|---|
| sensor kinase rtpA | | | | gp:AB002529 | | AB002529 |

Description

Pseudomonas tolaasii gene for sensor kinase rtpA, complete cds.

| ORF Name | NTID | AAID | NT Length | AA Length | Score | Probability |
|---|---|---|---|---|---|---|
| 22890917_f2_33 | 1429 | 3349 | 258 | 777 | 196 | 1.5e-15 |

Protein name | Locus Name | Acc#
| | sp:YBEN_ECOLI | P52085 |

Description

HYPOTHETICAL 24.5 KD PROTEIN IN PHPB-HOLA INTERGENIC REGION (ORFUU)

| ORF Name | NTID | AAID | NT Length | AA Length | Score | Probability |
|---|---|---|---|---|---|---|
| 23478458_c2_103 | 1430 | 3350 | 441 | 1326 | 1328 | 1.7e-135 |

Protein name | Locus Name | Acc#
BioA | gp:AF191556 | AF191556

Description

Xenorhabdus nematophilus YbhE (ybhE) gene, partial cds; Var1 (var1)and BioA (bioA) genes, complete cds; and unknown gene.

| ORF Name | NTID | AAID | NT Length | AA Length | Score | Probability |
|---|---|---|---|---|---|---|
| 24097812_c1_83 | 1431 | 3351 | 208 | 627 | 462 | 9.7e-44 |

Protein name | Locus Name | Acc#
| | sp:SSB_HAEIN | P44409 |

Description

SINGLE-STRAND BINDING PROTEIN (SSB) (HELIX-DESTABILIZING PROTEIN)

| ORF Name | NTID | AAID | NT Length | AA Length | Score | Probability |
|---|---|---|---|---|---|---|
| 24225088_f2_39 | 1432 | 3352 | 61 | 186 | | |

Protein name | Locus Name | Acc#

Description

NO-HIT

| ORF Name | NTID | AAID | NT Length | AA Length | Score | Probability |
|---|---|---|---|---|---|---|
| 25587827_c1_79 | 1433 | 3353 | 400 | 1203 | 888 | 7.0e-89 |

Protein name | Locus Name | Acc#
| | sp:BIOF_HAEIN | P44422 |

Description (LIGASE)

| ORF Name | NTID | AAID | NT Length | AA Length | Score | Probability |
|---|---|---|---|---|---|---|
| 26192160_f3_64 | 1434 | 3354 | 532 | 1599 | 894 | 1.6e-89 |

| Protein name | Locus Name | Acc# |
|---|---|---|
| | sp:RELA_ECOLI | P11585 |

Description (PPGPP SYNTHETASE I)

| ORF Name | NTID | AAID | NT Length | AA Length | Score | Probability |
|---|---|---|---|---|---|---|
| 29298385_f1_8 | 1435 | 3355 | 211 | 636 | 380 | 4.7e-35 |

| Protein name | Locus Name | Acc# |
|---|---|---|
| | gp:U90439 | |

Description

Arabidopsis thaliana chromosome II section 227 of 255 of thecomplete sequence.

| ORF Name | NTID | AAID | NT Length | AA Length | Score | Probability |
|---|---|---|---|---|---|---|
| 33708181_c1_75 | 1436 | 3356 | 411 | 1236 | 391 | 3.2e-36 |

| Protein name | Locus Name | Acc# |
|---|---|---|
| putative histidine kinase | gp:PST249741 | AJ249741 |

Description

Pseudomonas stutzeri JM300 gacS (partial) and ggtB (partial) genes.

| ORF Name | NTID | AAID | NT Length | AA Length | Score | Probability |
|---|---|---|---|---|---|---|
| 33728258_c3_117 | 1437 | 3357 | 78 | 237 | 85 | 0.0019 |

| Protein name | Locus Name | Acc# |
|---|---|---|
| | sp:BID2_HAEIN | P45248 |

Description 2) (DTB SYNTHETASE 2) (DTBS 2)

| ORF Name | NTID | AAID | NT Length | AA Length | Score | Probability |
|---|---|---|---|---|---|---|
| 35173953_f1_7 | 1438 | 3358 | 152 | 459 | 237 | 6.8e-20 |

| Protein name | Locus Name | Acc# |
|---|---|---|
|  | sp:YBEB_ECOLI |  |

Description

HYPOTHETICAL 11.6 KD PROTEIN IN MRDA-PHPB INTERGENIC REGION

| ORF Name | NTID | AAID | NT Length | AA Length | Score | Probability |
|---|---|---|---|---|---|---|
| 35183451_f2_38 | 1439 | 3359 | 261 | 786 | 259 | 3.1e-22 |

| Protein name | Locus Name | Acc# |
|---|---|---|
| hypothetical protein jhp0628 | pir:B71907 | B71907 |

Description

| ORF Name | NTID | AAID | NT Length | AA Length | Score | Probability |
|---|---|---|---|---|---|---|
| 4147637_c3_120 | 1440 | 3360 | 990 | 2973 | 3281 | 0.0 |

| Protein name | Locus Name | Acc# |
|---|---|---|
|  | sp:UVRA_ECOLI |  |

Description

EXCINUCLEASE ABC SUBUNIT A

| ORF Name | NTID | AAID | NT Length | AA Length | Score | Probability |
|---|---|---|---|---|---|---|
| 4199006_f3_56 | 1441 | 3361 | 69 | 210 | 52 | 0.022 |

| Protein name | Locus Name | Acc# |
|---|---|---|
| NADH dehydrogenase subunit 4 | gp:AF026170 | AF026170 |

Description

Teius teyou NADH dehydrogenase subunit 4 (ND4) gene, partial cds;and tRNA-His, tRNA-Ser, and tRNA-Leu genes, complete sequence,mitochondrial genes for mitochondrial products.

| ORF Name | NTID | AAID | NT Length | AA Length | Score | Probability |
|---|---|---|---|---|---|---|
| 4328431_f3_65 | 1442 | 3362 | 305 | 918 | 542 | 3.2e-52 |

| Protein name | Locus Name | Acc# |
|---|---|---|
| | sp:FPG_NEIME | P55044 |

Description

GLYCOSYLASE)

| ORF Name | NTID | AAID | NT Length | AA Length | Score | Probability |
|---|---|---|---|---|---|---|
| 4867812_c3_118 | 1443 | 3363 | 154 | 465 | 318 | 1.8e-28 |

| Protein name | Locus Name | Acc# |
|---|---|---|
| | sp:YIHZ_ECOLI | P32147 |

Description

HYPOTHETICAL 15.9 KD PROTEIN IN RBN-FDHE INTERGENIC REGION (O145)

| ORF Name | NTID | AAID | NT Length | AA Length | Score | Probability |
|---|---|---|---|---|---|---|
| 892177_c1_70 | 1444 | 3364 | 169 | 510 | 331 | 7.4e-30 |

| Protein name | Locus Name | Acc# |
|---|---|---|
| | gp:D83386 | D83386 |

Description

Shewanella violacea rhlE, cydD, cydC and putA genes, partial and complete cds.

| ORF Name | NTID | AAID | NT Length | AA Length | Score | Probability |
|---|---|---|---|---|---|---|
| 16847336_f3_5 | 1445 | 3365 | 177 | 534 | 633 | 7.3e-62 |

| Protein name | Locus Name | Acc# |
|---|---|---|
| DNA-directed RNA polymerase alpha chain | gp:AF047025 | AF047025 |

Description

Pseudomonas aeruginosa ribosomal protein S4 (rpsD) gene, partial cds; DNA-directed RNA polymerase alpha chain (rpoA), ribosomal large subunit protein L17 (rplQ), and catalase isozyme A (katA) genes, complete cds; and bacterioferritin (bfr) gene, partial cds.

| ORF_Name | NTID | AAID | NT Length | AA Length | Score | Probability |
|---|---|---|---|---|---|---|
| 16976442_c3_13 | 1446 | 3366 | 239 | 720 | 359 | 8.0e-33 |

Protein name | Locus Name | Acc#
--- | --- | ---
 | sp:YFCM_ECOLI |

Description

HYPOTHETICAL 21.1 KD PROTEIN IN FABB-MEPA INTERGENIC REGION

| ORF_Name | NTID | AAID | NT Length | AA Length | Score | Probability |
|---|---|---|---|---|---|---|
| 24226655_f2_3 | 1447 | 3367 | 165 | 498 | 499 | 1.2e-47 |

Protein name | Locus Name | Acc#
--- | --- | ---
DNA-directed RNA polymerase alpha chain | gp:AF047025 | AF047025

Description

Pseudomonas aeruginosa ribosomal protein S4 (rpsD) gene, partial cds; DNA-directed RNA polymerase alpha chain (rpoA), ribosomal large subunit protein L17 (rplQ), and catalase isozyme A (katA) genes, complete cds; and bacterioferritin (bfr) gene, partial cds.

| ORF_Name | NTID | AAID | NT Length | AA Length | Score | Probability |
|---|---|---|---|---|---|---|
| 24317501_f2_4 | 1448 | 3368 | 83 | 252 | 354 | 2.7e-32 |

Protein name | Locus Name | Acc#
--- | --- | ---
 | sp:RL17_PSEAE | O52761

Description

50S RIBOSOMAL PROTEIN L17

| ORF_Name | NTID | AAID | NT Length | AA Length | Score | Probability |
|---|---|---|---|---|---|---|
| 3001693_f2_2 | 1449 | 3369 | 217 | 654 | 683 | 3.7e-67 |

Protein name | Locus Name | Acc#
--- | --- | ---
ribosomal protein S4 | pir:A64095 | A64095

Description

| ORF Name | NTID | AAID | NT Length | AA Length | Score | Probability |
|---|---|---|---|---|---|---|
| 4867143_c1_9 | 1450 | 3370 | 191 | 576 | 314 | 4.7e-28 |

| Protein name | Locus Name | Acc# |
|---|---|---|
| probable translation factor yciO | pir:F64874 | F64874 |

Description

---

| ORF Name | NTID | AAID | NT Length | AA Length | Score | Probability |
|---|---|---|---|---|---|---|
| 6033377_c3_14 | 1451 | 3371 | 94 | 285 | 84 | 0.035 |

| Protein name | Locus Name | Acc# |
|---|---|---|
| hypothetical protein C34F6.9 | pir:T19736 | T19736 |

Description

---

| ORF Name | NTID | AAID | NT Length | AA Length | Score | Probability |
|---|---|---|---|---|---|---|
| 10437517_c1_70 | 1452 | 3372 | 62 | 189 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 11808576_c2_83 | 1453 | 3373 | 72 | 219 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1359677_f2_17 | 1454 | 3374 | 373 | 1122 | 969 | 1.8e-97 |

| Protein name | Locus Name | Acc# |
|---|---|---|
| uroporphyrinogen decarboxylase | gp:ECOUW89 | U00006 |

Description

E. coli chromosomal region from 89.2 to 92.8 minutes.

| ORF Name | NTID | AAID | NT Length | AA Length | Score | Probability |
|---|---|---|---|---|---|---|
| 14898317_c3_94 | 1455 | 3375 | 591 | 1776 | 1769 | 3.1e-182 |

| Protein name | Locus Name | Acc# |
|---|---|---|
| | sp:SYD_ECOLI | P21889 |

Description (ASPRS)

| ORF Name | NTID | AAID | NT Length | AA Length | Score | Probability |
|---|---|---|---|---|---|---|
| 16522206_c1_56 | 1456 | 3376 | 207 | 624 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16614042_c3_107 | 1457 | 3377 | 125 | 378 | 142 | 7.9e-10 |

| Protein name | Locus Name | Acc# |
|---|---|---|
| hypothetical protein slr1903 | pir:S77514 | S77514 |

Description

| ORF Name | NTID | AAID | NT Length | AA Length | Score | Probability |
|---|---|---|---|---|---|---|
| 175817_f3_32 | 1458 | 3378 | 442 | 1329 | 1020 | 7.2e-103 |

| Protein name | Locus Name | Acc# |
|---|---|---|
| glyceraldehyde-3-phosphate dehydrogenase | gp:AF058302 | AF058302 |

Description

Streptomyces roseofulvus frenolicin biosynthetic gene cluster, complete sequence.

| ORF Name | NTID | AAID | NT Length | AA Length | Score | Probability |
|---|---|---|---|---|---|---|
| 20984532_c1_68 | 1459 | 3379 | 60 | 183 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 2142151_f3_38 | 1460 | 3380 | 252 | 759 | 421 | 2.1e-39 |

| Protein name | Locus Name | Acc# |
|---|---|---|
| anion transport ABC transporter (ATP-bindi) homolog ytlC | pir:C69995 | C69995 |

Description

| ORF Name | NTID | AAID | NT Length | AA Length | Score | Probability |
|---|---|---|---|---|---|---|
| 23437558_f2_24 | 1461 | 3381 | 348 | 1047 | 946 | 5.0e-95 |

| Protein name | Locus Name | Acc# |
|---|---|---|
| 3-phosphoserine aminotransferase | gp:AF038578 | |

Description

Pseudomonas stutzeri gyrase A subunit (gyrA) gene, partial cds;3-phosphoserine aminotransferase (serC), chorismatemutase/prephenate dehydratase (aroQp/pheA), imidazole acetolphosphate aminotransferase (hisHb), and cyclohexadienyldehydrogenase (tyrAc) genes, complete cds; and5-enolpyruvylshikmate 3-P synthase (aroF) gene, partial cds.

| ORF Name | NTID | AAID | NT Length | AA Length | Score | Probability |
|---|---|---|---|---|---|---|
| 23526888_f1_7 | 1462 | 3382 | 65 | 198 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23642875_f3_39 | 1463 | 3383 | 255 | 768 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24103137_f2_16 | 1464 | 3384 | 409 | 1230 | 1079 | 4.0e-109 |

| Protein name | | | | Locus Name | | Acc# |
|---|---|---|---|---|---|---|
| | | | | sp:YHBZ_HAEIN | | P44915 |

Description

HYPOTHETICAL 43.4 KD GTP-BINDING PROTEIN HI0877

| ORF Name | NTID | AAID | NT Length | AA Length | Score | Probability |
|---|---|---|---|---|---|---|
| 24272135_c3_103 | 1465 | 3385 | 174 | 525 | 295 | 4.8e-26 |

| Protein name | | | | Locus Name | | Acc# |
|---|---|---|---|---|---|---|
| Lrp-family transcriptional regulators | | | | gp:D89015 | | D89015 |

Description

Pseudomonas putida genes for MdeR,MdeA and MdeB,complete cds.

| ORF Name | NTID | AAID | NT Length | AA Length | Score | Probability |
|---|---|---|---|---|---|---|
| 24410038_f2_19 | 1466 | 3386 | 443 | 1332 | 743 | 1.6e-73 |

| Protein name | | | | Locus Name | | Acc# |
|---|---|---|---|---|---|---|
| proteinase DO | | | | pir:H71936 | | H71936 |

Description

| ORF Name | NTID | AAID | NT Length | AA Length | Score | Probability |
|---|---|---|---|---|---|---|
| 25662512_c3_98 | 1467 | 3387 | 304 | 915 | 532 | 3.7e-51 |

| Protein name | | | | Locus Name | | Acc# |
|---|---|---|---|---|---|---|
| | | | | sp:YJJP_ECOLI | | P39402 |

Description

HYPOTHETICAL 30.5 KD PROTEIN IN DNAT-BGLJ INTERGENIC REGION (F277)

| ORF Name | NTID | AAID | NT Length | AA Length | Score | Probability |
|---|---|---|---|---|---|---|
| 25665963_f1_5 | 1468 | 3388 | 264 | 795 | 444 | 7.8e-42 |

| Protein name | | | | Locus Name | | Acc# |
|---|---|---|---|---|---|---|
| | | | | sp:GLO2_ECOLI | | Q47677 |

Description

II) (GLX II)

| ORF Name | NTID | AAID | NT Length | AA Length | Score | Probability |
|---|---|---|---|---|---|---|
| 2757750_f3_47 | 1469 | 3389 | 72 | 219 | 73 | 0.016 |

| Protein name | | | | Locus Name | | Acc# |
|---|---|---|---|---|---|---|
| | | | | gp:AB021078 | | AB021078 |

Description plasmid ColIb-P9 DNA, complete sequence.

| ORF Name | NTID | AAID | NT Length | AA Length | Score | Probability |
|---|---|---|---|---|---|---|
| 31412958_f2_23 | 1470 | 3390 | 250 | 753 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 33394002_f2_30 | 1471 | 3391 | 507 | 1524 | 79 | 0.036 |

| Protein name | | | | Locus Name | | Acc# |
|---|---|---|---|---|---|---|
| cytochrome-c oxidase, chain I RP405 | | | | pir:D71698 | | D71698 |

Description

| ORF Name | NTID | AAID | NT Length | AA Length | Score | Probability |
|---|---|---|---|---|---|---|
| 35181680_c3_95 | 1472 | 3392 | 356 | 1071 | 267 | 4.5e-23 |

| Protein name | | | | Locus Name | | Acc# |
|---|---|---|---|---|---|---|
| | | | | gp:PFY14568 | | Y14568 |

Description

Pseudomonas fluorescens tag gene and partial glyQ, htrB genes.

| ORF Name | NTID | AAID | NT Length | AA Length | Score | Probability |
|---|---|---|---|---|---|---|
| 4009750_c1_69 | 1473 | 3393 | 221 | 666 | 279 | 2.4e-24 |

| Protein name | | | | Locus Name | | Acc# |
|---|---|---|---|---|---|---|
| hypothetical protein | | | | pir:S76551 | | S76551 |

Description

| ORF Name | NTID | AAID | NT Length | AA Length | Score | Probability |
|---|---|---|---|---|---|---|
| 4165952_f3_34 | 1474 | 3394 | 82 | 249 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4328443_c1_74 | 1475 | 3395 | 176 | 531 | 193 | 3.1e-15 |

| Protein name | Locus Name | Acc# |
|---|---|---|
| hypothetical protein | pir:G75479 | G75479 |

Description

| ORF Name | NTID | AAID | NT Length | AA Length | Score | Probability |
|---|---|---|---|---|---|---|
| 4423193_c2_79 | 1476 | 3396 | 85 | 258 | 87 | 4.6e-07 |

| Protein name | Locus Name | Acc# |
|---|---|---|
| | sp:ARGD_ARCFU | O30156 |

Description

ACETYLORNITHINE AMINOTRANSFERASE, (ACOAT)

| ORF Name | NTID | AAID | NT Length | AA Length | Score | Probability |
|---|---|---|---|---|---|---|
| 4864077_c2_78 | 1477 | 3397 | 63 | 192 | 149 | 1.4e-10 |

| Protein name | Locus Name | Acc# |
|---|---|---|
| unknown | gp:AF062531 | AF062531 |

Description

Pseudomonas putida GB-1 signal peptidase (pilD) gene, partial cds;and unknown genes.

| ORF Name | NTID | AAID | NT Length | AA Length | Score | Probability |
|---|---|---|---|---|---|---|
| 4878407_f1_6 | 1478 | 3398 | 589 | 1770 | 1355 | 2.3e-138 |

| Protein name | Locus Name | Acc# |
|---|---|---|
| | sp:LEU1_YEAST | P06208 |

Description

SYNTHASE) (ALPHA-IPM SYNTHETASE)

| ORF_Name | NTID | AAID | NT Length | AA Length | Score | Probability |
|---|---|---|---|---|---|---|
| 5085963_f1_11 | 1479 | 3399 | 243 | 732 | 124 | 3.2e-13 |

Protein name: (blank) — Locus Name: sp:YDFN_BACSU — Acc#: P96692

Description: PUTATIVE NAD(P)H NITROREDUCTASE YDFN,

| ORF_Name | NTID | AAID | NT Length | AA Length | Score | Probability |
|---|---|---|---|---|---|---|
| 5115943_f2_21 | 1480 | 3400 | 330 | 993 | 585 | 9.0e-57 |

Protein name: hypothetical protein TM0484 — Locus Name: pir:C72369 — Acc#: C72369

Description:

| ORF_Name | NTID | AAID | NT Length | AA Length | Score | Probability |
|---|---|---|---|---|---|---|
| 5266588_f2_29 | 1481 | 3401 | 878 | 2637 | 2754 | 1.3e-286 |

Protein name: UspA1 — Locus Name: gp:AF113606 — Acc#: AF113606

Description: Moraxella catarrhalis strain ATCC25238 UspA1 (uspA1) gene, completecds.

| ORF_Name | NTID | AAID | NT Length | AA Length | Score | Probability |
|---|---|---|---|---|---|---|
| 802137_f3_37 | 1482 | 3402 | 261 | 786 | 459 | 2.0e-43 |

Protein name: ABC transporter, permease protein, cysTW family — Locus Name: pir:D72369 — Acc#: D72369

Description:

| ORF_Name | NTID | AAID | NT Length | AA Length | Score | Probability |
|---|---|---|---|---|---|---|
| 894387_c2_80 | 1483 | 3403 | 160 | 483 | 313 | 6.0e-28 |

Protein name: (blank) — Locus Name: sp:YJJP_HAEIN — Acc#: P44520

Description: HYPOTHETICAL PROTEIN HI0108

| ORF Name | NTID | AAID | NT Length | AA Length | Score | Probability |
|---|---|---|---|---|---|---|
| 976558_f2_18 | 1484 | 3404 | 61 | 186 | | |

Protein name | Locus Name | Acc#

Description

NO-HIT

| ORF Name | NTID | AAID | NT Length | AA Length | Score | Probability |
|---|---|---|---|---|---|---|
| 10740682_c2_12 | 1485 | 3405 | 297 | 894 | 678 | 1.3e-66 |

Protein name: probable acyl-CoA dehydrogenase | Locus Name: pir:B75282 | Acc#: B75282

Description

| ORF Name | NTID | AAID | NT Length | AA Length | Score | Probability |
|---|---|---|---|---|---|---|
| 16829202_f3_8 | 1486 | 3406 | 251 | 753 | 185 | 2.2e-14 |

Protein name | Locus Name: sp:PABC_ECOLI | Acc#: P28305

Description

4-AMINO-4-DEOXYCHORISMATE LYASE, (ADC LYASE)

| ORF Name | NTID | AAID | NT Length | AA Length | Score | Probability |
|---|---|---|---|---|---|---|
| 25421887_f1_2 | 1487 | 3407 | 188 | 567 | | |

Protein name | Locus Name | Acc#

Description

NO-HIT

| ORF Name | NTID | AAID | NT Length | AA Length | Score | Probability |
|---|---|---|---|---|---|---|
| 34160918_f3_7 | 1488 | 3408 | 64 | 195 | | |

Protein name | Locus Name | Acc#

Description

NO-HIT

| ORF Name | NTID | AAID | NT Length | AA Length | Score | Probability |
|---|---|---|---|---|---|---|
| 6365631_c3_13 | 1489 | 3409 | 275 | 828 | 475 | 4.1e-45 |

Protein name: shikimate dehydrogenase
Locus Name: gp:NPU82846
Acc#: U82846

Description: Neisseria pharyngis var. flava shikimate dehydrogenase (aroE) gene, complete cds.

| ORF Name | NTID | AAID | NT Length | AA Length | Score | Probability |
|---|---|---|---|---|---|---|
| 12156514_c1_16 | 1490 | 3410 | 162 | 489 | 336 | 2.2e-30 |

Protein name
Locus Name: sp:RSTA_ECOLI
Acc#: P52108

Description: TRANSCRIPTIONAL REGULATORY PROTEIN RSTA

| ORF Name | NTID | AAID | NT Length | AA Length | Score | Probability |
|---|---|---|---|---|---|---|
| 15625078_c1_19 | 1491 | 3411 | 179 | 537 | 444 | 7.8e-42 |

Protein name
Locus Name: sp:TRMD_SERMA
Acc#: P36244

Description: METHYLTRANSFERASE)

| ORF Name | NTID | AAID | NT Length | AA Length | Score | Probability |
|---|---|---|---|---|---|---|
| 23468928_c1_18 | 1492 | 3412 | 191 | 576 | 295 | 4.8e-26 |

Protein name
Locus Name: sp:RIMM_HAEIN
Acc#: P44568

Description: 16S RRNA PROCESSING PROTEIN RIMM

| ORF Name | NTID | AAID | NT Length | AA Length | Score | Probability |
|---|---|---|---|---|---|---|
| 23859377_f1_4 | 1493 | 3413 | 502 | 1509 | 525 | 2.0e-50 |

| Protein name | Locus Name | Acc# |
|---|---|---|
| EnvZ protein | gp:YEOMPR | Y08950 |

Description

Y.enterocolitica ompR and envZ genes.

| ORF Name | NTID | AAID | NT Length | AA Length | Score | Probability |
|---|---|---|---|---|---|---|
| 3961587_c2_21 | 1494 | 3414 | 86 | 261 | 279 | 2.4e-24 |

| Protein name | Locus Name | Acc# |
|---|---|---|
|  | sp:RS16_HAEIN | P44382 |

Description

30S RIBOSOMAL PROTEIN S16

| ORF Name | NTID | AAID | NT Length | AA Length | Score | Probability |
|---|---|---|---|---|---|---|
| 964692_c3_22 | 1495 | 3415 | 598 | 1797 | 442 | 1.3e-41 |

| Protein name | Locus Name | Acc# |
|---|---|---|
|  | sp:RSTB_ECOLI | P18392 |

Description

SENSOR PROTEIN RSTB,

| ORF Name | NTID | AAID | NT Length | AA Length | Score | Probability |
|---|---|---|---|---|---|---|
| 10676257_f2_68 | 1496 | 3416 | 393 | 1182 | 1212 | 3.2e-123 |

| Protein name | Locus Name | Acc# |
|---|---|---|
|  | sp:PUR9_HAEIN | P43852 |

Description

| ORF Name | NTID | AAID | NT Length | AA Length | Score | Probability |
|---|---|---|---|---|---|---|
| 10736257_f3_80 | 1497 | 3417 | 65 | 198 |  |  |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 12556337_f1_31 | 1498 | 3418 | 128 | 387 | 477 | 2.5e-45 |

| Protein name | Locus Name | Acc# |
|---|---|---|
| | sp:PUR9_ECOLI | P15639 |

Description

| ORF_Name | NTID | AAID | NT Length | AA Length | Score | Probability |
|---|---|---|---|---|---|---|
| 1272283_f2_60 | 1499 | 3419 | 183 | 552 | 244 | 7.9e-20 |

| Protein name | Locus Name | Acc# |
|---|---|---|
| | sp:AARF_ECOLI | |

Description

UBIQUINONE BIOSYNTHESIS PROTEIN AARF

| ORF_Name | NTID | AAID | NT Length | AA Length | Score | Probability |
|---|---|---|---|---|---|---|
| 131700_c1_108 | 1500 | 3420 | 255 | 768 | 215 | 1.4e-16 |

| Protein name | Locus Name | Acc# |
|---|---|---|
| putative peptidyl-prolyl cis-trans isomerase | gp:ASAJ2316 | AJ002316 |

Description

Acinetobacter sp. ADP1 alkR & alkM genes, ORF1 & ORF4.

| ORF_Name | NTID | AAID | NT Length | AA Length | Score | Probability |
|---|---|---|---|---|---|---|
| 13876562_c1_128 | 1501 | 3421 | 75 | 228 | 73 | 0.016 |

| Protein name | Locus Name | Acc# |
|---|---|---|
| immunoglobulin kappa light chain variable | gp:AF131156 | AF131156 |

Description

Mus musculus immunoglobulin kappa light chain variable region gene, partial cds.

| ORF_Name | NTID | AAID | NT Length | AA Length | Score | Probability |
|---|---|---|---|---|---|---|
| 13947127_c3_217 | 1502 | 3422 | 584 | 1755 | 1216 | 1.6e-163 |

| Protein name | Locus Name | Acc# |
|---|---|---|
| | sp:SYQ_HAEIN | P43831 |

Description (GLNRS)

| ORF Name | NTID | AAID | NT Length | AA Length | Score | Probability |
|---|---|---|---|---|---|---|
| 14852035_c1_129 | 1503 | 3423 | 85 | 258 | 70 | 0.033 |

| Protein name | Locus Name | Acc# |
|---|---|---|
| tat protein | gp:HIVU86775 | U86775 |

Description

HIV-1 clone ZAM184-5.2 from Zambia, tat protein (tat) gene, partialcds, rev protein (rev), vpu protein (vpu), and envelopeglycoprotein (env) genes, complete cds and nef protein (nef)pseudogene.

| ORF Name | NTID | AAID | NT Length | AA Length | Score | Probability |
|---|---|---|---|---|---|---|
| 15663417_f2_42 | 1504 | 3424 | 79 | 240 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16583425_c1_131 | 1505 | 3425 | 326 | 981 | 535 | 1.8e-51 |

| Protein name | Locus Name | Acc# |
|---|---|---|
| yfjB protein | pir:B65040 | B65040 |

Description

| ORF Name | NTID | AAID | NT Length | AA Length | Score | Probability |
|---|---|---|---|---|---|---|
| 19632665_c2_160 | 1506 | 3426 | 696 | 2091 | 633 | 2.3e-79 |

| Protein name | Locus Name | Acc# |
|---|---|---|
| | sp:COPA_ENTHR | |

Description

COPPER/POTASSIUM-TRANSPORTING ATPASE A,

| ORF Name | NTID | AAID | NT Length | AA Length | Score | Probability |
|---|---|---|---|---|---|---|
| 19706557_c3_193 | 1507 | 3427 | 216 | 651 | 148 | 4.8e-08 |

| Protein name | Locus Name | Acc# |
|---|---|---|
| probable component of cation transport for cbb3-type oxidase | pir:E71813 | E71813 |

Description

| ORF_Name | NTID | AAID | NT Length | AA Length | Score | Probability |
|---|---|---|---|---|---|---|
| 21753552_c3_220 | 1508 | 3428 | 168 | 507 | | |

| Protein name | | Locus Name | Acc# |
|---|---|---|---|
| | | | |

Description

NO-HIT

| ORF_Name | NTID | AAID | NT Length | AA Length | Score | Probability |
|---|---|---|---|---|---|---|
| 2197962_f1_11 | 1509 | 3429 | 122 | 369 | | |

| Protein name | | Locus Name | Acc# |
|---|---|---|---|
| | | | |

Description

NO-HIT

| ORF_Name | NTID | AAID | NT Length | AA Length | Score | Probability |
|---|---|---|---|---|---|---|
| 22145253_c2_177 | 1510 | 3430 | 210 | 633 | 592 | 1.6e-57 |

| Protein name | | Locus Name | Acc# |
|---|---|---|---|
| | | sp:ORN_HAEIN | P45340 |

Description

OLIGORIBONUCLEASE,

| ORF_Name | NTID | AAID | NT Length | AA Length | Score | Probability |
|---|---|---|---|---|---|---|
| 22272900_f1_5 | 1511 | 3431 | 227 | 684 | 263 | 1.2e-22 |

| Protein name | | Locus Name | Acc# |
|---|---|---|---|
| hypothetical protein | | gp:PST243354 | AJ243354 |

Description

Pseudomonas stutzeri hyp1 and comA genes and putative tolQ, exbB, tolR and exbD genes.

| ORF_Name | NTID | AAID | NT Length | AA Length | Score | Probability |
|---|---|---|---|---|---|---|
| 22285902_c3_212 | 1512 | 3432 | 229 | 690 | 299 | 1.8e-26 |

| Protein name | | Locus Name | Acc# |
|---|---|---|---|
| transposase slr2062:protein slr2062:protein slr2062 | | pir:S74909 | S74909 |

Description

| ORF Name | NTID | AAID | NT Length | AA Length | Score | Probability |
|---|---|---|---|---|---|---|
| 22710402_c2_154 | 1513 | 3433 | 78 | 237 | | |

Protein name | | | | Locus Name | | Acc# |

Description

NO-HIT

| ORF Name | NTID | AAID | NT Length | AA Length | Score | Probability |
|---|---|---|---|---|---|---|
| 23457632_f3_90 | 1514 | 3434 | 295 | 888 | 885 | 1.5e-88 |

Protein name | | | | Locus Name | | Acc# |
| | | | | sp:UBIE_ECOLI | | P27851 |

Description (EC 2.1.1.-)

| ORF Name | NTID | AAID | NT Length | AA Length | Score | Probability |
|---|---|---|---|---|---|---|
| 23475002_f1_9 | 1515 | 3435 | 182 | 549 | 121 | 4.8e-06 |

Protein name | | | | Locus Name | | Acc# |
| | | | | sp:CUTF_ECOLI | | P40710 |

Description

COPPER HOMEOSTASIS PROTEIN CUTF PRECURSOR (LIPOPROTEIN NLPE)

| ORF Name | NTID | AAID | NT Length | AA Length | Score | Probability |
|---|---|---|---|---|---|---|
| 23554676_f1_16 | 1516 | 3436 | 384 | 1155 | 692 | 4.1e-68 |

Protein name | | | | Locus Name | | Acc# |
| | | | | sp:AARF_ECOLI | | |

Description

UBIQUINONE BIOSYNTHESIS PROTEIN AARF

| ORF Name | NTID | AAID | NT Length | AA Length | Score | Probability |
|---|---|---|---|---|---|---|
| 23634656_c3_200 | 1517 | 3437 | 97 | 294 | 147 | 2.3e-10 |

Protein name | | | | Locus Name | | Acc# |
| | | | | sp:YEAC_ECOLI | | P76231 |

Description

HYPOTHETICAL 10.3 KD PROTEIN IN ANSA-GAPA INTERGENIC REGION

| ORF Name | NTID | AAID | NT Length | AA Length | Score | Probability |
|---|---|---|---|---|---|---|
| 24015950_c1_147 | 1518 | 3438 | 201 | 606 | 207 | 1.0e-16 |

| Protein name | Locus Name | Acc# |
|---|---|---|
| hypothetical protein | gp:AF157493 | AF157493 |

Description

Zymomonas mobilis ZM4 fosmid clone 42D7, complete sequence.

| ORF Name | NTID | AAID | NT Length | AA Length | Score | Probability |
|---|---|---|---|---|---|---|
| 24259702_f1_10 | 1519 | 3439 | 500 | 1503 | 275 | 2.4e-23 |

| Protein name | Locus Name | Acc# |
|---|---|---|
| | sp:YF46_ARCFU | O28726 |

Description

HYPOTHETICAL PROTEIN AF1546

| ORF Name | NTID | AAID | NT Length | AA Length | Score | Probability |
|---|---|---|---|---|---|---|
| 24303583_f1_30 | 1520 | 3440 | 93 | 282 | 169 | 1.1e-12 |

| Protein name | Locus Name | Acc# |
|---|---|---|
| small DNA binding protein Fis | gp:AF040379 | AF040379 |

Description

Proteus vulgaris ribosomal protein L11 methyltransferase (prmA)gene, partial cds; yhdG homolog gene, complete cds; and small DNAbinding protein Fis (fis) gene, partial cds.

| ORF Name | NTID | AAID | NT Length | AA Length | Score | Probability |
|---|---|---|---|---|---|---|
| 24306510_c3_209 | 1521 | 3441 | 224 | 675 | 443 | 1.0e-41 |

| Protein name | Locus Name | Acc# |
|---|---|---|
| | sp:EST2_PSEFL | Q53547 |

Description

CARBOXYLESTERASE 2, (ESTERASE II)

| ORF_Name | NTID | AAID | NT Length | AA Length | Score | Probability |
|---|---|---|---|---|---|---|
| 24613752_c2_168 | 1522 | 3442 | 241 | 726 | 813 | 6.2e-81 |

| Protein name | Locus Name | Acc# |
|---|---|---|
| superoxide dismutase, (Mn):SodA protein | pir:JC6542 | JC6542 |

Description

| ORF_Name | NTID | AAID | NT Length | AA Length | Score | Probability |
|---|---|---|---|---|---|---|
| 24614125_f2_65 | 1523 | 3443 | 816 | 2451 | 1566 | 1.0e-160 |

| Protein name | Locus Name | Acc# |
|---|---|---|
| penicillin-binding protein 1B | gp:AF147449 | AF147449 |

Description

Pseudomonas aeruginosa strain PAO1 penicillin-binding protein 1B(ponB) gene, complete cds.

| ORF_Name | NTID | AAID | NT Length | AA Length | Score | Probability |
|---|---|---|---|---|---|---|
| 24640762_f3_79 | 1524 | 3444 | 388 | 1167 | 1412 | 2.1e-144 |

| Protein name | Locus Name | Acc# |
|---|---|---|
|  | sp:METK_ECOLI |  |

Description

ADENOSYLTRANSFERASE) (ADOMET SYNTHETASE)

| ORF_Name | NTID | AAID | NT Length | AA Length | Score | Probability |
|---|---|---|---|---|---|---|
| 25551385_f1_17 | 1525 | 3445 | 175 | 528 | 298 | 2.3e-26 |

| Protein name | Locus Name | Acc# |
|---|---|---|
| adenine phosphoribosyltransferase,:protein sll1430:protein sll1430 | pir:S75440 | S75440 |

Description

| ORF_Name | NTID | AAID | NT Length | AA Length | Score | Probability |
|---|---|---|---|---|---|---|
| 25665962_f1_8 | 1526 | 3446 | 115 | 348 | 75 | 0.0099 |

| Protein name | Locus Name | Acc# |
|---|---|---|
| glutamyl-tRNA (Gln) amidotransferase subunit C | pir:D70484 | D70484 |

Description

| ORF Name | NTID | AAID | NT Length | AA Length | Score | Probability |
|---|---|---|---|---|---|---|
| 29687660_f3_88 | 1527 | 3447 | 310 | 933 | 441 | 1.6e-41 |

| Protein name | Locus Name | Acc# |
|---|---|---|
| hypothetical protein | pir:S76006 | S76006 |

Description

---

| ORF Name | NTID | AAID | NT Length | AA Length | Score | Probability |
|---|---|---|---|---|---|---|
| 30650250_f1_12 | 1528 | 3448 | 298 | 897 | 664 | 3.8e-65 |

| Protein name | Locus Name | Acc# |
|---|---|---|
| conserved hypothetical protein | pir:A75256 | A75256 |

Description

---

| ORF Name | NTID | AAID | NT Length | AA Length | Score | Probability |
|---|---|---|---|---|---|---|
| 31541442_c3_183 | 1529 | 3449 | 317 | 954 | 338 | 6.5e-30 |

| Protein name | Locus Name | Acc# |
|---|---|---|
| putative peptidyl-prolyl cis-trans isomerase | gp:ASAJ2316 | AJ002316 |

Description

Acinetobacter sp. ADP1 alkR & alkM genes, ORF1 & ORF4.

---

| ORF Name | NTID | AAID | NT Length | AA Length | Score | Probability |
|---|---|---|---|---|---|---|
| 32694687_c2_181 | 1530 | 3450 | 140 | 423 | 117 | 2.0e-06 |

| Protein name | Locus Name | Acc# |
|---|---|---|
|  | sp:YPBB_BACSU | P50728 |

Description

HYPOTHETICAL 40.7 KD PROTEIN IN FER-RECQ INTERGENIC REGION

---

| ORF Name | NTID | AAID | NT Length | AA Length | Score | Probability |
|---|---|---|---|---|---|---|
| 33213555_c3_216 | 1531 | 3451 | 60 | 183 | 106 | 1.3e-05 |

| Protein name | Locus Name | Acc# |
|---|---|---|
|  | gp:ECU82664 | U82664 |

Description

Escherichia coli minutes 9 to 11 genomic sequence.

399

| ORF Name | NTID | AAID | NT Length | AA Length | Score | Probability |
|---|---|---|---|---|---|---|
| 33245927_c3_213 | 1532 | 3452 | 229 | 690 | 606 | 5.3e-59 |

| Protein name | | | | Locus Name | | Acc# |
|---|---|---|---|---|---|---|
| | | | | sp:YCFV_ECOLI | | P75957 |

Description

HYPOTHETICAL ABC TRANSPORTER ATP-BINDING PROTEIN YCFV

| ORF Name | NTID | AAID | NT Length | AA Length | Score | Probability |
|---|---|---|---|---|---|---|
| 33394050_f3_76 | 1533 | 3453 | 269 | 810 | 340 | 8.2e-31 |

| Protein name | | | | Locus Name | | Acc# |
|---|---|---|---|---|---|---|
| | | | | sp:YBBF_ECOLI | | |

Description

HYPOTHETICAL 26.9 KD PROTEIN IN PURE-PPIB INTERGENIC REGION

| ORF Name | NTID | AAID | NT Length | AA Length | Score | Probability |
|---|---|---|---|---|---|---|
| 3465_f3_89 | 1534 | 3454 | 71 | 216 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 3906561_f1_18 | 1535 | 3455 | 248 | 747 | 311 | 9.7e-28 |

| Protein name | | | | Locus Name | | Acc# |
|---|---|---|---|---|---|---|
| | | | | gp:STMBLDA | | M80628 |

Description

Streptomyces griseus transfer RNA-Leu (bldA) gene and ORF, completecds.

| ORF Name | NTID | AAID | NT Length | AA Length | Score | Probability |
|---|---|---|---|---|---|---|
| 3910693_f2_39 | 1536 | 3456 | 172 | 519 | 526 | 1.6e-50 |

| Protein name | | | | Locus Name | | Acc# |
|---|---|---|---|---|---|---|
| | | | | sp:CYPB_ECOLI | | |

Description (ROTAMASE B)

| ORF Name | NTID | AAID | NT Length | AA Length | Score | Probability |
|---|---|---|---|---|---|---|
| 3944178_f2_52 | 1537 | 3457 | 328 | 987 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3953218_c1_125 | 1538 | 3458 | 943 | 2832 | 156 | 1.1e-10 |

| Protein name | Locus Name | Acc# |
|---|---|---|
| PhoC protein | gp:KPN250377 | AJ250377 |

Description

Klebsiella pneumoniae partial selD gene for SelD protein and phoC gene for PhoC protein.

| ORF Name | NTID | AAID | NT Length | AA Length | Score | Probability |
|---|---|---|---|---|---|---|
| 3991527_f2_67 | 1539 | 3459 | 2142 | 6429 | 577 | 4.0e-51 |

| Protein name | Locus Name | Acc# |
|---|---|---|
| | gp:U41852 | U41852 |

Description

Haemophilus influenzae hsf gene, complete cds.

| ORF Name | NTID | AAID | NT Length | AA Length | Score | Probability |
|---|---|---|---|---|---|---|
| 4322793_f2_57 | 1540 | 3460 | 217 | 654 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4410943_c3_219 | 1541 | 3461 | 91 | 276 | 103 | 1.1e-05 |

| Protein name | Locus Name | Acc# |
|---|---|---|
| | sp:YGFY_ECOLI | Q46825 |

Description

HYPOTHETICAL 10.5 KD PROTEIN IN FLDB-BGLA INTERGENIC REGION

| ORF Name | NTID | AAID | NT Length | AA Length | Score | Probability |
|---|---|---|---|---|---|---|
| 4688887_c3_211 | 1542 | 3462 | 452 | 1359 | 142 | 7.9e-07 |

| Protein name | | | | Locus Name | | Acc# |
|---|---|---|---|---|---|---|
| metal transporter Nramp4 | | | | gp:AF202540 | | AF202540 |

Description

Arabidopsis thaliana metal transporter Nramp4 mRNA, complete cds.

| ORF Name | NTID | AAID | NT Length | AA Length | Score | Probability |
|---|---|---|---|---|---|---|
| 4782812_c1_141 | 1543 | 3463 | 147 | 444 | 95 | 0.011 |

| Protein name | | | | Locus Name | | Acc# |
|---|---|---|---|---|---|---|
| hypothetical protein TM1026 | | | | pir:A72303 | | A72303 |

Description

| ORF Name | NTID | AAID | NT Length | AA Length | Score | Probability |
|---|---|---|---|---|---|---|
| 4798430_c1_151 | 1544 | 3464 | 453 | 1362 | 447 | 7.2e-62 |

| Protein name | | | | Locus Name | | Acc# |
|---|---|---|---|---|---|---|
| | | | | gp:SC9745 | | |

Description

S.cerevisiae chromosome XIII cosmid 9745.

| ORF Name | NTID | AAID | NT Length | AA Length | Score | Probability |
|---|---|---|---|---|---|---|
| 5125318_c3_206 | 1545 | 3465 | 356 | 1071 | 184 | 5.0e-21 |

| Protein name | | | | Locus Name | | Acc# |
|---|---|---|---|---|---|---|
| | | | | gp:ATAC007168 | | AC007168 |

Description

Arabidopsis thaliana chromosome II BAC T26C19 genomic sequence,complete sequence.

| ORF Name | NTID | AAID | NT Length | AA Length | Score | Probability |
|---|---|---|---|---|---|---|
| 5192757_c1_144 | 1546 | 3466 | 425 | 1278 | 734 | 1.5e-72 |

| Protein name | | | | Locus Name | | Acc# |
|---|---|---|---|---|---|---|
| | | | | sp:YCFW_ECOLI | | P75958 |

Description

HYPOTHETICAL 45.3 KD PROTEIN IN MFD-COBB INTERGENIC REGION

| ORF Name | NTID | AAID | NT Length | AA Length | Score | Probability |
|---|---|---|---|---|---|---|
| 5343752_f3_101 | 1547 | 3467 | 316 | 951 | 630 | 1.5e-61 |

| Protein name | Locus Name | Acc# |
|---|---|---|
| | sp:PRMA_ECOLI | |

Description

RIBOSOMAL PROTEIN L11 METHYLTRANSFERASE,

| ORF Name | NTID | AAID | NT Length | AA Length | Score | Probability |
|---|---|---|---|---|---|---|
| 7042580_c1_142 | 1548 | 3468 | 75 | 228 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 7312717_f3_77 | 1549 | 3469 | 75 | 228 | 77 | 0.028 |

| Protein name | Locus Name | Acc# |
|---|---|---|
| conserved hypothetical protein 262 | pir:S59078 | S59078 |

Description

| ORF Name | NTID | AAID | NT Length | AA Length | Score | Probability |
|---|---|---|---|---|---|---|
| 822680_c3_218 | 1550 | 3470 | 417 | 1254 | 675 | 8.8e-82 |

| Protein name | Locus Name | Acc# |
|---|---|---|
| glyceraldehyde-3-phosphate dehydrogenase | gp:BACPGKTIMG | M87647 |

Description

Bacillus megaterium glyceraldehyde-3-phosphate dehydrogenase (gap),phosphoglycerate kinase (pgk), and triose phosphate isomerase (tpi)genes, complete cds.

| ORF Name | NTID | AAID | NT Length | AA Length | Score | Probability |
|---|---|---|---|---|---|---|
| 9767325_f3_82 | 1551 | 3471 | 147 | 444 | 476 | 3.2e-45 |

| Protein name | Locus Name | Acc# |
|---|---|---|
| transposase homolog A | gp:HPU95957 | U95957 |

Description

Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 12635413_f3_5 | 1552 | 3472 | 813 | 2442 | 1030 | 4.2e-129 |

| Protein name | Locus Name | Acc# |
|---|---|---|
| | sp:UP05_ECOLI | |

Description

UNKNOWN PROTEIN FROM 2D-PAGE SPOTS M62/M63/O3/O9/T35 PRECURSOR

| ORF Name | NTID | AAID | NT Length | AA Length | Score | Probability |
|---|---|---|---|---|---|---|
| 31671880_f1_2 | 1553 | 3473 | 185 | 558 | 360 | 6.2e-33 |

| Protein name | Locus Name | Acc# |
|---|---|---|
| FabZ | gp:NMU79481 | U79481 |

Description

Neisseria meningitidis UDP-3-O-(R-3-hydroxymyristoyl)-glucosamineN-acyltransferase (lpxD) gene, partial cds, and3(R)-hydroxymyristoyl acyl carrier protein dehydrase (fabZ) andUDP-N-acetylglucosamine acyltransferase (lpxA) genes, complete cds.

| ORF Name | NTID | AAID | NT Length | AA Length | Score | Probability |
|---|---|---|---|---|---|---|
| 36148427_f3_8 | 1554 | 3474 | 67 | 201 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4412963_f2_4 | 1555 | 3475 | 185 | 558 | 470 | 1.4e-44 |

| Protein name | Locus Name | Acc# |
|---|---|---|
| | sp:LPXA_ECOLI | |

Description

| (EC 2.3.1.129) (UDP-N-ACETYLGLUCOSAMINE ACYLTRANSFERASE) |
|---|

| ORF Name | NTID | AAID | NT Length | AA Length | Score | Probability |
|---|---|---|---|---|---|---|
| 4687640_f2_3 | 1556 | 3476 | 340 | 1023 | 667 | 1.8e-65 |

| Protein name | Locus Name | Acc# |
|---|---|---|
| | sp:LPXD_HAEIN | P43888 |

Description

| (EC 2.3.1.-) |
|---|

| ORF Name | NTID | AAID | NT Length | AA Length | Score | Probability |
|---|---|---|---|---|---|---|
| 11978127_f1_2 | 1557 | 3477 | 379 | 1140 | 811 | 1.0e-80 |

| Protein name | Locus Name | Acc# |
|---|---|---|
| | sp:YECP_ECOLI | |

Description

| HYPOTHETICAL 37.0 KD PROTEIN IN ASPS-BISZ INTERGENIC REGION |
|---|

| ORF Name | NTID | AAID | NT Length | AA Length | Score | Probability |
|---|---|---|---|---|---|---|
| 14658562_f3_6 | 1558 | 3478 | 309 | 930 | 835 | 2.9e-83 |

| Protein name | Locus Name | Acc# |
|---|---|---|
| | sp:YEDI_ECOLI | |

Description

| HYPOTHETICAL 32.2 KD PROTEIN IN DSRB-VSR INTERGENIC REGION |
|---|

| ORF Name | NTID | AAID | NT Length | AA Length | Score | Probability |
|---|---|---|---|---|---|---|
| 23714375_f3_8 | 1559 | 3479 | 100 | 303 | 70 | 0.033 |

| Protein name | Locus Name | Acc# |
|---|---|---|
| outer membrane protein H.8 precursor | pir:S04157 | S04157 |

Description

| ORF_Name | NTID | AAID | NT Length | AA Length | Score | Probability |
|---|---|---|---|---|---|---|
| 24253427_f3_7 | 1560 | 3480 | 85 | 258 | | |

Protein name | Locus Name | Acc#

Description

NO-HIT

| ORF_Name | NTID | AAID | NT Length | AA Length | Score | Probability |
|---|---|---|---|---|---|---|
| 24322153_f3_5 | 1561 | 3481 | 257 | 774 | 475 | 4.1e-45 |

Protein name | Locus Name | Acc#
 | sp:YECO_HAEIN |

Description

HYPOTHETICAL PROTEIN HI0319/320

| ORF_Name | NTID | AAID | NT Length | AA Length | Score | Probability |
|---|---|---|---|---|---|---|
| 24804651_c2_16 | 1562 | 3482 | 62 | 189 | 171 | 3.1e-12 |

Protein name | Locus Name | Acc#
 | sp:SSP2_PLAYO | Q01443

Description

SPOROZOITE SURFACE PROTEIN 2 PRECURSOR

| ORF_Name | NTID | AAID | NT Length | AA Length | Score | Probability |
|---|---|---|---|---|---|---|
| 35181956_c1_11 | 1563 | 3483 | 251 | 756 | | |

Protein name | Locus Name | Acc#

Description

NO-HIT

| ORF_Name | NTID | AAID | NT Length | AA Length | Score | Probability |
|---|---|---|---|---|---|---|
| 3955437_c2_19 | 1564 | 3484 | 73 | 219 | 138 | 2.1e-09 |

Protein name | Locus Name | Acc#
peptide methionine sulfoxide reductase | pir:E75345 | E75345

Description

| ORF Name | NTID | AAID | NT Length | AA Length | Score | Probability |
|---|---|---|---|---|---|---|
| 5117337_f3_9 | 1565 | 3485 | 379 | 1140 | 1148 | 2.0e-116 |

| Protein name | | Locus Name | Acc# |
|---|---|---|---|
| serine-pyruvate aminotransferase | | pir:F75269 | F75269 |

Description

| ORF Name | NTID | AAID | NT Length | AA Length | Score | Probability |
|---|---|---|---|---|---|---|
| 1063441_c3_193 | 1566 | 3486 | 442 | 1329 | 272 | 1.4e-21 |

| Protein name | | Locus Name | Acc# |
|---|---|---|---|
| hypothetical protein 25 | | pir:T13514 | T13514 |

Description

| ORF Name | NTID | AAID | NT Length | AA Length | Score | Probability |
|---|---|---|---|---|---|---|
| 10650681_c3_218 | 1567 | 3487 | 102 | 309 | 72 | 1.0e-05 |

| Protein name | | Locus Name | Acc# |
|---|---|---|---|
| unknown | | gp:AF050676 | AF050676 |

Description

Pseudomonas aeruginosa lipoprotein (oprX) and ferric uptakeregulator (fur) genes, complete cds; and unknown genes.

| ORF Name | NTID | AAID | NT Length | AA Length | Score | Probability |
|---|---|---|---|---|---|---|
| 119027_c2_166 | 1568 | 3488 | 95 | 288 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 1227302_c3_221 | 1569 | 3489 | 90 | 273 | 85 | 0.012 |

| Protein name | | Locus Name | Acc# |
|---|---|---|---|
| probable fatty-acid--CoA ligase, fadD7 | | pir:C69471 | C69471 |

Description

| ORF Name | NTID | AAID | NT Length | AA Length | Score | Probability |
|---|---|---|---|---|---|---|
| 12773910_c2_171 | 1570 | 3490 | 116 | 351 | | |

Protein name                                                  Locus Name         Acc#

Description

NO-HIT

| ORF Name | NTID | AAID | NT Length | AA Length | Score | Probability |
|---|---|---|---|---|---|---|
| 12973332_f1_18 | 1571 | 3491 | 63 | 192 | | |

Protein name                                                  Locus Name         Acc#

Description

NO-HIT

| ORF Name | NTID | AAID | NT Length | AA Length | Score | Probability |
|---|---|---|---|---|---|---|
| 12992125_c2_170 | 1572 | 3492 | 152 | 459 | | |

Protein name                                                  Locus Name         Acc#

Description

NO-HIT

| ORF Name | NTID | AAID | NT Length | AA Length | Score | Probability |
|---|---|---|---|---|---|---|
| 13085160_c3_196 | 1573 | 3493 | 236 | 711 | | |

Protein name                                                  Locus Name         Acc#

Description

NO-HIT

| ORF Name | NTID | AAID | NT Length | AA Length | Score | Probability |
|---|---|---|---|---|---|---|
| 1371003_f3_87 | 1574 | 3494 | 413 | 1242 | 1088 | 4.5e-110 |

| Protein name | Locus Name | Acc# |
|---|---|---|
| Na+/H+-exchanging protein:Na+/H+ antiporter | pir:JX0360 | JX0360 |

Description

| ORF Name | NTID | AAID | NT Length | AA Length | Score | Probability |
|---|---|---|---|---|---|---|
| 14647033_c3_209 | 1575 | 3495 | 192 | 579 | 128 | 1.8e-07 |

| Protein name | Locus Name | Acc# |
|---|---|---|
| muramoyl-pentapeptide carboxypeptidase | pir:T34747 | T34747 |

Description

| ORF Name | NTID | AAID | NT Length | AA Length | Score | Probability |
|---|---|---|---|---|---|---|
| 14745253_c3_214 | 1576 | 3496 | 468 | 1407 | 596 | 6.1e-58 |

| Protein name | Locus Name | Acc# |
|---|---|---|
| hypothetical protein Rv3734c | pir:G70797 | G70797 |

Description

| ORF Name | NTID | AAID | NT Length | AA Length | Score | Probability |
|---|---|---|---|---|---|---|
| 15633253_c1_149 | 1577 | 3497 | 150 | 453 | | |

Protein name                                           Locus Name         Acc#

Description

NO-HIT

| ORF Name | NTID | AAID | NT Length | AA Length | Score | Probability |
|---|---|---|---|---|---|---|
| 16485906_c3_192 | 1578 | 3498 | 484 | 1455 | 207 | 2.3e-14 |

| Protein name | Locus Name | Acc# |
|---|---|---|
| | sp:VG17_BPMD2 | O64210 |

Description

MAJOR HEAD PROTEIN GP17

| ORF Name | NTID | AAID | NT Length | AA Length | Score | Probability |
|---|---|---|---|---|---|---|
| 16595716_f2_69 | 1579 | 3499 | 60 | 183 | | |

Protein name                                           Locus Name         Acc#

Description

NO-HIT

| ORF Name | NTID | AAID | NT Length | AA Length | Score | Probability |
|---|---|---|---|---|---|---|
| 16597827_c1_133 | 1580 | 3500 | 205 | 618 | 92 | 0.022 |

| Protein name | Locus Name | Acc# |
|---|---|---|
| putative prohead protease | gp:AF181080 | AF181080 |

Description

Rhodobacter capsulatus putative large terminase, putative portalprotein, and putative prohead protease genes, complete cds; andputative capsid protein gene, partial cds.

| ORF Name | NTID | AAID | NT Length | AA Length | Score | Probability |
|---|---|---|---|---|---|---|
| 19547875_c1_157 | 1581 | 3501 | 124 | 375 | 189 | 8.2e-15 |

| Protein name | Locus Name | Acc# |
|---|---|---|
| mono-heme c-type cytochrome ScyA | gp:AF044582 | AF044582 |

Description

Shewanella putrefaciens NrfG homolog gene, partial cds; andmono-heme c-type cytochrome ScyA (scyA), cytochrome c maturationprotein A (ccmA), cytochrome c maturation protein B (ccmB),cytochrome c maturation protein C (ccmC), cytochrome c maturationprotein D (ccmD), and cytochrome c maturation protein E (ccmE)genes, complete cds.

| ORF Name | NTID | AAID | NT Length | AA Length | Score | Probability |
|---|---|---|---|---|---|---|
| 19697265_c2_179 | 1582 | 3502 | 65 | 198 | 75 | 0.020 |

| Protein name | Locus Name | Acc# |
|---|---|---|
|  | sp:YC67_ASTLO | P34778 |

Description

HYPOTHETICAL 20.1 KD PROTEIN YCF67 (ORF170)

| ORF Name | NTID | AAID | NT Length | AA Length | Score | Probability |
|---|---|---|---|---|---|---|
| 20917082_f3_105 | 1583 | 3503 | 71 | 216 |  |  |

| Protein name | Locus Name | Acc# |
|---|---|---|
|  |  |  |

Description

NO-HIT

| ORF Name | NTID | AAID | NT Length | AA Length | Score | Probability |
|---|---|---|---|---|---|---|
| 21663410_f1_17 | 1584 | 3504 | 170 | 513 | | |

| Protein name | | Locus Name | Acc# |
|---|---|---|---|

Description

NO-HIT

| ORF Name | NTID | AAID | NT Length | AA Length | Score | Probability |
|---|---|---|---|---|---|---|
| 22351557_c3_191 | 1585 | 3505 | 89 | 270 | 70 | 0.0039 |

| Protein name | Locus Name | Acc# |
|---|---|---|
| hypothetical protein F26B6.23 | pir:T01147 | T01147 |

Description

| ORF Name | NTID | AAID | NT Length | AA Length | Score | Probability |
|---|---|---|---|---|---|---|
| 22381542_c3_199 | 1586 | 3506 | 257 | 774 | 457 | 3.3e-43 |

| Protein name | Locus Name | Acc# |
|---|---|---|
| minor tail protein L homolog:protein gp18 | pir:T13104 | T13104 |

Description

| ORF Name | NTID | AAID | NT Length | AA Length | Score | Probability |
|---|---|---|---|---|---|---|
| 23437561_f2_52 | 1587 | 3507 | 690 | 2073 | 1985 | 4.0e-205 |

| Protein name | Locus Name | Acc# |
|---|---|---|
| | sp:SYM_HAEIN | P43828 |

Description (METRS)

| ORF Name | NTID | AAID | NT Length | AA Length | Score | Probability |
|---|---|---|---|---|---|---|
| 23549217_c1_144 | 1588 | 3508 | 192 | 579 | 113 | 5.4e-05 |

| Protein name | Locus Name | Acc# |
|---|---|---|
| hypothetical protein | pir:T14651 | T14651 |

Description

| ORF Name | NTID | AAID | NT Length | AA Length | Score | Probability |
|---|---|---|---|---|---|---|
| 23847257_c2_167 | 1589 | 3509 | 125 | 378 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24316886_f3_115 | 1590 | 3510 | 151 | 456 | 356 | 1.7e-32 |

| Protein name | | | | | Locus Name | Acc# |
|---|---|---|---|---|---|---|
| | | | | | sp:YDCQ_ECOLI | P76107 |

Description

HYPOTHETICAL 16.1 KD PROTEIN IN TEHB-ANSP INTERGENIC REGION

| ORF Name | NTID | AAID | NT Length | AA Length | Score | Probability |
|---|---|---|---|---|---|---|
| 24415876_f2_48 | 1591 | 3511 | 154 | 465 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24417540_c2_187 | 1592 | 3512 | 209 | 630 | 600 | 2.3e-58 |

| Protein name | | | | | Locus Name | Acc# |
|---|---|---|---|---|---|---|
| | | | | | gp:XCRPFB | Y09700 |

Description

X.campestris rpfB gene.

| ORF Name | NTID | AAID | NT Length | AA Length | Score | Probability |
|---|---|---|---|---|---|---|
| 24431265_c2_182 | 1593 | 3513 | 486 | 1461 | 1261 | 2.1e-128 |

| Protein name | | | | | Locus Name | Acc# |
|---|---|---|---|---|---|---|
| | | | | | sp:SYC_ECOLI | P21888 |

Description (CYSRS)

| ORF Name | NTID | AAID | NT Length | AA Length | Score | Probability |
|---|---|---|---|---|---|---|
| 24614431_c2_173 | 1594 | 3514 | 169 | 510 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 24631552_c2_181 | 1595 | 3515 | 271 | 816 | 723 | 2.1e-71 |

| Protein name | Locus Name | Acc# |
|---|---|---|
| thiamin biosynthesis protein thiG | pir:B70487 | B70487 |

Description

| ORF Name | NTID | AAID | NT Length | AA Length | Score | Probability |
|---|---|---|---|---|---|---|
| 24882676_c2_163 | 1596 | 3516 | 198 | 597 | 261 | 1.9e-22 |

| Protein name | Locus Name | Acc# |
|---|---|---|
| | sp:YE18_HAEIN | P44189 |

Description

HYPOTHETICAL PROTEIN HI1418

| ORF Name | NTID | AAID | NT Length | AA Length | Score | Probability |
|---|---|---|---|---|---|---|
| 25397700_c1_148 | 1597 | 3517 | 221 | 666 | 388 | 6.7e-36 |

| Protein name | Locus Name | Acc# |
|---|---|---|
| minor tail protein gp20 | pir:T13106 | T13106 |

Description

| ORF Name | NTID | AAID | NT Length | AA Length | Score | Probability |
|---|---|---|---|---|---|---|
| 25493762_c1_161 | 1598 | 3518 | 60 | 183 | | |

| Protein name | Locus Name | Acc# |
|---|---|---|
| | | |

Description

NO-HIT

| ORF_Name | NTID | AAID | NT Length | AA Length | Score | Probability |
|---|---|---|---|---|---|---|
| 25584627_c3_216 | 1599 | 3519 | 60 | 183 | | |

| Protein name | | Locus Name | Acc# |
|---|---|---|---|
| | | | |

Description

NO-HIT

| ORF_Name | NTID | AAID | NT Length | AA Length | Score | Probability |
|---|---|---|---|---|---|---|
| 2581542_c3_213 | 1600 | 3520 | 72 | 219 | | |

| Protein name | | Locus Name | Acc# |
|---|---|---|---|
| | | | |

Description

NO-HIT

| ORF_Name | NTID | AAID | NT Length | AA Length | Score | Probability |
|---|---|---|---|---|---|---|
| 26819002_c1_141 | 1601 | 3521 | 90 | 273 | 72 | 0.020 |

| Protein name | | Locus Name | Acc# |
|---|---|---|---|
| hypothetical protein yorB | | pir:T12887 | |

Description

| ORF_Name | NTID | AAID | NT Length | AA Length | Score | Probability |
|---|---|---|---|---|---|---|
| 276927_f2_58 | 1602 | 3522 | 330 | 993 | 111 | 0.0016 |

| Protein name | | Locus Name | Acc# |
|---|---|---|---|
| | | sp:FINQ_ECOLI | P18809 |

Description

FINQ PROTEIN

| ORF_Name | NTID | AAID | NT Length | AA Length | Score | Probability |
|---|---|---|---|---|---|---|
| 2792176_c2_180 | 1603 | 3523 | 112 | 339 | 112 | 1.2e-06 |

| Protein name | | Locus Name | Acc# |
|---|---|---|---|
| | | sp:YRKF_BACSU | P54433 |

Description

HYPOTHETICAL 20.7 KD PROTEIN IN BLTR-SPOIIIC INTERGENIC REGION

| ORF Name | NTID | AAID | NT Length | AA Length | Score | Probability |
|---|---|---|---|---|---|---|
| 29337908_f1_37 | 1604 | 3524 | 82 | 249 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 31678827_c3_222 | 1605 | 3525 | 244 | 735 | 527 | 1.3e-50 |

| Protein name | Locus Name | Acc# |
|---|---|---|
| long-chain-fatty-acid-CoA ligase | gp:AF150669 | AF150669 |

Description

Pseudomonas putida long-chain-fatty-acid-CoA ligase (fadD) gene, complete cds.

| ORF Name | NTID | AAID | NT Length | AA Length | Score | Probability |
|---|---|---|---|---|---|---|
| 32062552_f3_102 | 1606 | 3526 | 61 | 186 | 54 | 0.0065 |

| Protein name | Locus Name | Acc# |
|---|---|---|
| | sp:Y683_METJA | Q58096 |

Description

HYPOTHETICAL PROTEIN MJ0683

| ORF Name | NTID | AAID | NT Length | AA Length | Score | Probability |
|---|---|---|---|---|---|---|
| 3207751_f3_103 | 1607 | 3527 | 126 | 381 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 35187543_c3_217 | 1608 | 3528 | 378 | 1137 | 105 | 0.0058 |

| Protein name | Locus Name | Acc# |
|---|---|---|
| AdcB protein | gp:SPADCA | Z71552 |

Description

Streptococcus pneumoniae adcRCBA operon.

| ORF Name | NTID | AAID | NT Length | AA Length | Score | Probability |
|---|---|---|---|---|---|---|
| 3937813_c1_158 | 1609 | 3529 | 233 | 702 | 368 | 8.9e-34 |

Protein name | | | | Locus Name | | Acc#
| | | | | sp:CYC4_PSEST | | Q52369

Description

CYTOCHROME C4 PRECURSOR

| ORF Name | NTID | AAID | NT Length | AA Length | Score | Probability |
|---|---|---|---|---|---|---|
| 402217_c3_194 | 1610 | 3530 | 161 | 486 | | |

Protein name | | | | Locus Name | | Acc#

Description

NO-HIT

| ORF Name | NTID | AAID | NT Length | AA Length | Score | Probability |
|---|---|---|---|---|---|---|
| 4069212_c3_195 | 1611 | 3531 | 118 | 357 | 83 | 0.017 |

Protein name | | | | Locus Name | | Acc#
| | | | | sp:Y182_METJA | | Q57641

Description

HYPOTHETICAL PROTEIN MJ0182

| ORF Name | NTID | AAID | NT Length | AA Length | Score | Probability |
|---|---|---|---|---|---|---|
| 4331563_c2_172 | 1612 | 3532 | 1179 | 3540 | 181 | 1.2e-09 |

Protein name | | | | Locus Name | | Acc#
unknown | | | | gp:AF011378 | | AF011378

Description

Bacteriophage sk1 complete genome.

| ORF Name | NTID | AAID | NT Length | AA Length | Score | Probability |
|---|---|---|---|---|---|---|
| 4415938_c2_177 | 1613 | 3533 | 1627 | 4884 | 1863 | 3.4e-198 |

Protein name | | | | Locus Name | | Acc#
tail tip fiber protein gp21 | | | | pir:T13107 | | T13107

Description

| ORF Name | NTID | AAID | NT Length | AA Length | Score | Probability |
|---|---|---|---|---|---|---|
| 4861263_c2_169 | 1614 | 3534 | 121 | 366 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4867819_c2_162 | 1615 | 3535 | 196 | 591 | 404 | 1.4e-37 |

| Protein name | Locus Name | Acc# |
|---|---|---|
| hypothetical protein HP1334 | pir:F64686 | F64686 |

Description

| ORF Name | NTID | AAID | NT Length | AA Length | Score | Probability |
|---|---|---|---|---|---|---|
| 5130075_c2_186 | 1616 | 3536 | 431 | 1296 | 858 | 1.1e-85 |

| Protein name | Locus Name | Acc# |
|---|---|---|
| | sp:DFP_HAEIN | P44953 |

Description

DNA/PANTOTHENATE METABOLISM FLAVOPROTEIN HOMOLOG

| ORF Name | NTID | AAID | NT Length | AA Length | Score | Probability |
|---|---|---|---|---|---|---|
| 553437_f1_28 | 1617 | 3537 | 91 | 276 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6375032_c2_175 | 1618 | 3538 | 282 | 849 | 301 | 1.1e-33 |

| Protein name | Locus Name | Acc# |
|---|---|---|
| minor tail protein gp19 | pir:T13105 | T13105 |

Description

417

| ORF_Name | NTID | AAID | NT Length | AA Length | Score | Probability |
|---|---|---|---|---|---|---|
| 682777_c1_145 | 1619 | 3539 | 135 | 408 | | |

Protein name — Locus Name — Acc#

Description

NO-HIT

| ORF_Name | NTID | AAID | NT Length | AA Length | Score | Probability |
|---|---|---|---|---|---|---|
| 683187_c1_135 | 1620 | 3540 | 71 | 216 | | |

Protein name — Locus Name — Acc#

Description

NO-HIT

| ORF_Name | NTID | AAID | NT Length | AA Length | Score | Probability |
|---|---|---|---|---|---|---|
| 6925452_f3_100 | 1621 | 3541 | 68 | 207 | 69 | 0.042 |

Protein name: hypothetical protein APE0740 — Locus Name: pir:E72664 — Acc#: E72664

Description

| ORF_Name | NTID | AAID | NT Length | AA Length | Score | Probability |
|---|---|---|---|---|---|---|
| 790807_f1_16 | 1622 | 3542 | 101 | 306 | | |

Protein name — Locus Name — Acc#

Description

NO-HIT

| ORF_Name | NTID | AAID | NT Length | AA Length | Score | Probability |
|---|---|---|---|---|---|---|
| 830300_f1_21 | 1623 | 3543 | 65 | 198 | | |

Protein name — Locus Name — Acc#

Description

NO-HIT

| ORF Name | NTID | AAID | NT Length | AA Length | Score | Probability |
|---|---|---|---|---|---|---|
| 865782_c3_198 | 1624 | 3544 | 750 | 2253 | 173 | 6.3e-12 |

Protein name:

Locus Name: gp:AB030825

Acc#: AB030825

Description: Pseudomonas aeruginosa genomic DNA, partial sequence, strain:PAO1.

| ORF Name | NTID | AAID | NT Length | AA Length | Score | Probability |
|---|---|---|---|---|---|---|
| 14175056_f1_2 | 1625 | 3545 | 67 | 204 | 116 | 4.5e-07 |

Protein name:

Locus Name: gp:ABCARRA

Acc#: X70360

Description: A.brasilense carR gene.

| ORF Name | NTID | AAID | NT Length | AA Length | Score | Probability |
|---|---|---|---|---|---|---|
| 23831527_c3_33 | 1626 | 3546 | 674 | 2025 | 619 | 1.7e-74 |

Protein name: protein-disulfide reductase

Locus Name: gp:AF010322

Acc#: AF010322

Description: Pseudomonas aeruginosa protein-disulfide reductase (dipZ) and catabolic dehydroquinase (aroQ) genes, complete cds.

| ORF Name | NTID | AAID | NT Length | AA Length | Score | Probability |
|---|---|---|---|---|---|---|
| 26276961_c2_28 | 1627 | 3547 | 405 | 1218 | 1607 | 4.5e-165 |

Protein name: chloroacetaldehyde dehydrogenase

Locus Name: gp:AF029733

Acc#: AF029733

Description: Xanthobacter autotrophicus linear plasmid pXAU1 chloroacetaldehydedehydrogenase (aldA) gene, complete cds.

| ORF Name | NTID | AAID | NT Length | AA Length | Score | Probability |
|---|---|---|---|---|---|---|
| 33581289_c2_24 | 1628 | 3548 | 512 | 1539 | 1211 | 4.1e-123 |

| Protein name | | | | Locus Name | | Acc# |
|---|---|---|---|---|---|---|
| | | | | sp:Y736_HAEIN | | P44849 |

Description

HYPOTHETICAL SODIUM-DEPENDENT TRANSPORTER HI0736

| ORF Name | NTID | AAID | NT Length | AA Length | Score | Probability |
|---|---|---|---|---|---|---|
| 5312692_f3_15 | 1629 | 3549 | 411 | 1236 | 1075 | 1.1e-108 |

| Protein name | | | | Locus Name | | Acc# |
|---|---|---|---|---|---|---|
| sodium/proton-dependent alanine carrier pr homolog yrbD | | | | pir:C69972 | | C69972 |

Description

| ORF Name | NTID | AAID | NT Length | AA Length | Score | Probability |
|---|---|---|---|---|---|---|
| 6152307_c2_26 | 1630 | 3550 | 387 | 1164 | 1087 | 5.7e-110 |

| Protein name | | | | Locus Name | | Acc# |
|---|---|---|---|---|---|---|
| | | | | sp:CYDB_ECOLI | | P11027 |

Description

BD-I OXIDASE SUBUNIT II)

| ORF Name | NTID | AAID | NT Length | AA Length | Score | Probability |
|---|---|---|---|---|---|---|
| 781461_c2_25 | 1631 | 3551 | 480 | 1443 | 1563 | 2.1e-160 |

| Protein name | | | | Locus Name | | Acc# |
|---|---|---|---|---|---|---|
| | | | | sp:CYDA_AZOVI | | Q09049 |

Description

CYTOCHROME D UBIQUINOL OXIDASE SUBUNIT I,

| ORF Name | NTID | AAID | NT Length | AA Length | Score | Probability |
|---|---|---|---|---|---|---|
| 125143_c1_36 | 1632 | 3552 | 82 | 249 | 137 | 5.7e-09 |

| Protein name | | | | Locus Name | | Acc# |
|---|---|---|---|---|---|---|
| probable enoyl-CoA hydratase | | | | pir:G75557 | | G75557 |

Description

| ORF Name | NTID | AAID | NT Length | AA Length | Score | Probability |
|---|---|---|---|---|---|---|
| 12632255_c3_48 | 1633 | 3553 | 239 | 720 | 136 | 8.4e-06 |

| Protein name | Locus Name | Acc# |
|---|---|---|
| probable erythrocyte-binding protein MAEBL | pir:T09127 | T09127 |

Description

| ORF Name | NTID | AAID | NT Length | AA Length | Score | Probability |
|---|---|---|---|---|---|---|
| 13064425_f1_6 | 1634 | 3554 | 160 | 483 | 569 | 4.4e-55 |

| Protein name | Locus Name | Acc# |
|---|---|---|
| | sp:HEM6_ECOLI | P36553 |

Description (COPROPORPHYRINOGENASE) (COPROGEN OXIDASE)

| ORF Name | NTID | AAID | NT Length | AA Length | Score | Probability |
|---|---|---|---|---|---|---|
| 16692186_f2_20 | 1635 | 3555 | 158 | 477 | 166 | 2.3e-12 |

| Protein name | Locus Name | Acc# |
|---|---|---|
| | sp:CYCP_ALCSP | P00138 |

Description

CYTOCHROME C'

| ORF Name | NTID | AAID | NT Length | AA Length | Score | Probability |
|---|---|---|---|---|---|---|
| 195277_f1_11 | 1636 | 3556 | 405 | 1218 | 491 | 8.2e-47 |

| Protein name | Locus Name | Acc# |
|---|---|---|
| ORF396 protein | gp:PSDNGC | Z73914 |

Description

Pseudomonas stutzeri orf175 gene.

| ORF Name | NTID | AAID | NT Length | AA Length | Score | Probability |
|---|---|---|---|---|---|---|
| 197137_c2_46 | 1637 | 3557 | 710 | 2133 | 965 | 2.5e-156 |

| Protein name | Locus Name | Acc# |
|---|---|---|
| | sp:DXS_HAEIN | P45205 |

Description

1-DEOXYXYLULOSE-5-PHOSPHATE SYNTHASE (DXP SYNTHASE)

| ORF Name | NTID | AAID | NT Length | AA Length | Score | Probability |
|---|---|---|---|---|---|---|
| 22697263_c1_37 | 1638 | 3558 | 104 | 315 | 87 | 0.0022 |

| Protein name | Locus Name | Acc# |
|---|---|---|
| probable enoyl-coA hydratase | pir:E70868 | E70868 |

Description

| ORF Name | NTID | AAID | NT Length | AA Length | Score | Probability |
|---|---|---|---|---|---|---|
| 24323500_f1_5 | 1639 | 3559 | 171 | 516 | 435 | 7.0e-41 |

| Protein name | Locus Name | Acc# |
|---|---|---|
|  | sp:HEM6_ECOLI | P36553 |

Description (COPROPORPHYRINOGENASE) (COPROGEN OXIDASE)

| ORF Name | NTID | AAID | NT Length | AA Length | Score | Probability |
|---|---|---|---|---|---|---|
| 30120325_c1_32 | 1640 | 3560 | 103 | 312 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 33449042_c3_54 | 1641 | 3561 | 126 | 378 | 294 | 6.2e-26 |

| Protein name | Locus Name | Acc# |
|---|---|---|
| SuhB | gp:AF010139 | AF010139 |

Description

Azotobacter vinelandii iron-sulfur cluster assembly gene cluster, suhB, cysE2, iscS, iscU, iscA, hscB, hscA and fdx genes complete cds; ndk gene, partial cds.

| ORF Name | NTID | AAID | NT Length | AA Length | Score | Probability |
|---|---|---|---|---|---|---|
| 33986312_f2_16 | 1642 | 3562 | 209 | 630 | 522 | 4.3e-50 |

| Protein name | Locus Name | Acc# |
|---|---|---|
|  | sp:GCH2_HAEIN | P44571 |

Description

GTP CYCLOHYDROLASE II,

| ORF Name | NTID | AAID | NT Length | AA Length | Score | Probability |
|---|---|---|---|---|---|---|
| 35441086_c2_43 | 1643 | 3563 | 149 | 450 | 96 | 0.011 |

| Protein name | Locus Name | Acc# |
|---|---|---|
| cell wall-binding protein homolog yvcE | pir:F70031 | F70031 |

Description

| ORF Name | NTID | AAID | NT Length | AA Length | Score | Probability |
|---|---|---|---|---|---|---|
| 5859703_c1_33 | 1644 | 3564 | 464 | 1395 | 705 | 1.7e-69 |

| Protein name | Locus Name | Acc# |
|---|---|---|
|  | gp:ECOFOLC | J02808 |

Description

E.coli folC gene encoding folylpolyglutamate-dihydrofolatesynthetase, and a protein required for its expression, completecds.

| ORF Name | NTID | AAID | NT Length | AA Length | Score | Probability |
|---|---|---|---|---|---|---|
| 1046926_c1_177 | 1645 | 3565 | 217 | 654 | 325 | 3.2e-29 |

| Protein name | Locus Name | Acc# |
|---|---|---|
| yrp protein:multiple regulator protein | pir:S70842 | S70842 |

Description

| ORF Name | NTID | AAID | NT Length | AA Length | Score | Probability |
|---|---|---|---|---|---|---|
| 10588311_c3_274 | 1646 | 3566 | 401 | 1206 | 1495 | 3.3e-153 |

| Protein name | Locus Name | Acc# |
|---|---|---|
| ribonucleoside-diphosphate reductase, beta chain | pir:C64135 | C64135 |

Description

| ORF Name | NTID | AAID | NT Length | AA Length | Score | Probability |
|---|---|---|---|---|---|---|
| 10602250_f2_95 | 1647 | 3567 | 132 | 399 | 251 | 2.2e-21 |

| Protein name | Locus Name | Acc# |
|---|---|---|
| aluminum tolerance protein | pir:PC4440 |  |

Description

| ORF Name | NTID | AAID | NT Length | AA Length | Score | Probability |
|---|---|---|---|---|---|---|
| 10751006_c1_182 | 1648 | 3568 | 153 | 462 | 125 | 5.0e-08 |

Protein name | Locus Name | Acc#
gp:ABCARRA | X70360

Description
A.brasilense carR gene.

| ORF Name | NTID | AAID | NT Length | AA Length | Score | Probability |
|---|---|---|---|---|---|---|
| 11912951_f1_20 | 1649 | 3569 | 107 | 324 | | |

Protein name | Locus Name | Acc#

Description
NO-HIT

| ORF Name | NTID | AAID | NT Length | AA Length | Score | Probability |
|---|---|---|---|---|---|---|
| 1297216_c3_289 | 1650 | 3570 | 185 | 558 | 125 | 5.0e-08 |

Protein name | Locus Name | Acc#
colicin V production protein homolog | pir:E70195 | E70195

Description

| ORF Name | NTID | AAID | NT Length | AA Length | Score | Probability |
|---|---|---|---|---|---|---|
| 14275330_f2_68 | 1651 | 3571 | 489 | 1470 | 377 | 9.9e-35 |

Protein name | Locus Name | Acc#
 | sp:Y4WB_RHISN | P55680

Description
HYPOTHETICAL ZINC PROTEASE-LIKE PROTEIN Y4WB

| ORF Name | NTID | AAID | NT Length | AA Length | Score | Probability |
|---|---|---|---|---|---|---|
| 14508500_c2_247 | 1652 | 3572 | 513 | 1542 | 1546 | 1.3e-158 |

Protein name | Locus Name | Acc#
amidophosphoribosyltransferase, | pir:XQEC |

Description

| ORF Name | NTID | AAID | NT Length | AA Length | Score | Probability |
|---|---|---|---|---|---|---|
| 14900187_f3_134 | 1653 | 3573 | 220 | 663 | 361 | 4.9e-33 |

Protein name: probable 2-hydroxyhepta-2,4-diene-1,7-dioate isomerase b1180

Locus Name: pir:A64864

Acc#: A64864

Description

---

| ORF Name | NTID | AAID | NT Length | AA Length | Score | Probability |
|---|---|---|---|---|---|---|
| 15908263_c1_143 | 1654 | 3574 | 108 | 327 | 307 | 2.6e-27 |

Protein name: RpsA

Locus Name: gp:AF035937

Acc#: AF035937

Description: Pseudomonas aeruginosa strain IATS 06 RpsA (rpsA) gene, partial cds; Ihf-Beta, Wzz (wzz), and Wzx (wzx) genes, complete cds; and wbp gene cluster for O-antigen biosynthesis, complete sequence.

| ORF Name | NTID | AAID | NT Length | AA Length | Score | Probability |
|---|---|---|---|---|---|---|
| 16194442_f3_135 | 1655 | 3575 | 458 | 1377 | 1285 | 6.0e-131 |

Protein name:

Locus Name: sp:PUR2_SALTY

Acc#: P26977

Description: RIBONUCLEOTIDE SYNTHETASE) (PHOSPHORIBOSYLGLYCINAMIDE SYNTHETASE)

| ORF Name | NTID | AAID | NT Length | AA Length | Score | Probability |
|---|---|---|---|---|---|---|
| 16828790_f1_43 | 1656 | 3576 | 292 | 879 | 398 | 5.9e-37 |

Protein name:

Locus Name: sp:YJAD_HAEIN

Acc#: P44710

Description: HYPOTHETICAL PROTEIN HI0432

| ORF Name | NTID | AAID | NT Length | AA Length | Score | Probability |
|---|---|---|---|---|---|---|
| 19698381_c1_189 | 1657 | 3577 | 60 | 183 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1972931_f2_63 | 1658 | 3578 | 68 | 207 | 57 | 0.023 |

| Protein name | Locus Name | Acc# |
|---|---|---|
| unknown | gp:AF197128 | AF197128 |

Description

Rattus norvegicus unknown mRNA.

| ORF Name | NTID | AAID | NT Length | AA Length | Score | Probability |
|---|---|---|---|---|---|---|
| 20601558_c1_163 | 1659 | 3579 | 273 | 822 | 737 | 7.0e-73 |

| Protein name | Locus Name | Acc# |
|---|---|---|
| | sp:YGHU_ECOLI | Q46845 |

Description

HYPOTHETICAL 34.2 KD PROTEIN IN GSP-HYBG INTERGENIC REGION

| ORF Name | NTID | AAID | NT Length | AA Length | Score | Probability |
|---|---|---|---|---|---|---|
| 2111556_c1_164 | 1660 | 3580 | 1383 | 4152 | 161 | 1.3e-29 |

| Protein name | Locus Name | Acc# |
|---|---|---|
| | sp:EX5C_HAEIN | P44945 |

Description

EXODEOXYRIBONUCLEASE V GAMMA CHAIN,

| ORF Name | NTID | AAID | NT Length | AA Length | Score | Probability |
|---|---|---|---|---|---|---|
| 21642556_c3_272 | 1661 | 3581 | 87 | 264 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 22751387_c3_271 | 1662 | 3582 | 150 | 453 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23611527_c3_275 | 1663 | 3583 | 114 | 345 | 140 | 1.3e-09 |

| Protein name | | | | | Locus Name | Acc# |
|---|---|---|---|---|---|---|
| | | | | | sp:YFAE_HAEIN | P45154 |

Description

HYPOTHETICAL PROTEIN HI1309

| ORF Name | NTID | AAID | NT Length | AA Length | Score | Probability |
|---|---|---|---|---|---|---|
| 23676035_c3_262 | 1664 | 3584 | 410 | 1233 | 177 | 1.3e-10 |

| Protein name | | | | | Locus Name | Acc# |
|---|---|---|---|---|---|---|
| YtfP | | | | | gp:AF008220 | AF008220 |

Description

Bacillus subtilis rrnB-dnaB genomic region.

| ORF Name | NTID | AAID | NT Length | AA Length | Score | Probability |
|---|---|---|---|---|---|---|
| 23725387_c2_244 | 1665 | 3585 | 318 | 957 | 1046 | 1.3e-105 |

| Protein name | | | | | Locus Name | Acc# |
|---|---|---|---|---|---|---|
| | | | | | sp:FTSY_HAEIN | P44870 |

Description

CELL DIVISION PROTEIN FTSY

| ORF Name | NTID | AAID | NT Length | AA Length | Score | Probability |
|---|---|---|---|---|---|---|
| 23728465_c1_161 | 1666 | 3586 | 925 | 2778 | 2856 | 2.0e-297 |

| Protein name | | | | | Locus Name | Acc# |
|---|---|---|---|---|---|---|
| pyruvate dehydrogenase (lipoamide) | | | | | gp:AZPDHE | Y15124 |

Description

Azotobacter vinelandii pdhE gene.

427

| ORF_Name | NTID | AAID | NT Length | AA Length | Score | Probability |
|---|---|---|---|---|---|---|
| 23989512_c3_268 | 1667 | 3587 | 393 | 1182 | 1066 | 9.6e-108 |

| Protein name | Locus Name | Acc# |
|---|---|---|
| | sp:PHEA_PSEST | P27603 |

Description

| ORF_Name | NTID | AAID | NT Length | AA Length | Score | Probability |
|---|---|---|---|---|---|---|
| 24303127_c1_171 | 1668 | 3588 | 407 | 1224 | 797 | 3.1e-79 |

| Protein name | Locus Name | Acc# |
|---|---|---|
| carboxynorspermidine decarboxylase | gp:VIBCANSDC | D31783 |

Description

Vibrio alginolyticus nspC gene for carboxynorspermidinedecarboxylase(CANSDC), complete cds.

| ORF_Name | NTID | AAID | NT Length | AA Length | Score | Probability |
|---|---|---|---|---|---|---|
| 24407750_c3_253 | 1669 | 3589 | 248 | 747 | 603 | 1.1e-58 |

| Protein name | Locus Name | Acc# |
|---|---|---|
| | sp:DCOP_HAEIN | P43812 |

Description

DECARBOXYLASE)

| ORF_Name | NTID | AAID | NT Length | AA Length | Score | Probability |
|---|---|---|---|---|---|---|
| 24642711_c2_216 | 1670 | 3590 | 773 | 2322 | 960 | 1.6e-96 |

| Protein name | Locus Name | Acc# |
|---|---|---|
| | sp:AROA_BACSU | P20691 |

Description (5-ENOLPYRUVYLSHIKIMATE-3-PHOSPHATE SYNTHASE) (EPSP SYNTHASE)

| ORF_Name | NTID | AAID | NT Length | AA Length | Score | Probability |
|---|---|---|---|---|---|---|
| 25025987_c2_232 | 1671 | 3591 | 207 | 624 | 484 | 4.5e-46 |

| Protein name | Locus Name | Acc# |
|---|---|---|
| | sp:YRBH_ECOLI | P45395 |

Description

HYPOTHETICAL 35.2 KD PROTEIN IN MURA-RPON INTERGENIC REGION (O328)

| ORF Name | NTID | AAID | NT Length | AA Length | Score | Probability |
|---|---|---|---|---|---|---|
| 25431625_c3_251 | 1672 | 3592 | 106 | 321 | 224 | 1.6e-18 |

| Protein name | | Locus Name | Acc# |
|---|---|---|---|
| | | sp:IHFB_ERWCH | P37983 |

Description

INTEGRATION HOST FACTOR BETA-SUBUNIT (IHF-BETA)

| ORF Name | NTID | AAID | NT Length | AA Length | Score | Probability |
|---|---|---|---|---|---|---|
| 25445452_c1_144 | 1673 | 3593 | 215 | 648 | 313 | 6.0e-28 |

| Protein name | | Locus Name | Acc# |
|---|---|---|---|
| conserved hypothetical protein | | pir:F75285 | F75285 |

Description

| ORF Name | NTID | AAID | NT Length | AA Length | Score | Probability |
|---|---|---|---|---|---|---|
| 25564402_c3_285 | 1674 | 3594 | 739 | 2220 | 82 | 9.2e-06 |

| Protein name | | Locus Name | Acc# |
|---|---|---|---|
| hypothetical protein SCI7.24c | | pir:T36920 | T36920 |

Description

| ORF Name | NTID | AAID | NT Length | AA Length | Score | Probability |
|---|---|---|---|---|---|---|
| 26359451_c2_249 | 1675 | 3595 | 713 | 2142 | 2272 | 1.5e-235 |

| Protein name | | Locus Name | Acc# |
|---|---|---|---|
| | | sp:UVRB_PSEAE | |

Description

EXCINUCLEASE ABC SUBUNIT B

| ORF Name | NTID | AAID | NT Length | AA Length | Score | Probability |
|---|---|---|---|---|---|---|
| 26750090_c2_245 | 1676 | 3596 | 347 | 1044 | 880 | 4.9e-88 |

| Protein name | | Locus Name | Acc# |
|---|---|---|---|
| | | sp:PYRD_SALTY | P25468 |

Description (DHODEHASE)

| ORF Name | NTID | AAID | NT Length | AA Length | Score | Probability |
|---|---|---|---|---|---|---|
| 2923562_c2_233 | 1677 | 3597 | 177 | 534 | 352 | 4.4e-32 |

| Protein name | | Locus Name | Acc# |
|---|---|---|---|
| | | sp:YRBI_ECOLI | |

Description

HYPOTHETICAL 20.0 KD PROTEIN IN MURA-RPON INTERGENIC REGION

| ORF Name | NTID | AAID | NT Length | AA Length | Score | Probability |
|---|---|---|---|---|---|---|
| 29336052_f1_41 | 1678 | 3598 | 474 | 1425 | 440 | 9.1e-46 |

| Protein name | Locus Name | Acc# |
|---|---|---|
| ABC1 protein homolog T15B16.14 | pir:T02007 | T02007 |

Description

| ORF Name | NTID | AAID | NT Length | AA Length | Score | Probability |
|---|---|---|---|---|---|---|
| 30173201_f2_94 | 1679 | 3599 | 66 | 201 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 30469092_c1_151 | 1680 | 3600 | 250 | 753 | 152 | 6.4e-09 |

| Protein name | Locus Name | Acc# |
|---|---|---|
| unknown | gp:MLCL622 | Z95398 |

Description

Mycobacterium leprae cosmid L622.

| ORF Name | NTID | AAID | NT Length | AA Length | Score | Probability |
|---|---|---|---|---|---|---|
| 30600453_f3_139 | 1681 | 3601 | 697 | 2094 | 777 | 2.0e-86 |

| Protein name | Locus Name | Acc# |
|---|---|---|
| hypothetical protein b2324 | pir:B65005 | B65005 |

Description

| ORF Name | NTID | AAID | NT Length | AA Length | Score | Probability |
|---|---|---|---|---|---|---|
| 30720027_f3_141 | 1682 | 3602 | 154 | 465 | 382 | 2.9e-35 |

| Protein name | Locus Name | Acc# |
|---|---|---|
| hypothetical protein | gp:PPPAL1 | X74218 |

Description

Pseudomonas putida ruvB, tolQ, tolR, tolA, tolB and oprL genes.

| ORF Name | NTID | AAID | NT Length | AA Length | Score | Probability |
|---|---|---|---|---|---|---|
| 31800280_c1_158 | 1683 | 3603 | 305 | 918 | 649 | 1.5e-63 |

| Protein name | Locus Name | Acc# |
|---|---|---|
| hypothetical protein | gp:PFFC2 | Y11998 |

Description

P.fluorescens FC2.1, FC2.2, FC2.3c, FC2.4 and FC2.5c open readingframes.

| ORF Name | NTID | AAID | NT Length | AA Length | Score | Probability |
|---|---|---|---|---|---|---|
| 31828211_f2_69 | 1684 | 3604 | 1208 | 3627 | 2934 | 0.0 |

| Protein name | Locus Name | Acc# |
|---|---|---|
| proline dehydrogenase | gp:ATU39263 | U39263 |

Description

Agrobacterium tumefaciens plasmid pAtR10 proline dehydrogenase(putA) and Prp (prp) genes, complete cds.

| ORF Name | NTID | AAID | NT Length | AA Length | Score | Probability |
|---|---|---|---|---|---|---|
| 33229667_c3_270 | 1685 | 3605 | 72 | 219 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 33985930_f1_23 | 1686 | 3606 | 288 | 867 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34062503_c1_178 | 1687 | 3607 | 181 | 546 | 224 | 1.6e-18 |

Protein name | Locus Name | Acc#
sp:YHBN_HAEIN | P45074

Description

HYPOTHETICAL PROTEIN HI1149 PRECURSOR

| ORF Name | NTID | AAID | NT Length | AA Length | Score | Probability |
|---|---|---|---|---|---|---|
| 34172883_c1_176 | 1688 | 3608 | 166 | 501 | 296 | 3.8e-26 |

Protein name | Locus Name | Acc#
sp:YJEE_HAEIN | P44492

Description

HYPOTHETICAL PROTEIN HI0065 PRECURSOR

| ORF Name | NTID | AAID | NT Length | AA Length | Score | Probability |
|---|---|---|---|---|---|---|
| 34409658_f2_84 | 1689 | 3609 | 360 | 1083 | 757 | 5.3e-75 |

Protein name | Locus Name | Acc#
carboxyl esterase | pir:S57530 | S57530

Description

| ORF Name | NTID | AAID | NT Length | AA Length | Score | Probability |
|---|---|---|---|---|---|---|
| 35157165_c1_191 | 1690 | 3610 | 204 | 615 | 303 | 2.7e-29 |

Protein name | Locus Name | Acc#
methylated-DNA--protein-cysteine S-methyltransferase, | pir:D64604 | D64604

Description

| ORF Name | NTID | AAID | NT Length | AA Length | Score | Probability |
|---|---|---|---|---|---|---|
| 36072135_c3_295 | 1691 | 3611 | 686 | 2061 | 564 | 1.5e-54 |

Protein name | Locus Name | Acc#
| sp:EX5A_ECOLI |

Description

ALPHA CHAIN)

| ORF Name | NTID | AAID | NT Length | AA Length | Score | Probability |
|---|---|---|---|---|---|---|
| 36112900_f2_91 | 1692 | 3612 | 103 | 312 | 253 | 1.4e-21 |

| Protein name | Locus Name | Acc# |
|---|---|---|
| | gp:ECU24202 | U24202 |

Description

Escherichia coli ECOR 50 (yciD) gene, partial cds, and (yciC),(yciB), (yciA), membrane protein (tonB), (yciI), putative potassiumchannel (kch), and cardiolipin synthase (cls) genes, complete cds.

| ORF Name | NTID | AAID | NT Length | AA Length | Score | Probability |
|---|---|---|---|---|---|---|
| 36129676_c3_252 | 1693 | 3613 | 139 | 420 | 85 | 0.00086 |

| Protein name | Locus Name | Acc# |
|---|---|---|
| hypothetical protein yrvD | pir:G69980 | G69980 |

Description

| ORF Name | NTID | AAID | NT Length | AA Length | Score | Probability |
|---|---|---|---|---|---|---|
| 3915943_c2_226 | 1694 | 3614 | 414 | 1245 | 1163 | 5.0e-118 |

| Protein name | Locus Name | Acc# |
|---|---|---|
| | sp:METZ_PSEAE | P55218 |

Description

O-SUCCINYLHOMOSERINE SULFHYDRYLASE, (OSH SULFHYDRYLASE)

| ORF Name | NTID | AAID | NT Length | AA Length | Score | Probability |
|---|---|---|---|---|---|---|
| 3922193_f2_50 | 1695 | 3615 | 381 | 1146 | 708 | 8.3e-70 |

| Protein name | Locus Name | Acc# |
|---|---|---|
| probable pvdS protein | pir:B70591 | B70591 |

Description

| ORF Name | NTID | AAID | NT Length | AA Length | Score | Probability |
|---|---|---|---|---|---|---|
| 3933437_c2_229 | 1696 | 3616 | 202 | 609 | 387 | 8.6e-36 |

| Protein name | Locus Name | Acc# |
|---|---|---|
| hypothetical protein jhp0867 | pir:B71879 | B71879 |

Description

| ORF Name | NTID | AAID | NT Length | AA Length | Score | Probability |
|---|---|---|---|---|---|---|
| 4016943_f2_67 | 1697 | 3617 | 473 | 1422 | 653 | 5.6e-64 |

| Protein name | | | | Locus Name | | Acc# |
|---|---|---|---|---|---|---|
| | | | | sp:Y4WA_RHISN | | P55679 |

Description

HYPOTHETICAL ZINC PROTEASE Y4WA,

| ORF Name | NTID | AAID | NT Length | AA Length | Score | Probability |
|---|---|---|---|---|---|---|
| 4103293_c1_179 | 1698 | 3618 | 245 | 738 | 822 | 6.9e-82 |

| Protein name | | | | Locus Name | | Acc# |
|---|---|---|---|---|---|---|
| putative ABC transporter ATP-binding protein | | | | gp:AF013987 | | AF013987 |

Description

Vibrio cholerae strain O395 putative ABC transporter ATP-bindingprotein, sigma54 (rpoN), putative sigma54 modulation protein andnitrogen regulatory IIA protein (ptsN) genes, complete cds.

| ORF Name | NTID | AAID | NT Length | AA Length | Score | Probability |
|---|---|---|---|---|---|---|
| 4114702_c1_159 | 1699 | 3619 | 119 | 360 | 194 | 2.4e-15 |

| Protein name | | | | Locus Name | | Acc# |
|---|---|---|---|---|---|---|
| probable dihydroneopterin aldolase, | | | | pir:H65093 | | H65093 |

Description

| ORF Name | NTID | AAID | NT Length | AA Length | Score | Probability |
|---|---|---|---|---|---|---|
| 4489463_f2_90 | 1700 | 3620 | 425 | 1278 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4689693_c3_278 | 1701 | 3621 | 372 | 1119 | 509 | 8.2e-55 |

| Protein name | | | | Locus Name | | Acc# |
|---|---|---|---|---|---|---|
| | | | | sp:MIAA_HAEIN | | P44495 |

Description (IPP TRANSFERASE)

| ORF Name | NTID | AAID | NT Length | AA Length | Score | Probability |
|---|---|---|---|---|---|---|
| 4772050_f2_86 | 1702 | 3622 | 441 | 1326 | 487 | 2.2e-46 |

| Protein name | | | | Locus Name | | Acc# |
|---|---|---|---|---|---|---|
| | | | | sp:DP3E_HAEIN | | P43745 |

Description

DNA POLYMERASE III, EPSILON CHAIN,

| ORF Name | NTID | AAID | NT Length | AA Length | Score | Probability |
|---|---|---|---|---|---|---|
| 4816513_c3_294 | 1703 | 3623 | 1318 | 3957 | 230 | 3.1e-41 |

| Protein name | | | | Locus Name | | Acc# |
|---|---|---|---|---|---|---|
| | | | | sp:EX5B_ECOLI | | P08394 |

Description

BETA CHAIN)

| ORF Name | NTID | AAID | NT Length | AA Length | Score | Probability |
|---|---|---|---|---|---|---|
| 4863458_c2_234 | 1704 | 3624 | 172 | 519 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4876525_c3_293 | 1705 | 3625 | 229 | 690 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4878135_c2_250 | 1706 | 3626 | 350 | 1053 | 810 | 1.3e-80 |

| Protein name | | | | Locus Name | | Acc# |
|---|---|---|---|---|---|---|
| yhdG homolog | | | | gp:AF040378 | | AF040378 |

Description

Serratia marcescens ribosomal protein L11 methyltransferase (prmA)gene, partial cds; and yhdG homolog and small DNA binding proteinFis (fis) genes, complete cds.

| ORF Name | NTID | AAID | NT Length | AA Length | Score | Probability |
|---|---|---|---|---|---|---|
| 4881700_c3_290 | 1707 | 3627 | 479 | 1440 | 381 | 3.7e-35 |

| Protein name | Locus Name | Acc# |
|---|---|---|
| hypothetical protein 5 | pir:T00101 | T00101 |

Description

| ORF Name | NTID | AAID | NT Length | AA Length | Score | Probability |
|---|---|---|---|---|---|---|
| 4884675_c3_283 | 1708 | 3628 | 253 | 762 | 138 | 1.5e-07 |

| Protein name | Locus Name | Acc# |
|---|---|---|
| hypothetical protein | gp:AF031940 | AF031940 |

Description

Sinorhizobium meliloti alcohol dehydrogenase (adhA) gene, completecds.

| ORF Name | NTID | AAID | NT Length | AA Length | Score | Probability |
|---|---|---|---|---|---|---|
| 5086693_c3_277 | 1709 | 3629 | 419 | 1260 | 793 | 8.2e-79 |

| Protein name | Locus Name | Acc# |
|---|---|---|
| hypothetical protein slr0049 | pir:S74347 | S74347 |

Description

| ORF Name | NTID | AAID | NT Length | AA Length | Score | Probability |
|---|---|---|---|---|---|---|
| 5098937_f2_51 | 1710 | 3630 | 543 | 1632 | 520 | 3.1e-53 |

| Protein name | Locus Name | Acc# |
|---|---|---|
| probable exodeoxyribonuclease VII large subunit | pir:C75549 | C75549 |

Description

| ORF Name | NTID | AAID | NT Length | AA Length | Score | Probability |
|---|---|---|---|---|---|---|
| 5110963_c1_162 | 1711 | 3631 | 559 | 1680 | 1056 | 1.1e-106 |

| Protein name | Locus Name | Acc# |
|---|---|---|
| | sp:ODP2_PSEAE | Q59638 |

Description

COMPLEX, (E2)

| ORF_Name | NTID | AAID | NT Length | AA Length | Score | Probability |
|---|---|---|---|---|---|---|
| 5112763_f2_89 | 1712 | 3632 | 277 | 834 | 364 | 2.4e-33 |

| Protein name | | | | Locus Name | | Acc# |
|---|---|---|---|---|---|---|
| | | | | sp:YDGM_HAEIN | | P71396 |

Description

PUTATIVE FERREDOXIN-LIKE PROTEIN HI1684

| ORF_Name | NTID | AAID | NT Length | AA Length | Score | Probability |
|---|---|---|---|---|---|---|
| 5323750_f3_108 | 1713 | 3633 | 104 | 315 | | |

| Protein name | | | | Locus Name | | Acc# |

Description

NO-HIT

| ORF_Name | NTID | AAID | NT Length | AA Length | Score | Probability |
|---|---|---|---|---|---|---|
| 6484691_f1_26 | 1714 | 3634 | 377 | 1134 | 738 | 5.5e-73 |

| Protein name | | | | Locus Name | | Acc# |
|---|---|---|---|---|---|---|
| | | | | sp:CYSP_ECOLI | | P16700 |

Description

THIOSULFATE-BINDING PROTEIN PRECURSOR

| ORF_Name | NTID | AAID | NT Length | AA Length | Score | Probability |
|---|---|---|---|---|---|---|
| 806512_c3_279 | 1715 | 3635 | 137 | 414 | 171 | 1.8e-12 |

| Protein name | | | | Locus Name | | Acc# |
|---|---|---|---|---|---|---|
| polysialic acid capsule expression protein | | | | pir:B70434 | | B70434 |

Description

| ORF_Name | NTID | AAID | NT Length | AA Length | Score | Probability |
|---|---|---|---|---|---|---|
| 11562_c3_7 | 1716 | 3636 | 78 | 237 | | |

| Protein name | | | | Locus Name | | Acc# |

Description

NO-HIT

| ORF Name | NTID | AAID | NT Length | AA Length | Score | Probability |
|---|---|---|---|---|---|---|
| 20395432_c2_6 | 1717 | 3637 | 70 | 213 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 36117135_f1_1 | 1718 | 3638 | 335 | 1008 | 1334 | 3.8e-136 |

| Protein name | | | | | Locus Name | Acc# |
|---|---|---|---|---|---|---|
| malate dehydrogenase | | | | | gp:AF109682 | AF109682 |

Description

Aquaspirillum arcticum malate dehydrogenase (MDH) gene, completecds.

| ORF Name | NTID | AAID | NT Length | AA Length | Score | Probability |
|---|---|---|---|---|---|---|
| 6682962_f1_2 | 1719 | 3639 | 85 | 258 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 13958403_f1_1 | 1720 | 3640 | 399 | 1200 | 1251 | 2.4e-127 |

| Protein name | | | | | Locus Name | Acc# |
|---|---|---|---|---|---|---|
| | | | | | sp:YLIG_ECOLI | P75802 |

Description

HYPOTHETICAL 49.6 KD PROTEIN IN MOEA-DACC INTERGENIC REGION

| ORF Name | NTID | AAID | NT Length | AA Length | Score | Probability |
|---|---|---|---|---|---|---|
| 16506250_f2_4 | 1721 | 3641 | 140 | 423 | 236 | 4.8e-19 |

| Protein name | | | | | Locus Name | Acc# |
|---|---|---|---|---|---|---|
| unknown | | | | | gp:AF026544 | AF026544 |

Description

Ralstonia eutropha phbF and beta-ketothiolase (bktB) genes, complete cds; and unknown genes.

| ORF Name | NTID | AAID | NT Length | AA Length | Score | Probability |
|---|---|---|---|---|---|---|
| 20782550_f3_16 | 1722 | 3642 | 242 | 729 | 933 | 1.2e-93 |

| Protein name | | | | | Locus Name | Acc# |
|---|---|---|---|---|---|---|
| | | | | | sp:MTNG_NEIGO | P08455 |

Description

METHYLTRANSFERASE NGOPII) (M.NGOPII)

| ORF Name | NTID | AAID | NT Length | AA Length | Score | Probability |
|---|---|---|---|---|---|---|
| 24328950_f2_8 | 1723 | 3643 | 153 | 462 | 336 | 2.2e-30 |

| Protein name | | | | | Locus Name | Acc# |
|---|---|---|---|---|---|---|
| | | | | | sp:YRFH_ECOLI | P45802 |

Description

HYPOTHETICAL 15.5 KD PROTEIN IN MRCA-PCKA INTERGENIC REGION (O133)

| ORF Name | NTID | AAID | NT Length | AA Length | Score | Probability |
|---|---|---|---|---|---|---|
| 29859790_c2_32 | 1724 | 3644 | 74 | 225 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 3942592_f2_6 | 1725 | 3645 | 252 | 759 | 741 | 2.6e-73 |

| Protein name | | | | | Locus Name | Acc# |
|---|---|---|---|---|---|---|
| hypothetical protein, 26K | | | | | pir:JC5479 | JC5479 |

Description

| ORF Name | NTID | AAID | NT Length | AA Length | Score | Probability |
|---|---|---|---|---|---|---|
| 4103390_f3_15 | 1726 | 3646 | 85 | 258 | 323 | 5.2e-29 |

| Protein name | | | | | Locus Name | Acc# |
|---|---|---|---|---|---|---|
| | | | | | sp:MTNG_NEIGO | P08455 |

Description

METHYLTRANSFERASE NGOPII) (M.NGOPII)

| ORF Name | NTID | AAID | NT Length | AA Length | Score | Probability |
|---|---|---|---|---|---|---|
| 42837_f1_2 | 1727 | 3647 | 71 | 216 | 170 | 2.5e-12 |

Protein name | Locus Name | Acc#
sp:MTNG_NEIGO | P08455

Description
METHYLTRANSFERASE NGOPII) (M.NGOPII)

| ORF Name | NTID | AAID | NT Length | AA Length | Score | Probability |
|---|---|---|---|---|---|---|
| 4976512_f2_7 | 1728 | 3648 | 518 | 1557 | 1265 | 7.8e-129 |

Protein name: threonine dehydratase, biosynthetic | Locus Name: pir:E75502 | Acc#: E75502

Description

| ORF Name | NTID | AAID | NT Length | AA Length | Score | Probability |
|---|---|---|---|---|---|---|
| 7038307_f1_3 | 1729 | 3649 | 127 | 384 | 228 | 6.1e-19 |

Protein name | Locus Name | Acc#
sp:PA1F_HUMAN

Description
(EC 3.1.3.48) (ADIPOCYTE ACID PHOSPHATASE, ISOZYME ALPHA)

| ORF Name | NTID | AAID | NT Length | AA Length | Score | Probability |
|---|---|---|---|---|---|---|
| 30175950_f1_1 | 1730 | 3650 | 77 | 234 | 292 | 5.8e-25 |

Protein name | Locus Name | Acc#
sp:THIC_BACSU

Description
THIAMINE BIOSYNTHESIS PROTEIN THIC

| ORF Name | NTID | AAID | NT Length | AA Length | Score | Probability |
|---|---|---|---|---|---|---|
| 4470181_f3_5 | 1731 | 3651 | 156 | 471 | 635 | 4.5e-62 |

Protein name | Locus Name | Acc#
sp:THIC_ECOLI | P30136

Description
THIAMINE BIOSYNTHESIS PROTEIN THIC

| ORF_Name | NTID | AAID | NT Length | AA Length | Score | Probability |
|---|---|---|---|---|---|---|
| 7119001_f2_4 | 1732 | 3652 | 73 | 222 | 85 | 0.013 |

| Protein name | | | | Locus Name | | Acc# |
|---|---|---|---|---|---|---|
| | | | | sp:YA51_HAEIN | | |

Description

HYPOTHETICAL ABC TRANSPORTER ATP-BINDING PROTEIN HI1051

| ORF_Name | NTID | AAID | NT Length | AA Length | Score | Probability |
|---|---|---|---|---|---|---|
| 24254702_f3_3 | 1733 | 3653 | 252 | 759 | 253 | 1.4e-21 |

| Protein name | | | | Locus Name | | Acc# |
|---|---|---|---|---|---|---|
| | | | | sp:YIAT_ECOLI | | P37681 |

Description

HYPOTHETICAL 27.4 KD PROTEIN IN AVTA-SELB INTERGENIC REGION PRECURSOR

| ORF_Name | NTID | AAID | NT Length | AA Length | Score | Probability |
|---|---|---|---|---|---|---|
| 25787500_c3_6 | 1734 | 3654 | 278 | 837 | 503 | 4.4e-48 |

| Protein name | | | | Locus Name | | Acc# |
|---|---|---|---|---|---|---|
| | | | | sp:BFRA_NEIGO | | P72080 |

Description

BACTERIOFERRITIN A

| ORF_Name | NTID | AAID | NT Length | AA Length | Score | Probability |
|---|---|---|---|---|---|---|
| 5133575_c3_7 | 1735 | 3655 | 162 | 489 | 489 | 1.3e-46 |

| Protein name | | | | Locus Name | | Acc# |
|---|---|---|---|---|---|---|
| | | | | sp:BFRB_NEIGO | | P77914 |

Description

BACTERIOFERRITIN B (BFR A) (BFR B)

| ORF_Name | NTID | AAID | NT Length | AA Length | Score | Probability |
|---|---|---|---|---|---|---|
| 21984375_c1_10 | 1736 | 3656 | 473 | 1422 | 708 | 8.3e-70 |

Protein name: (blank) Locus Name: sp:AIP2_YEAST Acc#: P46681

Description: ACTIN INTERACTING PROTEIN 2

| ORF_Name | NTID | AAID | NT Length | AA Length | Score | Probability |
|---|---|---|---|---|---|---|
| 23535910_f1_2 | 1737 | 3657 | 492 | 1479 | 1489 | 1.4e-152 |

Protein name: (blank) Locus Name: sp:YEGQ_ECOLI Acc#: (blank)

Description: PUTATIVE PROTEASE YEGQ,

| ORF_Name | NTID | AAID | NT Length | AA Length | Score | Probability |
|---|---|---|---|---|---|---|
| 25677176_f3_6 | 1738 | 3658 | 205 | 615 | 516 | 1.8e-49 |

Protein name: site-specific DNA-methyltransferase (cytosine-specific), HP1121   Locus Name: pir:A64660   Acc#: A64660

Description:

| ORF_Name | NTID | AAID | NT Length | AA Length | Score | Probability |
|---|---|---|---|---|---|---|
| 3926262_c2_13 | 1739 | 3659 | 225 | 678 | 134 | 8.6e-08 |

Protein name: TerZ   Locus Name: gp:AF168355   Acc#: AF168355

Description: Proteus mirabilis tellurite resistance locus, complete sequence; and unknown gene.

| ORF Name | NTID | AAID | NT Length | AA Length | Score | Probability |
|---|---|---|---|---|---|---|
| 3946943_f1_1 | 1740 | 3660 | 510 | 1533 | 808 | 2.1e-80 |

| Protein name | Locus Name | Acc# |
|---|---|---|
| OprM | gp:AB011381 | AB011381 |

Description

Pseudomonas aeruginosa gene for OprM, complete cds.

| ORF Name | NTID | AAID | NT Length | AA Length | Score | Probability |
|---|---|---|---|---|---|---|
| 2110657_c2_3 | 1741 | 3661 | 221 | 663 | 570 | 3.5e-55 |

| Protein name | Locus Name | Acc# |
|---|---|---|
|  | sp:Y926_SYNY3 | P72872 |

Description

HYPOTHETICAL 37.9 KD PROTEIN SLL0926

| ORF Name | NTID | AAID | NT Length | AA Length | Score | Probability |
|---|---|---|---|---|---|---|
| 16040887_f3_11 | 1742 | 3662 | 504 | 1512 | 2557 | 9.6e-266 |

| Protein name | Locus Name | Acc# |
|---|---|---|
| unknown | gp:AF039312 | AF039312 |

Description

Moraxella catarrhalis strain 4223 transferrin binding protein A(tbpA) and transferrin binding protein B (tbpB) genes, completecds; and unknown gene.

| ORF Name | NTID | AAID | NT Length | AA Length | Score | Probability |
|---|---|---|---|---|---|---|
| 4016563_c1_13 | 1743 | 3663 | 108 | 327 | 92 | 0.00021 |

| Protein name | Locus Name | Acc# |
|---|---|---|
| conserved hypothetical protein ykoJ | pir:F69859 | F69859 |

Description

| ORF Name | NTID | AAID | NT Length | AA Length | Score | Probability |
|---|---|---|---|---|---|---|
| 4484567_f1_1 | 1744 | 3664 | 899 | 2700 | 4565 | 0.0 |

| Protein name | Locus Name | Acc# |
|---|---|---|
| transferrin binding protein A | gp:AF039312 | AF039312 |

Description

Moraxella catarrhalis strain 4223 transferrin binding protein A(tbpA) and transferrin binding protein B (tbpB) genes, completecds; and unknown gene.

| ORF Name | NTID | AAID | NT Length | AA Length | Score | Probability |
|---|---|---|---|---|---|---|
| 4775207_f2_9 | 1745 | 3665 | 173 | 522 | 728 | 1.6e-71 |

| Protein name | Locus Name | Acc# |
|---|---|---|
| transferrin binding protein A | gp:AF039315 | AF039315 |

Description

Moraxella catarrhalis strain Q8 transferrin binding protein A(tbpA) and transferrin binding protein B (tbpB) genes, completecds; and unknown gene.

| ORF Name | NTID | AAID | NT Length | AA Length | Score | Probability |
|---|---|---|---|---|---|---|
| 33380275_f1_2 | 1746 | 3666 | 65 | 198 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 35361043_c1_7 | 1747 | 3667 | 62 | 189 | 93 | 0.00048 |

| Protein name | Locus Name | Acc# |
|---|---|---|
| phosphate-binding protein, phosphate-repressible | pir:I64120 | I64120 |

Description

| ORF Name | NTID | AAID | NT Length | AA Length | Score | Probability |
|---|---|---|---|---|---|---|
| 36501561_c3_9 | 1748 | 3668 | 301 | 903 | 842 | 5.2e-84 |

| Protein name | | | | Locus Name | | Acc# |
|---|---|---|---|---|---|---|
| | | | | sp:PSTC_HAEIN | | P45191 |

Description

PHOSPHATE TRANSPORT SYSTEM PERMEASE PROTEIN PSTC

| ORF Name | NTID | AAID | NT Length | AA Length | Score | Probability |
|---|---|---|---|---|---|---|
| 5960433_c1_8 | 1749 | 3669 | 60 | 183 | | |

| Protein name | | | | Locus Name | | Acc# |

Description

NO-HIT

| ORF Name | NTID | AAID | NT Length | AA Length | Score | Probability |
|---|---|---|---|---|---|---|
| 4429510_f1_1 | 1750 | 3670 | 477 | 1434 | 1328 | 1.7e-135 |

| Protein name | | | | Locus Name | | Acc# |
|---|---|---|---|---|---|---|
| | | | | sp:MANB_SALMO | | Q01411 |

Description

PHOSPHOMANNOMUTASE, (PMM)

| ORF Name | NTID | AAID | NT Length | AA Length | Score | Probability |
|---|---|---|---|---|---|---|
| 4459376_c2_15 | 1751 | 3671 | 294 | 885 | 575 | 1.0e-55 |

| Protein name | | | | Locus Name | | Acc# |
|---|---|---|---|---|---|---|
| conserved hypothetical protein | | | | pir:D75311 | | D75311 |

Description

| ORF Name | NTID | AAID | NT Length | AA Length | Score | Probability |
|---|---|---|---|---|---|---|
| 10429517_c1_34 | 1752 | 3672 | 413 | 1242 | 573 | 1.7e-55 |

| Protein name | | | | Locus Name | | Acc# |
|---|---|---|---|---|---|---|
| conserved hypothetical protein | | | | pir:A75525 | | A75525 |

Description

| ORF Name | NTID | AAID | NT Length | AA Length | Score | Probability |
|---|---|---|---|---|---|---|
| 12384625_c3_48 | 1753 | 3673 | 362 | 1089 | 386 | 1.1e-35 |

| Protein name | | | | Locus Name | | Acc# |
|---|---|---|---|---|---|---|
| | | | | sp:YGBO_ECOLI | | Q57261 |

Description

HYPOTHETICAL 39.1 KD PROTEIN IN SURE-CYSC INTERGENIC REGION

| ORF Name | NTID | AAID | NT Length | AA Length | Score | Probability |
|---|---|---|---|---|---|---|
| 15915625_f2_13 | 1754 | 3674 | 170 | 513 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 21673425_f2_12 | 1755 | 3675 | 447 | 1344 | 507 | 1.7e-48 |

| Protein name | | | | Locus Name | | Acc# |
|---|---|---|---|---|---|---|
| | | | | sp:UBIH_ECOLI | | P25534 |

Description

UBIH PROTEIN,

| ORF Name | NTID | AAID | NT Length | AA Length | Score | Probability |
|---|---|---|---|---|---|---|
| 2195931_c1_29 | 1756 | 3676 | 69 | 210 | 93 | 0.0018 |

| Protein name | | Locus Name | | Acc# |
|---|---|---|---|---|
| conserved hypothetical protein aq_2107 | | pir:F70480 | | F70480 |

Description

| ORF Name | NTID | AAID | NT Length | AA Length | Score | Probability |
|---|---|---|---|---|---|---|
| 22355001_f3_23 | 1757 | 3677 | 73 | 222 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23954035_c3_50 | 1758 | 3678 | 175 | 528 | 119 | 3.8e-05 |

| Protein name | Locus Name | Acc# |
|---|---|---|
| conserved hypothetical protein aq_2107 | pir:F70480 | F70480 |

Description

| ORF Name | NTID | AAID | NT Length | AA Length | Score | Probability |
|---|---|---|---|---|---|---|
| 25665885_c2_36 | 1759 | 3679 | 241 | 726 | 389 | 6.3e-45 |

| Protein name | Locus Name | Acc# |
|---|---|---|
|  | sp:MIAE_SALTY | Q08015 |

Description

TRNA-(MS[2

| ORF Name | NTID | AAID | NT Length | AA Length | Score | Probability |
|---|---|---|---|---|---|---|
| 30100880_c3_51 | 1760 | 3680 | 201 | 606 | 186 | 1.7e-14 |

| Protein name | Locus Name | Acc# |
|---|---|---|
| hypothetical protein aq_2108 | pir:G70480 | G70480 |

Description

| ORF Name | NTID | AAID | NT Length | AA Length | Score | Probability |
|---|---|---|---|---|---|---|
| 3994052_f1_3 | 1761 | 3681 | 192 | 579 | 682 | 4.7e-67 |

| Protein name | Locus Name | Acc# |
|---|---|---|
| probable dctp deaminase | pir:B71565 | B71565 |

Description

| ORF Name | NTID | AAID | NT Length | AA Length | Score | Probability |
|---|---|---|---|---|---|---|
| 4109790_c1_28 | 1762 | 3682 | 155 | 468 | 176 | 2.2e-12 |

| Protein name | Locus Name | Acc# |
|---|---|---|
| conserved hypothetical protein aq_2107 | pir:F70480 | F70480 |

Description

| ORF Name | NTID | AAID | NT Length | AA Length | Score | Probability |
|---|---|---|---|---|---|---|
| 4319837_c2_37 | 1763 | 3683 | 493 | 1482 | 466 | 3.7e-44 |

| Protein name | Locus Name | Acc# |
|---|---|---|
| | sp:YJEF_ECOLI | P31806 |

Description

HYPOTHETICAL 54.7 KD PROTEIN IN PSD-AMIB INTERGENIC REGION (URF1)

| ORF Name | NTID | AAID | NT Length | AA Length | Score | Probability |
|---|---|---|---|---|---|---|
| 4345068_f3_21 | 1764 | 3684 | 128 | 387 | 177 | 1.5e-13 |

| Protein name | Locus Name | Acc# |
|---|---|---|
| | sp:YOHJ_ECOLI | P33372 |

Description

HYPOTHETICAL 14.6 KD PROTEIN IN PBPG-CDD INTERGENIC REGION

| ORF Name | NTID | AAID | NT Length | AA Length | Score | Probability |
|---|---|---|---|---|---|---|
| 4790637_f3_22 | 1765 | 3685 | 183 | 552 | 295 | 4.8e-26 |

| Protein name | Locus Name | Acc# |
|---|---|---|
| | sp:YOHK_HAEIN | P45146 |

Description

HYPOTHETICAL PROTEIN HI1298

| ORF Name | NTID | AAID | NT Length | AA Length | Score | Probability |
|---|---|---|---|---|---|---|
| 5900203_f1_1 | 1766 | 3686 | 689 | 2070 | 1609 | 2.8e-165 |

| Protein name | Locus Name | Acc# |
|---|---|---|
| | sp:REP_ECOLI | P09980 |

Description

ATP-DEPENDENT DNA HELICASE REP,

| ORF Name | NTID | AAID | NT Length | AA Length | Score | Probability |
|---|---|---|---|---|---|---|
| 6658527_c2_39 | 1767 | 3687 | 184 | 555 | 228 | 5.6e-18 |

| Protein name | Locus Name | Acc# |
|---|---|---|
| conserved hypothetical protein aq_2107 | pir:F70480 | F70480 |

Description

| ORF Name | NTID | AAID | NT Length | AA Length | Score | Probability |
|---|---|---|---|---|---|---|
| 7226518_f2_17 | 1768 | 3688 | 102 | 309 | 112 | 1.2e-06 |

| Protein name | Locus Name | Acc# |
|---|---|---|
| hypothetical protein | gp:POL010393 | AJ010393 |

Description

Pseudomonas oleovorans phaI and phaF genes, and ORF1, ORF2(partial) and ORF3.

| ORF Name | NTID | AAID | NT Length | AA Length | Score | Probability |
|---|---|---|---|---|---|---|
| 22897332_c2_15 | 1769 | 3689 | 153 | 462 | 338 | 1.3e-30 |

| Protein name | Locus Name | Acc# |
|---|---|---|
| | sp:FMAH_BACNO | P04953 |

Description (SUBUNITS PILIN)

| ORF Name | NTID | AAID | NT Length | AA Length | Score | Probability |
|---|---|---|---|---|---|---|
| 36210875_f2_3 | 1770 | 3690 | 883 | 2652 | 3272 | 0.0 |

| Protein name | Locus Name | Acc# |
|---|---|---|
| | sp:ACO2_ECOLI | |

Description (ACONITASE 2)

| ORF Name | NTID | AAID | NT Length | AA Length | Score | Probability |
|---|---|---|---|---|---|---|
| 14853143_c1_9 | 1771 | 3691 | 703 | 2112 | 1460 | 1.7e-149 |

| Protein name | Locus Name | Acc# |
|---|---|---|
| | sp:YHGF_NEIME | Q51152 |

Description

HYPOTHETICAL 83.1 KD PROTEIN IN REGION E

| ORF Name | NTID | AAID | NT Length | AA Length | Score | Probability |
|---|---|---|---|---|---|---|
| 16050817_f1_1 | 1772 | 3692 | 225 | 678 | 203 | 2.7e-16 |

| Protein name | Locus Name | Acc# |
|---|---|---|
| hypothetical protein sll0788 | pir:S77018 | S77018 |

Description

| ORF Name | NTID | AAID | NT Length | AA Length | Score | Probability |
|---|---|---|---|---|---|---|
| 10175877_f3_73 | 1773 | 3693 | 264 | 795 | 124 | 2.2e-11 |

| Protein name | Locus Name | Acc# |
|---|---|---|
| DnrD protein | gp:PST131715 | AJ131715 |

Description

Pseudomonas stutzeri dnrD gene and ORF194 (partial) and ORF63(partial).

| ORF Name | NTID | AAID | NT Length | AA Length | Score | Probability |
|---|---|---|---|---|---|---|
| 10195250_f2_49 | 1774 | 3694 | 81 | 246 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 10546930_f1_18 | 1775 | 3695 | 239 | 720 | 576 | 8.1e-56 |

| Protein name | Locus Name | Acc# |
|---|---|---|
| | sp:MODB_HAEIN | P45322 |

Description

MOLYBDENUM TRANSPORT SYSTEM PERMEASE PROTEIN MODB

| ORF Name | NTID | AAID | NT Length | AA Length | Score | Probability |
|---|---|---|---|---|---|---|
| 11113152_f3_70 | 1776 | 3696 | 142 | 429 | 205 | 1.7e-16 |

| Protein name | Locus Name | Acc# |
|---|---|---|
| hypothetical protein APE1291 | pir:D72603 | D72603 |

Description

| ORF Name | NTID | AAID | NT Length | AA Length | Score | Probability |
|---|---|---|---|---|---|---|
| 12367711_f3_63 | 1777 | 3697 | 259 | 780 | 438 | 3.4e-41 |

| Protein name | Locus Name | Acc# |
|---|---|---|
| | sp:MODD_AZOVI | P37732 |

Description

MOLYBDENUM TRANSPORT ATP-BINDING PROTEIN MODD

450

| ORF Name | NTID | AAID | NT Length | AA Length | Score | Probability |
|---|---|---|---|---|---|---|
| 15710327_c1_84 | 1778 | 3698 | 266 | 801 | 427 | 5.0e-40 |

| Protein name | Locus Name | Acc# |
|---|---|---|
| putative chaperone | gp:PSNARXL | Y15252 |

Description

Pseudomonas aeruginosa narX, narL, narK1, narK2, narG, narH, narJ, narI, nifM, moaA genes.

| ORF Name | NTID | AAID | NT Length | AA Length | Score | Probability |
|---|---|---|---|---|---|---|
| 15781576_c2_103 | 1779 | 3699 | 223 | 672 | 594 | 1.0e-57 |

| Protein name | Locus Name | Acc# |
|---|---|---|
|  | sp:YADF_ECOLI |  |

Description

HYPOTHETICAL 25.1 KD PROTEIN IN HPT-PAND INTERGENIC REGION

| ORF Name | NTID | AAID | NT Length | AA Length | Score | Probability |
|---|---|---|---|---|---|---|
| 19735188_f3_58 | 1780 | 3700 | 677 | 2034 | 484 | 3.8e-70 |

| Protein name | Locus Name | Acc# |
|---|---|---|
| nitrate/nitrite sensory protein | gp:PSNARXL | Y15252 |

Description

Pseudomonas aeruginosa narX, narL, narK1, narK2, narG, narH, narJ, narI, nifM, moaA genes.

| ORF Name | NTID | AAID | NT Length | AA Length | Score | Probability |
|---|---|---|---|---|---|---|
| 19806552_f2_31 | 1781 | 3701 | 187 | 564 | 134 | 5.5e-08 |

| Protein name | Locus Name | Acc# |
|---|---|---|
| Notch homolog | gp:AF033013 | AF033013 |

Description

Bombyx mori Notch homolog mRNA, partial cds.

| ORF Name | NTID | AAID | NT Length | AA Length | Score | Probability |
|---|---|---|---|---|---|---|
| 19806552_f3_51 | 1782 | 3702 | 180 | 543 | 142 | 1.3e-09 |

| Protein name | | | | Locus Name | | Acc# |
|---|---|---|---|---|---|---|
| Notch homolog | | | | gp:AF033013 | | AF033013 |

Description

Bombyx mori Notch homolog mRNA, partial cds.

| ORF Name | NTID | AAID | NT Length | AA Length | Score | Probability |
|---|---|---|---|---|---|---|
| 20423500_f2_33 | 1783 | 3703 | 269 | 810 | 420 | 2.7e-39 |

| Protein name | | | | Locus Name | | Acc# |
|---|---|---|---|---|---|---|
| | | | | sp:MOEB_SALTY | | Q56067 |

Description

MOLYBDOPTERIN BIOSYNTHESIS MOEB PROTEIN

| ORF Name | NTID | AAID | NT Length | AA Length | Score | Probability |
|---|---|---|---|---|---|---|
| 20587686_f1_8 | 1784 | 3704 | 139 | 420 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 20876387_f1_13 | 1785 | 3705 | 234 | 705 | 247 | 5.9e-21 |

| Protein name | | | | Locus Name | | Acc# |
|---|---|---|---|---|---|---|
| | | | | sp:YIIM_ECOLI | | P32157 |

Description

HYPOTHETICAL 26.6 KD PROTEIN IN KDGT-CPXA INTERGENIC REGION (O234)

| ORF Name | NTID | AAID | NT Length | AA Length | Score | Probability |
|---|---|---|---|---|---|---|
| 21485962_c2_129 | 1786 | 3706 | 63 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 21673452_c3_141 | 1787 | 3707 | 448 | 1347 | 1455 | 5.8e-149 |

| Protein name | Locus Name | Acc# |
|---|---|---|
| nitrate extrusion protein | gp:PSNARXL | Y15252 |

Description

Pseudomonas aeruginosa narX, narL, narK1, narK2, narG, narH, narJ, narI, nifM, moaA genes.

| ORF Name | NTID | AAID | NT Length | AA Length | Score | Probability |
|---|---|---|---|---|---|---|
| 21688888_c1_76 | 1788 | 3708 | 332 | 999 | 1035 | 1.8e-104 |

| Protein name | Locus Name | Acc# |
|---|---|---|
|  | sp:THII_SALTY |  |

Description

THIAMINE BIOSYNTHESIS PROTEIN THII

| ORF Name | NTID | AAID | NT Length | AA Length | Score | Probability |
|---|---|---|---|---|---|---|
| 22000717_f1_19 | 1789 | 3709 | 145 | 438 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22378418_f1_17 | 1790 | 3710 | 283 | 852 | 502 | 5.6e-48 |

| Protein name | Locus Name | Acc# |
|---|---|---|
|  | sp:MODA_HAEIN | P45323 |

Description

MOLYBDATE-BINDING PERIPLASMIC PROTEIN PRECURSOR

| ORF Name | NTID | AAID | NT Length | AA Length | Score | Probability |
|---|---|---|---|---|---|---|
| 22554031_f3_60 | 1791 | 3711 | 194 | 585 | 499 | 1.2e-47 |

| Protein name | Locus Name | Acc# |
|---|---|---|
|  | sp:MOAB_ECOLI | P30746 |

Description

MOLYBDENUM COFACTOR BIOSYNTHESIS PROTEIN B

453

| ORF Name | NTID | AAID | NT Length | AA Length | Score | Probability |
|---|---|---|---|---|---|---|
| 24068812_f1_12 | 1792 | 3712 | 258 | 777 | 561 | 3.1e-54 |

| Protein name | Locus Name | Acc# |
|---|---|---|
| nitrate/nitrite regulatory protein | gp:PSNARXL | Y15252 |

Description

Pseudomonas aeruginosa narX, narL, narK1, narK2, narG, narH, narJ, narI, nifM, moaA genes.

| ORF Name | NTID | AAID | NT Length | AA Length | Score | Probability |
|---|---|---|---|---|---|---|
| 24423375_f1_5 | 1793 | 3713 | 71 | 216 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24423375_f2_32 | 1794 | 3714 | 66 | 201 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24651536_f1_16 | 1795 | 3715 | 200 | 603 | 310 | 1.2e-27 |

| Protein name | Locus Name | Acc# |
|---|---|---|
| | sp:Y903_SYNY3 | Q55371 |

Description

HYPOTHETICAL 16.5 KD PROTEIN SLR0903

| ORF Name | NTID | AAID | NT Length | AA Length | Score | Probability |
|---|---|---|---|---|---|---|
| 25507260_f1_9 | 1796 | 3716 | 338 | 1017 | 82 | 0.048 |

| Protein name | Locus Name | Acc# |
|---|---|---|
| MHC class I antigen | pir:I57454 | I57454 |

Description

| ORF_Name | NTID | AAID | NT Length | AA Length | Score | Probability |
|---|---|---|---|---|---|---|
| 275283_f1_15 | 1797 | 3717 | 196 | 591 | 142 | 7.9e-10 |

| Protein name | Locus Name | Acc# |
|---|---|---|
| hypothetical protein Rv2453c | pir:D70864 | D70864 |

Description

| ORF_Name | NTID | AAID | NT Length | AA Length | Score | Probability |
|---|---|---|---|---|---|---|
| 2853437_f1_11 | 1798 | 3718 | 66 | 201 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 29432768_c2_123 | 1799 | 3719 | 91 | 276 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 30509827_f1_7 | 1800 | 3720 | 134 | 405 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 31453162_c2_128 | 1801 | 3721 | 77 | 234 | 197 | 1.2e-15 |

| Protein name | Locus Name | Acc# |
|---|---|---|
| hypothetical protein | gp:AF213822 | AF213822 |

Description

Zymomonas mobilis strain ZM4 fosmid clone 42B3, complete sequence.

| ORF Name | NTID | AAID | NT Length | AA Length | Score | Probability |
|---|---|---|---|---|---|---|
| 33331633_c1_83 | 1802 | 3722 | 521 | 1566 | 2362 | 4.4e-245 |

| Protein name | Locus Name | Acc# |
|---|---|---|
| respiratory nitrate reductase beta subunit | gp:PSNARXL | Y15252 |

Description

Pseudomonas aeruginosa narX, narL, narK1, narK2, narG, narH, narJ, narI, nifM, moaA genes.

| ORF Name | NTID | AAID | NT Length | AA Length | Score | Probability |
|---|---|---|---|---|---|---|
| 33758515_f1_6 | 1803 | 3723 | 174 | 525 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 36351552_f3_61 | 1804 | 3724 | 91 | 276 | 145 | 3.8e-10 |

| Protein name | Locus Name | Acc# |
|---|---|---|
| hypothetical protein ssr1527 | pir:S75710 | |

Description

| ORF Name | NTID | AAID | NT Length | AA Length | Score | Probability |
|---|---|---|---|---|---|---|
| 36371012_c2_102 | 1805 | 3725 | 60 | 183 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3906555_f2_36 | 1806 | 3726 | 172 | 519 | 296 | 3.8e-26 |

| Protein name | Locus Name | Acc# |
|---|---|---|
| probable molybdenum-pterin-binding-protein | pir:S57954 | S57954 |

Description

| ORF Name | NTID | AAID | NT Length | AA Length | Score | Probability |
|---|---|---|---|---|---|---|
| 4011062_c1_91 | 1807 | 3727 | 427 | 1284 | 1152 | 7.4e-117 |

Protein name: nitrate extrusion protein
Locus Name: gp:PSNARXL
Acc#: Y15252

Description: Pseudomonas aeruginosa narX, narL, narK1, narK2, narG, narH, narJ, narI, nifM, moaA genes.

| ORF Name | NTID | AAID | NT Length | AA Length | Score | Probability |
|---|---|---|---|---|---|---|
| 4070308_c3_134 | 1808 | 3728 | 442 | 1329 | 676 | 2.0e-66 |

Protein name:
Locus Name: sp:MOEA_HAEIN
Acc#: P45210

Description: MOLYBDOPTERIN BIOSYNTHESIS MOEA PROTEIN

| ORF Name | NTID | AAID | NT Length | AA Length | Score | Probability |
|---|---|---|---|---|---|---|
| 4344003_f3_59 | 1809 | 3729 | 364 | 1095 | 737 | 7.0e-73 |

Protein name:
Locus Name: sp:MOAA_HAEIN
Acc#: P45311

Description: MOLYBDENUM COFACTOR BIOSYNTHESIS PROTEIN A

| ORF Name | NTID | AAID | NT Length | AA Length | Score | Probability |
|---|---|---|---|---|---|---|
| 4788876_c3_133 | 1810 | 3730 | 248 | 747 | 704 | 2.2e-69 |

Protein name: respiratory nitrate reductase gamma subunit
Locus Name: gp:PSNARXL
Acc#: Y15252

Description: Pseudomonas aeruginosa narX, narL, narK1, narK2, narG, narH, narJ, narI, nifM, moaA genes.

| ORF Name | NTID | AAID | NT Length | AA Length | Score | Probability |
|---|---|---|---|---|---|---|
| 4797093_f3_52 | 1811 | 3731 | 157 | 474 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4806502_c2_127 | 1812 | 3732 | 102 | 309 | 117 | 3.5e-07 |

| Protein name | Locus Name | Acc# |
|---|---|---|
| negative regulator of translation | gp:AF213822 | AF213822 |

Description

Zymomonas mobilis strain ZM4 fosmid clone 42B3, complete sequence.

| ORF Name | NTID | AAID | NT Length | AA Length | Score | Probability |
|---|---|---|---|---|---|---|
| 4886251_f2_35 | 1813 | 3733 | 168 | 507 | 354 | 2.7e-32 |

| Protein name | Locus Name | Acc# |
|---|---|---|
| molybdenum cofactor biosynthesis protein C | gp:AF108766 | AF108766 |

Description

Rhodobacter sphaeroides AsmA (asmA) gene, partial cds; YbaU (ybaU), anthranilate synthase component I (trpE), YibQ (yibQ), anthranilatesynthase component II (trpG), anthranilatephosphoribosyltransferase (trpD), indole-3-glycerol phosphatesynthase (trpC), molybdenum cofactor biosynthesis protein C (moaC), molybdenum cofactor biosynthesis protein A (moeA), LexA

| ORF Name | NTID | AAID | NT Length | AA Length | Score | Probability |
|---|---|---|---|---|---|---|
| 4897576_c3_147 | 1814 | 3734 | 69 | 210 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5282812_f3_56 | 1815 | 3735 | 65 | 198 | 52 | 0.032 |

| Protein name | | Locus Name | Acc# |
|---|---|---|---|
| MDP1 | | gp:AB013441 | AB013441 |

Description

Mycobacterium bovis gene for MDP1, complete cds.

| ORF Name | NTID | AAID | NT Length | AA Length | Score | Probability |
|---|---|---|---|---|---|---|
| 630053_f2_47 | 1816 | 3736 | 385 | 1158 | 320 | 1.1e-28 |

| Protein name | | Locus Name | Acc# |
|---|---|---|---|
| ORF396 protein | | gp:PSDNGC | Z73914 |

Description

Pseudomonas stutzeri orf175 gene.

| ORF Name | NTID | AAID | NT Length | AA Length | Score | Probability |
|---|---|---|---|---|---|---|
| 635903_f1_10 | 1817 | 3737 | 75 | 228 | | |

| Protein name | | Locus Name | Acc# |
|---|---|---|---|

Description

NO-HIT

| ORF Name | NTID | AAID | NT Length | AA Length | Score | Probability |
|---|---|---|---|---|---|---|
| 7064692_c1_86 | 1818 | 3738 | 369 | 1110 | 415 | 9.3e-39 |

| Protein name | | Locus Name | Acc# |
|---|---|---|---|
| NifM protein | | gp:PSNARXL | Y15252 |

Description

Pseudomonas aeruginosa narX, narL, narK1, narK2, narG, narH, narJ, narI, nifM, moaA genes.

| ORF Name | NTID | AAID | NT Length | AA Length | Score | Probability |
|---|---|---|---|---|---|---|
| 7225637_f3_50 | 1819 | 3739 | 1739 | 5220 | 540 | 6.2e-50 |

| Protein name | | Locus Name | Acc# |
|---|---|---|---|
| filamentous hemagglutinin-like protein PspA:probable secreted protein | | pir:T09083 | T09083 |

Description

459

| ORF_Name | NTID | AAID | NT Length | AA Length | Score | Probability |
|---|---|---|---|---|---|---|
| 9814751_c3_131 | 1820 | 3740 | 1271 | 3816 | 5075 | 0.0 |

| Protein name | Locus_Name | Acc# |
|---|---|---|
| alpha-subunit of nitrate reductase | gp:PFU71398 | U71398 |

Description

Pseudomonas fluorescens nitrate reductase alpha-subunit (narG) andbeta-subunit (narH) genes, partial cds.

| ORF_Name | NTID | AAID | NT Length | AA Length | Score | Probability |
|---|---|---|---|---|---|---|
| 1176576_f3_28 | 1821 | 3741 | 157 | 474 | 314 | 4.7e-28 |

| Protein name | Locus_Name | Acc# |
|---|---|---|
|  | sp:YAII_ECOLI |  |

Description

HYPOTHETICAL 17.0 KD PROTEIN IN PROC-AROL INTERGENIC REGION

| ORF_Name | NTID | AAID | NT Length | AA Length | Score | Probability |
|---|---|---|---|---|---|---|
| 14647507_f2_20 | 1822 | 3742 | 405 | 1218 | 386 | 1.1e-35 |

| Protein name | Locus_Name | Acc# |
|---|---|---|
| conserved hypothetical protein aq_740 | pir:A70365 | A70365 |

Description

| ORF_Name | NTID | AAID | NT Length | AA Length | Score | Probability |
|---|---|---|---|---|---|---|
| 23443752_f3_23 | 1823 | 3743 | 661 | 1986 | 298 | 3.4e-23 |

| Protein name | Locus_Name | Acc# |
|---|---|---|
|  | sp:YTRP_PSEPU | P40604 |

Description

HYPOTHETICAL 62.7 KD PROTEIN IN TRPE-TRPG INTERGENIC REGION PRECURSOR

| ORF_Name | NTID | AAID | NT Length | AA Length | Score | Probability |
|---|---|---|---|---|---|---|
| 23610636_c3_58 | 1824 | 3744 | 274 | 825 | 755 | 8.7e-75 |

| Protein name | Locus_Name | Acc# |
|---|---|---|
|  | sp:YQCB_HAEIN | P44197 |

Description

HYPOTHETICAL PROTEIN HI1435

460

| ORF Name | NTID | AAID | NT Length | AA Length | Score | Probability |
|---|---|---|---|---|---|---|
| 24644035_c2_45 | 1825 | 3745 | 219 | 660 | 255 | 8.4e-22 |

| Protein name | Locus Name | Acc# |
|---|---|---|
| probable citrate lyase beta chain | pir:T35062 | T35062 |

Description

---

| ORF Name | NTID | AAID | NT Length | AA Length | Score | Probability |
|---|---|---|---|---|---|---|
| 250251_f2_18 | 1826 | 3746 | 192 | 579 | 525 | 2.0e-50 |

| Protein name | Locus Name | Acc# |
|---|---|---|
| | sp:PUR6_HAEIN | P43849 |

Description (EC 4.1.1.21) (AIR CARBOXYLASE) (AIRC)

---

| ORF Name | NTID | AAID | NT Length | AA Length | Score | Probability |
|---|---|---|---|---|---|---|
| 25485763_f1_1 | 1827 | 3747 | 89 | 270 | | |

| Protein name | Locus Name | Acc# |
|---|---|---|
| | | |

Description

NO-HIT

---

| ORF Name | NTID | AAID | NT Length | AA Length | Score | Probability |
|---|---|---|---|---|---|---|
| 25510974_c1_34 | 1828 | 3748 | 185 | 558 | 331 | 7.4e-30 |

| Protein name | Locus Name | Acc# |
|---|---|---|
| | sp:YBEQ_ECOLI | P77234 |

Description

HYPOTHETICAL 37.3 KD PROTEIN IN LEUS-GLTL INTERGENIC REGION

---

| ORF Name | NTID | AAID | NT Length | AA Length | Score | Probability |
|---|---|---|---|---|---|---|
| 29304668_f3_30 | 1829 | 3749 | 302 | 909 | 556 | 1.1e-53 |

| Protein name | Locus Name | Acc# |
|---|---|---|
| | sp:SYK3_ECOLI | |

Description

HYPOTHETICAL LYSYL-TRNA SYNTHETASE HOMOLOG, (GX)

| ORF_Name | NTID | AAID | NT Length | AA Length | Score | Probability |
|---|---|---|---|---|---|---|
| 31275301_f1_11 | 1830 | 3750 | 352 | 1059 | 516 | 1.8e-49 |

Protein name | | | | Locus_Name | | Acc# |
| | | | | sp:PDXB_ECOLI | | P05459 |

Description

ERYTHRONATE-4-PHOSPHATE DEHYDROGENASE,

| ORF_Name | NTID | AAID | NT Length | AA Length | Score | Probability |
|---|---|---|---|---|---|---|
| 34179211_f3_24 | 1831 | 3751 | 330 | 993 | 158 | 1.2e-08 |

Protein name: probable protein serine-threonine phosphatase | Locus_Name: pir:C75297 | Acc# C75297

Description

| ORF_Name | NTID | AAID | NT Length | AA Length | Score | Probability |
|---|---|---|---|---|---|---|
| 36365625_f2_17 | 1832 | 3752 | 147 | 444 | 348 | 1.2e-31 |

Protein name: hypothetical protein jhp1377 | Locus_Name: pir:D71815 | Acc# D71815

Description

| ORF_Name | NTID | AAID | NT Length | AA Length | Score | Probability |
|---|---|---|---|---|---|---|
| 5118952_c1_35 | 1833 | 3753 | 403 | 1212 | 703 | 2.8e-69 |

Protein name | | | | Locus_Name: sp:PYR2_PSEAE | | Acc# Q51551

Description

CATALYTIC CHAIN)

| ORF_Name | NTID | AAID | NT Length | AA Length | Score | Probability |
|---|---|---|---|---|---|---|
| 5275300_f3_22 | 1834 | 3754 | 347 | 1044 | 954 | 7.1e-96 |

Protein name | | | | Locus_Name: sp:BIOB_ECOLI | | Acc# P12996

Description

BIOTIN SYNTHASE, (BIOTIN SYNTHETASE)

| ORF_Name | NTID | AAID | NT Length | AA Length | Score | Probability |
|---|---|---|---|---|---|---|
| 5948342_f3_27 | 1835 | 3755 | 259 | 780 | 530 | 6.0e-51 |

| Protein name | Locus_Name | Acc# |
|---|---|---|
| | sp:PURK_PSEAE | P72158 |

Description (AIR CARBOXYLASE) (AIRC)

| ORF_Name | NTID | AAID | NT Length | AA Length | Score | Probability |
|---|---|---|---|---|---|---|
| 7041_f1_8 | 1836 | 3756 | 132 | 399 | 155 | 1.5e-10 |

| Protein name | Locus_Name | Acc# |
|---|---|---|
| | sp:PURK_AQUAE | O66608 |

Description (AIR CARBOXYLASE) (AIRC)

| ORF_Name | NTID | AAID | NT Length | AA Length | Score | Probability |
|---|---|---|---|---|---|---|
| 12991392_f2_18 | 1837 | 3757 | 101 | 306 | 160 | 9.7e-12 |

| Protein name | Locus_Name | Acc# |
|---|---|---|
| unknown | gp:PDU08856 | U08856 |

Description

Paracoccus denitrificans insertion sequence IS1248b, completesequence.

| ORF_Name | NTID | AAID | NT Length | AA Length | Score | Probability |
|---|---|---|---|---|---|---|
| 15110912_c3_69 | 1838 | 3758 | 358 | 1077 | 690 | 6.7e-68 |

| Protein name | Locus_Name | Acc# |
|---|---|---|
| | sp:YQJM_BACSU | P54550 |

Description

PROBABLE NADH-DEPENDENT FLAVIN OXIDOREDUCTASE YQJM,

| ORF_Name | NTID | AAID | NT Length | AA Length | Score | Probability |
|---|---|---|---|---|---|---|
| 15632781_c2_61 | 1839 | 3759 | 79 | 240 | | |

| Protein name | Locus_Name | Acc# |
|---|---|---|
| | | |

Description

NO-HIT

| ORF Name | NTID | AAID | NT Length | AA Length | Score | Probability |
|---|---|---|---|---|---|---|
| 15673816_f3_31 | 1840 | 3760 | 472 | 1419 | 1772 | 1.5e-182 |

| Protein name | Locus Name | Acc# |
|---|---|---|
| type I site-specific deoxyribonuclease, Hsd chain R:type I restriction enzyme, Hsd, chain R:type I restriction-modification system, | pir:JC5216 | JC5216 |

Description

| ORF Name | NTID | AAID | NT Length | AA Length | Score | Probability |
|---|---|---|---|---|---|---|
| 19823578_f3_29 | 1841 | 3761 | 405 | 1218 | 130 | 1.0e-07 |

| Protein name | Locus Name | Acc# |
|---|---|---|
| hypothetical protein | pir:A75592 | A75592 |

Description

| ORF Name | NTID | AAID | NT Length | AA Length | Score | Probability |
|---|---|---|---|---|---|---|
| 21642052_c3_70 | 1842 | 3762 | 232 | 699 | 686 | 1.8e-67 |

| Protein name | Locus Name | Acc# |
|---|---|---|
|  | sp:YC78_HAEIN |  |

Description

PUTATIVE NAD(P)H NITROREDUCTASE,

| ORF Name | NTID | AAID | NT Length | AA Length | Score | Probability |
|---|---|---|---|---|---|---|
| 21673201_f3_25 | 1843 | 3763 | 220 | 663 | 364 | 2.4e-33 |

| Protein name | Locus Name | Acc# |
|---|---|---|
| protein Tp70 | pir:A71309 |  |

Description

| ORF Name | NTID | AAID | NT Length | AA Length | Score | Probability |
|---|---|---|---|---|---|---|
| 2189075_c2_66 | 1844 | 3764 | 126 | 381 | 195 | 1.9e-15 |

| Protein name | Locus Name | Acc# |
|---|---|---|
|  | sp:YPRO_OWEFU |  |

Description

HYPOTHETICAL PROLINE-RICH PROTEIN (FRAGMENT)

| ORF Name | NTID | AAID | NT Length | AA Length | Score | Probability |
|---|---|---|---|---|---|---|
| 22143752_f1_9 | 1845 | 3765 | 636 | 1911 | 2756 | 7.9e-287 |

| Protein name | Locus Name | Acc# |
|---|---|---|
| type I site-specific deoxyribonuclease, Hsd chain R:type I restriction enzyme, Hsd, chain R:type I restriction-modification system, | pir:JC5216 | JC5216 |

Description

---

| ORF Name | NTID | AAID | NT Length | AA Length | Score | Probability |
|---|---|---|---|---|---|---|
| 23437551_f1_4 | 1846 | 3766 | 83 | 252 | | |

| Protein name | Locus Name | Acc# |
|---|---|---|
| | | |

Description

NO-HIT

---

| ORF Name | NTID | AAID | NT Length | AA Length | Score | Probability |
|---|---|---|---|---|---|---|
| 23490937_c3_81 | 1847 | 3767 | 93 | 282 | 73 | 0.037 |

| Protein name | Locus Name | Acc# |
|---|---|---|
| nicotinamide adenine dinucleotide dehydrogenase | gp:AF025836 | AF025836 |

Description

Echinostoma sp.I. Africa nicotinamide adenine dinucleotidedehydrogenase subunit 1 (ND1) gene, mitochondrial gene encodingmitochondrial protein, partial cds.

---

| ORF Name | NTID | AAID | NT Length | AA Length | Score | Probability |
|---|---|---|---|---|---|---|
| 24704462_c2_51 | 1848 | 3768 | 206 | 621 | 296 | 3.8e-26 |

| Protein name | Locus Name | Acc# |
|---|---|---|
| cinnamyl-alcohol dehydrogenase | gp:AF083333 | AF083333 |

Description

Medicago sativa cinnamyl-alcohol dehydrogenase (MsaCad1) mRNA, complete cds.

| ORF Name | NTID | AAID | NT Length | AA Length | Score | Probability |
|---|---|---|---|---|---|---|
| 32667715_f3_26 | 1849 | 3769 | 188 | 567 | 106 | 0.00093 |

| Protein name | Locus Name | Acc# |
|---|---|---|
| hypothetical protein TP0570 | pir:H71308 | H71308 |

Description

| ORF Name | NTID | AAID | NT Length | AA Length | Score | Probability |
|---|---|---|---|---|---|---|
| 35350802_f1_5 | 1850 | 3770 | 167 | 504 | 345 | 2.4e-31 |

| Protein name | Locus Name | Acc# |
|---|---|---|
| putative transposase | gp:AF007429 | AF007429 |

Description

Haemophilus paragallinarum IS-like putative transposase gene, complete cds.

| ORF Name | NTID | AAID | NT Length | AA Length | Score | Probability |
|---|---|---|---|---|---|---|
| 36564842_f2_19 | 1851 | 3771 | 460 | 1383 | 573 | 1.7e-55 |

| Protein name | Locus Name | Acc# |
|---|---|---|
| type I site-specific deoxyribonuclease, Hsd chain S:type I restriction enzyme, Hsd, chain S:type I restriction-modification system, | pir:JC5218 | JC5218 |

Description

| ORF Name | NTID | AAID | NT Length | AA Length | Score | Probability |
|---|---|---|---|---|---|---|
| 4032715_f3_27 | 1852 | 3772 | 116 | 351 | 214 | 1.8e-17 |

| Protein name | Locus Name | Acc# |
|---|---|---|
|  | sp:Y4SN_RHISN | P50358 |

Description

HYPOTHETICAL 14.4 KD PROTEIN Y4SN

| ORF Name | NTID | AAID | NT Length | AA Length | Score | Probability |
|---|---|---|---|---|---|---|
| 4111333_f3_33 | 1853 | 3773 | 201 | 603 | 238 | 5.3e-20 |

| Protein name | Locus Name | Acc# |
|---|---|---|
|  | sp:NAHR_PSEPU | P10183 |

Description

TRANSCRIPTIONAL ACTIVATOR PROTEIN NAHR

| ORF Name | NTID | AAID | NT Length | AA Length | Score | Probability |
|---|---|---|---|---|---|---|
| 4895127_cl_36 | 1854 | 3774 | 116 | 351 | 334 | 3.6e-30 |

| Protein name | Locus Name | Acc# |
|---|---|---|
| Orf8 | gp:AB011413 | AB011413 |

Description

Streptomyces griseus genes for Orf2, Orf3, Orf4, Orf5, AfsA, Orf8, partial and complete cds.

| ORF Name | NTID | AAID | NT Length | AA Length | Score | Probability |
|---|---|---|---|---|---|---|
| 7034808_cl_49 | 1855 | 3775 | 70 | 213 | 51 | 0.033 |

| Protein name | Locus Name | Acc# |
|---|---|---|
| hypothetical protein ZK856.5 | pir:T28044 | T28044 |

Description

| ORF Name | NTID | AAID | NT Length | AA Length | Score | Probability |
|---|---|---|---|---|---|---|
| 7080001_f1_2 | 1856 | 3776 | 371 | 1116 | 298 | 2.3e-26 |

| Protein name | Locus Name | Acc# |
|---|---|---|
|  | sp:YGCG_ECOLI | P55140 |

Description

HYPOTHETICAL 34.9 KD PROTEIN IN CYSJ-ENO INTERGENIC REGION (O313)

| ORF Name | NTID | AAID | NT Length | AA Length | Score | Probability |
|---|---|---|---|---|---|---|
| 7083578_cl_37 | 1857 | 3777 | 60 | 183 | 162 | 2.4e-11 |

| Protein name | Locus Name | Acc# |
|---|---|---|
| NADP-dependent alcohol hydrogenase | gp:LMFL1063 | AL121862 |

Description

Leishmania major Friedlin chromosome 23 cosmid L1063, complete cds.

| ORF Name | NTID | AAID | NT Length | AA Length | Score | Probability |
|---|---|---|---|---|---|---|
| 9782666_f1_7 | 1858 | 3778 | 554 | 1665 | 2520 | 8.0e-262 |

| Protein name | | Locus Name | Acc# |
|---|---|---|---|
| ALXA and HSDM | | gp:PHU46781 | U46781 |

Description

Pasteurella haemolytica putative coproporphyrinogen III oxidase(hemN') gene, partial cds, leukotoxin transcriptional activator and restriction modification methylase subunit (alxA-hsdM), (hsdS) and (hsdR) genes, complete cds.

| ORF Name | NTID | AAID | NT Length | AA Length | Score | Probability |
|---|---|---|---|---|---|---|
| 14257160_f1_2 | 1859 | 3779 | 294 | 885 | | |

| Protein name | | Locus Name | Acc# |
|---|---|---|---|

Description

NO-HIT

| ORF Name | NTID | AAID | NT Length | AA Length | Score | Probability |
|---|---|---|---|---|---|---|
| 16180437_f3_18 | 1860 | 3780 | 502 | 1509 | 1460 | 1.7e-149 |

| Protein name | | Locus Name | Acc# |
|---|---|---|---|
| | | sp:GABD_ECOLI | P25526 |

Description

, (SSDH)

| ORF Name | NTID | AAID | NT Length | AA Length | Score | Probability |
|---|---|---|---|---|---|---|
| 19806552_f1_1 | 1861 | 3781 | 174 | 525 | 131 | 2.6e-07 |

| Protein name | | Locus Name | Acc# |
|---|---|---|---|
| probable ankyrin | | pir:H71274 | H71274 |

Description

| ORF Name | NTID | AAID | NT Length | AA Length | Score | Probability |
|---|---|---|---|---|---|---|
| 24407502_f3_17 | 1862 | 3782 | 224 | 675 | 392 | 2.5e-36 |

| Protein name | | Locus Name | Acc# |
|---|---|---|---|
| glycine betaine/carnitine/choline ABC transporter (membrane p) opuCD | | pir:F69670 | F69670 |

Description

| ORF Name | NTID | AAID | NT Length | AA Length | Score | Probability |
|---|---|---|---|---|---|---|
| 25900252_c2_30 | 1863 | 3783 | 417 | 1254 | 138 | 1.3e-05 |

| Protein name | Locus Name | Acc# |
|---|---|---|
| putative natural resistance-associated | gp:CCA133735 | AJ133735 |

Description

Cyprinus carpio mRNA for putative natural resistance-associatedmacrophage protein (NRAMP).

| ORF Name | NTID | AAID | NT Length | AA Length | Score | Probability |
|---|---|---|---|---|---|---|
| 34094385_c1_23 | 1864 | 3784 | 107 | 324 | 155 | 6.3e-11 |

| Protein name | Locus Name | Acc# |
|---|---|---|
| AttJ | gp:U59485 | |

Description

Agrobacterium tumefaciens AtrC (atrC) gene, partial cds; AtrB(atrB), AtrA (atrA), AttA1 (attA1), AttA2 (attA2), AttB (attB),AttC (attC), AttD (attD), AttE (attE), and AttF (attF) genes,complete cds; AttG (attG) gene, alternative splice products,complete cds; AttH (attH), AttI (attI), AttJ (attJ), AttK (attK),AttL (attL), AttM (attM), AttO (attO), AttP (attP), AttR (attR),AttS (attS), AttT (attT), AttU (attU), attV (attV), AttW (attW),AttX

| ORF Name | NTID | AAID | NT Length | AA Length | Score | Probability |
|---|---|---|---|---|---|---|
| 4770887_f1_3 | 1865 | 3785 | 176 | 531 | 130 | 2.7e-14 |

| Protein name | Locus Name | Acc# |
|---|---|---|
| hypothetical protein | gp:SSU18930 | Y18930 |

Description

Sulfolobus solfataricus 281 kb genomic DNA fragment, strain P2.

| ORF Name | NTID | AAID | NT Length | AA Length | Score | Probability |
|---|---|---|---|---|---|---|
| 4875260_c2_33 | 1866 | 3786 | 72 | 219 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4884702_c1_27 | 1867 | 3787 | 226 | 681 | 404 | 1.4e-37 |

| Protein name | Locus Name | Acc# |
|---|---|---|
| NonF | gp:AF074603 | AF074603 |

Description

Streptomyces griseus subsp. griseus nonactin biosynthesis genecluster, partial sequence.

| ORF Name | NTID | AAID | NT Length | AA Length | Score | Probability |
|---|---|---|---|---|---|---|
| 6740692_f2_10 | 1868 | 3788 | 165 | 498 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 7218752_f3_15 | 1869 | 3789 | 129 | 390 | 88 | 0.030 |

| Protein name | Locus Name | Acc# |
|---|---|---|
| putative polysaccharide polymerase | gp:SPCPS14E | X85787 |

Description

S.pneumoniae cps14 locus.

| ORF Name | NTID | AAID | NT Length | AA Length | Score | Probability |
|---|---|---|---|---|---|---|
| 786305_f1_5 | 1870 | 3790 | 317 | 954 | 632 | 9.4e-62 |

| Protein name | Locus Name | Acc# |
|---|---|---|
| probable osmoprotection binding protein | pir:G71892 | G71892 |

Description

| ORF Name | NTID | AAID | NT Length | AA Length | Score | Probability |
|---|---|---|---|---|---|---|
| 792090_f2_12 | 1871 | 3791 | 148 | 447 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 12273437_f3_58 | 1872 | 3792 | 337 | 1014 | 1680 | 8.3e-173 |

| Protein name | Locus Name | Acc# |
|---|---|---|
| | sp:SYGA_MORCA | P77892 |

Description

ALPHA CHAIN) (GLYRS)

| ORF Name | NTID | AAID | NT Length | AA Length | Score | Probability |
|---|---|---|---|---|---|---|
| 14181500_f2_36 | 1873 | 3793 | 693 | 2082 | 1593 | 1.4e-163 |

| Protein name | Locus Name | Acc# |
|---|---|---|
| | sp:SYGB_HAEIN | P43822 |

Description

BETA CHAIN) (GLYRS)

| ORF Name | NTID | AAID | NT Length | AA Length | Score | Probability |
|---|---|---|---|---|---|---|
| 19650062_c1_101 | 1874 | 3794 | 279 | 840 | 581 | 2.4e-56 |

| Protein name | Locus Name | Acc# |
|---|---|---|
| | sp:BUDC_KLEPN | Q48436 |

Description

ACETOIN(DIACETYL) REDUCTASE, (ACETOIN DEHYDROGENASE) (AR)

| ORF Name | NTID | AAID | NT Length | AA Length | Score | Probability |
|---|---|---|---|---|---|---|
| 21648382_f1_22 | 1875 | 3795 | 279 | 840 | 813 | 6.2e-81 |

| Protein name | Locus Name | Acc# |
|---|---|---|
| | sp:ACCA_ECOLI | P30867 |

Description (EC 6.4.1.2)

| ORF Name | NTID | AAID | NT Length | AA Length | Score | Probability |
|---|---|---|---|---|---|---|
| 21650017_c2_112 | 1876 | 3796 | 254 | 765 | 437 | 4.3e-41 |

| Protein name | Locus Name | Acc# |
|---|---|---|
| | sp:LPTP_ECOLI | P23885 |

Description

LEUCYL/PHENYLALANYL-TRNA--PROTEIN TRANSFERASE,

| ORF Name | NTID | AAID | NT Length | AA Length | Score | Probability |
|---|---|---|---|---|---|---|
| 21657752_c3_147 | 1877 | 3797 | 345 | 1038 | 580 | 3.0e-56 |

| Protein name | Locus Name | Acc# |
|---|---|---|
| | sp:YZ37_SYNY3 | Q55480 |

Description

HYPOTHETICAL SUGAR KINASE SLR0537

| ORF Name | NTID | AAID | NT Length | AA Length | Score | Probability |
|---|---|---|---|---|---|---|
| 21987811_f2_34 | 1878 | 3798 | 237 | 714 | 384 | 6.2e-41 |

| Protein name | Locus Name | Acc# |
|---|---|---|
| | sp:PGSA_HAEIN | P44528 |

Description (EC 2.7.8.5) (PHOSPHATIDYLGLYCEROPHOSPHATE SYNTHASE) (PGP SYNTHASE)

| ORF Name | NTID | AAID | NT Length | AA Length | Score | Probability |
|---|---|---|---|---|---|---|
| 22038132_f3_67 | 1879 | 3799 | 76 | 231 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22384628_f1_5 | 1880 | 3800 | 448 | 1347 | 1005 | 2.8e-101 |

| Protein name | Locus Name | Acc# |
|---|---|---|
| | sp:YKGC_ECOLI | P77212 |

Description

INTERGENIC REGION

| ORF Name | NTID | AAID | NT Length | AA Length | Score | Probability |
|---|---|---|---|---|---|---|
| 23493812_f2_33 | 1881 | 3801 | 998 | 2997 | 972 | 6.2e-119 |

| Protein name | | Locus Name | Acc# |
|---|---|---|---|
| metalloprotease 1 | | gp:AF061243 | AF061243 |

Description

Homo sapiens metalloprotease 1 (MP1) mRNA, complete cds.

| ORF Name | NTID | AAID | NT Length | AA Length | Score | Probability |
|---|---|---|---|---|---|---|
| 23875027_f2_50 | 1882 | 3802 | 396 | 1191 | 621 | 1.4e-60 |

| Protein name | | Locus Name | Acc# |
|---|---|---|---|
| | | sp:RLUC_HAEIN | P44433 |

Description (PSEUDOURIDYLATE SYNTHASE) (URACIL HYDROLYASE)

| ORF Name | NTID | AAID | NT Length | AA Length | Score | Probability |
|---|---|---|---|---|---|---|
| 24118802_c3_138 | 1883 | 3803 | 441 | 1326 | 1742 | 2.2e-179 |

| Protein name | | Locus Name | Acc# |
|---|---|---|---|
| serine hydroxymethyltransferase | | gp:AF073769 | AF073769 |

Description

Acinetobacter radioresistens serine hydroxymethyltransferase (glyA) gene, complete cds.

| ORF Name | NTID | AAID | NT Length | AA Length | Score | Probability |
|---|---|---|---|---|---|---|
| 24268777_c3_134 | 1884 | 3804 | 1181 | 3546 | 1542 | 1.5e-160 |

| Protein name | | Locus Name | Acc# |
|---|---|---|---|
| ribonuclease E,:cell shape-determining protein:message stability-altering protein:RNase E | | pir:S27311 | |

Description

| ORF Name | NTID | AAID | NT Length | AA Length | Score | Probability |
|---|---|---|---|---|---|---|
| 24900257_f1_11 | 1885 | 3805 | 86 | 261 | 145 | 3.8e-10 |

| Protein name | | Locus Name | Acc# |
|---|---|---|---|
| conserved hypothetical protein | | pir:B72287 | B72287 |

Description

| ORF Name | NTID | AAID | NT Length | AA Length | Score | Probability |
|---|---|---|---|---|---|---|
| 25657776_c1_102 | 1886 | 3806 | 149 | 450 | 180 | 7.4e-14 |

| Protein name | Locus Name | Acc# |
|---|---|---|
| | sp:PSPE_ECOLI | P23857 |

Description

PHAGE SHOCK PROTEIN E PRECURSOR

| ORF Name | NTID | AAID | NT Length | AA Length | Score | Probability |
|---|---|---|---|---|---|---|
| 26565686_c3_149 | 1887 | 3807 | 348 | 1047 | 691 | 5.2e-68 |

| Protein name | Locus Name | Acc# |
|---|---|---|
| hypothetical protein slr0787 | pir:S77001 | S77001 |

Description

| ORF Name | NTID | AAID | NT Length | AA Length | Score | Probability |
|---|---|---|---|---|---|---|
| 26754011_c1_86 | 1888 | 3808 | 357 | 1074 | 1765 | 8.1e-182 |

| Protein name | Locus Name | Acc# |
|---|---|---|
| NAD repressor/NMN transporter NadRp | gp:MCU73324 | U73324 |

Description

Moraxella catarrhalis glycyl-tRNA synthetase beta subunit (GlyRS) and NAD repressor/NMN transporter NadRp (NadR) genes, partial cds, and glycyl-tRNA synthetase alpha subunit (GlyRS) gene, complete cds.

| ORF Name | NTID | AAID | NT Length | AA Length | Score | Probability |
|---|---|---|---|---|---|---|
| 2845637_c3_137 | 1889 | 3809 | 172 | 519 | 168 | 1.4e-12 |

| Protein name | Locus Name | Acc# |
|---|---|---|
| | sp:UBIC_ECOLI | |

Description

CHORISMATE--PYRUVATE LYASE,

| ORF Name | NTID | AAID | NT Length | AA Length | Score | Probability |
|---|---|---|---|---|---|---|
| 30332811_f2_51 | 1890 | 3810 | 541 | 1626 | 1087 | 5.7e-110 |

| Protein name | Locus Name | Acc# |
|---|---|---|
| exopolyphosphatase | gp:AF053463 | AF053463 |

Description

Pseudomonas aeruginosa thioredoxin (trx) and exopolyphosphatase(ppx) genes, complete cds.

| ORF Name | NTID | AAID | NT Length | AA Length | Score | Probability |
|---|---|---|---|---|---|---|
| 30726562_f3_62 | 1891 | 3811 | 768 | 2307 | 2256 | 7.6e-234 |

| Protein name | Locus Name | Acc# |
|---|---|---|
| hypothetical protein | gp:PFFC2 | Y11998 |

Description

P.fluorescens FC2.1, FC2.2, FC2.3c, FC2.4 and FC2.5c open readingframes.

| ORF Name | NTID | AAID | NT Length | AA Length | Score | Probability |
|---|---|---|---|---|---|---|
| 33240686_c3_140 | 1892 | 3812 | 260 | 783 | 155 | 1.4e-09 |

| Protein name | Locus Name | Acc# |
|---|---|---|
|  | sp:PNUC_ECOLI |  |

Description

PNUC PROTEIN

| ORF Name | NTID | AAID | NT Length | AA Length | Score | Probability |
|---|---|---|---|---|---|---|
| 34421878_c2_120 | 1893 | 3813 | 408 | 1227 | 991 | 8.5e-100 |

| Protein name | Locus Name | Acc# |
|---|---|---|
|  | sp:YHIN_ECOLI |  |

Description

HYPOTHETICAL 43.8 KD PROTEIN IN RHSB-PIT INTERGENIC REGION

| ORF Name | NTID | AAID | NT Length | AA Length | Score | Probability |
|---|---|---|---|---|---|---|
| 34578126_f3_54 | 1894 | 3814 | 355 | 1068 | 91 | 0.023 |

| Protein name | Locus Name | Acc# |
|---|---|---|
| translation elongation factor eEF-1 alpha chain PIK-A49:phosphatidylinositol 4-kinase activator PIK-A49 | pir:A45325 | |

Description

| ORF Name | NTID | AAID | NT Length | AA Length | Score | Probability |
|---|---|---|---|---|---|---|
| 4695252_f2_29 | 1895 | 3815 | 213 | 642 | 497 | 1.9e-47 |

| Protein name | Locus Name | Acc# |
|---|---|---|
| | sp:YHGI_ECOLI | P46847 |

Description

HYPOTHETICAL 21.0 KD PROTEIN IN BIOH-GNTT INTERGENIC REGION (O191)

| ORF Name | NTID | AAID | NT Length | AA Length | Score | Probability |
|---|---|---|---|---|---|---|
| 4875885_c2_126 | 1896 | 3816 | 164 | 495 | 120 | 1.7e-07 |

| Protein name | Locus Name | Acc# |
|---|---|---|
| | sp:YFMU_COXBU | P45680 |

Description

HYPOTHETICAL 15.8 KD PROTEIN IN FMU-RPMH INTERGENIC REGION

| ORF Name | NTID | AAID | NT Length | AA Length | Score | Probability |
|---|---|---|---|---|---|---|
| 6651712_f1_15 | 1897 | 3817 | 536 | 1611 | 1545 | 1.7e-158 |

| Protein name | Locus Name | Acc# |
|---|---|---|
| isocitrate lyase | gp:AB004651 | AB004651 |

Description

Hyphomicrobium methylovorum gene for isocitrate lyase,inorganicphosphate transporter,methionine synthase,complete and partial cds.

| ORF Name | NTID | AAID | NT Length | AA Length | Score | Probability |
|---|---|---|---|---|---|---|
| 6759625_c3_150 | 1898 | 3818 | 187 | 564 | 248 | 4.6e-21 |

| Protein name | Locus Name | Acc# |
|---|---|---|
| hypothetical protein TP0895 | pir:D71266 | D71266 |

Description

| ORF Name | NTID | AAID | NT Length | AA Length | Score | Probability |
|---|---|---|---|---|---|---|
| 14642925_f3_23 | 1899 | 3819 | 351 | 1056 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16693750_f3_17 | 1900 | 3820 | 100 | 303 | 137 | 2.7e-09 |

| Protein name | Locus Name | Acc# |
|---|---|---|
| conserved hypothetical protein yerL | pir:A69795 | A69795 |

Description

| ORF Name | NTID | AAID | NT Length | AA Length | Score | Probability |
|---|---|---|---|---|---|---|
| 183437_f3_18 | 1901 | 3821 | 496 | 1491 | 2443 | 1.2e-253 |

| Protein name | Locus Name | Acc# |
|---|---|---|
| | sp:AMID_MORCA | Q49091 |

Description

PUTATIVE AMIDASE,

| ORF Name | NTID | AAID | NT Length | AA Length | Score | Probability |
|---|---|---|---|---|---|---|
| 1987793_f2_16 | 1902 | 3822 | 264 | 795 | 189 | 8.2e-15 |

| Protein name | Locus Name | Acc# |
|---|---|---|
| | sp:MINC_ECOLI | P18196 |

Description

CELL DIVISION INHIBITOR MINC

| ORF Name | NTID | AAID | NT Length | AA Length | Score | Probability |
|---|---|---|---|---|---|---|
| 22078181_c3_52 | 1903 | 3823 | 137 | 411 | 161 | 7.6e-12 |

| Protein name | Locus Name | Acc# |
|---|---|---|
| maf-type protein | pir:D72129 | D72129 |

Description

| ORF Name | NTID | AAID | NT Length | AA Length | Score | Probability |
|---|---|---|---|---|---|---|
| 22942053_f1_9 | 1904 | 3824 | 70 | 210 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23492792_c2_37 | 1905 | 3825 | 203 | 612 | 141 | 1.0e-09 |

| Protein name | | | | Locus Name | | Acc# |
|---|---|---|---|---|---|---|
| | | | | sp:CYC5_AZOVI | | P11732 |

Description

CYTOCHROME C5

| ORF Name | NTID | AAID | NT Length | AA Length | Score | Probability |
|---|---|---|---|---|---|---|
| 24259651_f2_14 | 1906 | 3826 | 319 | 960 | 462 | 9.7e-44 |

| Protein name | | | | Locus Name | | Acc# |
|---|---|---|---|---|---|---|
| | | | | sp:YIHG_ECOLI | | P32129 |

Description

HYPOTHETICAL 36.3 KD PROTEIN IN DSBA-POLA INTERGENIC REGION

| ORF Name | NTID | AAID | NT Length | AA Length | Score | Probability |
|---|---|---|---|---|---|---|
| 24351556_c1_28 | 1907 | 3827 | 231 | 696 | 389 | 5.3e-36 |

| Protein name | | | | Locus Name | | Acc# |
|---|---|---|---|---|---|---|
| outer membrane protein homolog | | | | gp:AF067083 | | AF067083 |

Description

Vitreoscilla sp. outer membrane protein homolog gene, complete cds;Trp repressor binding protein gene, partial cds; and unknown genes.

| ORF Name | NTID | AAID | NT Length | AA Length | Score | Probability |
|---|---|---|---|---|---|---|
| 30203430_c2_35 | 1908 | 3828 | 86 | 261 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 31423200_f3_25 | 1909 | 3829 | 181 | 546 | 622 | 1.1e-60 |

Protein name: cell division inhibitor minD:septum site-determining protein minD
Locus Name: pir:CCECID
Acc#:

Description

| ORF Name | NTID | AAID | NT Length | AA Length | Score | Probability |
|---|---|---|---|---|---|---|
| 4729837_f3_19 | 1910 | 3830 | 317 | 954 | 1626 | 4.4e-167 |

Protein name: BRO-1
Locus Name: gp:MCBLABRO1
Acc#: Z54180

Description: M.catarrhalis bla gene.

| ORF Name | NTID | AAID | NT Length | AA Length | Score | Probability |
|---|---|---|---|---|---|---|
| 4791053_c1_31 | 1911 | 3831 | 72 | 219 | 54 | 0.0063 |

Protein name: gag protein
Locus Name: gp:MUSERVGG2
Acc#: M26006

Description: Mouse endogenous retrovirus truncated gag gene, complete cds, clonedel env-2 15.3.

| ORF Name | NTID | AAID | NT Length | AA Length | Score | Probability |
|---|---|---|---|---|---|---|
| 976677_f3_20 | 1912 | 3832 | 494 | 1485 | 2124 | 7.4e-220 |

Protein name:
Locus Name: sp:YBL3_MORCA
Acc#: Q49092

Description: HYPOTHETICAL 46.4 KD PROTEIN IN BLOR-1 3'REGION (ORF3)

| ORF Name | NTID | AAID | NT Length | AA Length | Score | Probability |
|---|---|---|---|---|---|---|
| 14469635_f2_5 | 1913 | 3833 | 716 | 2151 | 1425 | 8.7e-146 |

| Protein name | | | | Locus Name | | Acc# |
|---|---|---|---|---|---|---|
| | | | | sp:OPDA_HAEIN | | P44573 |

Description

OLIGOPEPTIDASE A,

| ORF Name | NTID | AAID | NT Length | AA Length | Score | Probability |
|---|---|---|---|---|---|---|
| 19569430_c3_39 | 1914 | 3834 | 275 | 828 | 454 | 6.8e-43 |

| Protein name | | | | Locus Name | | Acc# |
|---|---|---|---|---|---|---|
| | | | | sp:YBHP_ECOLI | | P75772 |

Description

HYPOTHETICAL 28.8 KD PROTEIN IN MOAE-RHLE INTERGENIC REGION

| ORF Name | NTID | AAID | NT Length | AA Length | Score | Probability |
|---|---|---|---|---|---|---|
| 21718878_c1_20 | 1915 | 3835 | 269 | 810 | | |

| Protein name | | | | Locus Name | | Acc# |

Description

NO-HIT

| ORF Name | NTID | AAID | NT Length | AA Length | Score | Probability |
|---|---|---|---|---|---|---|
| 22847175_f3_15 | 1916 | 3836 | 83 | 252 | 81 | 0.0023 |

| Protein name | | | | Locus Name | | Acc# |
|---|---|---|---|---|---|---|
| | | | | sp:YHEV_ECOLI | | P56622 |

Description

HYPOTHETICAL 7.6 KD PROTEIN IN SLYD-KEFB INTERGENIC REGION

| ORF Name | NTID | AAID | NT Length | AA Length | Score | Probability |
|---|---|---|---|---|---|---|
| 23445300_c3_37 | 1917 | 3837 | 923 | 2772 | 778 | 2.2e-100 |

| Protein name | | | | Locus Name | | Acc# |
|---|---|---|---|---|---|---|
| prolyl oligopeptidase, precursor | | | | pir:A38086 | | A38086 |

Description

| ORF Name | NTID | AAID | NT Length | AA Length | Score | Probability |
|---|---|---|---|---|---|---|
| 3907568_c2_28 | 1918 | 3838 | 124 | 375 | 70 | 0.033 |

| Protein name | Locus Name | Acc# |
|---|---|---|
| ORF102 | gp:AF162221 | AF162221 |

Description

Xestia c-nigrum granulovirus genome, complete sequence.

| ORF Name | NTID | AAID | NT Length | AA Length | Score | Probability |
|---|---|---|---|---|---|---|
| 4773287_c1_26 | 1919 | 3839 | 212 | 639 | 503 | 4.4e-48 |

| Protein name | Locus Name | Acc# |
|---|---|---|
| | sp:YGGV_ECOLI | P52061 |

Description

HYPOTHETICAL 21.0 KD PROTEIN IN GSHB-ANSB INTERGENIC REGION (O197)

| ORF Name | NTID | AAID | NT Length | AA Length | Score | Probability |
|---|---|---|---|---|---|---|
| 964212_c3_35 | 1920 | 3840 | 410 | 1233 | 104 | 0.0091 |

| Protein name | Locus Name | Acc# |
|---|---|---|
| voltage-dependent anion channel protein 1b | gp:AF178951 | AF178951 |

Description

Zea mays voltage-dependent anion channel protein 1b (vdac1b) mRNA, complete cds; nuclear gene for mitochondrial product.

SEQUENCE LISTING (3840 sequences)

SEQ ID NO: 1 - DNA, 255 bp, M.catarrhalis
gtacaaaacctgctgtttaatccagtttttgtacctaatgatatgcaagtgggacaaactggtaaaatcgttgcacctaatttatacattgccatcggtatttcaggggcgattcagcatttggcaggcatgaaggattcaaaaaccatcgtggctatcaacaacgacccagagtcacccattgcatcggtggctgattatttcttagaaggtgatttgtttgatgttgtgcctgaactgattgaaaagctatga

SEQ ID NO: 2 - DNA, 1509 bp, M.catarrhalis
agacccgacaatgctgtactttttgtccctaatggtgatctattaacccaaccggcaaatcaggctgataaacctcaactttatcaccgtttgtggggcgatttactcaattggatcaaaactaatcgcccaagacaaccaatgaatggcatcgtcttaactgtcgataccctatcgttattaaccaatagtaaggagcaaaatagtcagctacttgctgatttacaaatgcgtattgaagaaatacgcatgacatttaatagtcgcttgcctttatatatcgtcttaaccaagctagatctattacgtggttttgactcaatgtatcaatcattagatgttcaacaacgtaatgaagtactaggtgtttctttcaaccagaaagcaaaaagtaattggaaaaaggaattaaatcatttttggtcacaatgggtaggccaaatgaacagcgcattaccagaaatgatgctacaaagagcagaaggtaaccagcgtagtgatctatttagtttcgtgcgccaaattgaagggttacaacattctgtatgcacattaattgatgcattgctcatcaataatgagcaacataatatctgtttaagaggggtttatttaacttctgcattgcaaatcggtcaaatcgatgatgtgtttagccaaacagcgtccgaacaatatcatttaccgacagcacctcttactacatggccaattaatgatagccacccttattttactacccaattatttaatcaagtgctatttagtgagcctaatattgcagcagaaaaccattattgggttaaaaaacatcggactcgcctattagtcaccactgctgttagctttgtcggcttaatcgcaatttggaatggttggagccactattacgacaaaaactatcgtgctggagaaaacgttcttaatgaggtaaaagcattccgtgctattgagaacaatgctcagaaagatactgatggtagcctacaattaccggtgctcaatccattacgtgaagcaaccttagcttatggtaatcatcgtgataaaaatgtgctcttttctgatatgggtctttaccaaggtcaaaaagttggcccacaagttgaacaagtctatttacaactactcaccgatcgttttttacctgcggttatgtctgggttgttaaatgaacttaacagtgccgacaaaggaagtgaagataagttagagatattgcgtattatgcgcatgttagaagataaaagtggccgtaataatggcatggtagaagattttatggccgattattggagccaactgttcactggtcaacgtgaaaaacaactgcaactaaaagcccatttgcgctatgcccttgagcacacagattggaaacaagagcgtgaaaaaagatttgtttcagccactaaagcctttatgccttttgctggacctataaaaaatgcacaagcagagttaagtgtattgtcactttatcagcgtgtatatcaagccttacgctaa

SEQ ID NO: 3 - DNA, 189 bp, M.catarrhalis
ctcattttatctgtgtctatatttcttccgatctttatcgtggatttttgttctacatatatgctcctattattgtttcatacaatatatcttataattccctctaatattttgtccagcagtaattatcttactcaacattttcttaatctcgtattatactcttcatggtgtcaccaatatctatag

SEQ ID NO: 4 - DNA, 606 bp, M.catarrhalis
gaagacccaaactgtcttgagattgtaaccaccatgcagcaagacagtttggtatgccaagtgccttgccaccgatttgatttaacaatttatcaagatatcgttgaagagattactcgcatgtatggctatgccaatatttgtgcgaccttgccagagctttctgtggatatgcgatatgatgatacggcagatttggttcaattggttaagcgatctttggcaagctcaggttattacgaagcagtgagcttcagctttagcgatgctaaaattgaagcactgtttgatgatcaaagcctaggcgcggtattgccacttgccaatcccatctccagtgatcttgcggtgatgcgtcgtaccttaatgtcgagtctgttaccgattgttagttataatcttaatcgtcagcagccgcgtgtccgcttgtttgaaactggattaagcttcgttggcggtgatgttgagcatgtggttcagacaccaagcttggctatgattgcaacaggcgagctgaccactgagcaaagtcatgggacacgcaagatggatttttatgatctcaagcgtgatattgaaagcctgctgccaaatactttggattaa

SEQ ID NO: 5 - DNA, 855 bp, M.catarrhalis
aaaggcaatcctatgagcgaccaagccccatcatcaatcacccccaaacccaaagcacccatcaccctatctactttaaacaaactaaaagcagagggtaaaacattttcttgcctaacttgttacgaggcaagttttgctcacgccatgcagttggcagacattgacaccattttaatcggtgatagtctgggcatggttgtccaaggacaaagctcaaccttgccagtgggcgttcaagacatggtttatcacactcaaaatgtggtgcgtggtaattctcatgccttaatcttatgcgatttgccattcatgagttatgccaccttatctgatgccatcaccagtgccaaggcggtcatgcaagcaggggcgaatgtggtcaaaattgaagggggcagcgagcttagcgacactgttaaggtcttgaccaataacggcgtgcctgtgtgcgtgcatttgggattaacgccgcagtcggtcaatgtctttggtggctataaagtacaaggtaaaacagacgcccaagcggataaattgatgagagactgtacggcggtggtgaatgctggggcgagtcttttgttgcttgaatgcgtgccagcaccgcttgccaaagccgttaccgagcggtttgatgtgcctgtcattggtattggggcgggtgtggatacagatgggcaagtgttggtcatgcacgacatgcttggcatttatacccgaaaacctgccaaatttgtcaagaattttttgaccgatgacagcaaccaaaccaaagacattgttggggcgtttaaggcctatcatcatgcagtcaagcagcgtgcctttccaacaaaacagcacagtttttag

SEQ ID NO: 6 - DNA, 666 bp, M.catarrhalis
atgttaagcaccgtgaaaaatctttttggtgagtttatgaatgcgatgataaaaaaattattacaagggcaagcggtagagtggcgagcgttgggggaggttgccaaaaaaatttcatcaggtggtacgcctaaaacaggcattcctgaatactataataatggcgaaatcccttggcttcgtacccaagaagttaattttaatgatatttatgacacaggcgtaaaaattatagaaccaggtgttaaaaattcaagtgcaaaatggatacctgcaaattgcgttattatagcaatgtatggggcaactgttgggcgtgttggtatcaataaaattccaatgacaaccaatcaggcatgtgcaaatattgaagtaaatgaagaaattgctgaatatcgctacgtatattactgtttagccaatcaatatgaatatattaaatcactgggaacgggttctcaaaccaatattaacgctcagattgtcaaaaaacttaaaatcccaatcccacccctatctattcaaagtcaaatcgttgccattttggacacatttgacacgctgacccaatccatcagcgaaggtctgcccaaagaaataaagctgcgtcaaaagcaatatgagtattaccgtgagcagttattaaattttaaagcgacgatttaa

SEQ ID NO: 7 - DNA, 222 bp, M.catarrhalis
  unsure (2),(3),(28),(31): Identity of nucleotide sequences at the above; locations are unknown.
annacggaagcagcgccggcgccgaaangcntaaatatcaataccgcaagccaagctgactttataagcttggtgggcgtggggcataagaccgcccaagccatcgtggattatcggcacgagcatggcaaatttgactcagttcaatcactgatgaatgtcaaaggtattggacctgccattttaaataagaaccgtcaccgcttaagcgtggcaaattaa

SEQ ID NO: 8 - DNA, 666 bp, M.catarrhalis
tatcatcatcagattttaggctttatcttacaacaaggaaattttatgaaatttgcattaaaaacagcattactcacaaccatgctaagtgttgcaactttggcacaagcaaactttgtcgaaggtcaggactataaagtattacccaatcctgaaactatcgcaggtgacgtcattgtggtgcgtgaatttttttggtacggttgcccacattgctatcatcttgagccacatatgcaaaaatgggcaaaaacacgccctgctgatgtggcattttttcagacacctgcggcgatgaatccagtgtgggaagtgggtgctcgtggcttttatgctgcccagcaactagacgcccaagaaaaaacccatcaagcattatttgatgccgtccacaaagatggcaatcgcaacattatcagttcacaacaagagcttggtaactggtacgcctctaaaggcatcgataaggcaaaatttgacagcctgtataattcttttgccgtaaccaccaaaatcgagcgtgccaaagcagctgcgacacgctatggtctatctggcgtgcctgctgtggttgttcatggtaagtatgtggtttccggtgaagatgccaaagtgcctcaagtcgtggattttttgattaataaagtgcgtgaagaaaaacaataa

SEQ ID NO: 9 - DNA, 546 bp, M.catarrhalis
ccacaaattaatgataaattaacgacaaatataaggtatcttatgattgattggtcaaaaatggacatgcgtgtttcacgcactgagattaaaaaatcccatgagcgtttgcaagcattatccgaaccacttgccaaattgtccaaaaaacagcttgccaatttgccagtaagtgaatattttttggatgaattaaagcatttaaccaatatagacagccacgccgccaaaaaccgccaaatcaaacgagtaggtaaactcatcattgaagaaaaccgccacgcgctaacgcaggcattatttgaatgtcaatttacccccgagcaaattgccaagattgaaacatggtatgatcgcctaaaactgtctgatgaaagcaccattaagcagtttgttaagcaatttaaaaaggcggaatataacagtatttatcaactgcttttgtggatagaatacgccaaacatttgggcgatgatgagctattggctgaaagcgtggcagattttgaaagttatgttaaagaggtggcgatattgtctaaatga

SEQ ID NO: 10 - DNA, 513 bp, M.catarrhalis
tgccaaaccaaaggcagacagcatatgaccacttgttttattggacttggtggcaacattaccaatgaacttggcactcccaccgagcatatcatcaacgccgtacaagccttcaaacagtcgccacattttaccgatgtgaaaatgtcatcactgtatcaatccaaagcctttggcatcaccgaccaacctgattttattaatgcggtattaagtgccaataccagcttaccaccgcttgagttgcttgatttttgtcaaggtcttgaacagaccgccaaaagagtgcgattgcgtcattggggtgagcggtctttggatgtggatattttgttatatggtgataaacgcattcatcatgaacggctgaccgtgccacatcaaggcttatttgaacgaaattttgtgttaattccaatgcttgaaattgatgagtgtttgctggttaatgggcaaaaattggcggatttaaatgaaagtaacagctggcaaggtttgaataaactgacataa

SEQ ID NO: 11 - DNA, 393 bp, M.catarrhalis
  unsure (192),(333),(336),(337),(362),(365): Identity of nucleotide sequences at the above; locations are unknown.
tcaaaagcaaaattatctgatgagctgggcgatgtgctgtttgtgttgacccatttggcacgccatttgggtattgatagcgagatggcacttcagggcactgtcggtaaatttcgccgccgttttgcatttgttgagcagtcgctgatggatcagggtaaatcgtttgagaatagtgatttggcagaaatntctggcccgcggagctgccaaaggcaaatggtagtctggttgcgtcgcgcattgccttattatttggcggtctttcgtatgcaggctttggatatgccaatccgcccaaacagtgctatgctgatacaaaaagtgcctatnaannacggaagcagcgccggcgccgaaangcntaaatatcaataccgcaagccaagctga

SEQ ID NO: 12 - DNA, 249 bp, M.catarrhalis
atcccaccactcatccgccaatttggtgaatttactaatttcgtcaaaatcagcattattgatcgcttggttggtatcgctggcagagtttatgctgttgatggtggcagtatcatgactttgcatggcatcatcctttggttttgttttatgtggctaaatttttttattttatcatttttaacggtatttgactacttttacaatttaaggtcatcattactcatcttaagcacccaaaactcttaa

SEQ ID NO: 13 - DNA, 399 bp, M.catarrhalis
atatcaaaaagcggccgaacttgggcattacgagtgatgtataatttggcggttgcctattttcaaggtgatggcatccagcaaaattatcaaaaagcacatgcgtggtatcaaaaagcggcggacatgggtcatgccagtgccaaatataatttgggcagcatgtatttttatgggcaaggggttgctgcaaatcaaagccacgcactcgcactctggcaacaggccgccaaacaaggcaatgcaaaagccgcccataatattggcgtgtattattacaaatcaaatcttgaacaaaataaagcagcagcaaaacagtggtttttggtctcgtgtcagttgggcttatctgatgggtgcatcaagcatgataattttgataaattaaccacaaattaa

SEQ ID NO: 14 - DNA, 1872 bp, M.catarrhalis
tggataagcggtaaaataaaggatttacttcagtcagtttttgggcaatgccccagtaatcaaggagtaggcatgggcaaagtgcctaaaaagccaaaacaaaccaaaaagagtatttgtaccacacattcagccaaatcgctgcgactacaaaaaggcagtttgccgcacagtattgtcgaggtcatcggcacactacaaaaagcaggatttgatgcttatattgttggcggtggcgttagagacagcttacttggtttggcacctaaggattttgatgcggtgaccgatgcaagaccgcatgagattaaggcaatttttgggggtcgttgtcgtatcattgggcggcgttttcagttggcgcatgtgtattcaggtcgtgagatgattgaggtggcgacttttcgtgctccacccaaagacgatacacacaccaccgatgacggtatgattatccgtgataatgtttggggcgatattgagcaagattttgcacgccgagattttagcattaacgcattgtattatcagccaattaagggtgaagtgctggatttttgtggtgcattaaaagacatcgacagtcatacgcttcgcttacttggcgatgccaaggtgcgtattgaagaagaccctgttcgtctgcttcgtgcgttgcgatttaaggcgaaactgggttttgaatttgatcaagatttggcaaatcaatttcatcaagacaattggacgcttttggagcaggtctctgcccatcgtctttatgatgaaactcaaaaaatgttcggtggtggctatttgacgccgctgttgccactgttgtttgaacatggggcgatgtcaagtttgatgagctttgcacccaatgagccgacgcctttgatgatggtggtcgcccaaaataccgatcggcgtatcgcagcagacaaaagtgtcaatccagcatttttttatgcagcgatgctgtgggaaaattatctgtatcaattggcgaagtataaaaagcgtggcttaccgtttcatgaagcacagattaaggctgccgaaaaaaccattgacgcccagcgtatcaaaactgccatacctaagtttgccgaacaattcattacagatatttggttgcttcagcctaagcttgtcaatccaagggtgcgtgatatcgctaatttggagcgtctgccaaaatttcgtgccgcatttgattttttggtactcagagaaggttatgatacccatccattatctgagccgacccaaaatatgggtgcttggtggcaggcgtatcaggacgccagtgctgttgataaagcgatcatgattgaggcgtttggtacgcaagcaggcacgccaaagcgtcgccgtgatcgtaatgccaaaaaagataccaagactcgtgagcttgagcagcttaaagagttgtctttgcgtagtgacgatgagctaatcaaaacacgccctgaaccattatttgtggtggcgggtgcagaagatttggtcaaaaaaaccaaagcacgaaccaaattgccaacgcctgccgtgcctacgcctgtctttgagccagtgaattttacacaagctgattttgaaaaattgcttgccaatgatgagccgtatattccagcatctcgccatcgtaagcgtaaaccatcatccactttatccatcaaagagcgtgaacaagggttgatcaagcagtcagacgagcattggtctggctctaaacaatcggctcaaacaaaaaaaccatcacgccatcaatctaaacaagttgatggtgtcactgatattgagcctaagcttgtagaaaatcaagccaagccaaaaagaacacgccgccgtaaatctaatgccaaaccaaaggcagacagcatatga

SEQ ID NO: 15 - DNA, 186 bp, M.catarrhalis
cattttcacatcggtaaaatgtggcgactgtttgaaggcttgtacggcgttgatgatatgctcggtgggagtgccaagttcattggtaatgttgccaccaagtccaataaaacaagtggtcatatgctgtctgcctttggtttggcattagatttacggcggcgtgttctttttggcttggcttga

SEQ ID NO: 16 - DNA, 852 bp, M.catarrhalis
gataaaaacatgaacatctgtcacaccatcaaagacttaaaaaacaaattaaaccccttacgcaaccaaaaaatagccttagtcccaaccatgggcaatttacatgatggacatttatcccttgtgaatcttgccaagcaacatgccgatgttgtggtggtgagtatctttgtcaatcccactcagtttggggcgggtgaagactttgccagttacccacgcacgcttgatgacgattgccaaaaacttgccaaagctggcgtggcgttggtttttgccccaagtgtggacgagatgtaccctgtctatccgcccaatgttcaaatcctatcaggcagcatcagcaagatattatgtggtcagacacgccccacgcattttgacggtgtgggcttggtggtgagtaagctgtttaatatcgttcgtcctgatgtggcggtatttggcaaaaaagactaccagcaacttgccatcatttaccaattggtgcaagaattaaattttgagattgacattattggcggtgagattgtcagagccgatgacggtttggcgttatcgtctcgcaaccagtatttgaccgagcaagagcgtgccatcgccccacggctggcacaggccttacaacagcttgcaggtgggttaaagtctgcaaattttgctgattttgatatgatgatacaaaaaactaaagatgaattaactcatgatggttttacggtggattatttgcaagtactcaatcagcaactgcaacctgctagccgccatgataaaaacttggtgattttgaccgcttgttatttgggtggggcaagacttttggataatttggaagttgccttaaattaa

SEQ ID NO: 17 - DNA, 255 bp, M.catarrhalis
  unsure (4),(5),(6),(8),(9),(10),(11),(12),(13),(15),(16),(17),(18),(19),(20),(21),(22),(23),(24),(25),(26),(27),(28),(29),(30),(31),(32),(33),(34),(35),(36),(37),(38),(39),(40),(41),(42),(43),(44),(45: Identity of nucleotide sequences at the above locations are unknown.
aaannnannnnnngnnnnnnnnnnnnnnnnnnnnnnnnnnnnnnnnnnnnnnnnnnnnnnnannngnnnnannnnngnnnannnnnnnnnnannnnnnnnnnnngnannnanngggggggggagggagaaggnggnaaataagaagagggggnnngnnagnncttttgggtgattttaattataaaccagatacgctaagcgataatcaaaagcaaaattatctgatgagctgggcgatgtgctgtttgtgttga

SEQ ID NO: 18 - DNA, 897 bp, M.catarrhalis
ggaaatatgatgcccaaactcattgccccaaactcaatcattgtggtgtcagggcgttcaggttcaggaaaaacctccgtactcaacaccttagaagattttggctattatccgcttgataatttgcctttatccatcgtgccacttgccatagaaaaattggtcaatgacagccagattcatcgcattgctgtggggatagatgtccgcacccccaaagcggatttatccaactttggtcaagtgtatgacagcttgatacaaacctatggcaagaccgctttgagtgtgttatataccaccgcccaagatgatgtactggtcgcgcgctatgatgccactcgccgagtgcatccattgatggcgatggctggcaatctgcccaatgccattcaaaaggaaaccgcgctgcttgaaccgattgcctgccatgccgatatcaaaattgacaccagtttgttaaacattcatgagctaaaaaacagcctaagacaacatttgggcgtggataatcatatcatcgttaatgtgctgtcgtttgggtttaggcatggcacgccaaaagatgctgattttgtctttgatgtgcgtaccttgccaaacccacattggcagatggatttgcgtcctttgacagggcttgatgcacctgtgcaggaattttttgctcaattttctgccgtgcatgagatgacgcatgacatcagcacatttttattaaagtggctgcctgattttattgagaacaatcaccattttgtgaccattgccattggttgtacagggggtaagcaccgctcggtatttgtcagccaagtggtgggggagatattaactggtcatttgcctgataaaatgcaggtgaatgttaagcaccgtgaaaaatctttttggtga

SEQ ID NO: 19 - DNA, 279 bp, M.catarrhalis
acaatcatgattaaaaggttattattcatgaatgtcgaaacacccaacccaaaaaccgccaaacatatggcgacaagcgtgatttttatgctgtctgtgatggcaggtacgcccagctgggcaaccgatggcgatgctgttcaaaccagtaaagacagcaccatcgcacaacaagccgatgagttttttgaattggcggttcgctatgatcaggcatcagattaccccatggcggtgcgtgaatatcaaaaagcggccgaacttgggcattacgagtga

SEQ ID NO: 20 - DNA, 624 bp, M.catarrhalis
gaaaacacagatgtagcgcgtgataataaagcggtggcacaagcacttgagattgaatcgcccaatggcaatttggagggtatgtttgcaccaaatacttaccaattttcacatggcacaactgatttagaaattttaagacgcttatatcaagatcagataaaaattttgaataaagcttgggaatctcgtgatgaaactttgccttatcagacaccatatgaagcactgattatggcaagtatcatcgaaaaagaaacgggtgttaaacaagaacgacaaatggtttcagcggtatttgtcaatcgtctgcgtcagggcatgagactgcaaacagatccgacaatcatttatggaatgtttgaccgttatgatggtaagatttatcgaagtaatattgccgaaaaaacagattataatacctatcaaattgatggtctgccaccaacgcccatcgcattaccttcggcagcttccatcaaagcagccatgcaccctgctgataccgatgtgatttattttgtggcaacaggcagtggggggcatacttttagccgcacctatcaagagcatcaaaaagctgtggcagaatatcgtgcttttatgcgtgatcgcaatcaataa

SEQ ID NO: 21 - DNA, 218 bp, M.catarrhalis
  unsure (198),(210),(211): Identity of nucleotide sequences at the above locations are unknown.
aagggtaagtgcatgcaagggaaatttatcagttttgagggtactgagggcgtgggtaaaaccacggcaattgaagcactcattactcgtttggtggatcgtggcatacaagtcgtacgcacacgagagccaggtggtagtgagctggctctcgtgtcttcaccacggggctggaaggatccgacgcgggcgtcaatngttccaaagggnngttctat

SEQ ID NO: 22 - DNA, 1122 bp, M.catarrhalis
tcgcatatactcgaggaaaccatcatggcaaaggccaagtttgaacgtgtaaaaccacacgtaaatgttggtaccatcggtcacgttgaccatggtaaaaccactctaactgctgctatcgcaaccgttgctgctaagcaccacggtggtgaagcaaaagattacgctgctattgactcagcacctgaagaaaaagcacgcggtatcaccatcaacacctctcatattgagtatgacactgcagctcgtcactacgcacatgtagactgcccaggtcacgctgactatgttaaaaacatgatcacaggtgcagcacagatggatggtgctatcttggttgtttctgcaactgatggtcctatgccacaaactcgtgagcatatcctactatctcgtcaggttggtgtaccatacatcatggtattcatgaacaagtgcgatatggttgatgatgaagagctactagaattggttgaaatggaagttcgtgaacttctatctgactatgatttccctggtgatgataccccaatcatcaaaggttcagcactagaagcattgaatggttctgatggtaaatatggcgagcctgcagttctagaactgctagacacactagacagctatatcccagagcctgagcgtgatatcgataagtcattcttgatgccaattgaagatgtcttctcgatctcaggtcgtggtacagttgtgactggtcgtgttgaatcaggtattattaaagttggtgatgaaattgaaatcatcggtatcaaaccaactgctaaaaccacctgtactggtgttgaaatgttccgtaaactgttagacgaaggtcgtgcaggtgagaactgtggtatcttgttgcgtggtactaagcgtgaagaagttcaacgcggtcaagtacttgcaaagccaggttcaatcaccccacatactaagtttgatgctgaagttaatgaactgtcgaacgaaaaaggtagacgtcacaccccattcttaaatggctatcgcccacagttctactttcataccacagaggtggctggtgccatcactctacaagaaggtaccgaagtggtaatacagggtgacaatgttttagatgagtgtcgaccttaa

SEQ ID NO: 23 - DNA, 267 bp, M.catarrhalis
acttcttcacgcttagtaccacgcaacaagataccacagttctcacctgcacgaccttcgtctaacagtttacggaacatttcaacaccagtacaggtggttttagcagttggtttgataccgatgatttcaatttcatcaccaactttaataatacctgattcaacacgaccagtcacaactgtaccacgacctgagatcgagaagacatcttcaattggcatcaagaatgacttatcgatatcacgctcaggctctgggatatag

SEQ ID NO: 24 - DNA, 183 bp, M.catarrhalis
acgcatttgggttgcatagccaaacatttcagccaatggtacttctgcacgaatagacttggtgccaccaggaagatcatccatgccttgaaccataccacgacgacggttcaagtcacccatgatgtcgcccatgtagtcttcaggtgtttccacttcaactttcatgataggctcaagtag

SEQ ID NO: 25 - DNA, 597 bp, M.catarrhalis
cgtggtaaatttggtcatgtttggttgcgtcttgaaccacttgatccaacaggcgatgtggaatacgaatttaacgaagaaattgtcggcggtgtagttccaaaagaataccatgcagcagttgataaaggtatccaagagcgtatgaaaaatggcgttatcgcaggatatccagttgttggtatcaaggcaactttatatgatggttcttatcatgatgttgactctgatgagctatcatttaagatggcaggttctatggcgttcaaaaaaggctttctacaagccaatccagcgctacttgagcctatcatgaaagttgaagtggaaacacctgaagactacatgggcgacatcatgggtgacttgaaccgtcgtcgtggtatggttcaaggcatggatgatcttcctggtggcaccaagtctattcgtgcagaagtaccattggctgaaatgtttggctatgcaacccaaatgcgttcaatgtctcaaggtcgtgcaacttactcaatggaattcttgaagtatcaagaaacgccaaaaaatgttgctgatgagatcatcaagaaatttacagctaaagatgatgatgaataa

SEQ ID NO: 26 - DNA, 1284 bp, M.catarrhalis
aaaataagtcttattgtcatcattactgattacaatgccatcaaaagtactatttatggagttgtgatgaaattttatatcgccaaaacacacattttcttagccctcatggtgggtttgtcatctatggcatgggcaaatcctgcggcaactttgacaggatttgccaaactggatgtcgaaacttatgccacaggtccaatctcaggtagggcagccaagacagccaatggcatcgttgtaccctttaaagctcagccggttcaggggttttctggtgccctaaaaaaccatgatagcagctatactgtgttggcagataatggttatggcaccaaggataattcagcagattttttattgcggatttatcatcttgatgttgattttcgctccaaagaagggggtggtggtgaggtgaaagtgctggattttattcagcttcgtgatcctaacaagctcatcccttttgaaatcgttaatgaaaactcagctgacagactcttaacaggtgcagactttgaccctgaatctattcagcgaacctctgacggcagttattggattggtgaagagtttggaccctttttgctgcattttaataaagaaggcgtgttgattgatgcaccgatcgcattactgcatccgaatcagaaaaatcagcagctgcgttcacctcaaaaccctttgaataccaattactcatcacctactaccgtgcagcgcagtggcggctttgaagggatggcgctgtcgagtgatggcaaatttttatatcccatgctagaaaagccattaactgatacaggcactaagcagttgctaatttctgaatttgatgtccagaaaaaagcttatacaggcaaccattactggtttgtgctggatgaaagagcgacagcgattggtgattttcagatgattgataaccgatcagggattgtaattgagcgagatgataccgaaaacgactggaatggctataaaaaattgatccgcattacgcttggtcggtcaggtcaagcagttgatcgcacggatcttgttgatctgatgaacattgataatcccgatcatttgtacggtcctgttcgagcaggcgatatgggtgtgggtcaaagattcacttttccattttttaccatcgaagatattatcattgaagatgatcgcactatcacagtgtttaatgataataattttccaggctcgtcagggcgtaatgcaaatttggcggatgacaatgaaatcattcgtctaaatttacatcagcccctgcgctga

SEQ ID NO: 27 - DNA, 1179 bp, M.catarrhalis
agacaccttaagcaggtaaatttaacgcttgcagcgtgtaatctgattgtcggagctaacggaagtggtaaaacatcgctgttggaggcggtgtttttgttgtcacgaggcaaaagctttcgtcatcatgagcctaaacgatatatccgccaccatcaaagtgcttgtaccgtatgggcacgcacaaaatttgaagagtcctgtacgcttgctatccaaaaaaagctcgatgagacaggcaagtctgactctattttaagatttaatgaacacaccgtttcaacccaaagtacgctaagctttcatttgccaaccttgctcatcgaccctgttagtatgagcttgctggatgaaggcagtatctctcggcgtcagatgcttgattggctgacttttcatattcagcctaagttttatcatcagtggctacaataccaacgcctactcaaacaaagaaacgctctactcaaacatcccagcgttcatcataagcttcccgagctgtttgcttgggatgaacagcttggattttatgcgcatgctttacatgagcatcgcttggcagtttttgatcaatggaccagatattttgatgagatgataaagcagcttttgcctgagtatcactcatcgcttagcctacaatatctggcaggttttgactataccaaacccttgagtcaaaccctaaaaatgcgtcttaatcaagacatgagcttaggttatacacgcataggtgcacatcgtgcagacatcaatgtcaaaattcattctcaaaacaatcaagggcaaacaatccacgaacaagccacgcatatcctatctcgtggcgaaaaaaaactcctcattactgccctaaaactgtctcagctaaagctgatgtgtcatgccatcgataagatacctatgcagacagcacatccgccagttgtattgattgatgatcttgatgctgaacttgatgaagatgccattgaaattttgctcaaaacggtattttcgttgccttgccaagcgattatcaccagccttaatgtacagacgcaccaaaaaatcttagcacttaagtctgatggctttatggcgacttctgcaccaaatcagcgtaccgccgaagacttatcttataagatgtttcatgtggaacagggtaaattccaagagtgcaacatttcataa

SEQ ID NO: 28 - DNA, 255 bp, M.catarrhalis
  unsure (31),(32),(35),(38),(39),(40),(57),(63),(64),(65),(67),(71),(77),(78),(79),(81),(90),(99),(126),(129),(130),(136),(147),(157),(161),(180),(191),(200),(219),(222),(223),(224),(225),(242),(243): Identity of nucleotide sequences at the above locations; are unknown.
atagggcgcgaccacgtattaagaagaaaannatncgnnnggcggcggcggggtcanattttnnnangcantacttnnntnacttattanaaaaaaaantttatttttatatttaaaaatattatnttnntaaaanaaaaatttttnttaaaaattntttnaaaattaattaatatatantttattttatnatatgaaanaaatatttttttttttttnttnnnnaaaaaaaataaaaaatnnttttttttttaa

SEQ ID NO: 29 - DNA, 336 bp, M.catarrhalis
  unsure (307): Identity of nucleotide sequences at the above locations are unknown.
aagcctaaggatcagatgatgaaaaagatttttgtagctgctttggcgctgtctgccttgtctgctcaagcggcgaccgtcacctactatggtgataagtttcatggcaaaaagacagcaagtggcgagagatttaaccaaaatgcaatgacctgtgccagtaatagccataaatttggcacgcatttaaaagttaccaacaccgccaatgataaatcagtgatttgccgagtgaatgaccgtggcggctttggtaaatatggcgtgactttagatttgtcaaaaggtgcatttactaaaattatantactggcgcgcggaagccgcgcgcggtaa

SEQ ID NO: 30 - DNA, 1578 bp, M.catarrhalis
ttaaccgaaggtattttaatgaccaacattacccaagaccgcatccttattcttgattttggctcacaatatagccagcttattgctcgccgtgtgcgtgaggctggtgtgtattctgagattcatgcgtttgatatgtctgatgaagatattcgtgcatttaatcctaggggcattattttatctggcggccctgaaagtgttcatcaagaaggttcgcctcgagcaccaaaggctgtctttgagcttggggtgcctgttttgggtatctgttatggttttcagaccatgtccgaacaattaggtggcaaggtagaagctggattggtgcatgaatttggctatgccaagattgatatcgcgcatcaagataaactgcttagcaaaatcaatgatgaaaaaaatcaatctcaagtttggatgagccatggcgataaggtggcaagcctaccaacaggtttcactgtaacatcttctacaccaaattgcccttatgcatctgcttctgatgaagatcgtcagttgtacggtgtgcaatttcatcctgaggtgacacataccgaaaaaggagaacagctgatttctaattttgtgcatatcatttgtggttgtggtaatgcgtggaattctgaaaatatcattgagatgcgtattgagcaactcaaaaaccaaattggcaatcaaaaagtattacttggtctatcaggtggcgttgatagttctgtggttgcagcactgcttcatcgtgccatcggtgatcagctgacttgtgtgtttgtggataatggattattacgattaaatgaaggcgatcaggtgatgcaaatgtttgctgaaaacatgggcattcgtgtgattcgtgctgatagtgaggcgcgttttttaaatgcacttgcaggtgtgagtgatcctgaagcgaagcgtaaaatcattggccgtgagtttatcgaagtgttctcggaagaggcgcgtaagcttgatggcgttaagttcttggctcagggcacaatttatcctgatgtcatcgagtcagcagccagcaagcaaggcaaagcacatgtcatcaaatcacatcacaatgtgggtggtttgcctgatgatttggcatttgaattggttgagcctttgcttgacttatttaaagatgaggtgcgtaagcttggcgttgcacttggcatcccgcatcatatgatttatcgccatccttttccaggtcctggattgggcgtgcgtattttgggtgaagttaaaaaagaatatgccgatatcttgcgtcttgcagatgatatttttatgcaagagcttagagcgtctggctggtatgataaaactgcccaagcttttgcagtatttgagcctgtcaaatcagtgggcgttgttggtgatggcaggcgctatgcatgggtgattgcactgcgtgccgttgagacggtagattttatgacggctcgttttgcacatttgccttatgagctgattgataaaatttcaacacgcatcatgaatgaaatcaaagaggtttctcgtgtggtgtatgatgtctcaagcaagccacctgcaacgattgaatgggaatga

SEQ ID NO: 31 - DNA, 2469 bp, M.catarrhalis
ggaaatttcatgaccgatagcaccaacaatcatccacaggtcgatgcacaagaaattgaatacaccgctaaaaatgtccgagttctgcgtgggcttgaggcggtgcgtgtccgcccaggtatgtatatcggtgataccgatgatggtacaggcttgcaccatatggtgtttgaggtggtggataatgccattgatgaggcattggcaggtcactgtgatgagattaatattatcgtccatgacgatgaatctgtttcggtgatggacaatgggcgtggtattcctgtggatatccaccctgaagaaggtgtatcagctgccgaggttattatgacggtgcttcatgcaggcggtaaatttgatgataattcatacaaagtatctggtggcctacatggtgttggcgtctcggtggtcaatgcactgtccaaaaagctgatcttaacgatttggcgtgatggttatgctcatacccaaaactatactgacggcgtgccagatgcgccactggctaagcttgagccgtctactcagacaggtactcaggtgcgtttttatccaagctttgagatttttaagggcgtgcaacactttgattacgatattcttgccaagcgtttgcgtgagttatcatttttaaattcaggggttcggattgttttaacggatgagcgtacaagtactactcaggtgtttgagcataaaggcggtttgtctgaatttgtcagttatattaatggcggcaaacacaccttaaacgatatttttcattttactgcagatggtgcagatggcatcggtgttgaggttgcactgcaatggtcggacagctacaatgagaaggtactttgttttaccaataatattcctcaaaaagatggtgggacgcacttatctgggtttcgttcagcgttgacacgctgtctaaatcattatttagactctgaaaatatcaccaaaaaagaaaaggttcaaatcacaggtgatgatgcgcgtgagggcttaaccgccatcatttctgttaaagtgcctgatcctaaatttagctcacaaaccaaagacaagctggtttcaagtgaagttaaatccgtggttgagaccgccatgcatgaacgattatctgagtatttacttgaaaatccgactgccgctaagatgattgcaagcaaaatcattgatgcagcacgggcgcgtgatgcagctcgcaaagcccgagaaatgacacgccgcaaaagtactttagacattgcaggtttgccgggcaaattggctgattgccaagaaaaagaccccgctttatctgaattgtttatcgttgagggcgactctgcgggtggttctgccaaacagggtcgtaatcgtaaaatgcaggcaattttacctttgaaaggtaaaattttaaatgttgagcgtgcacgatttgataaaatgctctcaagtgctgaggtggggacgctgattaccgctttgggtacaggtattggacctgacgaatacaatcctgacaaaattcgctaccataaaattgtcatcatgaccgatgcggatgtggatggtagccatattcgcactttgctcctgactttctttttccgtcaaatgccagagctgattgagcgtggtcatatttatattgctcagccaccgttatataaggtcaaacgcggcaagcaagaggtttatctaaaagataccgaagccttggatgcatatttgttatcatcaaccattgatgaccatcagctatttttgagtaaagatacaccgcctgtgactggcgtggcacttgaaaaactcttaaaagattacagtcaaagccaagtaattaaagcacatttgcaatcaaaatatccatcgcatctactagatgcacttactttgataccaaagcttgatgtctctgccattggcgataaacaggcagttgatgagtgggctttggcacttgaaaatcagcttaacgacctagagccaaagcttgatgccaaagttgaagcggtacaagtattgggcggggatgatggcaatggacattggctacctcgtgttacgcttcatattcatcgcctgccacatcagtatttattggatacgaattttttgggttctgctgactatatgcgtttattaaaactcagtgccaattggaataccgttttatctaacagtgcttttttgcgtcgtggtgacaaggatttcatcattaaagattttgagtatttatggcaacagttgatgcttgctgctcgccgtggtgtggatgtgcagcgttataaaggtctaggtgagatgaataaagagcagctttgggaaacgaccatggatcctgaaaatcgtcgtatgcttaaaatcaccattgaagatgcgatcaaggctgatcatttatttagttgcttaatgggtgatgaggttgaaccgcgtcgtatctttattgaagaaaatgcactaaatgccgatattgatacctaa

SEQ ID NO: 32 - DNA, 387 bp, M.catarrhalis
  unsure (97),(154): Identity of nucleotide sequences at the above locations are unknown.
attcgaacacccaaacaacttgttaatatctattcgaagcgaatgcagattgaagaaaccttccgagacttgaaaagtcctgcctacggactaggcntacgccatagccgaacgagcagctcagagcgttttgatatcatgctgctaatcgccntgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatga

SEQ ID NO: 33 - DNA, 273 bp, M.catarrhalis
  unsure (168): Identity of nucleotide sequences at the above locations are unknown.
tcactcaaaagatttgaggttataagaggcttgattaaaagcaattccattctcaaggcaaattcctattgtataattcccgctctaaaggccgaaaaaatcagcgctgaacaacggactcattgtcaccaccggtcacataaaatctactcagcgtcggcaaagagnccatgggttctagcaattaacttacttgttaaattcgaacacccaaacaacttgttaatatctattcgaagcgaatgcagattgaagaaaccttccgagacttga

SEQ ID NO: 34 - DNA, 249 bp, M.catarrhalis
tttatcggagcagcaccaatgcttgatacaggtattgaggtatcactgccaaaagagcagaccaaacccatcacacaagctgacaagctgcctgtcattgtcagcattcaggcaaatggcaatctgtatgtaagccataaaaatggcctcgatgtgccaatcacgcctgacaaagctaaataccctgctacgccagatgcaccaagacaataccgatttacaagtgatggtcaatgccgatgcaaataa

SEQ ID NO: 35 - DNA, 1605 bp, M.catarrhalis
gtgccttttctaggtattttaacttttttgtgctttttatttttattgatggcattgaagaaaattacaggcaacctttctataaggagaacccatatgtctaagcctactttgataaaaacaaccttaatttgtgccttaagtgcattgatgctcagtggttgtagcaatcaagcggacaaagccgcccagccaaaaagcagcacggtagacgctgccgccaagacagcaaatgcagataatgctgcctcacaagaacatcaaggcgagctgcctgtcattgatgccattgttacgcatgcaccagaagttccaccacctgttgaccgtgaccaccccgccaaagtggtggtaaaaatggaaaccgttgaaaaagtcatgcgtctggcagatggcgtggaatatcagttttggacatttggcggtcaagttccagggcagatgattcgtgtgcgtgaaggcgacaccatcgaagtgcagttctcaaaccacccagattcaaaaatgccccataatgttgactttcacgctgccacagggcctggcggcggggcagaagcgtcatttaccgcaccgggtcatacatcaacctttagttttaaagccttacagcctggtttgtatgtctatcactgtgcggttgcccctgttggcatgcacattgctaatggcatgtatggcttgattttggttgaaccaaaagagggcttgccaaaagtagacaaagaatactatgtcatgcaaggcgacttttataccaaaggcaaatatggcgaacaaggtctacagccctttgatatggaaaaagccattcgagaagatgctgaatatgttgtctttaatggttcggtgggggcgttgactggtgaaaatgctctaaaagccaaggttggcgaaaccgttcgcttatttgtgggtaacggcggcccgaatttgacatcatcattccatgtcattggtgagatttttgataaggttcactttgagggtggtaagggtgaaaaccacaatatccaaaccacgctaatcccagcaggtggcgctgccatcactgaatttaaggtggatgtgccgggtgattatgtcttggttgaccatgccatcttccgtgcctttaacaaaggggcattgggcatacttaaggtggaaggtgaagaaaatcatgagatttattcacacaaacaaacagacgctgtctatctgccagagggtgccccacaagcaattgatacccaagaagcacccaaaacacctgcacctgccaacttacaagagcagattaaagcaggtaaggcaacctatgactctaactgtgctgcttgtcaccaacctgatggtaaaggcgtgccaaacgctttcccaccgcttgccaactctgactatctgaacgccgaccacgctcgtgccgccagcatcgtggcaaatggattgtctggtaagattaccgtcaatggcaaccaatatgaaagcgtcatgcctgcgattgctctgagcgaccaacagattgccaatgtcatcacctacacgcttaacagctttggtaacaaaggcggtcaactcagtgcagacgatgtggcaaaagccaaaaaaaccaagccaaactga

SEQ ID NO: 36 - DNA, 534 bp, M.catarrhalis
acatggttgcagagtgtgattatgagattaactcaatacagtgattttgcgttgcgtgtgctgatttatttggcgaccatacccaataatgatgaattggtacgcattgatgacattgccaaaagctatgggatttctaaaaatcatttgaccaaggttattcatcagttgagcaagcttaaagtcgttgacagtgcgcggggtaaaaacggtggcattcgcttagcaatgcaccccaaaaacatcaatgttggcaacatcgttcgccaaacagagccagatttttttgtggtggcgtgttttgctgatgagccagcacaagatgatttaatgacagataatttgatgacaaatgatttgaggaaaatcaaaactttggatttgtctgtggggcaacccgccatgtcttgtgtcatctcacctgcttgtcatttaaagcaagtttttgccgaagccaccaaggcatttttgcaggttttggacagctatacgctgaccgataaatacagacatgaatgttgtgccttacattga

SEQ ID NO: 37 - DNA, 252 bp, M.catarrhalis
  unsure (237): Identity of nucleotide sequences at the above locations are unknown.
agggtccagtgcctatgccgaaaaaaaaaggccagggcgcgtttcctaaaaaataaaggagatccgcggattggcgccgccctctcgcgtcgtttaagcacttttgggcgcgcaaataaaactcacgcctttttattattcacaaacacaggagtagtcgtgtctttgtggtattcaacattcgagagggacttcctctccatatatttacgagggggaaaagtgcttacacgccgngacgctctaaattaa

SEQ ID NO: 38 - DNA, 189 bp, M.catarrhalis
gccataaaaatggcctcgatgtgccaatcacgcctgacaaagctaaataccctgctacgccagatgcaccaagacaataccgatttacaagtgatggtcaatgccgatgcaaataatgcctacagccgaattatgcagattatggaattgattcaaaaagttggaatcacccaggtgagttttgcttag

SEQ ID NO: 39 - DNA, 816 bp, M.catarrhalis
  unsure (670),(726),(747),(754),(760): Identity of nucleotide sequences at the above locations are unknown.
aaggagttagtaatgacctaccaatcagccctagaacatgttcgctctgttaaagccaaattaggtaattattgggacgccatccgcccagaagatgccgctcgtatggttgtccgcggccagacaggcttgacagcgattgtggttggcgtgctgtttttattgatgctattttttcagccattggcatttttggtaccaagctatgccaccccaccccttggctgttggcatggatttatcgcccagcaaaagatgattgccaacaaaaaatactttggcactaccagcaaacgctacatctacctatcaggctggatggttgctgcattgcgttctgaatttggtccattgcctgaccaatccatgcacgaaaaaaccgccgtaccaaaactcattgaagagatttatacttttcttcgtcaagcagatgccaaagagctaaatgatttattccgtgccttgcaacaagcagagcaagcaggcgatgaggcaaaggtcaaagaaattgaagcgaaaattgacaactttgaaacccatgttgtgccaatcatcgctgacattgatgcaggttttggtaacgaagaagcaacctatttattaaccaaacaaatgattgaagcgggtgcttgtgccattcaaattgaaaatcaggtgtcagatgctaagncatgtggacatcaagcgggtaaagtgactgtaccacacgaagactttttggcaaanattaacgcccgtgcgtatgcngtcttanagcttngcgttgatgagggcgtgattgttgccccgtaccgactcagagggtgcttgatttga

SEQ ID NO: 40 - DNA, 2739 bp, M.catarrhalis
atggcaaaaacagttaaacaacttgcacaaacttcaaaaacaacaaccgaaaccatcctaaaacaacttgccgatgctggtctaccaagtcgtggcgaaaatgatcttgttaccgatagcgagcaagataaactggtggcttttttaaagcaaagccatggtgaaaaacccaaatctcgcatcagtttaaaatccaaaactacctcaaccgctcaagtgacaggcacatcaggtaaggcaaaaacggtcaatgtcgtgcgtaccaaaaaagtcgtctatgacaaaccagatccagctaagattgaagcgaaaatcgcagcccaagctaaggctgccaaagaagcacgcctaaaagctgccgaagaaaaacaagctgccgaacgcagtaaaaaagaagcagctgagcgtcaagcggcaaccttggctgcgatgcgtgcaagcagtgagcctgtaaaaaatcatgaggttaatgcgacggttgtcgtcaaaaagataaaaaatccagaagacgccaagcctgctgataaagcagaaaaaaccgataagaaaaaacctgccaaacccatcaaaaaagaatcggcaactgacaaaaaagcgcgtgaagctcgtgaagcagaagaagagcgtttgcgtcagatggaggcagaaacacgccgtaaagctgccgaagaagctcaaaaacgcacacttgagcagatgaaacaaatggcgtctcgctatagcgatgctgatgacggtgcgactgccgctattgttcgtaccaaagacgatgcaccgttggctgatggcttggtgggtgctgcgcttgaagaatcatttgaaaaagagcgtcgtgaaattaaacgaggtgcaacaggcactgctggcaaaggcggtaaaaaaagccgcaaaggtcagcaagaagagcgtgaaatgaaaacccgtgcaaagggcttaaaatcatctcaagccaataaacataaatttgaaatgcctgttgaaaaaatcgtccataatgttgaggttggtgaaaatatcgttttatccgatttggcacaaaaaatggcggttaaggtgcgtgaagtcatcaaatcactgatgaagatgggtgagatggtgcgtgagtcagacagtatcgatcaaatgaccgctgcacttgtcatcgaagaatttggccataactttgtaccgatcagcgatacccagctagaagatgatttacaagtcgctgttgatgaaaaatcaggtaatgtccaaacacgcccacctgtagtaaccatcatgggtcatgttgaccatggtaagacatcgcttttggataaaatccgcactactaaagttgcaagcggcgaagcaggcggtattactcagcatatcggtgcatatcatgtaacaacagatcgtggtctaattacctttttagataccccaggccatgctgcttttaccgccatgcgttctcgaggggctcaagcaacagatatcgtggtgcttgtggttgctgctgatgacggcatgatgccacaaaccgaagaggccatcgatcatgctcgtgctgcagggacaccgctcattgttgcgattaacaagatggataaagataccgccgatccagatcgtgtgattaatgagttgtccgtcaaagaagtcattccagaagaatggggtggcgatactcctatggttaaagtctctgccaaatcgggtatgggtattgatgagcttttggaggttattagtatccaagcagaactgatggagcttgaggcaccgattgatggtgctgcccaaggtgtggtgattgaatcacgcttggataaaggacgaggtgctgtggcaagcttattggttaagcgaggtacattaaatcaaggtgatttggttttggcaggcgaatactatggtaaggttcgtgccatgactgatgaaaatggtcaacgcatcaaaaccgcaggcccatcaattcctgttgagattttgggtctaccagaagcacccgcagcaggcagtgaatttttagtggtatctgatgagaaaaaagcccgtgaagttgctgattttcgggcagcacgggagcgtgaacgcacgcttgatcgtcaaaataaaatgcgacttgataccttatttgaaagtatgggatcggcagaagttgcaactttgaatatcatcttaaaaacagatgtccgtggttcactagaagcgttattaaatgcattagacgaactttcaactgatgaagttaaagtgcgtgtgatcagctcaggcgttggtgcgattaccgaatctgatgtcatcttggcagaatcaagtgaagcggtattgcttggctttaatgtccgtgctgataatgcaggtaaacgcaaggcagatgaagcgggcatagatattcgttattatagcgttatctacggtcttattgatgatgtcaaagcagcaatgagtggcatgcttgcaccagagcatcgtgagcagattttaggtatcgctgaggttcgtgatgtcttccgctcaagtaaatttggcgcagccgcaggctgtatggttcaagaaggtactatttatcgcaataagccaatccgagtcttgcgtgatgacaaagtcatctttacaggccatttacaatctttgcgtcgctacaaagacgatgtcaatgaggtaaaagcaggtatggaatgcggtcttgcggtcaagggctatgaggttgccgtgggtgataagattgaggtctttgagatccatgaagtgaaacgagagctataa

SEQ ID NO: 41 - DNA, 519 bp, M.catarrhalis
ggaaataagacaatgaaaacaccgcatacaattgatgatactcaaaccttagagcttttggaagaaagggccgaagttcaaaaacagcgtgttaatacaggtaaggtgattttatccaaaaagatacacacacgcaccgttaatattcccatcaccttaactgaagaacatcttgtcatcacctatcaacaagatgatgcctctttggcaactcatgaacagttgtcaaatgatgatgacttggttaatattattgacaacacaaaagccacacacgccaaaattaccatcaacggtcaggtgcgttcattaacaccagatacaccaattgagatgttgttgtattgtgagactgcgacggtcacaaaaacagctcacgccattgaagatattcacctaaacacccaaaccattcagcgtgagcatgtttttaccaccaagctacaaaaagaagtgctggatatacaagaaggtgaaaatttagtgattcaaaatgatgacctagattatgccaaataa

SEQ ID NO: 42 - DNA, 600 bp, M.catarrhalis
ttgatctatcaatcagatcaacaaaacaaagggagaagtatggtgagtaagttagtacgattgtatgacattgaagctaccaaccgtgaagtattgggagatgactattataacccaatcggcaaaactgcttatggcatcggtcaagaaaaacttggtaaagtacaagatgtattggttgaggtagacacaggtaaaattcgctacctagtggttgacgctggtggttggttcttctcaaaagaggttttggttccagcaggcttgtctcgcattgttggcgatgaggtatattttgacagtctgaccaaagagcaagtagaagcaatggaaggctatgatcaaaattatagctatacctatgaagaacaatataataaagaccgtgaattttatgcagcagagacactgcctgcagaaagccgtcttgagttagatgaaagccattatcatgctccaaatacgctagagctgttagaagaacgcttaacagtcaataaagaccgtatcgtagcaggcattgttagccttggtaagcatgtggttaccgaagaacgccgtgttgaggtggatttagaagaagagcatgccccacattga

SEQ ID NO: 43 - DNA, 939 bp, M.catarrhalis
atcatgatgaatcggccgaccaaaaaagtggtgatttcaggcattttattattagataaacctgctgatatcagctcacacagtgctttggcaaaagctaagtatttatatcaatccgagttgtatgattctaaaaaagcaggtcatacaggcacgcttgaccctatggcaacagggcttttaccgatatgttttggtgaggcaaccaaatttgcacagtatgggcttaatgcagataaaagttatgtcgcactgttaagcttaggcgttaaaacagatactgctgatagatatggtcaggtgatacaacgcaccgatgcaccaagctttaatcagcaaacgcttgatgggattgccaacgctttaataggcaaacaaatgcaagtaccgcctatgtattccgccttaaaaaaagatggtaaaaaattgtatgaatatgcacgattaggcgaggtggtcgagcgtgatgccagacccattatcatacataatttgacactcacaaaactggataataccacaattaaattgattgtctcttgctcaaaggggacttatgtgcgtgtgctgggtgaaagtgtggcagagcatttggactgtgtggggcatttgattgccttacaccgaacctgtacaggtggatttgatgtggcagatgcgataagccttggtgagttggcgaattcatctttggatgaacgcttgggcagacttttgcccacagatgcgatgcttggtcatttgcccatgttgagactgacaacggatgaggcggcacgcattaaaatggggcaacgattaaatgtcaaagaccgtctagatagcttgcttgagtttgatgatgtgttgcttgtgcgactgtatgcccaagatgtatttattgggctggcagaggtatctaaaagcggaagattacagcctaaaaaattggtcgcataa

SEQ ID NO: 44 - DNA, 186 bp, M.catarrhalis
tataacgagcttcgacccagcgacaatatacttgaggataaaggtttgggctatggcataagctcccgtaaagagaccgacttggctcgttatgccttagattttaaaaattatggtacgattaactcttcttactcttatcaaccacaaacgagcacgactttcacctcttcaggcgagcattag

SEQ ID NO: 45 - DNA, 507 bp, M.catarrhalis
aaaaatgggctatactaccaccatcatactgaggtgaattttaataacattttattaatcgtatatctatttagaggacttatgaatcaacgattacagcgacttgctgaccaaattcagcgtactttagccattttaattcgagatgagattaatgacccacgcttgacggggtttgtgaccatttctagtgtgaaggttagccctgatttgggctatgctgatgtttatgtgacgattttggagccaagtcaagatggtggcatgaatagtgaggcacatgctcaaagcttaaaagtacttaataccgctgctggatttttgcgaactgagctggcacgcaccatgaaaacacgcaccacgccacgcttaagatttcattacgatgaggtgaccgcccatggtaatcgcatgatgagcttggttggtcaagccatgcaaaaaacccaagaaagtgaaaaaaactatctggatgaagagcatcagttggatgatgataaatcatga

SEQ ID NO: 46 - DNA, 312 bp, M.catarrhalis
aagaagagcatgccccacattgagcgtaccgctgtagatcgcccgacagatcgccgtattaatgattcgggtgcagacaccatcagcgttgagctagaagctgagcgagccaatgtgaccaaacaaacttatgtcaccgaagaggtcaccttaggcaaaacttcagaaactcgcacagagaccattttagaaaccattcagcgtgaagagcttaatattgatgatttaggcaatgtggttgataaaaatggcaatgtggtcaactatgaaggcattaccgctgatgaagtacgccgtgctcgtggtctataa

SEQ ID NO: 47 - DNA, 654 bp, M.catarrhalis
ttgtttggaatgaagataccagcacaatatatcatcagtgcgcttgagcctgctgatgtcattggtcttgtgcttgatgaagatgctaaaactgctgaagtgatttttgcaacgaatgatcaattagcccgtgccattggatctcaaggtcaaaatgttcgcttggcttctgaattaactggctacaagctgaacatgattttggagtctgaatacagcgagcgccaagcttctgaaaatcaagcagtgattgacctattttatgaacgcttggagcttgatcgtgatttggctgaagtgttggcggaagtgggttttgccgatattgaaactgtggcgtatgcaccagtagaggaattctatgaaattgatggcttagatgatgaaaccattactgccatccaagagcgtgccaaagaagtcatcatcagtgatgaaattgccaagcagcaaaatatcaaagagccaagtgccgagcttttggctttagaagacatgacgccagcaatcgcttacaaattggccgagcgtgatatcattacgctggatgatttggcagagcaagccatttttgatatcgaagatatcgagggcttgaacagccaaagtgctggaaaattcattatggcagcacgccaatcatggttcgaataa

SEQ ID NO: 48 - DNA, 189 bp, M.catarrhalis
tgtaaaatggttgagcttatcatcagtataagccgatataacaattcatgtgagtatatgatgaaaaaattaattttagcaacagtcttggcaggtctttcaactgccgatgcagacaatgttttggttaataacggatattatgatcaagccgatcttggctattcaaaatctagaaacatagtataa

SEQ ID NO: 49 - DNA, 957 bp, M.catarrhalis
agactctgtatatctcagtacagctactgcaacattgtgtctgttgcagtagctgtactgagatatacagataaatttttggtagcaaagcgtcatatgcatcaacaccaagggggtaagtgggaatttattgggggtaagattgatgcaaacgaatctgccaaacaggcgttgatgcgtgaggttaatgaagaaattggtctatcattaaataccgaccagttggtttttatgggaaaagtgtatcatgattatcaagataaaaaggtatatttatatacttatgaagtatatctaaccaaaaaacaatatcatgattttttatattgccaaaaaggacttgaaaatcaagcgttgagatggcttgatatggatgaaatgattgctaaggttaatcaatttcctgtcgctaacgcacggattatggattggattggattaccaaatctgctgtatatcagccatgcggtggattactttggtgattttgatggttttgtgaattattatagcaaccagttgcctaaatccgcctatttttattgtcgaccttgcgtgggtactgatgatgccattaggctgctaactttactaaaatctaagcgtccagatattaattttgtggtcagttggtcggtttgtcaagctgcccaagatatgatgaaagtacttggtggcgtcatggtgaaattaacttgtgatgaacttgaatatttttctgctaattttgataaactgccaaccgatttaccgctttgggttggtgtgcatgataaaaaagaggcaatgatggccaatcagcttgccaaaagccatcgcatcgtagcggcacttatctcacctgtacacaaaacaaaaacccatcctaaggctcatgcgcttggttggcaggggtttgagtccttggctaagctgtgtgtcttcaccacggggctggaagaatgcgcgccaacgtca

SEQ ID NO: 50 - DNA, 996 bp, M.catarrhalis
atggcgggattatttaaaccatcaactcaaaaaatacttgaattatttaacggagtgttaaacatgccaatcaatacgaatcacaccacggatctgaacagattccaaaatagacctaagtcatcagccaagattgcgtttgaactaagtgatgctctctataaaatggatgatttggtcttgccaatcaaaacaaaagccgatctagagcgtaccataggactgcgtcagtatcaatcggaagtttttgagcattgggggttttctgaaacccataagtttgataataagatgatcattaatttatacggtgaacctggcacaggcaagactatgtccgcccatgcaatcgcccatgcactaggtaaaaaattaatcttaatcaactatggtgacattgaatcaaaatatgttggagaaacacctaagaatatacaagcggcttttgaattcgccaaagaaaatgatgcaatcttattctttgatgaggctgatgcaattttaagccgtcgtgttactaatatgacaagtgcaaccgataccagtgtgaatcaaacacgttcagtgatgctaactttgcttaatgattataatgatacggtcatttttgccactaattttattagcaactatgatcctgcctttatgcggcgcattttaatacacattgaatacacacttcctgatgaagaaactagaacctacctatttaataaatacataccaaataaattacctcattctattgatttacctaccattgtcaaactgtcagaaggcttaagcggttcggatatttcaaatgcgattttattagctgctttttcagccaagacagaaggttgcgatttggtcactcatgagaatctacaaaacaagattgaggctattcaaagaagtaagagcgaaaattctcgaaaagaaaccaagttccaaacaagagttgtttctgaagagtatgttaaatcacaattaaatgatggagaaaccatatga

SEQ ID NO: 51 - DNA, 300 bp, M.catarrhalis
tctgtcactttaaccgaaccaatctcacagacacgcccaatatcattacgcccaagatcaatgagcatcagatgttctgcgatctctttttggtcatttaacaactcatgctcaagcgccagatcctcatccatatcactgccacggcggcgtgttcccgccaatggtctgaccgttactgtaccattttcgatgcgggataaaatctcaggggaagcaccaataatatcaaacggtgatttggtcgtaccaaaagtttcaccatgcaacataaatagatacggcgatggatttaaataa

SEQ ID NO: 52 - DNA, 504 bp, M.catarrhalis
tatcgacaaacctttggatcggtgatggaaattatcattttaattgttgtcggattgtctgttcttggtgctatattggcaatactaaaattcatttggggacttttcaaaaaaatctggcttattattatcggtattgccgttctttttggaatctcttggttaataaagtacggatttagcattatcggacttgatatacccatatggattatatttattttgacgctattttgtttaggctatttgagtcacactaacgaaaagaaagttcatcgggcagttgccaagtacttcaccattaaagagatgggcgacctgacagatattaccaattttttagatgaaaaatccataaaatacgatcaagaaatactaagtcaagccattgtgaaactggtagaagatgatcaaattattgagcaattaccaggtcagttatggcggtcaacgcaatcaggcaactttttagagcctatagaaactgtacatattgaaatttaa

SEQ ID NO: 53 - DNA, 1542 bp, M.catarrhalis
accaatttttatgaaaattttggaagtgtcatgtcaactttgctgagtcatcacgagtatcttcgcctcaaaagtcagggctttagccatgtacccttaatcaaaaaacgccttatggatgatgccacgcctgtgtcggtttttgccaatatcagacaactcaatcccaaggcttatctatttgaatcagtggttggcggtgagcgttttgcacgctactcgatgattggtctgggcaagggcgtatattttgaataccaagatggcgttatgcgtgtggggtcagagcttgtcggtacagtatcaagtaccaagaccgatcagccatttgatgaaattcgacgctttatgggacaatttaacatacccaccaaagacgatgtgccaaatttaccagtttttagcggtggtttggtggggtattttggctatgatttgatacgcacaattgaaccgacagttgggcattctgatacgcccaatcctttgaatttgcctgatttgtggctaatgctttctacagaagtggtgatatttgataatcttgagcatacgctgtctattgtggtttatgccaattgtgatgttgaaaatggctatgaagatgcacttggtcgcttaacgaatattgaaaatatcctaaatcaaaagccagatttgaccaccaaagcgcatccgataccaaaatttgtatcagccacaggccagcaaaagttttgtgatgatgtccaaaaaattaaagagtatattttggcaggtgatgtcatgcaagtcgtgcccgcccaaagattatcagccaagtctgaagcagatgcactgagtgtgtatcgagcgctgcgttatttaaatccatcgccgtatctatttatgttgcatggtgaaacttttggtacgaccaaatcaccgtttgatattattggtgcttcccctgagattttatcccgcatcgaaaatggtacagtaacggtcagaccattggcgggaacacgccgccgtggcagtgatatggatgaggatctggcgcttgagcatgagttgttaaatgaccaaaaagagatcgcagaacatctgatgctcattgatcttgggcgtaatgatattgggcgtgtctgtgagattggttcggttaaagtgacagatcagatgttcattgaacgctactcgcaagtgatgcatatcgctagtaatgttgaggggcgtatacgccaagatgtcgatgctttagatgtgttttgtgcgacctttccagcgggtactttgtctggtgcgccaaaaatccgtgccatgcaaattattgatgaagttgagccagtgcgtcgcaccgtttttggcggggcgatcggatatcttggctggcatggcaatatggatactgccatcgcaatacgcacagcggtcatgaaagatggtcaaatccatgtacaagctggtgcgggcgtggtggcagattcagaccctttggctgaatgggatgaaaccaacaaaaaagctttagcccttgtcaaagcagtagagatggcgtgcagagggcttgagatttag

SEQ ID NO: 54 - DNA, 417 bp, M.catarrhalis
agacgttggtatttgatcggcactcaaaataatgaaatcaaaacttttaggctcagtaaaattcttaacttaagtgtcttgcaaggacagtcttttgtgcctgatgatgagatctggcaattgattgatcaaggtcaaggaatttggttcggtcatcagcttaccaatgtactcatcaaaacagatgaatatgcacggggatattttttacaaaaacaaatcttgcctaatcaaaaaattatcaagagtttggaggatggcgggctgttaatccaatgcagtgtctatcaaaagcagcagatttttccaatgattcgctcatggataccacatttaaccatcatcgagcctgctgaatggcgggattatttaaaccatcaactcaaaaaatacttgaattatttaacggagtgttaa

SEQ ID NO: 55 - DNA, 372 bp, M.catarrhalis
tggagaaaccatatgattccttttttactcgctggtgcgcttatcgctggggtattcgttgctacagctttctggaaagagatcaaatcttttatccaggccagtattgagcgcataaaaacccacctaatacccagtatgattgttggttttaaaacttatcttcaaacgggtaatgccttatatgccaccgcaaaagctctacagaagtttttttcaaaaaatgaacgaggacaatggcaggaaaccatcatgacgcgcaatgtgccagcaaatgaaatcccagaagatattcgcaggaaggttaagaataacagaggacctgttgatattacagatgaagtacaagcagaattacatttggaggtgtaa

SEQ ID NO: 56 - DNA, 957 bp, M.catarrhalis
agcaggttcaatcgtattcatcataaccaaaagtacttagcaaggtgtcttatgacagatgcgtatcaacaaatcaaatcaacattaaaaggtgtcatgaccgctttagtgactccaatgaagccagatggttcggtggactatgatacgcttgctcaactgatagattggcagattgatgaaggggttaatgccttggtggcggtaggtaccacaggtgaggcagcaacacttgcaattgatgagcatattgatgtcattcgcttttttgtgaagcaagttgcaggacgcattcctgtgattgcaggaacaggcgcaaactcaacgcgtgaagccattgatttaaccatggccgccaaagcagctggtgctgattttgctttactggtcgtgccttattataataaacccacccaagagggcatgtatcagcattttaaggcggttgccacagcagttgatataccacagatagtgtataatgttcctgggcgtaccgtggttgatatgtgtgaagatactgtcagtcgtctggcagatattgataacattgttgccatcaaggatgcgacaggcaatcttgaacggggcatcagtctaattcgccgagtgggtgagcgtatggtggtattatcaggcgatgatccaacagcacttgagctgataaaatatggctcaaaaggtgatatttctgttacctctaatattgcacccaaggcgatgagtcaagcgtttggattggcacttgaaggtcattttgaggaagcttaccaaattcatgatactattgttcatctacaccgtgatttattcattgagtccagcccccagcctgtcaaatatgccttacacaaaatgggcaaaattggcacaggcattcgtttacctatggtttggctggctgaacactatcacgaaaccattgataattcactcaaaaaagcagggttgatttag

SEQ ID NO: 57 - DNA, 360 bp, M.catarrhalis
ttatttacagattttgaagataaagccatatattttcagatgtataaaattgttacctatatccctgagcctgatttagaaacggtaaaaactgcgatgtttgaagctggtgcaggtcattttggtccatatgagcgttgcagctggcagaccttgggcatcggtcagttttgccccttggaaggtgctaatccaacaattggtaaaatcgggcaggtcagtcaggtttctgaatggaaagtggaaatgatcgtgcctgaaaataagctgtatgaagttgttgaagcttataagcatgcacatccttatgaagtacccgcttatgaagtttatcaaacggtagatgttgatagcgattaa

SEQ ID NO: 58 - DNA, 525 bp, M.catarrhalis
cgcgcaatgtgccagcaaatgaaatcccagaagatattcgcaggaaggttaagaataacagaggacctgttgatattacagatgaagtacaagcagaattacatttggaggtgtaaaatgaataatgattcaacaaaaatctatgataacttaaaagatttagagcaagctgccaaagaaatcatttctagaaatatattaccgaaattgattaaacataatcaaacttcggccgctgaatttgtttcatccttttccaaaggtgcggatgatttcatcttgcaaactgagcgtgatgaaggtctaaactttgttgcaggttatgccatcttaaatcttttggaatccggtaccatgcaaattgattttgatttttattttcaaaatacgcaaggttcatggattaataaaaaaaagcaatccaaaacttttaatgtcgatgaatatctaaacccccaagctcaagcatcattattagagcatcaatctttaaaatttgatatcgacaaacctttggatcggtga

SEQ ID NO: 59 - DNA, 345 bp, M.catarrhalis
tttgagccaatactcgctgacatactgataaatatgggtaatgaccaaatacaaaataaaagtggaaggtttatgaaatttttaaaaataacggctggtgtgttaacggctagcatgatgttgacaggctgtacaacaaccaaaaatattctgtcaaagcgtaataatggcagtttggattatcgcaatgaaaaaaaactggcgcctattcagctgccagcacaacaaccagctgcagaatttacacctctgtatcatacaccaaattcggtgagccagttgctagattttacgaatgaatcaggcaaacagtatcaactgccaagaccaccaagcgttaggtaa

SEQ ID NO: 60 - DNA, 726 bp, M.catarrhalis
tcaaatgagattaccatgcaaaaacaagcactactttatactggaaaagccaaatccgtttatgaaactgaccatcctgactatttgattttacattttcgtaatgatgccagtgcatttaatggcgaaaaaatggaaagtcttgaccgaaaaggtgtcgttaataatcgttttaatgcgtttatcatgcaaaaacttgcagaagcaggcattgaaacgcactttgaaaaacagctttctgatgatgaagttttggtaaaacgcctgaaaatgattcctgtggaagctgttgtgcgtaactatgccgcaggcggtttgatgaagcgtttggggttatctgaaggtttgccattattaccaccaacttatgagctattttataaggatgatgcccttggtgatccgatgttgagtgagtcaaccgccattgctttgggttatgccactgctgatgagcttgcccaaatgcaaagcctgactttgaaagtcaatgaagtattatcaaaattatttgatgaagctgatttgatgttggtggattttaaattggagtttgggttattccaaggtcgtgtggtgcttggcgatgaattttcgccagatggctgccgcttgtgggataagcaaaccaagaaaaaacttgataaagatcgcttccgtcaaggtttgggcgatgtggttgagggctatgaagaagttgctcgccgcattggtgtacctttgtaa

SEQ ID NO: 61 - DNA, 381 bp, M.catarrhalis
tcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacgacttatggtattgcgagcttcagtcgcactacacggtcgttctgttactctt

SEQ ID NO: 62 - DNA, 381 bp, M.catarrhalis
gaagacgctttatcttttagaccaaagcgttcggtaactaagctgttacctgaaattaccgaacgctttggtctaaaagataaagccaatttagatacctcaaccgaagaagcacgcaagcaaaatatcaaagatcgcattgtctctgttggtggcttgattgctgctcgtggcgtcgttaataagaccattcaaggttttggcggacgctttattggtaagcaaatcagtaaatttatcccattaggtggctcaatggtggcagcatcgttaggctatatgatttttaaaaaaattgcttttgatcacattgaagaatgctataacattgccaagcaatctcaacgccaagagacaagctcacaggattttaatgcttaa

SEQ ID NO: 63 - DNA, 195 bp, M.catarrhalis
  unsure (29): Identity of nucleotide sequences at the above locations are unknown.
ggtactcccattgatattgctgccatcanccaaaaatcacctgtcttggtatatttttggggaagctggtgtcatgtgtgtaccataacctcacctaaagtcaatcaactacaccaaagatggttattctgtcggcagggatgttgtcaaatcaagaaaagaagcccaacttggcaaatatttaccaagacttaa

SEQ ID NO: 64 - DNA, 333 bp, M.catarrhalis
ggtaagaacatgacttttgttgtaactgataactgtatccgctgtaaatataccgactgtgttgaagtttgtcctgttgattgcttttatgaaggtcctaattttttggtcatcaatcctgatgaatgtattgattgtgctttgtgtgaacctgaatgccctgccaatgccattttctctgaagatgaagttccaagcggtcaagaagaatttttaaaaattaatgaagagttatccgctgtttggccaaacatcaccgagaaaaaagacgccctacctgactatgaaaaatgggatggtgttgagggtaaacttcaatatttagaacgctaa

SEQ ID NO: 65 - DNA, 480 bp, M.catarrhalis
tttaatcaaattttatcaaggcgatttatgaacttttggttattattttggcatattttgggtgcctgtatttgggttggtggtcatttatatctgtgtctgtgcatattacccaaggctgtgcgtcatcaggacagccaacccatcttaaactttgaaaatagttttgaaaaattgggcatgactgctttgattgtgcaggtcttgacgggcttttatatggcacataaatatttgcccagctttggcatgctcactgattatcataaccaaatttcagtactgattagcatgaaaatcacatggctaatattcaccatactgacggctttatccgctcagcttatcgtcattccaagattaaaaaaagacttgggtaatgctaagttacgccatatatttgctggacatattatcttggtaaccgtattggggctggcatttatgacaactggggtattatttcggacaggattttaa

SEQ ID NO: 66 - DNA, 477 bp, M.catarrhalis
ttgagcgttgcaccttcccatccccgtggtgaagaccttggcggctatcttgagagtatggggattcaggtgatttttgcgacaacggggattgtacttgcaactttatttgtcacctttgcatttatcgcacgagagctgattccgcttatgcaggctcaaggcgacagcgaagaacaagccgctttgacgcttggtgctaacggctggcagatgttttggaaagtcactttacccaatatcaaatgggcgctgctttatggcattatcctaaccaatgcacgcgctatgggtgaatttggggcggtatcggtagtatctgggcatatccgaggcgagaccaacactgtgcctttaatgattgaaattgcatacaacgaatatgcatttacattggcatttgcactctcaagcttgcttgcactacttgccttgattactttggtcgctcaaggattgatgagccataaaaaatag

SEQ ID NO: 67 - DNA, 740 bp, M.catarrhalis
  unsure (731),(732): Identity of nucleotide sequences at the above locations are unknown.
gtattaaacatgagtattaaaatccaaaacatccataaaactttcggggattttgttgccttaggtgaaatcagcattgatatttcaacaggtgagctgacaactttattaggtccatcaggctgtggcaagacaactttgctacgcattattgcaggtcttgaaaatgcagacaacgggcggatatattttgacagtatcgatgtaactgatataccagtgcaacaccgtggtatcggttttgtgtttcaccaatatgcgttatttcgacatcaaacggttgcacaaaccattgcttttggcttgacgctgttgcctcgcaatacacgcccttctgccaatacaatcgatcggcgtgtggatgagctgcttgatttggtgcaacttagccacaccaaaacccgctatccgcatgagctatcaggtggccagcgtcagcgtgttgctttggcacgtgcactggcgaccgaccctaaactgctgctacttgatgacccttttggcgcgcttgatgccaaagtgcgtaaatcgctgcgtgattcgctcaaagacattcagcgtgaaattggtatcaccagcatcttggtcacgcatgaccaagccgaagctcaagccatatctgataaaattgtcattatgaatcatgggcaaattgagcaaattggcacacccaccaactcatttgcccgtcttcaccacggggctggaaggcatcagcgcgtggttcattnntccccaaa

SEQ ID NO: 68 - DNA, 1563 bp, M.catarrhalis
atgacaatcgcacagcagcactcaaacgcttgcgtactttggctggtaaacacccaaatcacgcccaaattgctgaacaaattcgtattgttgacaacggtggttattacatttggaatatcaaagatgatgacattcatgtcaagcccatcaaataatgcgttggtaagtctattatcttccgtacagtctcttgattgtacggattttttttattatgataaatcttggctgattgtagctgatttaaaccctgacgaaccgccatacgcttcaccagagaaatccatgcagactttaccaataaaaccaagtaaattacgcttaggtaagcttttgttgcctgccagcttaatgatgattttgagcgcttgtcatatgcttataccgcccaaacagacacctgccaaattacttgaaaaaacaagaagcagtatcattacaaacggtcgtgtcagtgcagcgacacaatctattttagtttcggcaggttatacccaagaaagttgcatggcggattttgaagcgtgtgttgatgatgttagatcaatttttttcatcgaactgcccaatcgtttacaactgtctgtatttagtgagttgtattatacatatgctgacaatctcatcgccaaagatgcgtgtcgcatagagcttgccaggccgcccattgatccttattataccaatgcacccatcagtaaagacatcgctgaaaatcagcaaaaagctcgcactgagtgtcatgccaagtatcgagatgcactttatcaaactgtcaaatatagctatgcttatttattttattacagcttaggcggtcatggtactccctcatctcttccccaagagcctgatatccgaacgcttgatctttatcaccttgccatcaatgatttaatcactcaaatttatcgcaaagatcatggtgcgttttataatgccaaatttcaggatgtggtatcatctgagcaattagaacctatctacaatcagctaagaattggtcgtgttctcagcaatgaccacggtcaaaatacactgcatatctctgttggtgatcgtgattttttgacaagtaagctcaaacaacacgaacacagcagcgagctgttttctgagatgatttctgcttatgattctagattgctggatttggatgtcaatgcacgacgctcagggcttggtgtcagtttcgttggtgctatcaatgatcggcacaccaccagtattgataatctcaaaaagcttgcacgcaataaggccttagacgatcgcattcatcatgtcgggcacattcagcttaccgccatcattaaacctatgggcaataccattgatgaggtactgtcatcacatgagttttatgcctatttttttaatccaagcaataacactcatgtcaaaatcggcgatacatcatatcctttgacagcgaatttttcagcgggctatgcgttggggttggctgaaaatcaacttaggccagtcttgctgacaaatatgaattcttggtctgaagccaatggtttacctggactatttaagcttaaaaccgaataa

SEQ ID NO: 69 - DNA, 234 bp, M.catarrhalis
tgggagtcagcgcctttcaccccgcgtgaagaccacccatcacccgtcaacacaaggaaaatcgccatgactatgagtatcgctcgttattttagtaaccgtgatcacattcgcttaccaacattatactcacaaaatctttttgccatgaccaaggaagtgcgtattgaacatcaaggggaagagtaccgcctgcgtttaactcgaaataatcgattaattttgaccaagtaa

SEQ ID NO: 70 - DNA, 207 bp, M.catarrhalis
tttcatgttaatatcttgataatagctaatgtcgccaatggatcattagataattatgagataattacttggtcaaaattaatcgattatttcgagttaaacgcaggcggtactcttccccttgatgttcaatacgcacttccttggtcatggcaaaaagattttgtgagtataatgttggtaagcgaatgtgatcacggttactaa

SEQ ID NO: 71 - DNA, 2844 bp, M.catarrhalis
agttggggtaaattttgggctttcatcatgtacaaactctgctataatagcaggaatttgattttttatcttgagtttttttgtatgtcaaagcccgttttgtttgcaaattgcagttttatgcctgtcgcattggcggcttatttgcctttgatgacatcgcaagcattggcacaacaaaataactctgcaaacatcatcaatcatatacccgctcatgacaccgccatcaatcaagcaaaggcaggcaatccacctgttttgctaacacctgagcagatacaagcacgccttaatgctgctggactgaatgctaagccccaatcacaagctttggatgttgtcaattttgatgatcaatcgccgatatctcgtatcggtgagcaatcaccccctttgggtttggatatgtcggtcatcgaagaaaccacaccgctaagcttggaggaattatttgctcaagaatctactgagatgggaatcaatccaaatgattatattccagaatatcaaggcgagcaacctaatagtgaggtggttgtaccaccgacattagaacctgaaaaaccaggtttgatcaagcgtctttatgcacgcctatttaatgatggtgtcaataaggtgcctaggcttaaggcaaaattttatcaatcatcgcaatcaggcgaaaccagtgcgattgggtcatcgcatcaaaaaacagagccttatgcaaatatcaaagcagcacttgaagacatcacccaagagtcagcgatggatttgaatggctctatcccacgcctaaggcaaactgctttggtggcagcgcgtgctgtcggttattatgatattgatttatcaatcataagaaatagcatcggagaggtggatgtcatcatccatgatttaggtgaacctgtttatattgattatcgagcggtggaggtacgaggtgaaggtgctgatgataaagcatttactaccgtggcggatgaggtgccattgctgatcggcgatgtctttcatcatggcaagtacgaaaccaaaaaaaatctcatcgaaaatgccagtgctgaacatggatattttgatgggcgttggctggatcgttcagttgatgtaattttgccagataataccgctgatgtcagcttaatttatgatacaggtacgcagtatcgctttgatgaggtggtattttttaccattgatcctaaaaccaatcaattgacaaccgatccagataagctgccagttaaacgagaattacttgagcagttactcaccgttaacatgggagaggcttacaatttacaggcggtgcgtgcactttcaaatgatttgattgccacacggtattttaatatggtgaataccgagattgtctttccagagcgtgaacagatccaaaacgaccaagtgagctttgagcagtcttcaagtaaccgtactgaaccagcacaagttgatgaaagcacacttgaacctgtcattgaaaccgttgagctaacggatgggatattaatggatatttcgcccatcgaatttagtgcatctaatctgattcaagacaagctaaatttggtggctgccaaggctcgccatttatatgacatgcctgatgatagggtgcttgccatcaatcatgatgatggcgtaaatcgctctattttgggcagaatcagcgatgccgtatctgccgttgcacgcgctattttacctgatgaatctgaaaatgaggtaatagatttgcccgagcgtaccgcattggctaatcgcaagacccctgccgatgtctatcaaagtaaaaaagtgccgctatatgtctttgtggcgagtgataaaccacgagatggtcaaattggtttgggctggggatcggacacaggtacccgcctagtcacaaaatttgagcataatttgattaatcgtgatggctatcaagcaggcgctgagctaagactgtctgaggataaaaaaggggtcaagttatatgccaccaaaccgcttagccaccctctaaatgatcagctaagagcaactttgggttatcaacaagaagtttttggtcactctaccaatggttttgatttatccacacgcaccctagagcatgagattagccgcagtattatccaaaatggtggctggaatcgtacttattcattgcgttatcgtcttgataagcttaaaacccaagcaccccctgaaacatggcaggatttaccagtggattttgtcaatggtaagccaagccaagaggcgttattggcaggtgttgctgtgcataaaacggttgcagataatttggttaatccgatgcgtggctatcgtcagcgatattctttagaggttggctcaagcggtttggtatcggatgctaatatggctattgctcgagctggtattagtggcgtgtatagttttggggataatgcttatggcagcaatcgtgcccatcagatgactggtggcatacaagtaggatacatttggtcggataattttaatcatgtgccatatcgtttgcgtttttttgctggtggcgaccaaagtattcgtggatatgcacatgacagtttatcacctatatcagataagggttatctgacaggcggtcaagtattggcggttggtacagctgaatataattatgaatttatgaaagatttgcgtttggcggtttttggtgatattggtaatgcttatgataaaggctttactaatgataccaaaattggtgcaggtgtcggtgttcgctgggcatcacctgtcggtcaagttcgtgttgatgtggcaactggtgtcaaagaagagggcaatcccattaagctgcatttttttattggcacaccattttaa

SEQ ID NO: 72 - DNA, 891 bp, M.catarrhalis
aattttatcaagggttatcgcaccctcatcagttattcattcagtcatcattatcatggattttttatgaaaaaattagcactgacattatcagtttttactgccatttttgcctctaccgccatcgctaacaccacctatcaaagcccaactatgcgtggtgaaatcaccgaaaccatcacggctcgtgctggcactgctgatttactacaaaccatcgtgcaaggtctgcccgcacccaatattttaatcacagaaatcaaaaatatcccaactgttaccattgccgccaataccgcaggcaccgtcattttagatgttactttggttgatgagtttttggatgatatcgccccaaatgctcgccattatccaaccaatttcccaaatcgtaccgctgaatatatcacgacagaaaatatcaaacatctgtcagattggattgaatcttatgccagcacgcctgatgcgtcatttgatgttgtcattcgtgccgctaaattaaacggtatcgcaagaaatcttaatcttggtacaacctatacagttcgtgcaggcacatacatgcaaaaagccttacaattaaaaccaaatgaccttgaagccaacctgctatttgggattatgctgtctgaatcaggtggttttaaagaaggtcgtaaatatttagataaggcagtttcaatgggcaatgttgaggctgaacaaagcatcgctcaagcagatttgctaaatgacaatcgcacagcagcactcaaacgcttgcgtactttggctggtaaacacccaaatcacgcccaaattgctgaacaaattcgtattgttgacaacggtggttattacatttggaatatcaaagatgatgacattcatgtcaagcccatcaaataa

SEQ ID NO: 73 - DNA, 1335 bp, M.catarrhalis
attatggcaagccaattaaacttatttcgccgtcaagtgtttacatcaatgttttttactcaattttttggggcatttaacgataacatttttaagcaagcattgatattagtactcacctattcagcggcagcaaaacttgaaaccgaggtgagcttattaaataatttggcagcattattattcatcttgccttattttttattctcagcattggcaggtcagattgccgataaatacgaaaaatctaccttaactgggcatatcaaattacttgaaatcatcatcatggcagtcgctgctgtgggttttatttatgaaatatacagcctactgtttttttgcttatttatgatgggtactcaatccaccttttttggtcctattaaatatgcttatttacccgaaaccatgcgtcatgatgagctggttgcagccaatggattatttcaaaccagcaccagccttgccattttaacaggcatgatgacggcaggcatcttaacacagctatatttctctgaatattggctggctacggtaaccatcgttgtggcaatacttggttatttatcagcacgccaaatcccaaaaactaaagttcatgcacctgatttatccatcaattggaatattgctggtacgagctttgaactactcaagtacctgtatcatctgcccttattgttttttatcactttaggtaatagttggttttggttttatggtgcaacttttttgacgcaaacacctgaagtcaccaaggttttattacacgcagatgaatctgtggtcatctttttgctgagcttattttctgttggtattgccataggctcactactgtgtaaaacgctcaccaaaaatcaagtcagctttcgcttactgccttatggattattaggtctgtcagtctttgcgatggcgttatatttttctttaaatcagctgtctttggcattacctatttggccgtatgctgtgatggatatcatacatcagttgcacgcttggccggtatttatcgcactgtttttattgggatttagtggcggcgtgtatattgtaccactatatactgccatgcaagcatatgcacccattgattaccgttcacgcattgttggggcgaataatattttaaatgccatttttatggttatttctgcaattttctcaattattattttggcagtcatcaaactgagtttggctcagttgtttgccattacagcaatattaaatgccatattcggtctgtttttatgtctaaaattaaaaaaatatgatcgtactttaccaatccatacggataaaacggcgatttcgccttga

SEQ ID NO: 74 - DNA, 5028 bp, M.catarrhalis
aggcggcacatgactcatcaggataattcaaaaaactcgtcatcggcagaaaatggggtttctgctggcgttgctgcaccgactaaaactcagcccaaaccaccaaacccacccaaaccacaatggctaatctatttaattcgcttaattgtcggagcaattattgccgctttattgttgttggcggtgttatttgccatgaccaacagcgagtcaggttcaaagtttttaatcgaaaaaattgcgttagaaactggcactaagcttaagtacagcgaaggctcaattcgccatggagtttgggtgcaagatgtcaaaatcgctcaaagtgaagatattaccatcaccattaatcgtgcctatgtacagcttgggtggcgagccttgtttgctcgccaagtgcatttggtcaatcctaagattgataaagtttatgtgacaaacaccaagccatcaacaggcgaaccctttgattatgcgaccatcaacctaccagtgacgcttaagcttgaaaatgccaaagtcaatgaaattatctatgaccaagtggattctgagcctgtcgtactgcatcatatcgcatttgatcacgcatcatgggcagattcaacagttaaaattgataacgccatgctaagctatggtgatgatattaatatcagccatgccactggtggcattgatttaacaggtcattatccgctgtcgttgtcggcagatgtgcatattttggcacttgatgatgcgtattttgatactttgtcggtgaaagcaggcggtagccttaagcgtaccgttggtacactcactggcaaatataatcagcatcatgtgacaggcagctttatcgctcaagggttggataaaaactcaccttttagcgcacgccttgattttgatgaagtacgattgccttatgctgacagtcaaaatattttactaaaaaatggctctatcatcgctgatggcgtcatctcaaatatcgagctacgtattaacactgagttatccgccaaagatattcctgatgggcattatcacggtcgtggaattattcgtggcagtaccatgcaaatcccatatttgcaggctgatactgccaatggtactttggtggcaacgggtgatatgacttgggaagatggctatgagcttgatgccaccattgcagcagacggctatcgtatccgtgaagagatgccaagtgattatcatgaatatagagcctatctacctaaggttttgacaggctcacttggggttaagtatacgctattagacaaagccagtcatgacactcggtttgagtttgatctgaatcaaaaagacggtgaacgcattcaagcgacgctggctcaaaatcaacagagtgatcatgagccttggcgtattgatgcgacttgggcaaatctaatccgccatgatattccacaaattggcgagattcatagccgctcaggtcaggcatcagttcgtttggagaacggacatacctatattaacgcctctgctgacattgttaaacttaatgccgtcccaagcggatcatatcatgtgcaagcaaatattgagcaaaatcagcacttgcacttgacagattttaactatcaaggtgtgatgggcgagttgacaggtactggcagggttgattttgcgactgcccaaagaccgcttgagtggcagcttgatgtcactgccaatccagtcaaacccaatgcgtattttcaaacacccaatcaaacaccgtttgagcaaatttcaggtagaataattgcttcagggcgtctgcgtgagatagatggtgtgtcaattcatgacattaaagtggatgacagtgatttaaccgctttattaaatgacggcaagcaagtacatctgatgggtcaaggcgtcagcaagattaggctacaagatggacaaattagccatcttaaggcaaattttgatggcaagcttgctcaagatatcttaccgcaggtagctgactcaagcattggattggatattgaaggtgatttgaatgatttgaccatcacacgggcagtcatgatgaatgactcaggcaaagtatcgcttgcaggtcgtcttggattaaatgacggtattcattggcaaattcaagggcgattagatgaggtggataccgccgcttttgttgatgatgacaatttagttgcgatcatcacaggcgatcttgccacatcaggcagatatcgtgatggcgtgatggatgatatcgcactcacttttgatggtcaagtgattaacaattcaatcccaaatggtcatctaagtattgatgcgacaggttctggcaatcgctttatggtcaatcatctaagacatgatggcacagcaggcacgctgaatgcgacaggctgggtagatattagccaaggtgttgcatggcagctagaggctgatatgaattcattgaatttgggtgcatttatccagtcgctagatactgacttaaacggtacaattcagcttgcaggcaactggcaagagtctcatcaagtcattgatatcagtaatttggatattacaggtagctacaataatcagccacttatcgccacaggcagcttatatgccaagctttccctacctaaagatttggctgggtatatccaaagtatcaagcaagccagccgcccaccgacttcgtctgatgatttattggcactaaaaaatcgtattgataacaacgcacgccaaacccaaaatatcgttcataaactcaatgctgataatctacaagtccgcattggcaataatcatttggccatatcaggcgatgaaagacagttgaccgccagtgtgaatgtgattgatcttgggcagctgattgataccgcaagtggtgcgattcaaggcggtgtgattgtcgtcaatgatcatcacgctttgccaactttatatattgatgccagtgtctcatcactcagatttgccaatatcaccatccaaaacgcccaagctatcggtaaaattgtcaatctgggtaatagcgaaagccagctgttggttcagggtgatgatattatcgtgatgggacgcaccattaaatctgctcggatggattttagtggcacagaagccgatcatatcttatcaatttcaaccaaaagcggtgatatcgaagcatctatgcatattgatggggcatttaatcgcaacaatatgcgatatcatggtgttttgtctgatggttttgtcaagagtggatttggcaaaatgtcacagcgtcagccgaccgagtttagctatggattggatgataatagcttacaaattgcagcgcattgttggcaatcggcacatatccaaggcgatggcgtgggtgcgatttgtttacaagatacattaagttatacaccgcaatcagggaatgtcaatcttattatccaaaatcttgatactcaagtactattggcggctctacccagtgatattcattggaaatccatgctcaatggtcgcattaaggcaatgtggcaggcaggtcaatcacctttggttgatgctgtactgtattctgatgatggtacaattggcttaactcaagaagagacaggttatattgagatgccatatcagcgtgcgtttgtgattgccaaaagtgttgataatggcttaaaggtaagaaccgatatcttgggtacggcaggtcgtggttatgccgatgtaatcatcaaccccaagcaaacagacaagcccatttctggtgcgcttgttatgaatgatcttaatttggcggtattgcgaccatttttcccgagcattcaaacattgagcggtaaagtcagcttggcaggtggcttaggtggtacattatccaaaccattgttttatggtaatgccaatttaaagaatggtgcattagcgattgttggcgtaccaatgcccatttctgatgttgatgccacggtgaacatacgaggtactaaagcacgcttagacggtagatttatgggtggtgagggtcatggtgtgctttatggtgaaatggattgggcagaagagctgtatgctcgccttggcgtatttggtgaaaatctgaccgtcagccagccaccgcttgtgacggcacaaatcagccctgagctggaagtgattatcagacctttccaaaaatttgtagatgttcaaggcgttgttagtatcccatcagcaaccattcgtccgccagaggcaaccgcagatatcgtaaccgaatccccagatgtatcagtcattgaccgccgtatcacaggtaatattgaccagattttaagtagagcgaaaccttgggatattaatgcaaatatcggtgttgatttgggtaatgagattgaatttcgtggatttggggcggtattaccattggcaggcgcgatacatttgactcagttaggacaaggtgcaatgcaagctcttggcgtggttcaggtttctaaacgcacaaaaatcgatgtcatcggtcaaaatttggatttaaattatgcccaaattcgttttgatggcgacatgcttaatccacgcttatctattgagggtgaaaaacaaattgaagggcaaacggtgggcgttcgcattcgtggaacggcatcaaatccaaacattaccgtatttaatgatgcaggtttggatgaataccaagcaatgaatgcactggtgacaggacgcattagcgaatcaagtgatttgggtatcacagagcagggttttcgctcacaagtaaccaatcaccttgctgctgctggcttaagcttaggtttgtcaggaaccagagatttaaccaaccaaattggtcacgcatttggttttcagagtttgaccattgatgcctcgggcagctcagatgataccaatgttaatgttacaggctatattacaccagatttgtatttgcgttatggcgtgggtgtgtttaatgctgaatcaaccttatccatgcgttatcaattgacacgccgtgtttatattgaagcaaccagtgccgctgaaaatatggttgatgtgatttatcgttggaagttttag

SEQ ID NO: 75 - DNA, 834 bp, M.catarrhalis
accatcagcccttacatagtcgcacattatggcaacaaagtatccaatatttgcaatagcgatttaactacattaaggaatatgatgaatataccattattaggtgtcaatatcgatcacattgccacattacgaaatgcacgaggtgtcggctatccttgccccattaaaggagcgctgatttgtgagcaagcgggcgcatcagggattaccttgcatttgcgagaagatcgtcgacatattcaagatgaagatgtttatgaattgattgggcaattgacaacacgcatgaatcttgagatggcagtcactgatgagatgctaaatattgccctaaaggtacgaccagcatgggtgtgtttagtaccagaaaaacgccaagagctgactacagaaggtgggcttgatatcgccaatttatcaaatattcaagcatttatacacagtcttcagcaggcggatattaaggtttctttattcatcgatccagatccgcatcaaattgatgctgcaattgctttgggtgctgatgcgattgaactgcatacgggagcttatgctcaagcgactttacaaaataatcaaaagcttgttgataaagagcttgaccgtattcaaaaagccgttgcaatggcacaaaaaaaatcatcattattgattaatgcaggtcatggtttgacgcgtgataatgttgcagcgattgcccaaattgatggtattcatgagctgaatatcgggcatgcattgatttcagatgcgatatttatggggcttgataatgcagtcaaggcaatggtcttcaccacggggctggaaggatcaagcgctggtgca

SEQ ID NO: 76 - DNA, 219 bp, M.catarrhalis
atggtcataacagacgcacaccaagcttttgatgagcttggcgtgtttttactgctgttttttatggtatgttttaatgagcatgatgatggtgatgtgctggctttaagtgattgtttgcggttttatctttggataccaaggttaccaccaccattgtcgttgctaaaaaggtgccttcaatgtcatgcttgccatcaaaataagcacatcacctga

SEQ ID NO: 77 - DNA, 186 bp, M.catarrhalis
atccgctattttgttatctgtttttggccaatcgtgatggtgcatttacataaatctgacatgggtattctttgtgtttatttttattataatttaggctctgttatctcaaataatactttaaaaaataaaatcagttttttattaccatgtgttgtgttatatttaataagttatgataaatag

SEQ ID NO: 78 - DNA, 204 bp, M.catarrhalis
tccttttacgctgacgacaatagcaagatggaaccacctgatcccttcccgaactcagaagtgaaacgtcttagcgccgatggtagtgtggttcgcccatgtgagagtaggtcatcgtcagcaccttattttaaacccctctttgcagaagcaaaggggggttttgtttgggggttggtgatcagaatatatatagcaacctaa

SEQ ID NO: 79 - DNA, 234 bp, M.catarrhalis
  unsure (4),(80),(81),(82),(83),(91),(92),(115),(116),(117),(131),(149): Identity of nucleotide sequences at the above locations are unknown.
ccgngggtacacaggatgttcactgcgatttcggtgtcactgagtctctgctggagacgggcgccaaagaaacaagacgnnnngcaggtcnnaactggggggcgggtgaattttnnntaccttaagaccgntatatttaccggccgcgnttactggggctgtgatcaaaagcttcccttacgcttacccccatcaattaacctttcagcaccgggcaggcatcacaccctataa

SEQ ID NO: 80 - DNA, 312 bp, M.catarrhalis
caaccgaaacaccagaggttcgtccactctggtcctctcgtactaggagcagatcctctcaaatttccaacgcccacggtagatagggaccgaactgtctcacgacgttctaaacccagctcgcgtacctctttaaatggcgaacagccatacccttgggacctgcttcagccccaggatgagatgagccgacatcgaggtgccaaacaccgccgtcgatatgaactcttgggcggtatcagcctgttatccccagagtaccttttatccgttgagcgatggcccttccatacagaaccaccggatcactaa

SEQ ID NO: 81 - DNA, 1041 bp, M.catarrhalis
gtttgctttaaagatattagccaaagtgcaatcataaggaaaaatatgtctgataataccaagacccatagcaatgaagataccatttcggcgttttttgagaatcgatcaacaccaaaaaatgagtcttttagggcagggtttgttgcaattgttgggcgtcccaatgttggcaaatcaacgcttatgaatcacatgcttggacaaaagctgtcgattacttcaagaaagccacagacaacccgccatcgtattcatggtatcttgacagatgaagataggcaaattgtgtttgttgatacacccggaattcacagtaaagaggtgcgtgctatcaatgagcgaatgaataaagctgccatttctgcgttagctgatgtggatgtggtgctgtttgtggttgatggcattcaatggcgagaagatgatttattaacgcttgagaagttatcagcgaccaatttacccgttatcttagtcattaataaagcagataccgttaaagacaaatcaaaacttttgcctgtcatcgaaagctttagcgaaagttttgattttgcagatatcatccctgtttctgcacttcgtcgccataatcttgatcgattacagtctgtcattggtgagtatttgccaatcagaccagccatttttgatgctgaacaaattaccgaccgctcagagcgttttttagcatcagagattattcgagaaaaaatcatgcgtatctctggtgatgaagtgccttatgatttgacggtacaaattgatacctttaaagatgagcctgcacataaagacccagagacaggaaaatggcgtaaagcggtgacattcattgatgcgacaatttttgtagagcgtgcaggtcaaaaatcaattatcattggcgataaaggggcaaaaatcaaacaagttggtattgatgcccgtaaagatatggaagtgttatttgaccgaaaaattatgctgactttatgggtaaaagttaagcgtggttggagtgatgatgagcgcgccctcaatagtttgggttattaa

SEQ ID NO: 82 - DNA, 306 bp, M.catarrhalis
cccataaaaaacaccaacaaaacaatgaacaacacacggcttggcacagccattttatcaatactcgttttatcactatcgtggttgcacacccctgcccatgcagagccaatgggcatattaccaaagggtgaaggcgtcatttatcaaaatgaattgggtattcaaacggtgcgtaaaacttttagcaaagacaccccgatgaagtgtcataatcacccaaacgacattgttaccttgactgttaccaatggtttggcacaggttattaaatggtcaagaagcacatacgctgtcttcaggtga

SEQ ID NO: 83 - DNA, 807 bp, M.catarrhalis
ttaagattggagtatgtggtggcaaataaatcaccaaaaaccatgaagatgtcacaaaaggtgaccaaaactcctgatcagatgccttatttttctgattttgaacaagggttgcctgtgctttatgctaagcttggttatacttttaaagatgtgtcgctactttgtcgtgctttaacccatcgttcttatgatcctaaaaaaagctatgagcgtctggagtttttgggggatgcactgctaagctcaattattacaaaagcgttatttgcacagtatcctaagcatgatgaaggcaagcttacacgaatgcgagcagctttagtacgccaagaaaccctcgtgcagattgctgaccaccttgaattgtctcggtatctgattttgggagttggcgagcgtaaaggtgggggtcgccaccgtgcatcaattttggcggatgcagtcgaggcactcattgctgctgtgtatttggataatttaaacagtgatggcgaaaatattattcatcgtatggtgatggattggtacaaagatctgattcaagaggtaggtcaagaacaggtactcaaagatgccaaatctcgtctacaggagctacttcagggcaatcgcttaccattaccaacttatgaacttatccaaactttgggtagtgcgcctaatcaagtgtttgtcgttcgctgccattgtacggttgtcggcgttgaccccattatcgaaacaggtgccagccgccgtattgctgaacaaaaatgtgccgaaagaatgattaatcaattaaataaattattgcctaatagttaa

SEQ ID NO: 84 - DNA, 192 bp, M.catarrhalis
agagtaacggaggagtacgaaggtgcgctcagaacggtcggaaatcgttcaaagagtataaaggcaaaagcgcgcttaactgcgagacccacaagtcgagcaggtacgaaagtaggtcttagtgatccggtggttctgtatggaagggccatcgctcaacggataaaaggtactctggggataacaggctga

SEQ ID NO: 85 - DNA, 639 bp, M.catarrhalis
aaaagctttggtcaaatcagcttgggattttcagatgaatttgtgcggcaactaacagcacagtcaaacgaagcggcttatcatccagcaagttatggtttgatgacagggcgagtgcagtatgcactgttatatatgaatgagatacttgataagctacttgccaccgaaagtccttgtcttaagctgtggcaggtttatcataccaatatgaccaaacttcatgcattggatcggttatcgctgatggcagtagataagatgcaggcaatgaagctttacttacgcagctttgaaagaggactgttttcagagcttggggttatgatggatttttgtgttgatgggcatggtgtgccgatcaatgccgatgccatgtattgctttatacctcaaatgggttttatgttagcacatcttgtacggacgcaaattgaccctaagattcggtttgatggcgtatgttatacaggctcacaaattttacagatgggtgctgcaatggaagagccagaacttgctttggagtttttggatcaatttagccaaatccaaaaggcagttttggataatttattgaaccatcagcccttacatagtcgcacattatggcaacaaagtatccaatatttgcaatag

SEQ ID NO: 86 - DNA, 1824 bp, M.catarrhalis
gcaccttatatgactgcaaaaaaaccaactgatatttctcatattcgtaatttttctattatcgctcatatcgatcatggtaagagtactttggccgaccgttttattcaagtttgtggtggtttgtcagaccgtgagatgcaagctcaagtgctagatagtatggatattgagcgtgaacgaggaatcacgatcaaggcacaatcggtaactttgtactataatcatcccaatggcgaaacatatcaactcaattttattgatacacccggccatgtggattttagttacgaagtatctcgttcattagcggcttgtgaaggtgcattgcttgttgttgatgctgctcaaggtgttgaggcgcaaagtgttgcaaattgttatacagcagtagaacaggggcttgaggttttacctgttttaaataaaattgatttaccccaagttgaacctgagcgagtgattgaagagattgaagatatcattggtattgaggctgtggaagcaccgagagtatctgctaaaactggggttggtatcgaagaattattagcaacattgtgcgatgttattcctgctccaaaaggtaatcgtgaggcaccgctgcaggctttgattattgattcttggtttgataattatttgggtgtcgtgtcattggtgcgtgtgcgtgaaggtcaggtatccaaaggcgataaaatttttattaaatcaactggtgagacgcacattgtgacctcggttggggtttttacaccaaaatcactagaaaccgatgtgctacatgcaggcgaagtaggttttgtcattgcagggattaaggatatccaaggcgctcctgtgggcgataccattacgcatgccaaaacaccagatgtagaaaatattccaggatttcaaaaagttacgcctcaagtctatgcagggatgttcccgattgattccagtgattttgaaaaatttcgtgaggcattacaaaagcttcaaattaatgatgcagcactattttttgagcctgatacttctgaagcacttgggtttggttttcgctgtggatttttgggcatgctgcacatggaaatcattcaagagcggcttgagcgtgaatatgatcttgatttgattacgacagcaccatcggtcatttatgaaattgtcaagaaaaatggtgatattatttatgtagataacccatccaaactacctgatacaggtgtcattgctgagtttcgtgagccgatcgctcgttgccatatcttggtacctcaagaatatttaggcaatgttattaccttggcgattgagcgtcgaggtgtgcaagtggatatgaaatttatggcacggcaagtacaggttatatttgatatcccaatgggtgaggttgtgatggatttttttgataaattaaaatctgccagccgtggttttgcatcgttagattatggttttgagcgttatgaagcggataaattggttcgtgttgatgtgctgattaatggcgaaaaggtggatgcattggcgatgatttgccatcaagaacatgcacgccgccgtggcaatcagttggttgaaaaaatgaaagagttgattcctcgccaaatgtttgatgtggccattcaagcagcgattggcagtcaaatcattgcaagaagcacggttaaagccatgcgtaaagatgtcttggcaaagtgctatggtggtgatgtcagccgtaagaaaaaattgcttgaaaaacaaaaagcaggtaaaaaacgcatgaagcaagttggcagtgttgaaattccccaagaggctttcttggcagtcttgaaagttgacagttga

SEQ ID NO: 87 - DNA, 480 bp, M.catarrhalis
gttttaaatattatcgcctttgcccaaaagcatggcataccattcattgatgctgattatgacatggacaactggtttgcccgtgccaaaggcatggagcaagaccctgagcgaggcagacgatgtaccatgtgttttgacatgcgatttgagcgcaccgccctatacgcccacgagcatggttttcctgtgataaccagttctttgggcatctcacgatggaagaacatggctcagattaatgattgtggtcatcgtgccgctgccccttatgacgaccttgaatattgggattttaactggcgtaaaggcggtggcagtaatcgcatgattgagattagcaaacgagagcatttttatcaacaagaatattgtggctgtgcttactcactgcgtgataccaataattttcgccgcagccaaggacgagaacccattaagattggggttaagtattatggtgatgagccagttgaatga

SEQ ID NO: 88 - DNA, 1104 bp, M.catarrhalis
gagaatttggtgaattttgatattaatttagtgatcgtaccgataactttggtgtttttgctgatttggttggtggataagcttgtcttaaaacaacattttgccatcaagcatcatgccaaagaagttaagtttactgaaactcaactttcaatgcataaacaaaaacttgagctggctttagcaaattatggcatgcgtagtgatgcccaaagttatacacctgatgctcatgctccaagtgatttgtatagcgcctatcaggattatcaggcaagccgtgtcaaacttgctgctttggtaggcaatcctcccaatcatattgcagttgtacggtgggcttatgaatttttgcccattttgttggcgattgtgattgtacgagcatttgtgattgagccgtttaatatcccatcatcttctatggtgccaactttatacacaggcgattttattattgtcaataaagcagcttatgggcttcgtttgccaattatacatactaagattttggatacaggcaaccccaaacgaggcgatgttgctgtttttcgttatcctgtgaatgataatatttattttattaagcgagtaattggcttgcctggagatacggtaagctttaatcgtggggtgttgtcgattaatggtgaaaaggtagaaacgacggcggtgaattatcaaatgccaagtgtgttattggataaaatgttgcccaatatgattcatggtcaaacacttagcgatgcagaccgagcaggttttgggcgtcaagaagaatatttggcacgctatcaaactgaaaatttgggcaaccatacttatactgtacgatatgttataaattcaaactcatcagcagaagcaccatttttaattgagcactcaccagaggtggttgattctcatggagaacaatggtcaattgtgattcctgaaggtcaattttttgtgatgggtgataaccgtgatcgtagtgatgatggtcgtttttggggctttgtgccagaatctaatctgtcgggtaaggcaacttatatttggatgcataaagagtcaggttttagattaccaagttttgggcgtaatggtacaattgattaa

SEQ ID NO: 89 - DNA, 183 bp, M.catarrhalis
atgacgccttcaccctttggtaatatgcccattggctctgcatgggcaggggtgtgcaaccacgatagtgataaaacgagtattgataaaatggctgtgccaagccgtgtgttgttcattgttttgttggtgttttttatgggtcatgccctttctagatctaaaatcactttattacattaa

SEQ ID NO: 90 - DNA, 195 bp, M.catarrhalis
  unsure (24),(29),(143),(152),(153),(171),(175): Identity of nucleotide sequences at the above locations are unknown.
tcgggccgatccggcggcggaccntactnttttgctgcagacaataaatcatcatggatatttttcatgatgccttgtagttgttcatccaactctgagaaacttttatattgccctcgcgacgcaccgacccgcgcgaagcncgaaaacanncacgggggcgggctgaanttcntttgcctggtgcataagtga

SEQ ID NO: 91 - DNA, 1134 bp, M.catarrhalis
ccaaaggaaccgatgatggactttattaaaacacgagccgcagttgcttgggcggcaaatgagccgctggtaattgaagagctggatttgatgccaccacaagctggtgaggtattggttcgcatcgtggcaacaggtgtttgtcatacagatgcttataccttatcaggtgctgatcctgagggtattttcccttgtgtacttgggcatgaaggtgcaggtatcgttgaagctgtaggcgagggcgtaacagattttgcggttggtgaccatgtgattccgctatatacggccgaatgtggtcagtgcaaaatgtgcttatctaataaaactaacctttgttcggcagtgcgtgaaacccaaggtaaaggcttaatgccagacggtactgtccgattttttaaagaaggtgagccaatttatcattatatgggtacatcgactttttcagagtataccgtggtatctcagtattcgttggcaaaaattcaaaaagatgcacccttagaagaggtctgcttgcttggttgcggtgtcaccacgggcatgggcgcagttctaaaaacagccaaagtaaagcccggtgatacggtggcaatttttggtttgggtggtattggacttgccgcggtgatcggtgcttgcatggcaggggctggccgcattattgttgttgatattaatgaagataagtttgccaaagcacaagagcttggggcgacagactgtgttaatcctaataaatttgacaaacccattcagcaagttatcatcgagatgactgatggcggtgtggatttttcatttgaatgtattggtaatgtggatgtcatgcgagcagcacttgaatgctgtcataaagggtggggtgagagcgtgattatcggtgtcgcaccagcaggtgctgagatttcgacacgcccatttcaactggtaactgggcgtgtgtggcgaggttcggcatttggtgatgtgaaaggtcgtagtgagctgcctggtattgtcagccaatatatgcaaggtgattttgcattgagtgattttatcacccataccatgccacttgaccaaatcaatgccgcttttgatctgatgcatgaaggcaaatcaattcgcagtgtaatccatttttaa

SEQ ID NO: 92 - DNA, 609 bp, M.catarrhalis
cttactttgacattggatttggcaaaaggaacgctttataagcattttaccagtaaagatgaactgctgttacggattttgattgattatgaaaagcgaaaacttgatatgattattgttgaagacggtgctggggctggcgtggcccgattggtgattcagttggtcaatttaccgcaccgtgcgattttatttaatcatattgaagaacgcctgtcatcaacaacctctgggttaaacaagatgtttgcccaattataccatgtacgccgagaacgaatggttcgtatgtcttgtattgttcaaagatatttgaccgaacaaaacagtcagatgaatattcgtgactatatggcaaccttgtatgcggttgggcaaggtggtgcaagtttgttaaattcaagcttttatcagcgttatttgggtcggcgtgataccctaaagagtgctttggtgcggcagatgctggatttaccaaaattatatcccaaggcggataatcagccagcagatgagatttcacaaagattattggcgaccagccaagatataagcgaagcagaaattcttgagctgacagaggtgattgggcagaccatcacaccttaa

SEQ ID NO: 93 - DNA, 219 bp, M.catarrhalis
ccatgttctgcgtggacgccatgtaatttgtgcatgattggtatgctaaaggcacttgctaatcctgatatgagtatcaccacaccgctgaatttgcgtagattaaatgcgtggattttggattttagccaagcgatgactgtgcctgtggcaagtagcatgggtaaagtaccaaaccaaaaaaataccataaaggttgttgctgtcaatcctacttga

SEQ ID NO: 94 - DNA, 204 bp, M.catarrhalis
agcatctatttaattaatgatgatacgaatgcgaatggcttcgatctgaatgcgatgagtgagcggggttgtgggcagatgcttcagggtgatcttgatggctgtgatgacctacttgatcatgaatatgctcgtcgctggtgtggtaatggtgatggtgatggtgaccatgttctgcgtggacgccatgtaatttgtgcatga

SEQ ID NO: 95 - DNA, 231 bp, M.catarrhalis
aatcatttatgctataatgggattaatttttataaactgaggcacgccatgctcagtatttatctgttaatcccattaagcctgatgctttttgttatagcaatttgggcaatttattatgcagttaagtctaatcaatttgaagatttggataacgcctctgaacaaatcattttagacgatcgacaagcacgccgaaaaacaaagcgtattcataaggaacagcgatga

SEQ ID NO: 96 - DNA, 1326 bp, M.catarrhalis
atcattatcggtcttgcctacattcagcccatgaccttgcttgatacctttggtgtggtatctcgtgatagtagcggtcatgtacccatgtcgtatatttttgctttgattgcgattttgttgacttcggtgagttacggtcacatgattcgtgcttatccttcatcgggttctgcttatacttatacccaaaaatctattaacccatcaatgggctttatggtcggttggtcaagttggcttgattatttattatctccgttagtaaatatcattttggcggtgatttatttagaagcattattccctgcggtcaatcattgggtttgggttattggtttgacggcactgatgacgggcgttaatctttttggctcaaaagctgtggcctattttaacagctggattgtttttgtacagctggctgtcattgcagtctttgtttttttaacttacaatgctctgtcagcaggtcaaaatgccgatggtatcattagccctgaaaatgcttaccatctttggagcatggcacccttttgggacagcatgacctctgttgcagcactcattaaaggtgcaaccattttgtgcttctcatttacaggatttgacgcactctcaacattagctgaagaaaccaaagacgccaaaaacactctaccaaaagcaatgattttaacgactttgattgctggcgttgtatttattatcagcacttattttatgcaactgtatttcccaaatcatccagaaacttattttaaactcattgatgaaacacaacctgaaattttagaggctgttggtggtgcggtatttaaggcggtggtacttggatttgccatcgttacagtcatggcatcaggaatctcagcccatgcaggcgtttctcgcttgatgtatgtgatgggtcgtgatggtgtgattagcaaaaatatttttggtaaaattcacccaactttatttacacccgtcaataatattctcatcgctggtgttgtcgcactaaccgctggctttgtcacatttgaatcggtgataaatctaatcagttttggtgctttgacagcatttagctttgtcaatatttctgtgttattccattatgtctttagaaataaatatgtgcataatgcaaatgatgtattaagctatatcatcgtaccaattgcaggctttatcagtgtgtttttaatgtggttaaaggttgacaaactaacctttgaagtgggtctattttgggctgccattggctttatctggcttggcatcaaaactcgtggttttaaagcacctgtcccacagtttaaagaagaagatgtttaa

SEQ ID NO: 97 - DNA, 1506 bp, M.catarrhalis
cttaactttatgaaatttatccatgattatctaaaacatgacgagcgactatatcgccacacactgcctactccccttgataatcctaagctggtttctttaaatgctcaattaatcgaccaattaggtttatcatcacttgatgcgactgcttggactgatatcatttcaggccgcctatcgccattaactcagattgccccacataagatacaacccatcgccatggcgtatgcaggtcatcagtttggtcaatgggcaggtcagctgggtgatgggcgaggcgtattaattgcccaattgcacaataaaaaaacaggcaaactgattgatttacacctaaaaggtgcaggtctgacctcttattctcggcgtggtgatgggcgggcaatgttagcaagctgtattcgtgaatatcttgggggtcatgcgctcaatggtttaatgattgcatcttctgatgccattggtcttgttgtttctgatactcatatccagcggcgtcatattgaaaaagcagccgctttacttcgtgttagcgattgccatgtacgccttgggcactttgaatgggttgcgatgtatgctgctgattattttgagacatttgtcattaaaattatccaaagctattatctacatctgtatgatactcatcaaaacaccgctaacattagtcaattattacatgaaattgccgccaacaccgcacgcatgattgccaaatggcaactgattggtttttgccatggtgttatgaatactgataatctcaatatcacagggacaacactggattttggcccttttgcattcatggagggttttaacccaacttggattaacaatcattctgatcatacaggtcgttatgtttatcaaaatcagcctacgattgggcattggaatttggcggtggtatatcaccactttaaaagacttgtcaatcaagatggtattgatgatgcgctaatgacataccaagaggtttttgaaaatacttatcatcatggtctatgccaaaaacttggtatcaaacccagtcatcaagccatacaattgggctatcggctgctgatgctgatgcaaaacgagcgtttagattataccaatacatttcgtgctttaatcgcagttgctgatcacggtgagaatcgtacccaatttacacatgaatacacgctgctggctaatttgacaaatatcttatctgcgacatcttatgatatttggcaaaattgggttaatgattatttagattgtctcaagcaacagtccaccaaacaaacggctattaagacattacaacaaaccaaccccatctatattcttagaaatcacatggcagaacgcgctattgtatctgctcatcaaggcgattttgatgaagtggcacgattatttgcattgctagataatccctatcaacagcaaaccattgcaaccgttgatgatactcgcatggcgtttgccaatgaggctgtcgcagtcagttgcttgtcttaa

SEQ ID NO: 98 - DNA, 363 bp, M.catarrhalis
aaaaccctgatgcttatgccagtatttctgcttttgctcccattgttaatcccgtctaagacgccttggggtcaaaaagcatttacagcgtatttgggtgaaaaagagtctgattggtgtgagtatgccagcacttatttggtagccaaagcaaccaaagctccacccatttacattgatcaaggcttggcagatgatttttatccaaatcagttgcagcctgaacagttcgttgccgctgcccaagaaaatggtattaatgtggaactaaacttgcatgatggctatgaccacagttacttttttgttgcaagttttattgaagtacatattaagtttcatgcaaatcatcttaatgcctaa

SEQ ID NO: 99 - DNA, 870 bp, M.catarrhalis
ggaacagcgatgacatttgcactaatttttgctgcttttagtatgggtctgcttggctcaccacattgtttgggtatgtgtggtggtatcgtagcagcctttggtatctctatgaaaaatacctcgcctgccaagcgaactttattgatgttaggctatcatatggggcggttgggtagctatacgattttaggcttactggttgcagccttgggtaagcacattttagcacctttaatggccaacagtgccttacccaaatatttattgggcggtgctttggtttttgctgcactgctcatgttggggctaccagtactcaatcgccttgaaaaagcaggtctaagattttggaatacactggcacctttacgcaccaaagttctaccgatggatagcttgcctaaggcactgattgcaggtctgctttggggatttttaccctgtgggctggtttatggtgcattgggcgtggcattgggacttgcctctgacagtcaagtaggattgacagcaacaacctttatggtatttttttggtttggtactttacccatgctacttgccacaggcacagtcatcgcttggctaaaatccaaaatccacgcatttaatctacgcaaattcagcggtgtggtgatactcatatcaggattagcaagtgcctttagcataccaatcatgcacaaattacatggcgtccacgcagaacatggtcaccatcaccatcaccattaccacaccagcgacgagcatattcatgatcaagtaggtcatcacagccatcaagatcaccctgaagcatctgcccacaaccccgctcactcatcgcattcagatcgaagccattcgcattcgtatcatcattaa

SEQ ID NO: 100 - DNA, 1221 bp, M.catarrhalis
attataccagtttgttacctttattataggatacttacctttatgagtattgagcgtaattctgaagcgtttgagcaagcacccatcaactgggtacctgccattgtgctattatccaccttgtttcttgccattactatcgtgccttggtatctatggacgcatggtgtgggcatgggcgtttgggtggcttttgctattttaatggcttggacgggtctgtctatcactgctggctaccatcgtttgtggtcacataaatcctatgaagcccatcctgttgtcaaatatattttattacttggtgcgactttggcggttgaaagctcagtatttgactggtgttcagggcatcgctcacaccatcgccatgttgatgatgaatatgacgacccgtattcttctcgtcgtggtttttggtttagccacatgggctggatgctacgcaaatacccaagcggtcaatatgattacaaaaatatccccgacctaaaaaaagataagctacttgccctacaacacaagtattatggtttttgggtaattgccactaatgttgttattctagcgatgattggctggatcacaggggatatgctgggtacatttttagttgcaggtcttctacgcttggtattgacgcatcattttaccttttttatcaactcgctgtgccatatgtttggtacacgcccttataccgatgagaataccgcacgggacaatggcctacttgccatcgtgacttggggtgaaggttatcataattatcatcactattttcaatatgactaccgtaatggcgtcaaatggtggcaatatgacccaaccaaatggatcatcggtctgcttgccaaagtaggcttggccagtaatttaaagcgtgtcgatgatttgaccatcaaacatgcagagctgaccatgcagtttaaacgcgcccaagaacgcatcgtaacagggggcgaaccaagtttagatgagcgtttggccgcctttaaagagcgtatcagtgccgagtatgatgaatttaccaaaacggttgaagaatggcataccctaaaagccaaagcgattgagctaaagcgtgcagaattagctgaccgattaaatgaagcagatgaaaagctcaaagcacagcttgcccaaattgaaactaaaatcttagagcaaagtaagcgtgttgaacaggcatatctacaactcaaaggtaaagccatctga

SEQ ID NO: 101 - DNA, 531 bp, M.catarrhalis
cttatggaattaatcagctgtcataaaatgtttgatggtgagcatcgccgttatcgccatgtttctaaagcagtccaaagtgagatgacctttgcggtctatctaccaaagcaggcactcaaaggtgcctgtttacctgtattatattatttatcagggttaacctgtaatgatgagaatttttcgaccaaatcaggcgctcagcagtatgctgctaagtacggtataattttggtgatacctgatacatcacctcgtggagaaaccgtacctgatgatgaagcttatgacttaggccaaggtgctggattttatgtcaatgcaaccgccagcccttggtcagtacattatcaaatgtatgattatattgttgatgagctacctaggctgattgagaagaacttcaatgtcggacaaaaggcaatctgtgggcatagcatgggcggtcatggtgccctacaaattggactaaaaaaccctgatgcttatgccagtatttctgcttttgctcccattgttaatcccgtctaa

SEQ ID NO: 102 - DNA, 204 bp, M.catarrhalis
aattatagattgcaaataatctatgtgttttgctatctacttatagcaactgcagctgagagagcacattgttatctgacagaccagttttcaattggccaatttcttgttaatgcatgcttggctaaaacttcatcaggtgtgatgcaaacagggttatcagaccattcaagtaaaggaatatcattttttgaatctgagtaa

SEQ ID NO: 103 - DNA, 222 bp, M.catarrhalis
ttaaaaatatcaatatttgtctttaaaatattactattagatgcaaaaactatctcactatgcctgcttactcccatctattgtgcttttaagcttgcaaaatttatgatcctcttttcttatgaactaactactattttagcaatattgattatttctaatttggaagccctttttgttttgaacagcgcatttttatttagaattcttatctttttctaa

SEQ ID NO: 104 - DNA, 258 bp, M.catarrhalis
tacaagatgacatttttccaaccccttgatttaaacaacaaaaaagcccaaatctttcgatttgagctttttaaaatttggagcgggaaacgagattcgaactcgcgaccccgaccttggcaaggtcgtgctctaccaactgagctattcccgctgatcagcatttgctgtatggatgcgtattatacacgaaaaatacataccgtcaagccatttttgcaaaaattttgcaattatttgtcaaaaactgaaatgtct

SEQ ID NO: 105 - DNA, 480 bp, M.catarrhalis
aagcaaggacaaattatggcaaaaaaaccaagtaatcaaatttgtgccaataaaaaagcacgacatgaatatttcatcgaagaaacctatgaggcaggtttagtgcttgaaggctgggaggtaaaatcgattcgtgcaggtaaaatgtcaatcaccgaaagctatgtcatttttaaaaataatgaagcatttttatttggtgcacatattcagccactattaaccagctcaacacacattaatccagataatatccgcacacgcaagctgttactcaatcggcgtgaaattgataagctttatggcatggtcaatcaaaaaggttatgccgtggttgccttatcttgttattggaaacatggtcgggtgaaatgtgaaattgctttggcaaagggtaaaaaactgcatgataaaagagcaacgctcaaagaacgagattttgcacgcgataagcagcgaggctttaaaaatcagctgtaa

SEQ ID NO: 106 - DNA, 2178 bp, M.catarrhalis
gagatttttaagtatttactatcattgaaatactcaaaaagcgataaaatttctgctaaaataggacgcttaagcttaacgcatcatacccaaagtagatttatgaatacccaaacttcttttattaataatacctctaaaaataatcctagcaaagccaatgatcaaattatcgctcaaatgtgtgccttaattaagctgctaaagcgtcacaatcatgcgtattatgtgatggatgcaccaacgatttcagatggtgaatatgatggtctgcgtcgcacattaatgatgcttgagcagcagcatcccaatttgatacaacctgatagcccgattaatacggtcggtggtgagccgctgcctttttttacgcaagtggctcatgaagtgccgatgctatcactgggcaatgtatttaatgctgatgatttgtcagggtttttgcgtcgtgccaatgagcgattgggtatcgccattgatgagtatgaaatggaactaaaacttgatggcttggcggtatcattaaagtatcaaaatggtcaattcgcccaagctgtcactcgaggcgatgggcaggtgggcgaggatatcacgcataatgtcagaaccattcgtaatttaccactgactttgacaggatgtgagcaaatcaaacagcttgagattcgaggtgaggtgttgatgcccaaagcaggttttgaaaaattaaatcgtgaaagcatcgcacaagggatcaagacttttgccaatcctcgcaatgctgctgcaggttcgctaaggcagttaaatgctgccatcgccgccgcgcgtccgttggcattttttggatactcagtgaatgatggattgcctgatggtatcaccacgcagtcaggtgcaatgcagtggcttggtcagcttgggtttgagatagcaccttttaaggttgccaagagtcttgatgagattcaagcattttatgcccatgtcatcaaaactcgtagccagctaccgtttgaaatcgatggtttggtgattaaggtgaatgatctaaatttacaggcacggttagggttcttaagccgtgaaccacgctgggcaacagcttacaaatttcccgccgaaactgtgcccacacgactcatagatgtagagtggcaagtagggcgtacagggactttgacacctgtgggcagacttgagccgataactgtgggcggtgttacggtcagtaatgtgactttgcataattttggtgagattgagcgtcttggggtgatggttggagatgtggtcaatgtgcatcgagcaggtgatgtcattcctaaggtatctggcgttattggtgagctacgccctaccgatgccaaacctatcctcctgccaacggtttgcccagtttgtcaatcaccgattagcttaccagaaggtgaggcgttggcaagatgtactggtgggctatactgtgccgcacagcagcaagaagcattgattcattttgtctctcgccgtgccatggatattgatggtttgggcagtcagtggctgattaagttttttgaaatggggcttgttcagacggtggcagatatttacaaactccacaagcaggctgagtatttaataacgctagagggtatgggtgataaatcagtcaccaaaatgctatcggctattgaaaaatcaaaacagaccaccttacctcgttttatttttgctttggggattcgtggtgttggcgaaagtacagcattgtcattggcgcagcagtttggggaattacagtcgatcattgaggcagatttacaagcactacaagctgtacctgatattggtgagataactgcccaatcaatttatgatttttttcgggcatcgcataatattgaggttgtgcaggcactgattgaggctggtgtttcttggcaagcaatggatacgcctgacaaatcatcattgccattgactggagagacttgggtggtgactggtactttaggcagtatggggcgtgatgaagccaaagataagctcattgccttgggtgcaaaagttgctggtagtgtttcagcaaagaccacacggctacttgctggtgaaaaagcaggtagtaagcttgaaaaagcccaaaaacttggcgttacagtcgttttagaagatgaatttttggcactgattgctttatataatcaggtataa

SEQ ID NO: 107 - DNA, 930 bp, M.catarrhalis
gaatttattaaaatgatagccaaattctttaggtctaggtctgagcaaaccacaaatgtgatcttagtcaagtacccaaatagtggatttgctgacaatgccctgaaaggtcttggagagtatttagcactgctcccctttgttgtattggtagtaatgtttattttattgcccttaggtctaattatttttaatgctttttataatgagtatggtgagtttggttttgggaatttctcaaagatatttaatagcgaattttatttacaggctttggtgctttccttaaagattagtttatatagcagcttgattggtattattattgggtttcagggcgcctattctctatatgcaatcaaagattcagcactggggagagctttaatttctctaaacacgttgctgagtaactttagcggtgttcctttggcatttgcaatgatgattatttttggctctagtggggtaattactttaatattatcaagattcgggataaatgatctaatagatatttattcatttaagggtatattattaagctatacatattttcaaattcctgtagctatactattactattcccagcaatttctggcctgaaaagagaatggcaagaaagtgctgccttgttgggtgctagtacgcgtcaatatttttttaaagttggattgcctgttttatcacctgctattttaggtacgtttattattttatttgctaatgcacttggtgcctatgcaactgcctatgcacttacatctggcagctttaatatcttgccaatacgtattgctgccatgattgcaggaaatttaactttagagcctaatatggcggcggcattagctttaatattggtaggattaatgctgattataacttttgttcatcagtatttacttagccgctacaaaattgactaa

SEQ ID NO: 108 - DNA, 528 bp, M.catarrhalis
acagtttgttttgtaatcaaaaggcgtatcgccatgacaaccactcctagaaaagttctttatccgggtacttttgatcccataaccaatgggcacattgatttggtgactcgtgcgcttaagttatttgacgaggtggtcattgccgtggcatttgcacatcataaaaagccaatatttgattttgatgagcgtgtggcattggtggagcaatattttgggaacaatcctaaagtgtcggtggtgggttttgaggggttgttggttgaatttgccaaagagcaaggtgtaagtgcggtactccgaggtttgcgtgcagtcagtgattttgagtatgaatttgggcttgccaatatgaatcgaagtttggatgatgattttgaagcagtttttttaacgccatctcaggagtactcatttatttcatcaactttggtgcgtgaggttgcaaagcttggtggtgatgttagtaaatttgttcctgaatctgtattaatagcatttgagcaaaaatttaatataaaatag

SEQ ID NO: 109 - DNA, 1083 bp, M.catarrhalis
tgctgtagtaatctcttatttttgtattctaatcattattacagctttcataaatggattcagcaattcgcaaataatgagaaaaaaatgagctatattcaaataaacaatgcacataagtctttcggttcattgaccgttatagatgatttgaatttaaatgtagaaaagggtagtttagttaccttgcttggtccttcaggctgcggcaagtcaactttgttacgttgtattgccggtctggaaacattgaatcagggttcaattatattaaacaatcaagatattacctatttaaaaccccagaaacgccgtattgccatggtatttcaaaattatgctctcttccccaacatgacagtggcagataatgtagagtttggattaaagattaaaaaagtctctcttgaagaaagactgattaaagtcaaagacgtgcttgatttggttgagttaacttcttttgctcagcaaaaaccagaatctttatctggtggacaaaaacagcgtgttgcactggctagagcattagttatggagccagatttgcttttgttagatgagccattatccgctctagatgccaaactacgtaaaagtttacgcatgcaaattaagcgcattcaaaaagaattgggattaactacactttttgttactcatgatcaagatgaagctttagcgatgtcagacgaggtggtcttgcttaataagggcaagattgagcaacattccacgccagacacactatatactcagcctaacaataggtttactgcggggtttataggacattacaatataggatattttgaatcagtaaaatccaaatctgccaagcaactttcgatgatggcaataagacctgaaactatattgttagatacggatgatggagatattccaggggttattcttgaaagaactttgactgggggagtggtgcgttaccaagtcagaacagattatggtgatatatttgatgttgatgtactgaaccatggcaaaattagccaattaaaagtcaattgcaaggtttttttaataatcaaagatgaacaagtgatcaacctagatagttaa

SEQ ID NO: 110 - DNA, 1008 bp, M.catarrhalis
aaagaaggtaaaatgatgactgatttatccattttagacttatccccatttcgtcagggcgaaacctttgctcaggcagtggataataccgtggcactggctcagcatgccgaaaaattagggctgagccgtttttggattgccgaacaccacaatatgccatatttggcaagctctgcgaccagtctgcttattcagcgtgtattggataaaacggcacacattcgtgtcggctcaggtggtgttatgctgcccaatcactcaccttttgtggtagcagagtactatgggacattggcgagcctatattctaatcgagtggatttagggcttggtcgtgcacctggtacagatcctgagactgcacgcgccatccgtcgtaatcatgatgattttgcgatgagttttccaaatgatatcaaagagttacaattttattttggtgatgatgcagatagtaataaagtgcgtgcttatcctgccaaaggtctaaaagtgccgctttatatcttaggttctagtaccgaaagtgcgtatttggcggctcaaatgggtctgccatatgcatttgcctcacactttgcaccacgctttttaacgcaagcggtacagatttatcgtaatcactttcagccatcagcagtgcttgatacgcctaaggtcatcgttggcgtaaacgcatttgttgcagataccgataccgaagctgagtttttggctagcacaagtttacagtttttcttaaatatagtaacaggtcagcgtagcggtatgaagccaccagcgacagacatcgctgcccatatcccagcgcatattgtacagatggctgatagtatgatgtcgtgtcgcttgcttggttctcctaagacagtcgcagaacagctcgaacaattacaaagccaagttcaagccgatgaactgatggcagtcagctatatttatgatgtccaaaaacagcatgattcttatgagctattatctgatattgtcaaaaattttaaatag

SEQ ID NO: 111 - DNA, 660 bp, M.catarrhalis
aatttggtcaatttgatgcaaaaatctatttggatgattcatatgatcacaatatcacgcataaaaccattcatctttctgacggctgtcattttaattggctgtcaagataatactgttgagcaaaatctacaacccatcagcgatcacgccaaaacaaatactgcgttaagcgatgacccaaaaaatgcacgccaaaacgctcatgagtttgaaagtttattcaatgaacttgacacaagtgacactcaagagatacaaagccctcaactgatcactaccgctgatggtaaagctaagcttaattggtcttatattgatactaaaaccaagaaagccaacttacaagattttaactatccttttttaattgatagtgaacctgtgatgaattatgccaatgcctttaatatcagtgccaaacaagcacaacattccatggcattatctatggcaagccctgaagtacttggtaaaattgttgatcagcttggtaatcgatatatcgctcatcaattccgtgatggcagcaaccctgcactaatcattcaagtaacgcccaatattgtcaatgagcggcacagctatattatctctgataaatttgctgagggcttggagctgcccattgagattgtatcagctcaaaactcccaataa

SEQ ID NO: 112 - DNA, 897 bp, M.catarrhalis
tcaggtataaaaatgcgttggataaataacccccaaactctgtctatccttgggcttttaattgggtgtatcctgtttggcatgggcagcttaattgtggcgtatgtcgatgttggtgcctatgcaatgtcattttggagattggcaatttcatcggtagtttttgtgctgcttgcacggctattttgccaaaagtttccccaatcaagatctgctttgatttatgcgttacttgcaggtgcagcgcttggacttgatttggcactatggcatgagagcattcatgcagtaggtcctggcatttccacattgctaaatagtttacaaattttctttttaaccttcattgggttttatttttttgctgagcatcaaaaactgatacagcttgttagtctaatactggcggttatgggtgtggtgctaattgccagccctgagtttgggcataatatgcaggcaggttggggctttatcacaggtattatttcaggtgcttgccttgcaatttctttgacttgggttcggcaagtgcattatcatgaaccaacaccactatttagcttgatggctttggtgggtttgggcggtgcgatcgtgatgttgcctttgatgctatggctggatcaagatcacattttacctaaaacaccacatgaacttggctggatattggtctatggcacagtcatgcagtgcttggcatttggtgcgattacttttagtatcccacgcctaagcttggcggtgacagggcttttattattatcagagcctgtggcggcattggtgctggattatttttggttaaataaaaccatcactttaatacagtggctaggtgcaatactgaccatgttcgccatttatttgggttcagtcaaggttagacactga

SEQ ID NO: 113 - DNA, 828 bp, M.catarrhalis
aaagttaagaaaatgaaaaatactaataaggttatattggttgtattagatgggttaaatgccgatgttggtttaacatgtatgggctttttgcaggctttgtgtgaacaacacaaagccaaagcttataaattgcagtgtgaactaccctctttgtcgcgccccttgtatgagtgtattttaacaggtgtgcgcccaacagatagcggcatttatcacaaccaaatcaatcgtttgtctaaagaaaaaagtgttttcaattattgcattcaatcaaataaagtgacagccgccgccgcttattattggattagtgaattatataaccgcagtccatttcaagcagcttttgatagacatactaatgattcaagtctacctatccagtttggccatttttattatgatgatgcttacccagactcccatttatttgacgatgcagaccatttgcgcaaaatctaccgaccagattttttactggtacattctatgaatatagatgatgcgggacatagatttggtctaaatagtatgcaatatcgcaatgccgcacgtagagcagatatgcttttatcaaattatattaatctttggttggatgatgggtatcaaataattgtaacctcggatcatggtatgaacaatgatctatctcatggtggcaatttaatagaagaaagagaagtgcctttttatactatcggtgatagatttaccaataagaatatggatgagccaattcaacaaactgagatttgtggaacaatctgcgctttacttaaggtggagcatgataaaacggtttgtaggaatttattaaaatga

SEQ ID NO: 114 - DNA, 267 bp, M.catarrhalis
aggcagaccgataagccgagttctgtcgtggacaatcattcatctaggcatatcattgctgatatgctcaagcaacctacccgaactctgagcgggcaacccattgagttcctatttggtcttgctacatgtggagtttaccttgccgtgagctgtcgccagtcacgcggtgggctcttaccccaccgtttcacccttacctatttaataggcggtctattctctgctgcactggtcgtaggctttcgccccctagctgttagctag

SEQ ID NO: 115 - DNA, 747 bp, M.catarrhalis
ctactaaaatgcatcattaacctaaggattgcttcaaggtataaaatgattactcacagagactctcagataaaaaccctggctttgtttgatttagaccacactttaattgatgttgatagtgattatatgtggggtcaatatattgtcgaagagaaattggtggcagatgatgattatggaataaccaatcgacaattttacgaaaattatattgatggaacacttgacgcaactttatataatgaattcgtagctcgattcctaagatccaaaactatgccagtccttctacagctgcgtaataactttattgataagaaaattaaacctgctatgcgtcctaagggtattgtcgctataaataaccacttaagattagggcatgaagttgtcataacctctgctacaaatagttttttagtgcctgcaattgcagaattgtttggaatacactctaagaatacactatccacacctttgcaaatccaaaaagatcttttcactggctttttaaccgacagaccaaactttaaagacggtaagctttaccatataaataaatggcttaaaaatatggaacgagagaatttatattttgaaggtacttatgcttactcagattcaaaaaatgatattcctttacttgaatggtctgataaccctgtttgcatcacacctgatgaagttttagccaagcatgcattaacaagaaattggccaattgaaaactggtctgtcagataa

SEQ ID NO: 116 - DNA, 861 bp, M.catarrhalis
atatggaagctggtaatgtctaagcgtttatcatataaaaatgactatcggctagaaaaagccccattaagcattaagcagtattttcatctaatctttttaattgccctgatttcattgatgatgattcctgttgtggcaacaggcgtttatgcggtttctggcgattggtcacagtccatattgcccgaatcatggactataaagtggttgcttgaaatttggactcaagaaagatttttgtgggcctgtttttactcgctagtgctctgtattggcagtgctatattaagtattattttaatttttcctgtattgcttattgtacacactagcaaaccacaatggcaacgttggattaattttatactgatactaccgtttaccgttccaccaatcgtagcatcaattagtattttggatctatattctggcatacttggtagcaaaatcggtacaacgtttattcttattggttgttatttcacaattgtactcccttttgtataccgatctttggataataattttagagcaatcggggtaaaagatttgattgaatctgccaatttgctaggtgcatcgacaccacagataattgcttatattctactaccaaatctaaagccagggtttatagtggccttctttatctctatagcgtttttaataggtgaatttgtttatgtaaacattttaataggtggccattttgaaacaattcaaacttatttatttaacttaaaaaaccaatccggacatttaagtagtgctgtagtaatctcttatttttgtattctaatcattattacagctttcataaatggattcagcaattcgcaaataatgagaaaaaaatga

SEQ ID NO: 117 - DNA, 270 bp, M.catarrhalis
tataaaataggcagtattatggcattaaaaatcaccgaagaatgtattaactgcgatgtttgcgaaccagtttgccctaatgaagccatctctgcaggcgatgatatttatgtgatcaatccagccttatgtaccgaatgcgttgggcattacgacacaccgcagtgtgtggatatttgtcctgtagactgcattcctaaagacccaaaatttccagagaccgaagatgagctgctggtaaaatatcaaaaacttacctctgatttataa

SEQ ID NO: 118 - DNA, 321 bp, M.catarrhalis
agcggagtgggtgggaaattccatattaaaaaggcggcgggggaaaacctttcccgcccctttgttcatacccgaccggaaaaacatggggggtttgtccccccaaaaagtggggaggcaaacacaagggggggcggttcacccacggggggggggggaggaaaagggggtttaatttcctacacaaggaaacccggggggggggagcgtgagatattgaaacacacttttttaaccccccctctgttggagttggggggggaaaaaaaaaaacaaaattaccctttggttgggggttttaaaaaccggggttataaaccc

SEQ ID NO: 119 - DNA, 1032 bp, M.catarrhalis
gaccatcttatgaccgaattttcttttaaagcacatcttgaacgccaaaatattgtgatctcttggcagcgttatggtatcgaagcacttaactttatggcacttggcttattttcatcactgattttgggtttgattatcaaaaatttgggtgcatggcttgatttaccatggttggttgagattggcaaacaagcacaaagcctaatgggagcagccatcggtgctggtgtggcttatgcacttaaagcaccgccgttggtgttattcacctcaatcacaacaggctttgcaggggcggcgatgggcggtcctatcggtgcattcatagcagcattaattggtgcagagtttggaaaatttgtccaccgtatgacacctttagacatcatcgtcacacctgcaacaacgctgattatcggtatggcggtcgcaggatttatcagtcctgccattgaccaattgatgataagccttgggcagttgatcatgtgggcggtagatttatcgccgattgtgatgagtattattgtggcaattgcgatgggactgatgttaactctacccatctcaagtgcagcgatcgccatcagtcttgggcttggcggtttggcagcaggggcggcaacagtcggttgtgcggcacaaatgatcggttttgcggtgatgagctatcgagacaatggtatcggtggtgcgatagcatgtgggctgggtactagcatgattcaggtacccaatatcctaaaaaaccctaaaatctggctaccacccactttagcaggtgctgtacttgctccctttgcgacagcgatttttggtatggtcaatatcccttcaggtgcaggcatgggtacatcaggctttgtcggtcagattggcacacttgacgccatgggtatcagccccatgacttggctacttatcatcagctttcatgtcattctacctgcaatattaacttggatatttgccaagctatgcgacaaaaaaggctggattaaaacaggcgatctgttacttaataaatag

SEQ ID NO: 120 - DNA, 657 bp, M.catarrhalis
ggtactattatgaccacttctttaaatattcatgtcattgatcacccgcttgtccgtcataaactgtcgctcatgcgtgaaaaagaaaccagcacttataaatttcgcacgctaaccaatgagcttgggcgactgatggcgtacgaagcgagccgtgattttgagattgaaagctttagcatgcaaggctggtgtggtgaaattacaggcgagcagattaaaggtaaaactgtcaccattgtaccaattttacgcgcaggcttgggcatgcttgatggtgtacttgatctattaccaactgccaaaatctctgtcgttggacttcagcgagatgaaatgacactagaacctgtgcctttttttgagaaatttgtcagtgacattgaccgtcgccctgcattaattttggatccgatgttggcaacagggggcagtatggtcgctactattgatatgcttaaaaaacatggctgcactaacatcaaagcattggtattggtcgcagcacctgaaggcgtacgcttagtcaataaggcacaccccgatgtcaaaatttataccgccgctttagacagtcatcttaatgaaaacggctacatcattccaggtcttggtgatgctggtgataaaatctttggcaccaaacagattggttaa

SEQ ID NO: 121 - DNA, 1116 bp, M.catarrhalis
gatagttatatgcaattctccaaatcaatccctttattttttttattctctataccctttctcgctagctgtggtaccaactcaaaagatgcagccgaacaagatgataaagcagtcgcaacgcctcagctttctgtagaagagctgatcgaaaaagccaagtcggagggtcgggtcaacagcgtgggtatgccaaacacatgggctaattgggaggaaacttggaatgatattaacaccgagtttggtctttctcaccaagatacagatatgagctcagctcaagaaattgcaaagtttctagctgaaaaggaaaatgccaccgcagacattggagatgttggagcatcatttgcccctgttgcagttgataaaggagtaacccaaccttataagccaagcacttgggatcaaatacctgaatgggcaaaggataaagatggtcattgggtaataggttatacaggggcaattgcttttatagcagataagcaaaaagttaataaaattcctaccagttgggatgagttaaagagatctaaatacaaagtaaccattggcgatgtttcaactgctagccaagcagttaatggtgttttggcagcaaattacgcacttggtggtacagaagctgatttaacccccgctttagactattttaccgatttagctaaacaaaaacgtcttggcatggctgatccctcggtagcaaatttagaaaaaggcgagattgaagttgcagtagtatgggactttaatggtttgaattatcgagaccagattaatcgcgaacgctttgatgtggtaatccctagcgatgggtctgtacagtctggctatgccaccattatcaataagtatgccaaaaatcctcacgctgctatgttaacgcgagagtatatactctcagataaggggcaattaaatttggctcgtggatatgctcgccctgtacgtattgaccatcttacaattccaaaagacgtgcaatcaagactgctacctcaaaaccaatatattaacgccaggcctattgctgatgctaaagcgtgggaagagagttcggcaaaattgcctcagcagtggcaagagagagtgcttatacatcaacaataa

SEQ ID NO: 122 - DNA, 792 bp, M.catarrhalis
ggaaaaaatatgctaaatagtcaacccaccctaaaaacattgcttgaacatcgctcaattcgcaaatatacaggtgagccgattgatgacaaagtgttgacagcaatactagaagcagggcgtgcagtttcaacctcaagctttttacaggctgccagtatcattcgtgtggtggataaaaataagcgtacccagttacgccaaatttcatgcgatatgagcgaagaagaataccaaaaagcacttgctgatggcaagcgtttgggtcatgcttatgttgaggattgtgctgaatatttggttttttgtatggatagttaccgccataatcagcttgctaaggtgcagacagattggacggaggttatgatcatcggagcgattgatgcagcattaatggcacaaaatattctagcagctgcagagagtttggggcttggtggtgtgtatattggtagtttgcgtaatgacattcgccgtgcaggtgagattttaggtttgccaaagcatgttgtacctttatttgggctttgcttggggcatccagatatgtcctctaaaattaatcaatctcagcgtccacgcttaccactggatgtgttggtttcaaccgatacttatcaaataccagatgaaagtacgctgaccaaatataatgaggtggtgcgtgaatattatcaaggacgcagattggatttggattgggcggcacaaatcactgcaacctttggcgatgaagtgcgtccatttatgctcaactacttgcaagatcaaggctttgccaaacgatga

SEQ ID NO: 123 - DNA, 261 bp, M.catarrhalis
cgtcagggcttatgggtattaaccataagcttttcctccccacttaaagtgctttacaaccaaaaggccttcttcacacacgcggcatggctggatcaggctttcgcccattgtccaatattccccactgctgcctcccgtaggagtctgggccgtgtctcagtcccagtgtggctgatcatcctctcagaccagctacagatcgtcgccttggtaggcctttaccccaccaaccagctaatccgacttaggctcatctaa

SEQ ID NO: 124 - DNA, 2196 bp, M.catarrhalis
tgccagtttttaagcaagttatcatttgttaattataaccttatgttaattataatctcaggcggtgtatggtcgcctgagattattacatcaattggaattttggacatgaatatccccgagtccatcattgagcagctcaatagtcaagctgacttagtgggaatcattggcaagcataccacgctcaaagcggcaggtcgtgaatacaaaggctgttgcccctttcatggtgaaaaaacgccttccttttatgtcaatcctgaaaccaacttatattattgctttggctgtcatgccaagggcaatccgatcacttttttaaaagaatttgaacggatgagctttattgaatcggtcaaattcttgtccgaacaaacgggcatcgagctgcccaaagatgacactgatcaaaaaaaattcaaatacaaaaaaaccgttaagactcagggtgccaagctcccaactcaaccttcgccagatccgagcagtcgccaaaacttcattcatcatcagtccgatacacgcccatcaccagcaaccgattgggtcaatgatttatcggcatacgatacttattctggattggctgatccaagccatcatgctggtcaagtgaatgagctttatggcactcgagcacccattttgactcagtcgcccaatgcagcacaaggtgatttatacagtctactaaccgcagtgcatgattattatcagctgatgcttaacaattttacttttgcaaaacagtactttttagatcgtggtcttagcgaagagaccatacaaacctttgggctaggttatgcacctgacggttggcagcatttggagcaagttttcccccaagacatcgagggtttgaaaatattaggtttggttcgagaatcatctaaaagtaatggcaggactttttgcttattgcgtcatcgggtgatttttccgattcgtgataatcaagggcgtgttgtgggctttgctgggcgaagcctaggtgatgaaaacccaaaatacatcaactcaagcgaatcacctgtttttcaaaaacagcagattttatatggtctgtatgaatcacgcaaacaaaaagccaaaaactacctactggttgagggttatatggatgttattgccttataccaagcagggatttatggggcggtagcgcctatgggtactgccgctaacgaaaagcaaattgagcgactgttacgctataataatcagctgactttatgttttgatggtgataatgcagggcaaaaagcagcgtggcgtacgctagaaattgccgcacccatcttaaacgatggccgtgagcttaaatttttaactttacccgatcatcacgatcctgacacttacctaaaatctcatggggcagccgtaatgcgtgatgctatcgagggtgcggtgagcttatcggattatatttatggcgttttggcaagtcaatacgacctaacacgccccgaatctaaggcacaagccatggcaacgcttaggcaactgaccgaactgctgccaaaaggctctagcttaaaatggtggttaaatagcgatatttatcaaaaattaaaagccattggtcgagaaggacagtttagcccaaaagttgagttaattaactataaccgccacgacgccgccgatgcaatcaccgaaatcgcattgcatctgattcacacccccattttgctcaaatctgatcctttggcatttgtcatcgaacactcaggcatggcacaagcacatttaccattatctaatcatcttgagcgacaagaaattagtttacccaaactgcccaattgggcaagttttaaaagcccattattagatgaaatcattgccacagtcagcacattaccaaatgaaattttacaagatgatacaaaaatggttcaaagctgtgcgtattttgtcattgctgctttgagcgatgttcacaaaagtcaaatacagcgatactggcaaagatttatccaatcttggtccaatcaagatctcaaagccatcacgccagtattttatggactgatttgcaccgccttaaaagatattctgcttaaacaacaaactaacagtaaaaatttaattttatcagaagtttataaaagacgcttgcaagcattggttcattgggataatatccataataaatcacaattggcagaaattttaacaaaataa

SEQ ID NO: 125 - DNA, 1317 bp, M.catarrhalis
aatatgactttatcatcctatttaaaaattaatgagcgtggctcatccgtgcgtcaagaaatcattgctggcttgacgacttttttggcgatggtgtattcgatcatcgttgtgccaaatatgttatcagcagctggatttcctgctgaatccgtttttgttgcaacatgcttggtggcaggccttggttcaatattaattggactttgggcaaatgtaccgatggcgattggctgtgcgatttctttgacggcattcaccgcttttagcttagtgcttgggcaaggtgtgagcattcctgtggcactgggtgcaatttttttaatgggcgtggtttttaccttaatctcggtgactggtgttcgtgcgtggattttacgcaacttgcctgcatcgattgcacacggtgcaggcatcggcatcggactgtttttactgctgattgctgccaatggtgtgggtttagtcatcaaaaatgatgcaggtttacctgtgacaatgggtgagtttatgtcgttgcctgtgattttatctttagtggggctggcggcgattattggtcttgagcgattacgcattaagggcagtatcttatgggtgattattaccattacgatgattgggctactttttgatcctgcagtgaagtcagatggtgccattttaaaagtaccaagctttggttcagactctttatttatgcaaatggatgtcatgggtgcgctaaatacagcgattttaccggtggtgtttgccttagttatgacagcaatttttgatgcaacaggtaccattcgtgccgtggcaggtcaggcaaatctactggacaaagatggtcaaatcatcaatggcggtcgtgctttgacatcagattcagtcagtagcctgttttcgggtatttttgggacagcacctgctgcggtgtatatcgaatctgctgccggtacggcagtaggcggtaagacaggcttgacagcgattgtggttggcgtgctgtttttattgatgctattttttcagccattggcatttttggtaccaagctatgctaccgcacctgcactcatgtatgtcggtcttttgatgctaagcaatgtctcaagacttgattttgaagattttgtcggagcaatgagcggtttaatttgtgctgtatttattgttttgactgccaatattgtcacaggaattatgcttggttttggtacattggtgcttggacgactaatttctggtgaatttaacaagcttaatcttggtaccgtgattattgctgtcgtgcttgtcgcattttatgcattgggctatgccatttga

SEQ ID NO: 126 - DNA, 378 bp, M.catarrhalis
  unsure (230): Identity of nucleotide sequences at the above locations are unknown.
cattggcccccaagcgccaagcgtcgttcagcgttaaccaccaatttccaaaaggttttgggtaacaaaagagcgttgtatcacggttgcaacatcccagcaaatcaaaaaaagcccaaagatggttttgtccaaaaaaccttgcttgagtttattgaagagtcatcaagggtgatgattttgcagaaagtgggtcatgatcatgatgagcctttggtgagtattgcttnttcagagcaagtccaagatatgctaggtgctgatgccagagtggttgggcaagcgatgattcatgctgccatcgcaagtgttgtacaacgccaaagtaatttttggcatgcacatgtgtatgatgaagaaccagcacattatagctga

SEQ ID NO: 127 - DNA, 843 bp, M.catarrhalis
acgatgatacccaatgaaaatatgacgctgcctttggatattctttatcaaaatgatgatgtgttggttatacagactcatactggtgtatctgataaagccgatcggctgataggtcatgatgataatcaattggcactttatggcaaatttaatatggcacttcatgtcaatgatatgccatcttgggtactgaatcgacgagccaggctacttgcttggctgtatgagcaggcaggtgctaatcaaatccactggctaaatcaagtccatggcaatgttgtgattgatgttgatcagacaagatcgcagtcgttaagcttggcagatgccttgatcactcagcgtgctaagacagcactggcgatcatgacagcagattgtgtgcctatagcgatatttgaaaaaaatggcagtacggtcgcctgtattcatgcagggtggcaagggctggccaatggcgtaatcgccaaaacagtcgctttgatgccaacttcttacaagctatttgctgtcatcggtgcgtgcatctcactgccagcgtatgaagtggatcagcacttagctgagcatatcattgatgaggcggtaacaaataaacttgtcttacttgataggcaggtgctgtttgatatgctgatcaaaccttctcataacagtgataaggcatatattgatattaagagattggctcagttgcagcttgaaaaatttggcataacagtgctaaacgataccgtgccatgtagttatttatcacctaaatattattcgtaccgtctccaaactcacaccaatcgcccagcaatcggcagaatggcgatgcttatcatcaaaaaataa

SEQ ID NO: 128 - DNA, 207 bp, M.catarrhalis
cagcttccaccaaggcatttgccaaagggtggctggcgtactgctctatgctggctgtcaactcaagggccctgcgatttatttatcttactgcttaagccaatggattttttggacccttggatgacccaaagtcagcgtgcctgttttatcaaaaatgatggtatcaatgccaccagcagactcaaggctgaccgcatcttttaa

SEQ ID NO: 129 - DNA, 405 bp, M.catarrhalis
gaaaatttttatttgcatattgtgagattgccaagattttggtatcatagacggcatattgtccaagcggtgtgtcttcctcaaacacattgccccactttttataatttagcattttactttttaaggatttaccctatggcaaactctgcacaagctcgtaaacgcgctcgtcaaaatactaagcgtcgtcagcacaacgcatctcaacgctctatggtgcgtacctacatcaaacgcgtcaattctgcaattgaagcaaaatcttatgagcttgcaaccgaagcctataacaaagctgtgccagttattgaccgtatggctgataaaggcattatccataaaaacaaagccgctcgccacaagagccgcttgaatgccgcaattaaagctttaaaaggctag

SEQ ID NO: 130 - DNA, 2250 bp, M.catarrhalis
tttttagattttattataaggattattatgctaagtcctgaattgttaacgattcaagaatttatgctgaagtttgctaagcaacattcacatcaatttatcagcgttgagcatttgttgatgggtttattaaaagatgcgtttaccgtcagagtgcttgaggagtgcggtgctgacagtgaatttattttatcaagtatcaagcaatatcttaaagatttcatgcccaagcgtgaagatgtcgacccattgccaaccaaaagtctaaatcgtgtgatgcagcgtgcaatttggcaagtgcaagccagccaaacccagcagctggtcaaacccattgatgcacttgtcgcaatttttaaagaagaacgcagttatgccaatgagttgatccagtcttgtggcgtggatattttatcggttactcgtgcaatttcgattcatcagcgttctgcacatgacgcttataacggtgtcgacgagtctgccaatcaatcgacaaagcccaagcaaaatccactggatgcttatactttaaatcttaatgagcaagcaaagcaaggtaaaaccgatcctttggttgggcgggcagatgaaattgaacgcaccgtccaaatcctgtgccgccgccgcaaaaataacccgcttttggttggtgatcctggtgttggtaaaacagccattgctgagggtttggcgtggctgattgtgaatggcaaggcgccaaaaccgcttgctaatgcgacaatttatagcttggatatgggtgcgctgattgcaggtacgaagtttcgtggtgagtttgagacacgcatgaaagacttgattgatgagctaaaagatacaccagagtcaattttatttattgatgagattcatatgatgattggggcaggtgcgtccatggacagtagtatggatgtatcaaatctaatcaagcctgcacttgccaaggggtatattcgctcaattggctctacaacatttgctgagtatcgccaagtttttgaaaaagatcatgcactatctcggcgttttcagaaaatagacattaaagagccttcggtatctgatacaatcgccattttacaagggttgaaaggatattacgaagattttcatggcgtggcatacaccgaagatgccattgaggcggctgttaaattatctgtcaagcatattcatgaaagatttttgcccgataaggccattgatgtgatcgatgaagcaggctcttttgtgcgtttgcatcatgataaagtcaccaatcatagtcaaatggatacccaaaaaacctcatcatcaatccaagtcgatattgatatcatagaacaagtggtcgcaaaaatcgcacgcataccgcccaaatctgtctctcatgatgataagaatattttaaaaaatttaaacgctaatctaaagcagatggtcttcggtcaagaccaagccgttgatacgcttgttgatgcgattttgcttgcacgctcaggattaacccatcctgataaacctattggctcatttttattttcaggcccgacaggtgttggtaaaactgagatcagccgccagttggcttatttacttggtgtgcctttggtgcggtttgatatgagtgaatatatggaagcacatacggcatcacggttgatcggtgcgccgcctggttatgtggggtatgatcaaggtggtttattaaccgaaaaaattcagcaaaatccacattgcgtgctacttttagatgagttagaaaaagcgcacagtgatgtatttaatttgttgctgcaagtgatggaccatggcacattgacagataataatggacgcatggcatcatttaagcaggtgattgtgattatgacgaccaatgttggagcagatagcatcagccgccgatcgatggggtttacacagcaagatcatcatagcgataatcaaaatgccatacagcgtacatttagccctgagtttcgcaatcgcttggatgccatcgtaaattttgcaccattaccgcccgaggtgattggcgatgtggttgataagttcataaccgaattatatgatcaattgcttgataaaaatatcatcttatctgtggacgatgaggtgcgtttgcatttggcaaaaaaaggttatgatcgcttaatgggtgcaagacccatggcaagaaccattcaagagctactcaaaaaaccgctatcaaaactgattttgtcttcaccacggggctggaaggatccgcggtggcgcgat

SEQ ID NO: 131 - DNA, 600 bp, M.catarrhalis
atggtttatcatatgaatgacaatttatctattggtgaaaacaatctacacgctggcacatcaggtacaaagcgaaaaaataaaccagaggagcttaaacatgggttgatcatggcggccaagcacttgatggtcagtgatggtgtggcgaatttatccatgcaaaaagttgcggacactgcaggtaccagtaaaggcggactatttcatcattttaaaaataaagaagagctgttaaatgccgtggtgggtctttatatcgctcagctaaatactgcaattttatccatcactgatgaattgggtgctattcaaggtcgatttaccaaagcgtatttgcaagtgatttttcaagattctaagattggtatgaacagcaactggtctaggctactaacagccattcatgctgatgctaatatgtttgaggtgtggcaaaactggatggctcaaaaacaaaagcagttcgccgccaccgatagtcatccacagtatcaagtggtacgctacgccatcgaaggtgctcagcttgacaccgaactaaaatccaaccaagccaaacaacatgagatttatgagaccttagccagtctgatttag

SEQ ID NO: 132 - DNA, 753 bp, M.catarrhalis
atgttcagccaagcttacgggcttggctttttggaattgtcaatcatgttgcatttatatcatttgaataactctcgctcttttagagtggtttggctacttgaagagcttaaattggcttatggcttagagtatcagctgcatctgattgagcgtgatcaaaaaacttttttagcgcccaaaaatcttgagcagattcaccccatggggaaggcaccgattttaatcgatgacagattgcctaagggggagcaagttctggcagaatctgcactaattttatcttatttattaaaagcttatgattctaaagcgtatttttatcctgctgcagccaacccaaacgaacaagccaatgacaaagtatggcgtgattatactttttggatacattttgccgaagggtcattgatgccgcctttggtgatggggttgattttagataaagctcgccaaaaatctccttggtttgttaaacctgtactcaataaatttaactcaagcattcatcagattattttggataagaatgtgatgaatgctttaaagatgctagagacggctttggctgataagttatacttaacagggcaatttagtgccgctgacatacagatgtatttggcagtgtatggcgtacgcttgcgtggattgataccacaaacgcacaccaacacgcatgcttggcttggcacttgtgaaagtcgccaaggtttcaaatccgctatttctttggcgggttcacctttataa

SEQ ID NO: 133 - DNA, 1281 bp, M.catarrhalis
gtgattaaacaaagaaggtttggtatgcgattttcggcagtaataacggctttattgattggtgcgatgggctatatgagtgcatttgccaatccacaggcttttgatgatcaagcagatgtagacgatctgataatagatacgcctgctttggatgtagcaccaaatcatttgtatggtattgacggtttgcactctgggcgagtgcctttgaataccatcagtcccaccacgctcaaaacttttgtacaagtggttgatttgatgcgtcgtgaatacattgagcctgtagatgatgagatgttgttttatcatgccattcatgggatgctaaatcgtgtggatcgcaatgctgagtttcttgatgcgactgcctttgccaatcttagctcatttaccacaggtaatgtggcaggcgtgggtctaaaggcagtttggaggagccaagatgcacattgggtggtgactgaagtgattgccgatagccctgccaaaagtgcaggcattaatgttggtgattatctacaccagattggtgatattaaacttaaccaatcccaaaccgaaaatgacatcattcagcttttaagtggtatcgcaggctcaagcgttgatatcacttattcaagagcaggtcgatccaagcaatccgtcaatgtcattcgtaaccaagctcaaaagagtagcattgaagtttttgttcaaaatggcattgctgtcatcaaacttcccgtctttcaaaataataccagacaagatataattgatcgtcttgccttaatagaagggcaggttcggggtgtggtgattgatttacgaaacaatcctggcggcgtgcttgattcagccgctgaggtggcctctttatttatgcgaaagcaagtcgttacccaagtccaaaaccgaagtggcatagaaagggtgatagaaacgcatggttcacccgtactagaatccatgccagtgattattttacaaaaccgctattcggcatcagcagctgaagtactggcaagtgcattgcaaacccatgggcgggcaatgatcgtgggtgaggcgagctacggtaagggttcggtgcagtcggtcatcgctttgggaaatcatcaagggattaagataactaccgcacattatctaacgcccaatggcaaaaaaatcgataaaatcggtgtggtgcctgatgtgagttttaaaccaccttctaacgattcacaagacgatgaatggttgcgtttgagcctagatttgatggagcgagtaaaaacaaaccaaagttga

SEQ ID NO: 134 - DNA, 387 bp, M.catarrhalis
aatttccagcagcaatacgatatgacgaagcagtgcagcagttattttttgattaaggcagtccaagattttaaatcaccttccaaacatcggtcagataccgatgtcatcaccgaaaccaaaattcaagtcaagcagcccaagctgtacacagtgattatgtataatgataattatacgaccatggattttgtggtatatgtactcgttgagatttttcagcacaatattgataaggcgtatcagcttatgatgcagattcatgagttgggacaagcggcggttgccttgttgccttatgacttagctgagatgaaggtagatgaagtgacggcattggcagaacaagagtcttatccgttactcactatgattgagcctgcctaa

SEQ ID NO: 135 - DNA, 195 bp, M.catarrhalis
tggacaaataagctattatcgctaaattatggctttttttcaaccaaaaacaccgccaaatcgttggcggtgtttgagtatcaaaagtttattttggggcaaccatttgttctggacgcacaatctcatcaaattcagcttcagttaataagttcagctgaatggcagtttgttttaaagattgattatttttaa

SEQ ID NO: 136 - DNA, 1818 bp, M.catarrhalis
tttagcgataatagcttatttgtccattatcatacgccattcatcatgaccaccacgcaagcccgtcttaaaaagcccaaaaaacctcggcgttcacaagctgatatcgtggctaataattttttaaattctgtttttcgtcctgcaaaaaagcagctgactttagcatggctgtgcgatgtcattagcttgctattattcatggtacaagcttggattttggtgatgatttttgatggctggcttttgccatttattcctgaattatcccagcatcaagtgatggcgatcgaggctttggctgtttatgtgatggctttatttggcgtgatgttattacgcgcattgattggttatgccaaagatgcactactcacacgcatcggtgtgcaagcagccagtgatgtgcgtcagcggctattggttaaactgggtgacatgggtcctgccagacgcttttttggctctgatggtgcactggcaagcaaaatcattgatgaacctgagcatctcatcggttatgctcgctttgaaattcagaaaaaaactgccgttagtacaccaattttattggcagtttgtattagtttttttaataaaactgctgcaatgatattactggcgacggcaccactggtaccgatttttatggcgatgattggtgtagcaactgcacgcaaaagccgtgagcagatggatgcgatggcacagcttggcggtcgattttttgattggatacgaggggtgaatacactatctcgtctgggcgtggttgatatcgctgttaaagatattgatgtcagtagcgacaattaccgtaaaaaaaccatggcagtgctacgcattgcttttttaaatagtgcggtgcttgaatttttatcggcattatccattgcacttgtggctgtttatttgggttttgggctgattggaattttgccttggcaatctggtgttgtcataacaacttatagctcagctttgatgattttattattggtgcctgaattttatgcaccactacgccgcttgggtgctgagtatcatgtcaaaggtcaagccgtcggtgctgccaaggagatggttggcatacttgattttaaacatagcaaaaccgagctacatcaggtggatttgatgggaaaagtaggattttgtttaaggcaagtggctgcctttggtgatgatgggcgagtcaggttaacgccgacgacgctgcattttgtggcaggtaaatcaacattattaaaaggggaaagtggcacaggcaaatcgacacttttacagattttattgggatttgggcaatatactggcgtggttgaggtgtatgatgatcaaggacactatcgctacgatacgctggatatggcgtatcttagacatcagtttggctatttggcacaaatgccagcactgctgcccatcagtattcgtgataatctgacattggcaaaatctgatgcgaccgatgatgagctgattgatgtactagatgctgttggactgtggtctttgatccgtgatttgcccgagcagatggataccatacttggtgagcggggtggtgggctgtcaggtgggcaggcacatcgccttgccattgcgcagcttttgcttcaagatgctaaggtgtggctgcttgatgaaccaacagaacatctagacagtgagactgcctttatgatcaaagatttattaaaacgcttatcagtgcatcggacggtcatttggattacccatgatcaaagtgttgatatcgcctttgatgatatccatcatttagggggttatgatgaaatcaaatcaaccatttaa

SEQ ID NO: 137 - DNA, 219 bp, M.catarrhalis
gtaattgtcaaggagatgatggcgatgaataaaaataaaccagtcattttacaaaacagcggtgtcaagattttggtgggcgtgctatgtttattaagctttgtggcaggatattttgcccatcagtcacgccaaatgaattattgtaactctatcaatcaaacgcccatcgtccaaaacggtattgtgatttgccaactcaatgatccaaatacttaa

SEQ ID NO: 138 - DNA, 1053 bp, M.catarrhalis
agtggtctaaatttactcttgggctttattatgaatcatgatgaattgatggataacttggtcaatcaggcacctgactgcggcataggtgaggatagtgatgctgatgatctgattgatgcagatgagacgaccacccaaacaccgacccaaattcatctgacgcatagtgtcagtaccgagcaaattggcattaggcttgataagctttgtgcggatatttttggggggttttcacgcgcaaatttaaaaaagttcatcgatgagggtcaattgacggttaatggcaaggtggttaagccaaaatatgcggtcaaagtgggcgatatattaacgctagaagctgtccacgagtctcattcagaggatttgcctgaaaatattgatattgatatcatttatgaagatgaggcggtgattatcattaataaacctgcaggtatggtggtgcatcctggtgctggtaatcgtacgggtactttggtgaatgcactgctgtatcactttcccaagcaggcacacttgccacgagcgggcctagtgcatcgcattgacaaagatacaacagggctacttgtcatcgcacgcacaaaatcagctcagctatctttgattaatcagcttaaggataaaagcgtctaccgtcattatcaatgtattgctttgggtgcagtgcatgaagtgcttcgccatgctcaaattgatgcacccattggtcggcatagcacccatcggactaagatggcagtgaaacaaacgggcaagcctgctttaacgcacattgtcaatgccaagtctttacatgagcgttacagtcttttggatattcatctaaaaacaggtagaacacatcaaatacgcgtgcatctgtcttatgtcggtcatccgctggtgggcgatcctgtctatggtacatcgccacgtgcaggtttatccgacaggcaaagatgtgcaattttggattttggcaggcaggcacttcatgcatacatggtgggttttattcatcctgttactggcgaggcgataaaatttcatgcacccgctacctaa

SEQ ID NO: 139 - DNA, 1107 bp, M.catarrhalis
actagcccaaatttagaccaattcatgagaattcctatgaaatcacaaaacaagctgattgccgccatgatggcagcgactttgactgttacaggctgccagagcgtgaatggactgtttgaccgcaaggctgataccgtagaaacggctgaaaaaacagatgctgcatattatcaagaagccagtgaagcacttgataaaaatcaaaatcgcaacgccattgaagcactaaataacatccgaaccttttatccgacaggtcaatatgcacagcaggcactgctagatctcatttatgcccaatataaagccaatgattttgaagcagttctacaaagtacagaagagtttattcaccgatacccaaacagccgctcggtagactatgcgttatatgtccaaggcgttactcatatgggcggcgctcccaaagcttctcgtttggttagatttgatcaatctcatcgtgatgtgacttatctacgcctagctttccgagattttcaaaacctgcttaagcactatcctgatagtccatatgttgccgatgccgcacaacgcatgattgccatttataatgactttgctgagcatgaattggcggcagcgcgttggtatgtcaagcgtgatgcgatggtggctgctgccaaccgagctaagtgggtgtttcaatactatccacagtccacaggtgtgccagaagctatcgcaattttggcttatagcaatcaaaagcttggcttgactgagaccgccaaacagtacaagcagttactccaaattaattatccgcaatatctcaatcaagatggttcagtacgcctcagtgatacgggtgccaagacacgcacacaaaaggtattatcagcactaagctttgggcgtttggggcgtgtcagcgaaaatcttgacaactatcaaggtcaatatcatggcgcaacacgcacccaaatcatcagccaagcaggtgcgattagcttacctgccacaacccaagtcccaaaagaaattcctacagctggtggtacaaatcatcgccctgccatcagtttagacttgccatcagcagaggcagacgctggacaattaaatcaaataccacgctaa

SEQ ID NO: 140 - DNA, 618 bp, M.catarrhalis
tcattaccaaatataaacacaatgaccaagaccagccaccaaaccaatttatccgctgtccatttgcgtaaacacatgcgtatgcaaagacgatcgcttagtcactgtgagcgtcaaagatccgcttacctagcaaccagatttttatataaattaatgccgctattacccaaaaaagccaatattggtttttatttggatggattttgtgaactaccaaccgccaccattgcccaattttgtcaaaaacttgactatcaagcgtatttacccatcaccacgccaaacaaacccttgacatttgcccccatcattcaaccactgaataaaacacctcttaaaaagcatcgcctaggcatgcatgaaccccgctcaaaactgatattatctgccaatcacatggatgccatcatttgccctttggtgatggttgatcttgacggtatacgccttggtatggggggcggctactatgaccgcacatttgcaaaagccaaaaactgcctaaaaatcgcttggtgttatgattttcaagtggcagatcggctacccaaacagccttgggatatgtcggtggacatcatcattaccgatcaaaggctaattagattaaaataa

SEQ ID NO: 141 - DNA, 699 bp, M.catarrhalis
aatcagaaaaaattgataaatccatcaagttgcctgatatcatttgtgtgccgcgtggggtggatgttcgaaaatacccctatcgccatcactcatctgtgcattggctacatcaaacctttacccaatttcctgagcttgaacacaaaaaatggttggtttttccaacaccgatcggtcctgaatatggtcaagacatggctcattgatattttaggaaatctacaagaaaaatttccaaaaattcacgcaattatcatggatgatgaccccacagcacgcattcatcagtgtgttttttatgaagattttgtccaacgcctgcatactttgggcttacaagatcgggtctcttttatcggcaaaaatccacctgatatgcgtgaatggttgtcatcagctaatatcgtattatcgcttgccaatcaccccgaaagtattggcatgacagcacttcaagccattcatttaggaacaccagtgattggttgggcaaaaggtgcctttgcagatatcctaggagacttatacccccaaggattggtcaaagaacagactgcgatcatgctgtgtaaaagtgttaagtttttattatcaaaccccattccgcctgccatgacgcatgcttatgagattgatgatatggtcgataatacaattcaagtttatcaagacttagtcaagcaaagcacagagtga

SEQ ID NO: 142 - DNA, 705 bp, M.catarrhalis
aaattgatgaaaaccaaagcaatcttaatcggtggttcgagtcgagtgggcgaggcactggcacaagagcttgcactgatctatgagtcggtgatactcatcacgcgtactcagccgcgtgccatgagtgcaaatatgcaggtgtatcatgtggcggattttcgggcacttgcatcgaccattgagatggtggcgattggtgctgatacagatgcttttagttgtcttggtgtctcaaaacagcaagtaccaagtcatgatgaattttatcaagtcaatgtcctgtataatttagaatttgccaaagcgtgcaaacaaaagggtgtgcaacagttttattttttatccaaagaaggtgctgatacccccaatcatgatgatgagctaactgccaaggcagatgtagaatatgatttacgcacgctcagctttgatacattggcaatttttcgtttgtatcgcttaaccttacccaagcaccgcctgagcctaaaaagcctcggcagccaagcactcaatggtgtattatctacactcaataaaaacaaacgcgcgcttgagccaaaacaggtcgccgcttgtatggcgattaccgcctataagcataaccatcagccgcagctacgcacaccaaaccaagccacgatcatcacacatgaacagatgctcaacagcgtcattcgccccaataaaaaatccaaataa

SEQ ID NO: 143 - DNA, 204 bp, M.catarrhalis
ttgcttgcccttgtgcgcttggacttgcaacacctgccgcgattatggcaggcatgggcacagcagcacgccatggtgtatggtttaaaagatgcggtcagccttgagtctgctggtggcattgataccatcatttttgataaaacaggcacgctgactttgggtcatccaagggtccaaaaaatccattggcttaagcagtaa

SEQ ID NO: 144 - DNA, 897 bp, M.catarrhalis
cgatattttgatcgaccaatgaatatcaggttttttatgccaaatttaacccttttcactcattttaaaaagcagcgtggctcaaccaatcagattttggcattgtttttgattgcgcttgctgtttctgcattgattgtcgctgtgattggctataaatttggctatcgtcaaggcatgcacagtgttgagcgtaccgtcttagcaaagcatgatgcagcggttaatgtcagtgagctgaccgctgaaaatgtgcggctaaagcaggagatgacaactgccatccaagagcgtgatatcagtcgatcgacattaaataatctgcgtacagattatgacaatctaaagaccaccaatttacaacttgagcaggtcaatgagctactaaaaactgcagttgccgagcagggcggtgtggcattatctatcatggcatcagaaatcatctctttaccaaatgatacctttgaatatcgctttgatgtgtccatgcttgatatttctggaaaagccgttaagatgattcctaaattgactttactaaacgaaaccaatatggttaaggtaccgcttgagccatcaagctatgatattcgtggtgtgcaaatattcgtgttcgaattatcatgcctgagggctttgaagcgaaagcaaaagaagctgaagctggtcgcttgtaatcaaaaagttcagcagttgtataattggcaaaattggcaaaatcatcaccaatgcacccgcttcattggcacaaatgtcaaattcaaacccaccgaccaattgaaaaaagcacgcaataatttatgggtactttttatcacaaatacaggcgaggcagtggctttcgcctgttttatattaaccaaaattgaaatttccagcagcaatacgatatga

SEQ ID NO: 145 - DNA, 654 bp, M.catarrhalis
tatgggcgtttgatgagtattaaagttttggtcgtagatgaccatgatttggtaagaatgggcatcactcggatgcttgatgacgatccaaatattgaagttatcggtgaagcgattgatggcgacagtgcggtgatacaggtgcgcgccataagtcctgatgttgttttgttggatgtcaatatgccaaatatcaatggtgtagaagccactcgacgcattaaacagtttaatccaaacatcaaggtacttgctgtttcaagtttgacagctcagccatatccttccatgcttttaaaagcgggtgtcaatggctatattaccaaaggcacgccgcttgatgagatgattcgtgccatcaaaaaagtacacgcaggatcgcgttattttagtcatgatgttgccgagcagcttgccgaaactgtacttggtgaacaaaaagagtcgccctttgatgccttatctgagcgtgaaaaacaggttgccatgatggttgttaactgtcaaagtacacagcaaattgccgatcagctatttgtaagcgccaaaacagtcaatacttatcgctatcggatttttgataaactgggcattgatagcgatgtcaaactcacgcaccttgccatcaggcatgggctggtacagactcactga

SEQ ID NO: 146 - DNA, 549 bp, M.catarrhalis
aatatgcatcgtttaactgttatgattaaaatgacaacgagatacctaatgctacaaaattctaacgaaaccatcacgctgccaagttttgagttaaccatggtggcagccgatacccaagaagccactgctgtgcagctcaatcaactgcttaatcaaagtcatcagggcttgattttgtatttttaccccaaagacaacacgcaaggctgttccattcaggcggtggattttagtcatcataaagccaagcttgaatcattgggattttatatccttggcgtctctcgagatggtatcaaatctcatcaaaattttatcaataaaaaagccttatcaattgatttaattagtgataccgatgaaaaactttgccaatattacgatgtcatcaaagaaaaaaagatgtatggcaaaacccatcttggcgtggtacgctctacatttgtgtacaataaaaatggcgagatgattggtagttttcgggatgtcaaagccaaagagcatgttgagaaaattttagattttcttgaaaataaaaccaattga

SEQ ID NO: 147 - DNA, 1323 bp, M.catarrhalis
gaaaccaaccgttttgcttgtattaagcacagtttgcccctattattgagctatcagcagctaaaagcgagtgccttaatgtcggacaaatcaccaaatcctcatttttcccctgagcaagtgcatgaaattactgagcaatttgccatcagtggcatgacttgccaatcgtgtgccacacgcatcgaaaaagtactaagcaaaaagtccgccattcatcaagcgacagtcaattttgcaacagaggtattgcatatctcttatgatgccaatcagaccaatcgtgatgaggtgatggcttgggtagcaaaagcaggctttgaggctgtgccaatggcggatcgccaagaccaacacaagatgccttgggatttgatgattctttggggattgtcattaccgttttgggtaggtatgcttggtatgttgtttggatcacacgcattgatgatgcctgtgtggattcagtttgtcttggcaagtgtggtgcaagttgtgttcggtgcacgcttttatttgggtgcttgggcgagcattaggggcgggcttgctaatatggatgttttggttgcacttggtacaacagcaatttgggcatattcaagctatgtatggctgaccgatctgcacgccatgcatatggtatattttgaagcatcggtgatggtcattgcatttgttaggcttggtaaatatcttgagcatcgcaccaaaacacaaagcctaaacagcttaggcttattgacgcagctgattcctacagaagtcaatcggcgtatcgatgataaatgggtcaaaaccaacattgagcatattaaagttggtgatgtgctactggctaatactggtgataagatcgccgtagacggtgtggtgcaaggcggatttggtgtctgcaatgaatctcatctgacaggtgaaagcttactcattgataagaatatcggtgatacggtgtatgcaggcagtagcgtagaagatggctcaatacactaccaagcagccgcaacaggcacaaaaactcagcttggtgatatgatgtcagcacttcaagatgcacaaggcaccaaggcagatattgccagatttgccgataaagttgcagccgtctttgtgcctgtggtggtggcattggcaatgatgagttttttggtcaattatctacttggtgcagagtttgatatcgcattaatgcgtggcgtcgctgtgcttgtgattgcttgcccttgtgcgcttggacttgcaacacctgccgcgattatggcaggcatgggcacagcagcacgccatggtgtatggtttaaaagatgcggtcagccttga

SEQ ID NO: 148 - DNA, 867 bp, M.catarrhalis
ataaatcgcagggcccttgagttgacagccagcatagagcagtacgccagccaccctttggcaaatgccttggtggaagctgctaaagataaaaatttacctttatatgaggtatctgatatccaaagcaccaccggtcaagggctgatggggtatgttgatggcatcggacaactaaaagtggggacgcccaaatttattggtctagagacatggcaggcagatgatcagtggtcggatacaagtttggttgggttagccatagatgatgagccgatggcggtctttgggctaagcgatacattaaaggcagacgcacacagcatcatcagccgcattcatcatgatgggatcaaaacttatttaatgagcggtgatcgccaatcggttgtcgatggcgtcgcaaatcagcttggcattaccgccgcgtttggacaaatgtcgccacgagataagatgtccgccattgagacattaaaaacccaaggtaagcgggttgttatggttggtgatggtgtcaatgacgcacctgcgatggcggcatcacacgccagttttgcagttggcagtgccactggcgttgctaagcataccgcatcagcacgcttgttaggcgattcactcaaccatattttttatgcttatcgtatcgcgcgcatgactttaaccaatattaagcaaaacttcttttttgcactggtttataattgtatcggtattccattagctgcaatagggctacttaatcccatgatggcggcagctgcgatggcactaagttcaatctcggtgctgttaaatgccatgcgactaaagcgtgtacagcttacaccaaacgatatgcactcagataaatccgtgggctaa

SEQ ID NO: 149 - DNA, 786 bp, M.catarrhalis
  unsure (5): Identity of nucleotide sequences at the above locations are unknown.
tttgncataggaaaatttatgacaaccatcagcgtccaagctttggttaagttttgtgacaactatcttaatgctcatgagttccaagactactgcccaaatggattacaagtcgatgcaggcagacccattgaacggatcatcactggagtaaccgcttgccaagccttaatcgatcaagcaatccaagccaaagcacaggcgatcttggtgcatcatggatatttttggaaaggtgaagatcaacccttggtgggcatgaaaggcgtgcgtgtgcgtaaacttatgcaaaatggtatttcattgattgcttatcacctaccacttgacgcccatcctgacattggcaataatcgcaccttggctgatatgcttgatttgacgattacgggcgcattgtatcccaaccaaaagcatccgattggtaatgtggcaaccacaaaccctattttggcgtccgaattttccgataaaatcaccaaagttttaggacgcacgcccttacatattgccgccaccgatggcaatcgccgactaaataaaatcgccctatgcacaggcggtgcacaagatatgattgagcaagcggcaaccatggcctgtgatgcgtttatttcaggcgaaatttctgaacgcacaacacacatggcgcgtgagcttggtgtagattattttgctgcaggtcatcatgccacagagcgtggcggtgtgatccgactcggtgaagtcatcaatcaacaattgggcattgatgcaaaatttattgatattgataatcctgcgtaa

SEQ ID NO: 150 - DNA, 1392 bp, M.catarrhalis
aatatgacaatacgcaccgaaaaagacaccatgggagagattgctgtacctgctgatgcttattggggggcacaaactgaacgcagtcgccaaaatttccgtattggcggagaaagactgccagagcctttaatccatgcgatggcaactgttaaaaaagccgccgccatgactaatgcgacacttggccgcatcactgacgaacaatcacagctaatcgttcaagcctgtgatgagattttggcaggtaagcttaatgatcaatttccgcttgtggtgtggcaaacagggtcaggcacccagtctaatatgaatattaatgaggttatcgccaatcgtgccaatgaaattgctggtaaaccaaaaggaagttatcagccgattcaccccaatgatcatgtcaatcatgcccaatcgactaacgacagctttccgacggcgattcgggtggcggctgctcaagagatgagtaataaactgttgccagccattaataatttacgccaaacattggcacaaaaatcagctgattttgatgagattatcaaaatcggacgcacgcatttacaagatgccacgccgctgactttgggtcaagagtttagtggttatgtcatgcagcttgattatgctttggagcgtattgaggcggccttaagcggtctttatcagttaccattgggcggtacagcagtcggcacagggctaaatagtcatcctgattatgctgtcaaagtcgctaaagttctggcagaattaaccaagctgaattttatcacagcacccaataaatttgaggctttggccgcacgagatgccgaagtatttgcttcaggtgcactaaaaacactggcagcaagcctaaataaaatcgccaatgatgtgcgttggctggcttcaggcccacgctgcggtctaggtgagcttagcattcctgaaaatgagcctggttcatccatcatgcctggtaaagtcaatccaactcagtgtgaggcgatgaccatggtggtcacccaagtctttggtaatgatactaccatttctatggcaggggcttctggtaattttgaattaaatgtttatatgcctgtgattggatataacttattgcagtcgattcgtctgctaacggatgcgatcaatagctttaatgagcattgtgcggtagggatcgaaccaatttacgaaaaaattgaccattatttacatcattctttgatgttggtcaccgcactcaatcgccatattggctatgaaaatgccgccaaagttgctaaaaccgcttttaaaaataatcaatctttaaaacaaactgccattcagctgaacttattaactgaagctgaatttgatgagattgtgcgtccagaacaaatggttgccccaaaataa

SEQ ID NO: 151 - DNA, 1740 bp, M.catarrhalis
ggggttatgatgaaatcaaatcaaccatttaagcttcgtgaactcatcagtacccaagtttgggtatggatcttggcttggcttctagggcttgtgactgtttggtcagtcttaggattatcgatggtgtcagggtggtttgtgaccatgtcagcagtggcaggcctagttgcggtaggtactcatacatttaattatatgataccagcggccattatacgcacctttgccattgcacgcacgctatctcgctatggtgacttgatggtatcgcatcatgctgtctttgggctgttaaaagatttgcgtgtacgattttttgccgattgggcaagtttggattttaatgcccgaaacctgcaaagacagtctagcagccaaaaaatgcatcgccttgtcaaagacattgatgttttagatgaatttgttttacgcttgatatcaccttggattatggcaatcggtgcggtgattttggtggctggtgttacgctgttgctattacccaaagcatggtttgggctagtgccgatcggcttggcgattttgattgctgcttttgtggtatatcgtggcattcatttggcgtatgacgagagtactatacttgaaactcgcaaatcaaaactgctggataccttgccagcactgacatccttgctgatttggcatcgctgggatgcgtacatacatcagctgagtgatttggatgctcagcaaaccaaaataacactgtcatcacatcgtctacgcagaatgggcatgttgggggtgcaagtggcactggcactggcggcgacacttatgctttggggtgtagggagattttttagacagacagatagtgttgcttttaccattgagacattaaatgattatccgatgatgagttcggcggtcgcactggcagtatttttaggattgatgggcttgggtgagtttatccaaaacttgattgctgagccattggctttggggcgtagtcaggtagccaagcagcgcctcaacgagatgcttgtcggccaaaacgctgctcccaaaatcaattttaatcagattaccaatcagcaggatgctttgactttatggcttaataatgccattgttagggcgccaaatgccatcatcagtgctcatattcaccatgccaagattcgctctgataagccttgcttgattataggtccttcaggtgctggtaaatccactttactgcatacacttgcccaagagcatgatttgacctcgggtgagatttggttatgtaccgacaccaaaaaatatccgtggcagtcagttgattttgaccaatcactgggatttttggggcaaacagttgatatttttgatcaaacgctggcagataatcttcgtttgggtaaaccaaacgcaaccgatgatgagcttataacagctcttaaaaaagtaaatttattaacttggctaaataatcaaccaaaaggtctggcaactcggctcggagaatatggtatggctgtgtctggtgggcaagcacggcgtatcgccttggctcgactgttgctatccccaaaagcggtcatgatgctagatgagccttttgcaggcttggatccagatacacgccacaatgtatggttgagtctaattgatgcccaaaaatctggtgatattggcttgttattaatttgcacccaccagctgtggcaacagatgggtgaggttcaggtcatcaaaatcgagggtgagggtcaagtttaa

SEQ ID NO: 152 - DNA, 1596 bp, M.catarrhalis
ggggtatttttatcagtttatttggagcgtgcgatgtcaaatcagaaaaaaattccccatgtattgatgattttggatggtattggccatcgtgaagagaccaaagataatgccgttgccgtagccaatacaccaaacttagatgctttatttgccagctatcccaatgggctgatttctggttctggtatggatgttggattgccagaaggccagtttggtaattctgaagtggggcatatgaatttgggtgctgggcgtattttatttcaagattcaacccgaattatgaatgagattgcctcaggagaattttttaataattcagcattgatagatgccattcaagccacactgaataataaaggcgtggtgcatattttagggctgttgtctgatggcggggtgcatgcacacattgatcatattaaggcggcagctaagcttgcgttatctcaaggcgctatgcaagtgtttgtgcatgcgtttttggatggccgtgatacaccaccacagtctgccaaaggctatgtgactgatattgaagattattttactcagattaatcaagaatttgaaggtaatgttaaaattgccagcatcatcggtcgattttatgccatggatcgtgataagcgttgggatcgtgtggaatcttgctaccagctattaaccgaaggcaaatcggtcagaacagcagataatgctctagatgcaatcgagcaagcatatgctgcaggggagacggatgaatttatcgctgcaactttcattgaagatgatggcgtgattggtgataatgatggcgtgatttttatgaatttccgtgctgaccgtgcacgagaaatcagcttggcttttgtggatacaaattttgatggctttaatcgtcatattgtgcctgagttatcggcatttgttatgctcaccaaatactcagatgagcttgaaaataatccaaaaaccgacattgcctatcatccaacaagtctgacaaatacgctgggcgaatatttgcaaaatttgggtaaaacccaacttagaattgccgaaaccgaaaaatacgcacatgtaacctttttctttagcggtggtcgtgaagcgctgtacaatggcgaagatcgcattttgattaatagtcctgatgttaaaacatacgacctaaaacctgaaatgagtgcttttgaggttaccgaaaaattaaatgatgcgattgactcgggcaaatatgatgtattaattgtcaattatgccaatggcgatatggtggggcattcgggggtatttgatgcggcagttaaggcagtggaagcagtggatcagtgcataggcgaggtggtcaagcatattcgtgccgctggcggccatttattaatcaccgctgatcatggtaactgtgagcagatgcaagactaccaaagtggtcaggtacacacgcagcataccacagaacttgtaccttttatctatattggcgataaaaaagcgactgtgcgtcgtggcggcaagctgtgcgatgtgtcaccaacactgttggatctgatggggttagataagccaagtcagatgactggagagagtttattggttttttga

SEQ ID NO: 153 - DNA, 675 bp, M.catarrhalis
gttatgaaagttcttcaactgtcatcctcgcttaggcatgatgagtccgagcgtggcatttatcccatctcccatgcgctcatcaaagctggtcatgagtctatcatcatcggcagtgctccaagcgatagcaagcttgttgtgcgtcttgtgcgtgatggggcaatatattaccgcctacctatgcccaaaaaaagctggtgggcattgatacacacacttaagcttcgtcaaatcattgaacagcatcagcccgatatcattcacatacattctcgtacgcctgcttgggtgttatattgggcaatgcattcctttccaaatgacaagcgccccaaaattatttcaagtttatacggattttatcctgtcaattcttattcaaaagcactgtttcatgttgatttgctgatcagtgcatctaaaagtattgataaacattttaataaaatttttgaaaaagtaaaatcagaaaaaattgataaatccatcaagttgcctgatatcatttgtgtgccgcgtggggtggatgttcgaaaatacccctatcgccatcactcatctgtgcattggctacatcaaacctttacccaatttcctgagcttgaacacaaaaaatggttggtttttccaacaccgatcggtcctgaatatggtcaagacatggctcattga

SEQ ID NO: 154 - DNA, 2679 bp, M.catarrhalis
caaggattatttatgagtgattcggtcagtccaattggcattgtcgaagaattaaagcgttcgtatttggattatgcgatgagtgtcatcgtttctcgcgcgctacctgatgtgcgtgatggacttaagcctgttcaccgccgtattttatatgccatgcatgagcttggaaatgattataataaaaaatacctcaaatcggcgcgtgtggtcggtgatgtgattggtaaatatcatccacatggcgatactgccgtctatgatgccattgtgcgtatggcacaagattttagcttgcgttatatgctggtcaatggtcaaggtaattttgggtcaatggatggtgacccgccagcagccatgcgttatacagaaatgaaaatgcagaagctaacgcataaaatgcttgccgatcttgataaagagactgtcgattgggaagataactacgacggttcgatgaaaatgccaagcgtgttgcctgctcgcattccaaatttattggtcaatggtgcaacagggattgctgttggtatggcaaccaatatggcaccacataatctcacagaagtactcaatgcctgcttagcatacgccgaagatccaaatatttcaaccgatgagctaattagccatatttcagggccggacttcccaacgggcggcattatccatggcagaagcggtatcatcgatgcttatcgtactggcaaaggtcgtttgcacattcgtggtcgctatcacattgagccaatgggcgacagcggtgcaaacaaagaccgtgagcgcattatttttacacaaattccctaccaagttaataaagccaatctgatcaagcatatcgccgatttggtcaatgccaaaaaaattgaaggcatcaccgaaatccgagatgaatcagataaagaaggtgtgcgagtggcgatcgatttacgccgtggcgaaaattgtgaggtaatggttaataatttatttaaccaaacgccacttgaaacaagctttagtattaatatggtggcattggataatggtcagcctaagcttatgacgctgcgtgacttggtggcggcgtttattcgccatcgtcaagaggtggtcacacgccgtacaatttttgagctgaataaagcattggcacgtgggcatttgcttgaaggattggccattgcacttgccaatattgatgatatcttacagaccatcaagcaatcagccaatcgcagtcaagctcgagaaaatttattggtgcgtacttggcagtcagctggtgttgtcgccatgcttgacgcagcaggtgctaaatctatccgccctgagatgattgatggcgaggatctcaaagcaccgtatggcttgattgagaataaaacccgctatcgtctgtcacctgaccaagtgaacgccattttggatatgcagttgcatcgcttgactgggcttgagcaggataaattaacgggtgagtatcaagaaattttgggtgagattgcacgcctgaccctgattttggatgattttgatgtcttaatgggtgtggtgcgtgccgaattgattgacattcgtgatgaatttggtgatgagcgtaaaaccgatattgtcgatgcgcgtcatgactttaatcgtgaagatttaatccctgaacaaacggttgttttgacggtttctcgcacaggctacgccaagactcagccgatcagtgactatcaggcccaaaagcgtgggggtaaaggacgctcagcgactgccatgaaagaagatgatgttattgagcatttgttggtaaccagtacgcatgcccatattttatgctttaccaatacaggtcgtgtctttagattgcgtggttttgaaattccgattgccagtcgtggctcaaaaggccgccctttggtaaatttgattaatcttgagtcagatgagttggtcacagcaattttgcctgtcaatgacctaaaagacgaaaatagctttgtgttctttgcaacagcatcagggacagtcaagcgtgtggctttatcacaatttgccaatctgcgtgctggaggcttacgagcgattgatctagcagaaggtgacacattaattggtgttgcgatcaccgatggcgaacaagagattatgctatttagtaatgaaggtaaagccattcgctttaaagaacagagtatccgtgccatgagccgagttgccaaaggcgttcgtggtatgcgtgtgaatctgcttgcgacaactgatgaagaagagctgttggatgaagatggcgatgaagtcggcgatgattttgcggtgagccgagtggtgtctttggtggttgcacccaaacaaggtgagatcttgtgtgcttgcgaaaatggttttggtaaacgcacgccgattgatgattatccaaccaaaggccgtggcggcaaaggcgttattgcaatcaagacctctgagcgtaacggacaattggtcaaggcgattgcagtgactggcgaggaagatgtcattttgatttcggataaaggcactttggtgcgtacgcctgtggctcagattgctaatgctggtcgcaatgctcaaggcgttaagctgattcgcattgctgatgaagaggtattggttggcatggcgtgtgttgaacatgatgacgatgaaatcgaagagtcagaggtgttagctgatatggtgcaatag

SEQ ID NO: 155 - DNA, 789 bp, M.catarrhalis
gatggtgaatttgatgcccagagggacctttttttttgccatcattgtgcctcccttgcagtcgggataaaccagatcgataccactgacttcacagggagtttgatgaggcccattgtagtggtacttctcatcctggcagcggcactcacacccatactctggagggttgaaagggctgcacccgatcccgtggtgcaggttgacctgctggccagccgtgaggtccgcattgcaaccgcaatctctgctggtaatggcctatcccaggctgcaatcgtattcatacccagatacgccttcttcgccctttcactgtcagagtccatggccagtttcagcctcctccccttcgtcaccaccatggccttctcggcccccattgtgggtgttctgctggacagggttggttcaagggtagtgatgatctcagggagccttatcctgatggttgggtgtaccatcatggccctcctctcatcaaccacccctctcttcatacttgctgaggtgctcatggccctcggactcataaccgtcataggggcacccctcaggtacataatgctatctgaaactccccccgaacacagggcatctggacaggccctgataaacatattatcaagtgcagggcagcttgttggaggtgcactcatcggtggcattgtagcgtccatgggtagtggagtaatgggttacaggttctcattcctcttccttgttgcagttgcattcacactcttcctgctatcaaccggtctcaagggaagaacaggaacagcttga

SEQ ID NO: 156 - DNA, 477 bp, M.catarrhalis
aactctccgccatgcaggccagaaaatcaaggtgaggttatctcaacaccaaaagtcttgacggctgataaacaaaccgcacgtatttcatcagggctacaaattccttatcaagaaaccacgcattcaggtgccagcacaacaaaatttaaagaagcgtctttaattttggaggcgacaccaaatatcacacctgatggtaaaattggtcttaagctaaatatcaaaaatggcaatccagtaccaacacttggtcatatcgccatccaagaagatgccatcgaaacgaatgtcatcatcgaagatggacaaaccgtcgttcttggtggtatctatcgcaccagccagaatgaaggtgcaaataaagtgcctagattgggtgatatgcctgtgcttggacgattgtttcggcatgattccaaagcgcatgataagtcggagcttttgatttttattacacccaaattggtaagatag

SEQ ID NO: 157 - DNA, 696 bp, M.catarrhalis
aggcactgcaccaacccaaagccattcggcagagacagaatcgcaataaaagatgggcaagggtatcctatgtcaaatgaatatgcaaaacagattttaaatgcacttaaggcaggcaatgatcgatatgtggaaaatctatcaagtaccaaaaaaacgccattatcaccaccaactttggttaaagagcacaaacccaatgccattattttggggtgttcagatgcgcgtgtacctgttgagctgatttttgatcaaggtttgggcgatttgtttgtgatccgggttgctggtaatgttgttgcacccagccaaattggttcaattgagtttgctgctgaaaaatttgggacacgattggtggtggtgctcggtcattcgcattgtggtgctgtgaccgcttgtgttgaagctttaatcaatccagatcaatattattcaccaaatttacaatctattgtagatcgtatccgccccagtgtgttaaacttgcatgaaattgcgacggcatcatgtgatgatgtggatatggatgaactgattgaacgctctgtgcgtgccaatgttggtatgtcagttagtcaaatcaagtatggatcgcgtattttagaagacatggtcagacagggggatttgctggttattggtgctgaatatgatgtcgccacaggcaaagtacattttttagatgactga

SEQ ID NO: 158 - DNA, 1506 bp, M.catarrhalis
acaaattttttattttgcagacccttggagaaaaccatgaccgttggcactttcaatcctaaaactcaagcaaccgccatcaaaaatccagcaacagccttacatgaaatcagggaagctgatcgtgataccgctgtgccaaaaaaagtttatatcgttacccaaggttgtcaaatgaatgaatatgacagccaaaagatgggcgatgttttgggtagtagccatggtatggtcattaccaatgatattaatgatgctgatgtgttgattatgaatacctgctcaatccgtgaaaaagcacaagaaaaagttttttctgaattgggtcgttggcgtaaattaaaagaaaaaaacccaaatcttgtcattggtgttggtggttgtgttgcctctcaagaaggtgataatatccaaaagcgtgcgccatatgtggatatggtttttggtcctcaaaccttgcatcgcctacctgagttgtatgaaagtacaacaaatcaagccaaaactgatatgggtcaaatccccaaaaatcgtatcggtgtggttgatgtctcctttccaagtattgaaaaatttgattttttgcctgagccaagagttgagggttatactgcctttgtgtctattatggagggttgctcaaaatattgctcattttgtgttgtgccttatactcgtggtgaggaattatcacgccctttggatgatgtattggctgaaattgatagcttggctgaacagggtgtgcgtgaagtcaatcttttgggtcagaatgtcaatggctatcgtggtgaaaaagatgatggcagtatttgccgattcagcgagcttctacattatgtgtcatacattgatgggattgaacgcattcgctacaccacaagccaccctttggaatttaccgatgatatcattgaagcttaccaaagtattgataagttggtatcacatctacatttaccaattcaaagtggttcaaaccaagttttagctgccatgaagcgaaaccatacggtcgatgtctacatgaatcaaattgcaaaattacgcaaaattcgtcctgatttacatttatcaagtgattttatcattggatttcctggagagacagacgaagactttttacagacgcttcaatttgcaaaagacttagattttgatcattcatacagttttatttattctaaacggcctggtacgcccgcctctgatttgcctgatgatgtcagccttgaaaccaaaaaacaacgcttggcagtttttcaagagcttattaagcgttcaacttttgagaaaacagaggccatggtcggtcagacgctgcgtgtgttggccgaagagcctgcaaatcgccgtcagggatatttacacggtacagcggataatacccgttcggtaatttttaaagcagatactgatcttttgggcaagtttgttatgattaaaatcaccaaggccatcagcatgcatttagttgaaggcgagttggttgaggtcttgggctaa

SEQ ID NO: 159 - DNA, 264 bp, M.catarrhalis
aaattatcttatcatacaatgtttggcaatttgttaccagtatttttatgtattgaccattcagataccgattacttagataaaaatttcatttattttattgaccaatataatgccagctatcttaccaatttgggtgtaataaaaatcaaaagctccgacttatcatgcgctttggaatcatgccgaaacaatcgtccaagcacaggcatatcacccaatctaggcactttatttgcaccttcattctggctggtgcgatag

SEQ ID NO: 160 - DNA, 672 bp, M.catarrhalis
  unsure (655),(656),(668),(669),(670): Identity of nucleotide sequences at the above locations are unknown.
gcaaaatttaactcatttaagctaataatgaaaacagcaaataaattgaccatcaccgcactgcttgccacaatcagcattatgcaagctgcctgtgcacaaggtcatgccaacgacggtagtatttatcaattttttgatgtcgaacgccaaaaaagtagcccaaatgccctacgccaatacgaaaaaaatatgcaaggcacactatttgggatgtatcctacctattggcggctaaattataacctatctggtcaatcacccgaggcagtcaatcagtttgtccatcaatatccaagcactgtcatgagtgaaaaactcgccgctgactatgctgagattaaggctcgccaaggtgactatgcgtctgtgcgtgccgtagcagacagcattgaaaaccctgatgaatctgaagcttgtgcgattgccttaggatttaaccaaagtcgtgattcactgcgagctttataccaaaaacccaatgtatggctaaatactcaaatccgccaatctttatgtcataaactggccaccgaaatggtttataacccacgcatcaccaacatcgataaacatgaacaacttttgcgtatgctacgcattgataaacggcaagtatgcaccgccagttacaaaagccgtctgtataaaaccnncccccggccggnnncc

SEQ ID NO: 161 - DNA, 702 bp, M.catarrhalis
aaacttatcaagcaaacaaacgcccaaaaccagttgctcagcaggtgcctgatgttcaatgaatattatcggtggggcattttgggtgcttggatttgggttgggattggatgtgctgatagcaccagtcaagttgttgatgataagcttgcacatattacccatgaagagcgtatggcgatcagtgagcctgtgccgatacccttatctgtgccgatgatatatcagcaaggcaaagatccttttatcaatccttatagaaatgttgaggttcttgataccaatcatgccgctgatcagcaagatgagccaaaaaccgaatctaccaaagcttggcctatggcagacactatgccatctcagccatctgatactcatcagtctgccaaggctcaggcacaagtcttcaaaggcgatccgatagtcattgataccaaccgtgttcgagagcctttagaaagctatgagttatcaagcctacgctatcatggtcgtatttttgatgatattagacttgtggcactcattatgagtcctgatggtatcgttcatcgtgtgagtactggacaatatcttggtaaaaatcacggaaaaattacccatattgacagtcgtacgatacatctgattgaagcggtcgctgatacacaaggtggctattatcgccgtgatgtaaacattcattttattcataagcaatga

SEQ ID NO: 162 - DNA, 984 bp, M.catarrhalis
cacatggacaaaaaatttttaaaaaatagcttggtaatcgccgtgatgctcggtgtggttcatatggaggtacgtgctgatactcatatcgatcatgtgtctgttacccaaacagcagagcaacattatacaggcaagcctattagccttgagtttgccgatattcctgtacgagcggtttttgatattttagcaggttttacaggtattaatatcatcactgatgatagtgtgacaggcagtatgaccattcgcttgatgaatatcccttgggatcaagcatttgatgtgattttgcaaacacaaaatttatcagtattaaagcatggtaatgtatggctgatcagctcaaaatctatccaatccaatcagccgacaataaccgaatacattcgtctaaactatgcacttgccgatgatgtggcaacactcatcatgggcgaaaaaacccagcgtggtaatgtcaatcgaaccaatcaccgtgatgttatttatcctgaagcaccattatcacgggcctataatacccagactgatgaacttattaccaccgctgtgcgtgggacattactgtctgagcgtggcacagtgacggtggataagcgtaccaatactttaattatccaagatgtgcctgcaagcgttgccaatatcaaggcactgattgagcgtattgatatccctgttgaacaagtgatgattgaagctagaattgtttctgcgaatgaaaattttgggcgaaagcttggcgtaagttttggggcgcatggtcaaaatggtaaagtgcattatggcggctctcagggaagtttatgggcgatgcggcaagagggtgtggcggcaggtggtcatcaaaacagtcatctgaatgttgatttgggcgtagataacgccatgggacgcattgcttttgggctgttaaatttacctgatatcattttagatttagaactctccgccatgcaggccagaaaatcaaggtga

SEQ ID NO: 163 - DNA, 1938 bp, M.catarrhalis
ttgaaggcgagttggttgaggtcttgggctaatttgatagatacaggcacggagtgggatgtgagattaaataagctgcgtgcttggttaagagggcagtctgatacgccaaccattggtatatactttggagaaaaggcggcaacagcagtttggctagatgagcatgatggacgctatcactggttgggttcggcatgtgtgttttataccgatgtggtggtttctggcaaaattgttgataaagaaaaacttgcccagacgctaagacagatgatgcaaacgcttgggttaagtcaggcaaatgccatcacttgtgtacctgatgatgcagtcatgcagacgctcatcgatctgccagctgatttatcagatgaggatatcgaagcacaaatcttagttgatgctgagcgttatattgggcgtaatatccaagatgtttattttgattttcaagtacttgagcgatcatcagtagcaactcaaatcactctgacagtggcacaccaaaatagtatccatgactgctgtgaagtacttgccatggtgggaatagaggctgtagcagttgatgtccatacatcttgcttggcacgcatgatggctaaaatgacagcacaagtcagtgctttggtggagattaccgatcacgatattggcggttatatcactcatcatggcgtattgctatatcagcaaaatgagccaatacatacattgacaaattttggcaatcagccattggatgagcaatcagaacttgatcagttttctcaatttacccatgatgttgatacgcctaaaaattggcccaatcagtcacccttaacgatgaattttggcgatttgacagatcgattgtccaagacgaatgcatcaatccaaaatgactttgtacagcctttgcaagacaattttatccaaaaaacaccagatattgcgataaaagctcaaactggcgactaccatatccgctttgatgattgggtggatgacatggcagccgatgaactttcatttggcgaagcgtcggcaaatacgccacatatcaaatcatctgatcggtctgaattggaagttgatcagatggccacaaaaatcttatcactgatcaagaattgtcaggcacaaactgttttaccgattgagcggctatacatcagcggcacaacatggacaaaagcatcacagttggcagaggctttacaggcaaagcttgatattttgtgtctgcccatgcatcctaaatacgcggtcaatcatgccatcgaagataatgatatggagcaagcacccatgttaacagcagcagcggcactggctttgacaagatctgaggggattaatcttttgccatggcgtgaagagcgtcgcagtcaagctgatgctaagtttcgtcaaatatttgtgtcggtggtggggcttgctgttttggtgatgatgctgatttttggtgcaatttattatcggctcaatcaacaacaagcaatcaatgatgagattaaaacacgcatcagcaccttggacgataagatccatcaaatgcagcagctcaaagaacagctagatactgcccaaaaacacagtgaggcgttaaatgctttatcagaagatcgacaagttgcgtatcgctggcaacaattatcaaacctaatacctgagggtgtgtatctagacgaaatgagtcaggcggcagatatgcttagcttgacaggaaaggcggtatcgacacaatccgtgtctgcatttgcccatcggcttgagttgtctgggctgtatactgatgtacttgtggtgtctttgcaacaagcagatcaagcgatgagttttacgctcactgccactcagctgccacttgatgccaaagatatgatacagccagcgaacataacaaatcacgatgaaaatactgatgtgaacgagcgtggtaatgaataa

SEQ ID NO: 164 - DNA, 552 bp, M.catarrhalis
caaaaggagagtatgatgagtattcaacaacccaaaaatgctttggctgcagaaggtgttaaagacattcctgtgcagtcagagggttatattcttaatcacaccatgctaagaatcaaagacccagttcgatctttggaattttatactggcatacttggtatgactttgctaaagcacagtcgttttgctgacagtgagtttgatttgtactttttggcccgattaaccgaagatgaacgagcaaatctacctgctggtgatgagctgaaagattttgtatcacgccaacgcagtattttggagttgacccataattaccgtaccgaaaatcatgcagattttagctatcatgatggcaatagtgaaccacgaggctttggtcatatctgttttagcgtaccaagtttaaaagaagctggcgcttggtttgatgaaaatggggtacaatttaaaaagctttctgaagagggtacgatgaaagacatactctttatcatagacccacatggatattggattgaaattattgagagttataatcatctctga

SEQ ID NO: 165 - DNA, 1128 bp, M.catarrhalis
ggaaaattcatgacccaagcaccacttattgtcaaaacccaacgccatgattatcccatttttatccgagcaagtgatgatcaaattgacttggttagccaaattatcccatttatcaccgccaaacaagtccttattgtgaccaatgatgtggttgcgcctttatatttggcacaaatgcaagaaaggctattatctgctggatttcatgttgaggtatgcgtactgcctgatggcgagatttataaaaatcaagacagtattaatgcaatctatgatgtgctacttggggtgcattttgcacgagattgcacattgattgcactgggcggtggtgtgattggtgatatgacaggatttgcagctgcaagttttatgcgtggggtaaattttatccaagtacctaccacgctgcttgcccaagtggattcaagtgttggtggcaaaacgggcattaatcatccatgtggcaaaaatatgattggcgcattttggcagcccagctgtgttttggcagatatgacgacatttcaaacgctgcctgagcgtgaatttgcagcaggcatggcagaggtcatcaaatatgcactgattatggatgatgattttttgatttggctggaagaacatgccgatcaaatcaatgccaaagataggcatttacttgcagagatggtttatcgctgctgtgattttaaggctcaaattgtcgctgctgatgagcgtgaatctggcaagcgtgcgttgttaaattttggtcatacctttggtcatgtcattgagacacatcaaggatatggcaaatggttacatggcgaggcggtggcagctggcatggtgcaagctgcccaaatgtcgtacagattaggtctaattcgtgcttgtgatgtcgagcgtattgaaaatatcattaaaaaatatcatctgccgaccaagcctcctaagatagatgtcgcacaagcgctggatctgatggggcatgacaaaaaggttaaacaaggtcaaatccgcttggtgctactgcgtcgtatcggtgatgcgtttgtaacagcggattttgagttatcagacttagaagctgtgctggcagggcaaataacgaccgcaagtcttttagttgatgaatga

SEQ ID NO: 166 - DNA, 957 bp, M.catarrhalis
gtgggtaaaattatgtcaaaaattcccatggtgaatgaaaagtattttcgtcgtcaggcactttattggttgattgcggcggctatcatggcaggcttgtggttgattgtttggttgaccagctccgtaccagcaatgattaataaacaaaacgccaatcaaacatcgtcctatgttgcgacattgccgaccacaatcacagcgttaaatgagcttgatcatgttgttaagcccatggataattcggcacttgtgcgagacttacgcaactatccacctgaatttaaggacaaagtttattttaatggtattagtggtcgttataccattgagctgatggatgttaccgaaaatgaagttatcgtggattatctaaacagccgagaagatcgtaacaattttgcttattttcgctatactgatgccaatgataataagcgatatgtactgacttatggtaaatttaccagtccagctgatgcagaatctgctttgcaaaccgtaaattttagactgccaaaatcagtgacacaaaagaccaccaaaatctctgagttggtcgcagtaatggacaattatgaattgggtcaagatgtggtggatttggcagacttccagcctcgccgagttcgcctgcaagcgacgcgtaccgaaattccagtcaaagcggccacgccagcagatgaagaattggcacgcctaagccgtgagcgtgcattacaaacacaaatttcccagcaaactgagtcggtcaggcagccgactgatttggatatccaaaacgatatcaatcgtttgtctaatcaaagatctcaagtcagctctagcgatttgcctatggcaccaactgcacgcccacagtcaccgcagcaaacagccgatatagtacccaaaaatgaaatatctaaaggcactgcaccaacccaaagccattcggcagagacagaatcgcaataa

SEQ ID NO: 167 - DNA, 696 bp, M.catarrhalis
gtcaagttggtgcataaatacccatcatggcgaatatattatattaattggaaaatcacaatgcttgatgacgattcggctttcattgaagaggtgatggtcgaaaaagcaggtaatgccttatcaaaacaactacctgcgatttttttggtgggacctatgggtgcaggcaaaacaacgataggaaagctgcttgccaaacatttggggcgtaatttcattgattgcgattggtatatcgttgatcaaacgggtgctgatatcccatggatttttgaaaaagaaggtgaggaaggctttcgagatcgtgaaacacgcgcactacaagagctgaccgcactgcctaatattatcatggcaacaggtggtggggcggttggacgcaccaaaaatcgagaactgcttaaaaaaggcttggtgatttatttagatgccagtgtcgatacacagctggctcgtaccaaaaaggataaaaaccgcccactgctacaggcacaaaatccacgagcagtacttgagtctttgtacaaaaagcgtcatccgctgtatcgtgaagtagcagatatcatcatattgactggacgagcatatcccaagcaaatgatcggagagattttagaagtgcttgaaaattatgctttggatcatgcacccaataaattaaaaaccgatcaacacgctaaggaaaattcatga

SEQ ID NO: 168 - DNA, 651 bp, M.catarrhalis
acgagcgtggtaatgaataattttgtgtatcagctacaaagtttttggtatgagcttaatcaggtcaatcgtcataccattgctcaatcacccaaatatatacagctgacggtacttggtttgatcgtgatgatcattggcatttttggctggctacttgcgattttaccaaccattcaaaagcttaatgcagcccaaagtcaagaatctgccttaattgatgaatttgccactaaatatcataaagcccagcagtttgaccatctaagccatcaggtcatacaaaaaaatacacaacttgaaaatcagctcaatgctctgccacgcacagcaccgatgagcgagattgtcggaatgataaataccaaagcacaagcggttaatgtgcaggtggtgagtgcatcagttcaagcaggtcgtgaacaggattattataccgaacgccctatcgcagtgagtgcgacaggggattatcatgctttgggtcgatggttacttgagttgtcagaggctaaccatttgctgacagtgcatgattttgatctgaaggctggtttgaaccatcagctgatgatgattgttcagatgaaaacttatcaagcaaacaaacgcccaaaaccagttgctcagcaggtgcctgatgttcaatga

SEQ ID NO: 169 - DNA, 900 bp, M.catarrhalis
agttttagtaatttttgtcaaaataaaaccatgatttctacaaaaaaaatttatcacgctgactcatctgatgattttcaagattggcaagccgagctatcagcagcggtcagcgatttggatactttatttacgctgcttgatttaccaaaacaggctcattcacatacgcccaagcagtttggtttacgagtaccgcacgcctttatcaaaaaaatgaaaaaaggcgatattcatgacccgctcttacgccaagtacttcccgatggacgagaaaggatgaccgttgatggctatagtaccgatcctttggatgaaaataatcacaaccccatcaaaggtttattgcataaatatcaatctcgtgtcctgctgaccgtgacgggtgcatgtgcggtacattgtcgctactgttttcgccagcattttgattatcatgccaatcaaccaagcacgcatgaaatggatgaagtgatggattacatcaccaagcacacagaagttaatgaggtaatcttaagcggtggcgatcctttgagcctaaacaacaagcgacttaagctttggttggataagattactgccattggtcacattcgtacggtgcgacttcacactcgcctgcctgtggtattacctaaccgtgtggatcatgagctcattgcactgattcgtcattatcaaaaaaatatcgtgattgtgctgcacatcaatcaccccaatgaaattgatgatcaattgatcgctaaaaccaaacagctcaaagatgcaggtgcaactttattaaatcaaagtgtgctacttgccagcatcaatgatgacattcagactttaagtaagcttaatcaagatctgtttggtgctggaatcctaccctactatctgcaccaacaggtcttt

SEQ ID NO: 170 - DNA, 612 bp, M.catarrhalis
ataatggcaagtttttctacaaatgattttaaagcaggcttgaaagtgatgttggatgggaatccatgttccatccttgaaaatgaatatgtgaaaccaggtaaaggtcaagcttttaaccgtgttaagttgcgtaatctacgcacaggcaaagtgcttgagcagacttttaagtcaggcgattcacttgaaggtgctgatgtggtggatgtggaaatgaactatctatacaacgatggcgaattttggcattttatgcaccctgagacttttgagcaattgcaagcagataaaaccgcaatgggtgatgctgcacagtggctaaaagaaaattcaaatgcgttatgcactttgacgctatttaatggtgcgccgctgtcggtcacaccaccaaactttgtagagcttgaaatcgttgaaactgacccaggtgttcgcggtgatacctcaggtggtggcggtaagcctgcacgccttgaaacaggtgcaaccgtgcgtgtccccttgtttgttcagcaaaatgaagtggtgcgtgtagatacgcgtcatggcgaatatcgaacacagtggacgcttgataatgagcccaaatggccgaaggatccgcggaag

SEQ ID NO: 171 - DNA, 234 bp, M.catarrhalis
  unsure (102),(107),(108),(131),(137),(140),(144): Identity of nucleotide sequences at the above locations are unknown.
tgcgtggggcgccctaaggtaaatgaccgctacaacaacacttatcgtatgcatccggcattgtatcaaggctattatgcgaatcgtaccatgcttgcgatnaatannacgcgccgcggtcccgccgccgnaataanagnttcntacgctcagccaatcacacaaagggcaccaagcaatcctgtgattaatcgtgacgcatctgcacatatttatttttcaaacaatgaataa

SEQ ID NO: 172 - DNA, 1740 bp, M.catarrhalis
ctgattttaaggttcatcacatcaaaagcgtcttatcaatcaacaatccaacaaggagcttttatgacaaagccacgcttacgatcacatatctttgccatcagttttggtatatttgctagcctaactatgctctctgcttgcggtaaacccagcaaaattcatacaccatccataacgcaccaaaatatgttacctagcaacaccttggcacaattatccgccctgccccagcttacccaaggtttgggcgacacaggcaaaagcgtcattgacccaaataagccaactttggtgaagttttgggcaagctggtgccctttgtgtttagccaccttacaagaaacgcatgattggcgtgatgaccctaatttggcaggctttaacatcattaccgttgccagccccactcacttaaacgaaaaaaatacccaagattttaccgactggtatcaagtgctacaagcagattatccaaatctgcccgtgctcattgacagtagcggccaactcattaaagaacttggtgtacaggtctaccccagctgggcaatcttggacaaaaatgggcaacttgtgtatcttaataaaggcaatcttagctttgagcaagtgtcttatttggcaaaaaatccacaagagctagaccagcttaaaacccaaggtggtcagaccgccatgcccactaaaaataaagatggtgtatattataacgatcaaggccagcctttaaataccaaaaccatccatctggcgggcggctgtttttggggtgtagaagcttactttgagcgtatcgatggcgtggtagatgctgtcagtggttatgccaatggcaatgaaacaatcgccaatccaagctatgagcaagtcattgcaggctcaggacacgccgagaccgtcaaagtggtttatgatgccgataaggtggatttggacactctattacaatattattttaggattgttgacccaaccagcgtcaataaacaaggtcatgaccgtggcatacagtatcgcacaggcgtttattataccgatccaagcgacaaagcgattattgagaatgctttaaatgaattacaacaaaaatataaagcacccatcgtcgtcgaaaatctacctctaaggcatttttcccctgctgaagagtatcaccaagattatctcaccaaaaacccaaatggctactgtcatgtggatctaagtcttgccaatgataaaatcacgagtaaagctcccaccctaccaaaggcaagcaccgttcaagaggcccttgacccaagacgctaccaagcttttactaaagataatttaaaacaaagcttaaccaaggctcaatatgatatcacccaaaacgcaggcacggagcgggcatttagccatgcctacgaccatctgtttgatgatgggctgtatgtagacattgtcagcggtgagccactgtttttatctaccgataaatacaactcaggctgtggctggccaagctttaccaagccgattgatccacaagtcatcagcgagcataccgacacaagctataatatgatacgcaccgaggtacgctcacgcattgccaattcacatttggggcatgtgttccctgatggtccaaaggcacggggcggactgcgttactgcatcaatggcgatgcattaaaattcatccccaaagcggacatggaaaaacaaggctacggggcgttattgccactcattaagcctgcccaaccttaa

SEQ ID NO: 173 - DNA, 927 bp, M.catarrhalis
tttataaaaggaaattcacagatgatgcgaattggtttattcttattaaccaacttagccgtattgattgtctttagtatcgtatttatggtactctcacaagtctttggtctgggcaatgtccatgcttcaggcgggctaaactatgtcagcttggcggtgatgtgtttgttatacggtatgattggctcagtcatttcgttgtttttgtccaagtggatggctaaaaaatcaacaggtaccgtggtgattgataccccaaaaaatggtacagagcaatggttggtggatatggttgcccgtcaagcgcgtgaagttggcattggtatgcctgaggtgggtatttttgataatgcccagcccaacgcatttgctactggctggaataaaaataaggcattagttgcagtatcgacagggctgatccatacgatgacacctgatgaagtcgaagcggtgcttgcacacgaaattggccatgttgccaatggtgatatggtgactttggcactgattcaaggtgtggtcaatgcctttgtgatgttctttgcgcgtatcattggtaattttgtggatcgtgcgatctttaaaaatgaaagcagctcacctggcattgcctattttgtcaccagcatggtgatggatattttgcttgggattttggcatctgcgattgtcatgtggttttctagattgcgtgaatatcgtgctgatgaaatgggtgcgcgtttggctggtcgtgataagatgatcagtgcactcaatgccttgcgtcctgctgaggcacgcccagatcagatgcctgaagcaatgaaagcatttgcgattgcaagtggtcaatctcaaggttttagcattgccagcttatttcgctcacaccccactttagatgatcgtatcgcttcattgcaaaaatttcatggttaa

SEQ ID NO: 174 - DNA, 900 bp, M.catarrhalis
gtgtattttatgtcttattctatgaccaaatccattcgccaccgtaataaagtcatgacttttgatgtgccaaaggtgatgggcgtacttaatatgacaccagattcattttcagatggggggcgttttaaccatttggatgctgctttggttcacgccgagcagatgatcgcctatggtgttgatatcattgatattggtggagaatccacacgcccctatgccccaaaggttagtactgatgaagagcttgagcgtgtgatacccatcatcgccgctattcgtgaaaattttggtgaagatttgtggctgtctgtggataccagtgaccctgcggtgatgcttcaggcaattggtgcaggtgccgacattgtcaatgatgtgcgtggtctaagccgagagggcgcttgtgatatggtggctgatcttgagtgtcctgtggtcatcatgcacagccgtggtacgcctgataccatgactcagacgatgaatgagttgacaagttataacgatgtgcttgctgagattagcactgagcttcaaataagaattgataaggcgatggacgcaggcatggggcaagaaaaaattatcattgatattggtatgggattttcaaaaaattatgaacatcacattcaaattatgcaaaatttacagcaaatcattcagcattttcagatgcctatgttgtttggtgtatcccgcaagcgatttttgggtgaggttttaaccaatagcgaacttgaatatcttaaaaatcatcaaccgattgagagagataatttggggacgcttgcacattttatcgcactacagcaaggcgtgcatattgtgcgtgtacatgatgttaagccgatggcacaagccgtgcgactgtggcaggcgttatacggctaa

SEQ ID NO: 175 - DNA, 321 bp, M.catarrhalis
  unsure (76),(80),(83),(89),(112),(113),(118),(228),(236),(241),(263),(264),(266): Identity of nucleotide sequences at the above locations are unknown.
aaaataaatatgtgcagatgcgtcacgattaatcacaggattgcttggtgccctttgtgtgattggctgagcgtangaanctnttattncggcggcgggaccgcggcgcgtnntattnatcgcaagcatggtacgattcgcataatagccttgatacaatgccggatgcatacgataagtgttgttgtagcggtcatttaccttagggcgccccacgcactaagaagnaaatggangaatnccggcggggggggcgaaattannanggcctgcattataagcggcaatcacatgatttggattgctaaattggtgttgtaa

SEQ ID NO: 176 - DNA, 348 bp, M.catarrhalis
  unsure (4),(5),(6),(7),(8),(9),(10),(11),(12),(14),(15),(16),(18),(19),(21),(22),(23),(25),(26),(27),(30),(31),(44),(45),(48),(55),(57),(68),(69),(75),(302),(304),(305),(327),(332),(340): Identity of nucleotide sequences at the above locations are unknown.
aaannnnnnnnnannnanngnnnannnggnnggagggggagggnnggnggagagnanagggagggggnnacccgncccccgaagccggtcatccattccgaatcaagctttaacccaattgtgcgttcaggcatgggtgcaatgggtctaatgcagctgaagccgggtccggctcgtaatatgggtgtgtataatgcatgggatcctgcccaaaacattaagggtggtaccaaatatttggcgtatttacaacaccaatttagcaatccaaatcatgtgattgccgcttataatgcaggccntnntaatttcgccccccccgccggnattcntccatttncttcttag

SEQ ID NO: 177 - DNA, 1419 bp, M.catarrhalis
ggattcgtattgcaatattttgacagacacgaaggcggagaaaatgccattttggttcacttagacattcatcaaatcaccgatcctgatgacctagaagaatttcgcttgttagtacattcagcaggtgcaaacgaaatagaaatcatcacaggcagtcgcagtaagccacatgccaaatactttgttggtacaggcaaagccgaagaaatcgctgaagcagtcaagcgttttcgtgataccaatgacgataatacagatgatgttattgtgatttttaatcacacactcacgccaagtcaggagcgaaacttagaatcattgatcaaatgccgtgtgcttgaccgcacggggctgattttggatatctttgcacagcgtgcacgcacgcatgaaggtaagttacaagttgagcttgcacagctcaatcaccttgccacacgccttgtgcgtggctggacgcatctagaacgccaaaaaggtggtattggcctgcgtggtcctggtgaaactcagttagaaacggatcgccgattgctccagattcgggtgacacagctcaaagccaagcttgataaggtcaaacaaacccgtaaacaaggtcgtgctaaacgccaaaaatcagacattccaaccatatcattggtcggctataccaatgcaggcaaatcaacgctatttaaccgcttaactgacgataatatctatgctgccgatcaactttttgcgacccttgacccaacactacggcgtgtcaaatggccaggtgtcggtaatgtggtactggcagatacggtaggatttgtacgccatttgccacatgagctggtagaaagctttcatgcgacactagaggagacgcttgaggcggatttgttgctgcatgtgattgatgccgccagcgaggatatgcacgctcaaatcgaggcggtcaatgatgtgcttgagcaaatacaggcagatgcgccgattttattggtatttaataagattgacaaaagtggtgaacctgccaaaatacattatcaagaccatggcgtgccacatcgggtctatgtgtctgccaaagaaaatttgggcataaaccagctgatgttagcagtccaagaacttttatcaggacagctaaaccattatacgctgaccttacctcaccatgcaggcgccctaaaaaataccttgcatgagcttggcgtcattgagtcagaaagctttgatgaattgggccatcaaatcctaagcgtacagctttcgcctgctaagctgactcagctccttggtcaatatgcactcaatcccaaacaagtgctaccaccaaacgaagctgcaagcttagagcctgcacttgagccatttgaagaagtgcttaagcaacatgatgataagtcagacgatcagcttaatcccttttgtttataa

SEQ ID NO: 178 - DNA, 768 bp, M.catarrhalis
tttaagtcatttaaccggtcaaatatgccaagattttttgttgatacaccgctcaccaccaacctgattggacaaatcatcgccctgcctgatcatgtcacacatcattggtgcaaggtgctgcgcgcttcggttggtgattgtgcctttttatttgatgggatgggcggtgagtacacagtaacgctgacacatattcataaaaaatctgccagcgtcaagattgacgcctatcaccccatcaaccgtacgccaccgtttcgtgccagtatcggcttggtgatgagccgtggtgatcgtatggattatgccatacaaaaagccaccgaaatgggcgttcattgtattcatctattgaccagcgaccgttgccaagcccacctcaaatacgacagagattttaagaaactcacacattggcaaagtgttgccgtcgctgcttgtgagcagtgcggtatgaatatcattccaaacattatcgcacccatcttacttgatgaatgggtggccaattgtcaagatgaactgaaactggtacttgcacttagtgaaaataaccctacttttaacaaacttgtaccaaaaaatatcagcctgttgatcggtgccgaaggcggcttaagcccaagagagattgatttggcgattcatcatggttttgtgccatggcggattggcgagcgtgtgcttcgtacagaaactgcgcccgtggtcgccttgagtgcattgacacttttggccgaacttaaccactcaccacttaattag

SEQ ID NO: 179 - DNA, 1944 bp, M.catarrhalis
cataatttatcatatcaaaaacagttcaaaaacagtctattgctgggattaagctgtgctacaataagccgtattattgagattttggaagatagtttgaagcataccaccaaatttagcgccatatctttgggcatctttatactgccatttgtgatgagtttgccatcttatgctgccaatgtcatcactgataccactcaaatcaagccaaacgctgttagcagacaagatggcttcgttgatacaaaagtcgatcagatgataaatccttatgggctaagtgataaagccttacaaagtatcagtcaatcggcagcgtggcggcgactgttattatttcaagatacgcctgttgagcatgataacagcagtattgataaccctaaattttttttggcacaaaatgggcgtcatgatgcccatgctgaacttatcgccacattatccgccatgcaaagcggtgatggtgacgccgtatgccgctttgttgcacggacgcattttttaacccaagcgttggcaactcaagatattgatagcggtgttgatgataggcagtgcagcgattttcatgcctttgccgatacactcaatgccaagcgtttgtcgctgatttttgccgaagaacatcccaataatattgcttctgcttttgcgcatgtgctgatgcgtgtcgatgatggacaagatgaagatgaagccgccacggcgattaattacactgtacagcccaacaaagctgatggcgtcctcgtctcaacagccaaatccatcatcggaggttatccgggtgtgatggaaattatgccttatcaaaaaaaggcagatgactatttggtcaaagacgaacgagatttgtggcaatttagtctgaatttaacacccaaagaagtgacgcagattgtccgtcatatttgggaggttaaagagatgaagcgtccgtatttttttacacatgataattgtgcgaccgaaattgtcagattaattgatgtggttcgtcccgaagggaatatacaagctgatatcggtaatattgccattccctcacgcattgcagcgattttaagtcaggcgggtatggtgacagaccaaaaatttatcccctcaaactcaaccattaggcaagctaagcttaataatggcgagaattttgatattgcccatcttgccccaaatcgcaatagccctgtacatgcaatgcctgtgcatcggtttggttttggtataggtctggatactcggcttagtgatcgtgcagtttatggcattcaattaaatggtgcctatcaagatttactggataatcctcaaggtgttaggtctttgttggatttacaagtgatgtcagccaaactgattactgatggcagtacgcttaggcttgaagacttaacgattttttcaactcgtagcctaaatcctgccaatactgccaaaaataatgcaaccgttaaaaaaggtgtgggcttggcaatggcatttcatacaggtttgacacgaacgattgatgcatccaataaagccaatcatcatcatttggtgttggatatggatataaaggcaggcaaatcatggaattttgggcaggttcgccaaaatagcggcgagcttgcgaatacgacttgttatacattggtaggtggcggtacacagatagggcgggttaatcaaggctatcgtttgagagctggtactgatattggctgcattcattatgctaacgagaatttgcgtggtttaatgcagttatcattgccttattattaccattttgataatgcaccaagtgaccgctcgggttattttcagcctgccttgagtattggcatacaagcagatatcgcaccttatcatgccgtgcgtctgactgcccagcgtgaaaaactaaacagcgattatgcaactcaagcgatgttatcagtacaaaggtatttttaa

SEQ ID NO: 180 - DNA, 549 bp, M.catarrhalis
gcaaattcatcgttaggatttatctcaatgaccaaagcactttatccctatacgctaaagcccatcgctttaaacatgagcgaaactgaattttacgcagcacagttatcattgtttgaaaaaggcacaagtcattttacactaaagtccttaaaacgcacagagtggattgtgattgccctgatggttgtggcggcgattgcaggcttggtatttgtcagtggctattcgacaatcattttttggcttatgctgattttggttggtgtgtatctgcttgctcgtaccttgggtatgaaatggtatatgaagcgtgaatatgaaaaacaagtggcaagtacccaaatgcctgaacagcttcgcactctgcaattaggtgtacaatcacacgggcttgttatggcgatgcctacatccaccgatctgatgaaatcaccacaaatgcgaggtatgcaaatgcgtgcaggtgcaacgcagtcagcaaccataccttggcatacagtgagtagctgggatgagacagatgactatttattcatgatggtttga

SEQ ID NO: 181 - DNA, 1338 bp, M.catarrhalis
attttattgttcatcattttagcacgccaagcgccgtttggggcgtttttgtgcttgataggatttgatatgttagaccctaaatttttgcgtggtaacctagaagagctaaaagccaagcttgcggtgcgtggttatgatttggatgtggcattttggcaggaagttgaaaatcagcgtaaatctatccaagtaaagactgaagcattacaagccaaaaaaaatgcaggtgccaaaaaggtcggtgagctcaaacgacatggtgaagacacaagtgagctgatgaaccaaatgcaattggtcagtgaagccatgaaggctgccgaaaatgagctaaaagaactacaaaacaccatcacaaccgccgcactacaaatcccaaatctgcccgatgatagtgtgcctgtgggcagtgatgaaactgataatgttgaagtgcgtcgctggggcgtgcctcgtgagtttgattttgcaatcaaagaccacaccgatattggtgaaagcttaggtcagcttgattttgagttggcagctaaattgacaggtgctcgttttagtgttttaaaaggtcatcttgctaagctcaatcgtgcgttggtgcaatttatgcttgacacgcatacccaaaaatatggctataccgagatgtatgtaccttatatggttaattctgatagtttacaaggtacaggacagttgcctaaatttgaagaagatttgtttaagcttcgtggcgaaaaagaatattatttaattccaacatcagaagtgccactgaccaacagtgttcgtgataccattcttagccctaaggatttgcccatcaaactgaccgcacatacgccatgttttcgtagtgaggcaggcagtgcagggcgtgatacacgagggctgattcgtcagcatcagtttgaaaaagttgaaatggtgcaagtaacacgggctgatagctcaatgcaggcattagaggatatgactgcacaggcagaatatgtcttgcaagcgcttgagctgccatatcgtgttatgacactttgtacaggcgatatgggctttagtgccgttaaaacttacgatattgaggtttggttgccatctcaaaatatgtatcgtgaaatctcaagttgctcaaattgtggcgattttcaggcacggcgtatgagtgctcgcctaaaagatggcaaacacagtgaattggtgcatacgctaaatggttcgggtttggcagttggacgcactttgttggcaattttagaaaatcaccaaaatgctgatggtacgatcacgattcccaaagctttacagccttatatgggtggacttgaagtgattgcctaa

SEQ ID NO: 182 - DNA, 201 bp, M.catarrhalis
caaattttcccccaaaacttaagccaatttcaaatcaaagcagttaaaaatcaaaaaattttgacaaatattaactttgggtttatttttttggataaaatgggtaatataggcaaattcatcgttaggatttatctcaatgaccaaagcactttatccctatacgctaaagcccatcgctttaaacatgagcgaaactga

SEQ ID NO: 183 - DNA, 246 bp, M.catarrhalis
cagcatttgccaatgtgcctgacctgtacgatgtgtaaacgcagctgggacagtgatgatgtccgcccccatttgtctgagccgctgagcaaaggcagggaatctgacatcaaagcaaatcatcatgccaacattgatcgtctgcccatgaatgacgcacggctcacagaccaatcggctgccatgctcaaatgtcttaccttcatcatagttgcctgtgctgtcatcaatagttgcacgaaatag

SEQ ID NO: 184 - DNA, 237 bp, M.catarrhalis
gtatcgaagttgtgcaagccgttggtggtggctgatacacgctgtattgataccaaatttaatcttcgacaatctaaagtacccaaaaaaatacccaatgatgatcaaatgcctgttagtgatcgtcattgggtattgttactatcgcacagcctacccaattttgcaagtatttttgtgatgatcttgtacaaagccatctcatattaccttgacaatccaaacaaatatcgataa

SEQ ID NO: 185 - DNA, 447 bp, M.catarrhalis
ttaaaaattacttcgtatttctcttgccgttattttacttattcaagtgaatggataatttgggcaagaaaatattctaagataccacattattttaactatgatttgatgaaaaaattaaatggtgataaacaagccaaagatgtttggcgattgcctgcggtgggtagctgggaaaagacacagggcaaacaccctactcaaaaaccacttgggcttttatctcgtattatattatcatctacccaaaaaggcgatttgattttagatccattctcaggttctggtacaacaggcattgcagcaaccattttgggtaggcaatttatcggcattgataaagaattggaatttttagaattatcaaaaaggcgttatcaagcaattacacccaaatcaaaatatgaatttaaacaaaaaattcgtgagcagattagtttggtgtaa

SEQ ID NO: 186 - DNA, 444 bp, M.catarrhalis
agtctatggttcaaccgctttaatgccactaaaaccttaatgctaataaatatgccaccgccccatcatgtttatgtcaattttatttcggtgacacagatgctaaatcatatatttgacacgctcacagcagaagataaaagtacgcttaacgctcatttgaccagcaaactagaagcattaaaccttcctttaaatatcgtagaggtgttttatgatgccagaaatctgccttgtccgatgcccttattaaaagccaaagtgacactgcgtcatgtcaccgataatcaagcgctgtatttaatcgctactgaccaaaactcgcaaaaagacttagtgacctattgcaacaaaaacgctctgattgtccatacttggcatagtcatgacttgaccaatgagacgcccatctatcactttatcattatcaagcctgcaaattaa

SEQ ID NO: 187 - DNA, 741 bp, M.catarrhalis
aaaattaacacagatttgcccaaattttatattgataaaaatcttgccatatcgaccctaaaaagccatccaacgatttatttatttaatgaattcataactgtgatgaaactgttaaaaaaattaaaatcattactcaaacgagcagatgccaaacgctcaaataagaacgcacagtccatcactgagcatcaatcagacacaaagcagcccatcaccgatcatatcatccaatacctaaagcgtcatggctggcaatatgaagcacgatcaaacgatggcacgataacgcctcaaattcatcatctgattatattatttagttatactaaatatcaatggtcttgtgtgtttcgtattaatgaaacaagccagcttgtttctatctttggtattttgcctgaagtggtgcctgatagtcattttgcgatgatgctgatggcgatcgccaaggcaaatctatcaatcccttttgggagcattgagcttgacccaaccgatggcgaggtacacgccaaagttagcttggatgctgaatttactccattaagcgataacgctttgggcgtgcatttgcaaggtgtggtaagcctaactgaacttgcccaaaggctgtatgatgatgtactttatgaagccgaccccagccccatcgttactgattacctgcagcaccctaccgatgctcataccaaagaccttttggatcaatactttgagccaaccgatcaatatcagtga

SEQ ID NO: 188 - DNA, 258 bp, M.catarrhalis
cggaggcggttatctttttggcgcctcaagtggtgtatttattcgcaccaggttttgccgatgacccccaaaagtttgactctaccagccaagctgttacgcttgactttaccttatttattattcgtctccatgacggcattttttggtagcattcttcagagttatggaagatttgcagcacccgcctttgctcctgtattactaaatctttgtatgattggcgcgtgcattaatattagggcaggtgggtggtaa

SEQ ID NO: 189 - DNA, 405 bp, M.catarrhalis
tgtgttatgacggcattatatatgtttcttgccgctgtttgtatactcgggcctttggttgctttacatgagtttgggcattatatcgttgctcgtttatgtggggttaaggtacaaacatattcaattggttttgggccaaaactgcttgcttggacttctaaacgctcaggtatacgctaccaaattgccgccattcctttgggtggctatgttaaaatgctggacagtcgtcaagaatctgtcgcagatgaattaaagtcagttgcgtttaatcatcagcaccctttaaaaaaaattgccatcgttgcagctggtcctgtcatgaattttttgattgccattgggctattttgggtgctatttttattggccagtgagcagcttaacccccgaaatgggtaa

SEQ ID NO: 190 - DNA, 570 bp, M.catarrhalis
aatagccagacagcatataccgcattcgcattaaattactcaaggaaaataaccatgtcaacgcctgttagtcagcctgtcgccactcaaattgaccccaccttagatttagaaaaaatccgttatgagtgccaatctttagccaaatctcgagccaaagtctcagcaggtgctgccgtcattcccttgccatttttagatgttgccgttgatgtggcaatgctaactaagctgttacctgaaataaccgaacgctttggtctaaaagataaagccaatttagatacctcaaccgaagaagcacgcaagcaaaatatcaaagatcgcattgtctctgttggtggcttgattgctgctcgtggcgtcgttaataagaccattcaaggttttggcggacgctttattggtaagcaaatcagtaaatttatcccattaggtggctcaatggtggcagcatcgttaggctatatgatttttaaaaaaattgcttttgatcacattgaagaatgctataacattgccaagcaatctcaacgccaagagacaagctcacaggattttaatgcttaa

SEQ ID NO: 191 - DNA, 1029 bp, M.catarrhalis
ttggcgcgtgcattaatattagggcaggtgggtggtaagccaatcatggcattgggttatgctgtcgccatttcaggcattttgcagctgctcatacagttgccacagctttggcaacaaaaactgcttattccactcagtattagctttaaagatgaaggcgttaggcgtattttaaagctcatgctgcctgccatttttggggtatccgtcacccagattaacttattattaagcaccgtatttgcctcattaatgattgcaggttcagtatcatggatgtatgctgccgaacgcttaagtgaattgccattaggactcattggtgtggcgattggtacggtgattttaccaagcctatcatcaagtcgtgccaagtcagatgatgaaaattttcgccaaacgctagactgggctgcccgcttaattcttgtcatcggtataccagccagtcttgcgatatttgttttatcagatattttgatggatgctttatttgtgcgtggtcaatttacccaccaagatgccttgatgagtggtattgctctaaagtctttatcaggagggatcttaggatttatgctcattaaaatttttgcacctgcattttttgcaaatcaagacaccaaaacgcctgttaaaattggcatcatttcagtatttgctaatatgatttttagcgtcgtatttattgggctattttatttaatgaaactgcctttacatggtggattggccttggcaaccacagcagcaagttttgttaacgcaggtctactctatgccgttttacatcgccgtggtatctatcgttttggtactcactggaaaaagatgatacgacaatttgtgattgccaatattgccatggtgattagcttatctgtcattttgcccttatatccaattgatgctaatcactggctcaaaattgccatcttgctgggcatatgcggttttggggcaatcatttatggtatcacactactcatcactggttttcgcccaagtcagcttaagcatggctga

SEQ ID NO: 192 - DNA, 780 bp, M.catarrhalis
ggcgtgtattttagcatttgcaaaggcaggcggcgctgtactgatgaccagccatcaggcgacaaaagcgacaaatcggcaactgaatttggcggaatttgcgttatgatgactcatccttttttgaccatgattacccgtgaatggcaaatcaaacgacaaggcacagttcagtggctttatcctttggtgctgtttttattgattattacactatttcccttggcgattggcaatgaaccaaagcttttactcagattggcaccttcggcggtgtggattgctgctttgcttgcattggtgattggtgtggatgatttattccgcagtgagtttgataacggcacattggcacaaatggtcgttgccaaatcacccttaatcatttgggttttggcacggcttttggtgcattggttgtttagtgcaggtgtggtagcaatcttatccttattagtgattgtattgtttgagataccatttggtgaagcgggaatattgatggtttcgatatttgtgggttctccgattttgctgggattgtctgcgattgcaagcagtttgactttaactttaaaaaatggtgcagttcttgtccctttgattgcattaccgatgcaactgcctgtgctgatatttgcaacaggtgcggtggacttatatgccacagggttaaatggcttaccaaccttggctttattggcggcaggcagtattatcacggtgctggtgacgccatgggttgtcgcctcagtactcaaaatggcatgggcagattaa

SEQ ID NO: 193 - DNA, 351 bp, M.catarrhalis
gttacaagggcagttagcagaagtggagaagcaggtgggggcgttgaagcagttgtaagcttttttaatttagtgtatagcagggtgtatatgtatggcaccctactttatttccagtccacgaggttaaccatgagtccaaatgcattaaaggatttaattaatagtatccaattaacagtaactgaggatcgtttctgcgaagaatatacaactaaatacaaacttccacaagaagccctgaatgacaaggtagaaaatgcattaaaagagcattttctaaacaataactacaaacaagttgaaatagagaacggtgcactcattttaaaacatccttctattgactag

SEQ ID NO: 194 - DNA, 342 bp, M.catarrhalis
gtgcttaatttagctgtatttacgcttgacacccacctcaatcccccattgtacatcaatccgacaccaaaaggacacactatgccagcaaccgaacgtatcaatatccgcaccacaccccacgccaaagccttgattgaaaaggcaagccaatgtcttggcgtgtcggtcagtagctttatggctcaaagtgcctacgaaaaagccctaagtctagaacagtccgaaaccatttatctaaatcaagatgaatggcaaaaagcccttgccatgcttgacgatgagccgtctgatgagataaacgcacttttggcaaggggctatcgtgttatcggtcgttaa

SEQ ID NO: 195 - DNA, 204 bp, M.catarrhalis
actatgaaacaagtaactttaaacggacaaccgaccgaatcggatcattcaacggtatttgaattgctaaatgcccacggtctgacccaggggcgatttgcagtggagattgatgagatgctcgtaccaaaatcacgcttgacgctcacagagctaaaagatggtatgagtatcgaagttgtgcaagccgttggtggtggctga

SEQ ID NO: 196 - DNA, 468 bp, M.catarrhalis
gtttatattaagatggcaaaatctcggctctttcgctccaccgtcattgtcagttccatgaccatgctttctcgtattttaggtttaatcagagacatggttttgatgagtgtttttggtgctggtgggttgatggatgcgtttttagttgcctttaaaatccccaattttttacgccgcctgtttgccgaaggggcattttcccaagcctttgttcctgtattaactgagtacaaagaagcacgcactttaactgaggtgcaactgctgattgctcgtgtctctggggtattatccttggtactacttgtattgacggaggcggttatctttttggcgcctcaagtggtgtatttattcgcaccaggttttgccgatgacccccaaaagtttgactctaccagccaagctgttacgcttgactttaccttatttattattcgtctccatgacggcattttttggtag

SEQ ID NO: 197 - DNA, 267 bp, M.catarrhalis
agtaaatccaataacccccttaatttaggagaatattccatgggtaaaaatcagcacgttgtgccgcacaaagacggttgggcagttcaaggcgaaggtaactcaaaaccaacacgagttaccagtacacaaaaagaagccattcagattgcacaagatattgcacgcaatcaacaatctgacaccaagatccatggtagagatggaaagattcgtgcaggcaatagttatggaaatgacccatttccaccaaaagacactaaatag

SEQ ID NO: 198 - DNA, 891 bp, M.catarrhalis
agcgctttaaaattgataactctttgcaaggatgttttagtcatgtggcaacgaataaaaacggcaataattttggttttgattgttggatttgcgttatttgcaagctcaatgccgatttttgtgttgccactattagccattggggttttgatcgctgcacatgaatggacaaaactcatgccaaaatgcagacagcctgtacagtttattttggcagttttaatcatcaccatgttatcagttgcactgccttggacttgggtattttggtgggcagtatcgctgggtatttgggtaatggcaacggcatgggtggcacaataccccaataaagaacgctggtatggtaggcggctggtgtatatgggtgcggtcattctcaccgctgctatcaccgccatgtatgggctttggcagatgtcgccttggtggctgatgtatgtgtttttattggtatggtgtgctgatagtggggcttattttattggcagaaaatttggcaaacgaaaaatggcacccaatgtatcacccaataaaagtatcgaaggcttatgcggtggattgatggtctctggggtggtcactgtggcagttggttattatttgcagctgtctggtatgtcattggtattgtttttgattttgtcttggctaactgtacttgccagtatactgggcgacttatttgaatctatgctaaaacgccgtgcaggtattaaagattctgggacaattctaccaggtcatggcggtattttggatcgaattgattcgctactttcagcgataccgatatttgcattgggtttttggctattattaaaacttggtatttttacagaagtttggataaaaatgtactttgcaaccatgcaagtgcctttttga

SEQ ID NO: 199 - DNA, 909 bp, M.catarrhalis
gccatgctaaaaattgcttattcacccctattttgtcatcgtctgccagtctctcaccgctttcccatggcaaaatatgacctcatccccaaaaaactgcttaccgatggcatcatcacgcaagataatttatttcatcccgagctgttatcagaacaagagattctaagcacgcacaccgctgattattggcacaaattaaaaacaggcacgctcacggacaaagagattcgcaaaatcggtctgcccatgtccgccagtcttatcaagcgagaacgctacattacgcacgccacttacgaatgtgccttgtacgccaaaaaatatggcatctctttgtcggtatcaggtggtacgcaccacggatttgctgaccatggtgagggattttgtgtgtttaatgatgtgtgcgtggcgagcaatctgctcttagcacgagggcaagccaaacgcattttaagcgtggatttggatgtgcatcaaggtaacggcaatgcctccatcatggcaaataaccctgctgtctttgtgtttagcatgcacggcaaaaagaactatccctttatcaaaccaccgtccgacctagacatagagcttgatgatggtacggatgataatgcgtatttgacgatactgggcaagaccctgcccaagattatccgtgagtttgaccctgacatgctattttatcaagcaggcgtggatgtactggcgacggataaactgggtaaattatcgcttagcttacaaggctgttatgagcgagacaaactggtactcaccaccgcacacaaggcgggcatccctgtcgctgttgtcatgggtgggggctattcacctgatattgagacggtggtggcggctcattgtggggtgtttggggtggccgtggggttgatggcatcttaa

SEQ ID NO: 200 - DNA, 1482 bp, M.catarrhalis
ataggtataaaaatgtctgtgaaaatcggctttaaacccatgccattagtcatcgccattgccctttcggtgacgattcttttaattccaacacctgagggtgtgactgaccaagcttggaatttgcttgcgttatttgttggcgtgattgctgcaattattggtaaagcaatgcccattggtgccttatcaatcttggcaatcactttggtcgctgttacaggtattacagtcgccgatggtggcagtgctaatgatgccatgaaagatgcattatcaagctttgccaatccactgatttggctgattggggtgtctatcatgatttctcgtggtttgctgaagacgggtttgggtgcgcgtattggttatatattcattgccatctttggtaaaaaaaccttgggtattggctatagcttggcttttagtgagctgattttagcgcctgttacgcccagtaataccgctcgtggtggtgcaatcatgcatccgattatgcgggcaattgctgacagttttgactcatcaccaagtaaaaacactcaagatacgatcggtaaataccttgctttggttaattatcatagtaaccccatcagctcagcaatgttcatcaccgcaacagcaccaaacccattggtggtgaatctcatcgccgaaactttgggcagtgagtttcgcttaagctggagtcaatgggcgtgggcaatgttaattccaggtttggtggcatttgccttgatgccgttggtgctgtactttgtctctccacccaaaattaaaaatacacccaatgcggtaacatttgccaaagcaaaactgtctgacatgggtacgatgagccgagatgaaatcatcatgttggcgatttttgccgttttgttactgtgttgggcaggcgtgccaaatttattatttaatttccccattaatgctaccgctaccgcctttattggtttaagcttactactcttatcaggtgtgctgacttgggaggatgtgactgccgaaaaaggtgcttgggatacgatcgtttggtttgcagctttgattatgatggcgacatttttaaataagcttggattgattacatggttttcatccagccttgaaacacacatcgcaagtttgggtttgagcggcttatcagcaggtcttttattactgatcgcatatatgtatgcacactatatgtttgccagtacgacagcgcacattaccgcaatgtttggtgcgtttttatcggcaggtgttgccttgggtgtgccaccaatgctttttgccttgctgatggcggcggcatcaagcatcatgatgactttgacgcactatgccacaggcacctctcctgtgatttttggatcaggttataccactttgccagaatggtggaaagctggctttgtgatgagcgtcgttaatatcatcgtgttcaccctgattggtggtctatggtggaaagtgttgggttattggtaa

SEQ ID NO: 201 - DNA, 945 bp, M.catarrhalis
tcttgtacaaagccatctcatattaccttgacaatccaaacaaatatcgataagttaatccaaaataatttgaaaaatcaaggaaatatcatgaccattcgcattgctaccattcagctaaatagccaaaccgacattgacgccaatctaggtattatcaataatgccatcagcgaagctgccgcctgtgatgctaaatttatcgtactgcccgaaaatgcttgcgttatgggtcgtcaaagtcagcttgccactcgctatgatgaaatctgccaattttatcaatcgcttgccaagacatatggcgttcatctattagcaggtacgctaccttgcccaactcgtcccgatggcagtgatgtgccttgcgatcttgtcagacaagttagtctactgattgatgaccaaggtaatatcaaagcacgatatgataaaattcatctatttcgtgcaactattgatgacagcacaggcaactatgatgaaggtaagacatttgagcatggcagccgattggtctgtgagccgtgcgtcattcatgggcagacgatcaatgttggcatgatgatttgctttgatgtcagattccctgcctttgctcagcggctcagacaaatgggggcggacatcatcactgtcccagctgcgtttacacatcgtacaggtcaggcacattggcaaatgctgctacaggcacgtgcgttggatagtcaatgcctgattatcggttcagctcaaggcggtatccatcagatcggtaatagcatacgccagacttggggtcattccatgattgtgaatgcacatggtcaaatcatcgcagacagtggtcgcactgaggtggcagacaacggttattgtattgcttatgctgattatgacgctgataggcaagctaaaatccgtgctgccatgccgatttttgactgccatcacttggcatag

SEQ ID NO: 202 - DNA, 786 bp, M.catarrhalis
aagacgatgaatttatattttgataaaaacttagcaaatgaatacagtagtaaggctcaaattgcaagagttttaactgaaaattgggtgttgaataactcatattgtcccaaatgcggaaatctgccattatctgaatttgaaaacaatcgacctgttgctgatttttactgtcaaaattgcctcgaagaatttgagttaaaaagtaaaaatggtcgtttgcccaatgtaataacagacggtgcttatgcaacgatgatagagcgtatcaacgctaataacagcccaaactttttcttcttaacttatgataaacagtggcgagttaatgattttttgattataccaaaacaattttttactccaagtattattatcaaaagaaagcctttgtcgcccaatgcaaggcgtgcaggctgggttggatgcaatattgatatatccaatgttgttgattttggtaaaatttttttggtcaaaaattctcaaataattaatcaaaatttggtgcaagaacattttaataataccttatttattcgcactaagaatatagagtcaagaggttggatattggacataatgatgtgtatagatagtatttcaaaagatacttttaacctaaaagatatttatgattttgaagagatattaaaaataaaatacccaaacaataactttattaaagataaaattagacagcagttgcaaattttaagagataaaggattgattgaattcgttgcccgtggtcgatataaaaaggtaaaatatgcaaacctataa

SEQ ID NO: 203 - DNA, 222 bp, M.catarrhalis
tttaatgcgaatgcggtatatgctgtctggctattttatatatgtgtcatcttaatcgttacattttacgataattataaaaagttacaagtaattttttttgtgtgctttgtattgcttatgtcaatggtacggcagggtatcatgtataatgacagtagaatatataatgacagctcagccatgcttaagctgacttgggcgaaaaccagtgatgagtag

SEQ ID NO: 204 - DNA, 651 bp, M.catarrhalis
actgtttttgatatgataaattatgctaaaataattttatcatcagtcaaatcggtctatcttatgtgttcagcttctgtgatacaacatggaattttacagggtgcgacattcatcaaatctgacaattttaacgctcgtcctgctgacaaaacaggtctaataacaggcattgttattcgcaatatcagcctacctccttcacagtttgggcaagtcaatgccgatggcgtacatcatgtcaaggctttttttcaaaatcagctcaaccccgatgatcatgtatactttcagggcattcatacactcaaagtatctgcacatttattcatcgaacgcaatggcagcgtgacgcaatttgtcaattttaatgatcgtgcgtggcatgcgggacaatctgcctatttgggtcgtcaaaactgcaacgacttcaccattggtattgaacttgaaggggctgatgatataccctttgaagctgtccagtatcaagctcttggtcaaatcattgttgctatttatgatgcctatcctgccacacgccgccatttaatggggcatagcgacattgccccccaccgaaaaactgatccaggtaagtattttgactggcaaaagctgcgtactttggtcgctcaaatgatgatttaa

SEQ ID NO: 205 - DNA, 777 bp, M.catarrhalis
accataagtgataaagctatgttaataggttgggtgatatggcggtttatcatagctttatttgatagggttgtggtaaaattaggggttaatttatataccacagttaaacccatcattttcatcattgataccaatcatgccatgacaacagtaactaagcccattgataccgataataagccaatccttacgattgataaactggatgtacagcgtggtgattttgtgctgtgccaagaggtgcagttgaccttagagatgggtgatgtgtgtcatctgattggcgaaaatggcttgggtaaaacaacacttatgtctcagattgcaggtttattacctattattcatgggacttgtgtgtgtgctggtgctatggtatatgtctcgcatcagcttggtatcagtgcagcgttgactgtcgcacaaaatttgcgatttttgttgtcgctatatggtgtggatgctgatgatacattgattgatgaagcattatggcaggtgggacttgaggggctgcaagatatctcaagtgttcagctgtcagcaggtcagatgcgacgagtgggattggctcgcttgtttgttttgacaccaaatgaggcatcattttggctgcttgatgagccactgacggcactagataccaccatggttcaaagacttgaggcgtgtattttagcatttgcaaaggcaggcggcgctgtactgatgaccagccatcaggcgacaaaagcgacaaatcggcaactgaatttggcggaatttgcgttatga

SEQ ID NO: 206 - DNA, 465 bp, M.catarrhalis
ataaaaggtttcattgggctaatttgttgtattagtatttgttgtattattcttcataatcaccatcaaatagaaggctttatgactgttaaaatcaattggctgttagtggcggcgcttaatcttgctataggtgtcgcctttggggcatttggtgcacatggacttaagcacattgctgatgagtatgcgttacagatttggcaaactgccacgctgtatttgttcattcatgcgttgggcttattggttattggtgttttacagcatattgggcgatatcgctctgctttggctggcgtattactacaaatgggtattgtgatattttcaggcacactgtataccatggcacttggtgcgcctcgttggcttggggcaatcacacctatcggtggtggtttactgatcatcggttggcttgtgtttgccttacaaatcgccaaaacgactcgcttggcttaa

SEQ ID NO: 207 - DNA, 282 bp, M.catarrhalis
acgcacttttggcaaggggctatcgtgttatcggtcgttaaatttgacaaaagttttgatagggagagttttgattgtggcgtggcggtgctgaatgattttttaaaaattcgtgccagtcaatacattaagcgttatgaagcggtggtttattgtgcgtttgatgaccaaactcaaaaaatcgcgggttttacaccctgtccaataccgccatttgccaagctgatgaccctgtttttctcaaaaaacagcacccaaccgctccgattggttgcgtgttga

SEQ ID NO: 208 - DNA, 1194 bp, M.catarrhalis
ttaaaagattggatactagctaatttttggaaaattgcctacaatagtatcaagattttgagaatatatagggacaaaatggcacccaaacgcacccaagataacggtgatgattatgatcacaaccatgaaggctatgatgacacatatgacgatgagtttgatgaggatttgattgaagcgttagacggctttcatgagattgatgatgaagagtacgccgaaatcatcgatgatattgatgatgatatcgataaacccaaagtttctgctacgcccaaagcttacagtacaccatctggcacagatgccattgcgacgcacgatctagtaccagccatgccgacccatttggcagcacctggggtgaatttgggtgcttatattaatactgtgcatcaaattcctattttaacacccgaagaagagcgtgccttggctgagcgttattatcatgatggcgatgttgaagccgctcggctgcttgtgatgagccacttaagatttgtcattcatattgcacgcagttattcaggatatggattatcccaagccgatttgatccaagaaggcaatcttggcttaatgaaagccgtcaaacgctttgatcctaataagggggtgcgtttggtcagttttgcggtacattggattaaggcggagattcatgaatttgtcatcaaaaattggcgtattgttaaagttgctaccaccaaagcacatcgtaaattattttttaatttacgcagcctaaaaaaatcctccaatcagctgactttagatgaagcaactgccatcgccaatgatttgaatgtgaccgtcaagcaagttttggagatggaatcacgcttgaccagttatgatgcgtcttttgaggcacaagattcagatgatgatgaaggacgctatgcccctcagctatttttggaggatgcggtcaatcctgccgatgtcgttgaggaggcagattgggaagaaaataccacaaccgcactcaaagatgcgatggaaaccctagatgaacgctctcgtgatatcatcacgcagcggtggctggctgaccaaaaatccacattacatgagcttgcggcaacttataatatttcggctgaacgagttcgccaaattgaaaaaaatgccatgaataaaatcaaagaagctattacgcttgatcgtatgattatagatgaataa

SEQ ID NO: 209 - DNA, 288 bp, M.catarrhalis
acgacaaagagtctacaaatgaatgagcttgatactgttgttgattggatgttaattcggttaaatcaagacacttgtctttatcaagatgatgttatagattatttaattaaagccaatcttgaacacttgacagctgaaaatgctgaaggtaatcaggtcttgagggataaagttcttgcagtattcaaacaaaaaacattagacgatgttgtttgggttcaaaggggattgtattggcggtttagggttttagaggatgagccaagtagaatggcaaggtggtaa

SEQ ID NO: 210 - DNA, 1044 bp, M.catarrhalis
  unsure (119),(139),(185): Identity of nucleotide sequences at the above locations are unknown.
ttgccattgggctattttgggtgctatttttattggccagtgagcagcttaacccccgaaatgggtaaaattattgacaattcacctgctgctaccacgggcttggtggttggtgatanaattatcagtatcgattcanaatcagtcaatacttggcagcagaccgcttacgcattggcatctanaatgggtgaaagtaccaccattcacattggtgtcaatcgtgatgggcaagtacttcaaaaaactgccaaggttttacattttatgcagaccaaagacagtcgtcagcctaatgatcctttaagtagtttgggtattttgccttatcaacccatcatctcacctgtggtcggcgaggtgctttctgacggtgctggtgcgttgatgggtctaaaaactggtgatgtcttcactgctattcatggtgaaccaatcaatgattggctgagtgccaccaagattattcaggcaaatccagaaaccatgcttgatgtgacagtcatgcgtcaaggtaagcaggttgatttaaaattaatgccccgtggtgtaaagacacaaaacggcgtagtcggccaactgggtattcgcccccagattgataccgatacgctcattcctgatgaatatcgtatgacgattcaatatggtgtcggtgaggcatttactcaagccatccgacgaacttatgatttatcaataatgaccttagatgcgatgggtaagatgattacaggattgattggcattgaaaatctatcaggtcccattgccattgccgatatttctaagaccagttttgagttgggatttcaagaagtgttatcgacagccgcaatcatcagtttaagcttggcagtactgaatcttttacccattccagtgttagatggcgggcatttggtattttatacttatgaatgggttatgggcgaatctatgaatgaagcggtgcagatgacagcatttaaagcgggtgcgttattgcttttttgtttcatgttacttgcaatcagtaacgatatcatgcgattttttggctaa

SEQ ID NO: 211 - DNA, 771 bp, M.catarrhalis
ttttgcaagggcgaaataagccactttaatcagcttgggggctgtatgtctgataaaaatccacaattttcacgcattttattaaaactatcgggtgaagcgttggctggcggtcgtgatatgggcattgatgctaatatcttggatcaaatgagcctatccattgcacatcttcgagggctgggtgttcaagttggtattgttgttggtggtggcaatttgtaccgtggtagtacgctacaaaaacaagggttggttggtcgtgtgacaggtgaccaaatgggcatgctcgcaaccgtgatgaatggtttggcgatgcgtgatgctttggtacgccgaaatattaaaactcgcctaatgtcagcgattgccattgatacagtagttgagtcatattctagccgtgatgcgatacgccacttaaataatggcgaggtgtgtatctttgtggcaggtacgggtaatccattttttaccacagataccgcagcgtgcttgcgtggcatcgagattgaagcagggctgattttaaaagccaccaaagttgatggcgtttatgataaagacccaacaaccgatgatgatgcggttaaatttgacagtttgagttttgatgaagtgcttgaaaaaaagcttggtgtgatggatttaacagcgattgcgttatgccgagagcataatgtaccgctacaagtatttgatatgaataaaccaaatgcgctattgaatgtggttatgggtgaggctgaaggtacacgagtttatcactaa

SEQ ID NO: 212 - DNA, 564 bp, M.catarrhalis
ggaaattttatgattaatgaaattaaaacagatggcgaaagccgcatgcaaaaatctatcgaagctttggaagctgcttttagtaagctgcgtacgggtcgagcccatccagggattttatcaggcgtgatggtcagctattatggttctgatacaccgttaaatcaggtagccagtatcaatgtagaagacagtcgcactttattggtgcagccatttgagcggtctatggtacaagctgttgataaggcaatccgtgaagcggatttgggtctaaatccaatgaccgctgatgtgattcgtgtcccaatgcctgctttgaccgaagagacacgccgtgatatgcaaaaaattgctcgcaatgatgctgaacaaacacgcatttctgtgcgtaatattcgccgtgatatgctaagtgatattaaagatttgctaaaagataaagaaatatcagaagatgatgaacgccgtgctgcagatgacattcaaaaattaacggacaaattcatcgcaaccattgatagtcgcctagagaaaaaagaaagcgaactgatggaagtgtga

SEQ ID NO: 213 - DNA, 819 bp, M.catarrhalis
ggagttttctttatccatgttattcatttatttagattagatttaaagttaaatgacggtaattgtaacaccatgacaacccaaatttgtgaatctttacccatcattcccaagcacattgccatcattatggatggcaataatcgctttggtaaatccaaacagctggcaacaggtgcaggccatgtggcgggtaaagatgcacttgatccgattgttgagcattgtttggctttaggggttgaggtgctgacggtatttgccttttcaagtgaaaattgggcacgcccaaaagatgaggtggatcttttgatgcgtcttttgtcccaaacgatttacgagcagctaccacgcatgaatcagcaccggatccgtctgcgttttatcggtgatagaagtcaaattgatggcgacttggtaaagcttatggcacaggcagaagccaagacggcagattttgatgcgatgactttggtgattgctatcagctatggcggacaatgggacattaccaatgccgccaaaaaacttgccaaacaagttgaattgggtcacttatctgctgatgatatcgatatacaaatgataaaaacgcagcttgaattggcggatttaccttctgtggacatgctgattcgtacaggtggagagtaccgcatttcaaattttttactttggcagacggcatatgctgaattattttttacgcccacattatggcctgaatttggctgtgatgagcttgatgagatgattcgtatttttgctggtcgtgagcgtcgatttggcatgacaagcgaacaaatccaaaaaacctaa

SEQ ID NO: 214 - DNA, 615 bp, M.catarrhalis
tcaatgtttatactcacgattcaattggtctgggtgaagatgggcccaacgcaccagcctgtcgagcagattgctaatttacgcatgaccccaaatcattatgtatggcgtccttgcgatacggttgagacagcagtggcatggaagatggcgcttaaaacaaaaaccgctccttcatcattgattttatctcgtcagaatttggcatttcaatctcgcagtgatgagcaaattcagaatatcgaaaaaggcggatatattttagcacccgaaaaaggtactcttaaagccatcatcatcgcaacaggttctgaagttgagcttgcgatgcaggcgtatgagcaactagaaggcgtgcgtgtggtttctatgccatgtgctgagatttttgttaagcaggacagtggttatatcgaaagtgtgttaccatctgatgttcgtgtgcgtgttgctgttgaggcggcaatcacggattattggtataaatttgttggcttagatggcaaggttgttggtatgacgacatttggagagtctgcacctgccaaggtattgtttgagcattttggtatcacaacccaagctgtggtggatgcggtaaattctttactttaa

SEQ ID NO: 215 - DNA, 900 bp, M.catarrhalis
acagcgattatgcaactcaagcgatgttatcagtacaaaggtatttttaagatggcaaattatttaatgattggtcaaggtaatatcggcaagcctttggcaatcagattggcaaaagctcatactgtcaaaaccgtggctagacgcttgcatgaatatggcactttggctaaatatattcattttttacaaaaagacgccaagactttgaccttggatgatgtcaaagataccacgcaccttgccatcattatcacgccatcaaatatagggcgagcgtcgactttggattatcaaaaaagctatttggcagtgtgtcagcatattgtaggtttggcaaatcaatcatgtgagtggcagcaaaagctaaagcaagtgttatttgtgtcatcaacatcggtttatggtcaaaaccaaggcgagtggattgatgagaccgcgcctgcactacccataactgataccgctcagatattaaaagacgccgaagacttgctttggcaaacctttggcaagcgtgccattattgtgcgtgctggcgggatttatcataaaaatagcataagactcattgagcaggcacgccaagcccatttggttggtattccacgccatcattataccaaccgcatcatggatagcgatttggtgaattgtttgtatcaaattttggtgagtgattgccccaagtcgttgtaccttgcgacagataatacacctgtgacaagttttgaggtgcttgagtatatcgcaaaaagtctgaattacccatctgtcacacctatctttgatccgccaagtggcaaacggattattgcaaacattaataccaattggctaagctatcctaattatcagataggatacgatgctgtgattgcacatttgatcagatcttag

SEQ ID NO: 216 - DNA, 1494 bp, M.catarrhalis
aaatatgatataatgaagcaaattttgttaggaactttgctgatgccaatcgaacttaaccaacgccataatgccaatgctatccgtattcttacgatggatgccgtccaacaagccaactcaggtcacccaggggcaccgatgggtatggcggatatcgcagaagtgctatggcgagagtttttacgccataatccaaaaaatgccaaatgggtaaaccgtgatcgctttgtgctatctaatggccatggctcaatgttattgtatgctttactgcatttgactggttatgatttaagtattgatgatcttaaaaatttccgtcagctgcattcaaaaaccgcaggtcatcctgaatacggttatgccgatggtatcgagacaaccacaggacctttaggtcaaggtattgctaatgccgttggttttgcgttggctgagaagactttggcagcacagtttaacaaacctgacaatgcaatcattgatcattttacctatgcgtttttgggtgatggttgtttgatggaaggtattagccatgaagcatgctcactggcgggtactttggggcttggtaaactgattgcttattatgatgataatggcatttcaattgatggcgaggttgaaggttggttttctgatgatactgccaaacgatttgaagcgtatggctggcaggtattaaaaattgatggtcatgatgctgatgccattcgtgatgccaccaatcaagccaaagcagaatcagccaaaccgacattgattatttgcaaaaccattattggtttgggctcgcctaataaacaaggtaaagaaattagccatggtgcacctttgggcttagacgaaattgctttgacacgcacgcaaatgggctgggcggacaccacgccttttataattaccgatgagatgtatcgtgcttgggatgccaccgccaaaggcagtaccgatgaagcagcttggaataaacagtttgctgagtatcaagataaatatcctaaggaagctgctgagcttttacgccgtttcagtggtgatttgccagagaactttgatcagctggcagatgaatttatccaaacttgcgtccaaaaagcagaaagtatcgccacacgcaaagccagccaaaacgccatcgcagcacttgcaccacacttacctgaaatcttgggcggttcagctgaccttgcaggttcaaacctaactttgtggtcaggtgctaaaggtgttcaagagtacgccgatggtaattatgttcattatggtgtgcgtgaatttggcatgacagcaattgccaacggcgtggcactgcatggcgtatttatcccctacacagcgccatttttaatgtttatggaatatgctcgtaatgctgtgcgtatgtcatcgctgatgaagcagcgtgtgatcaatgtttatactcacgattcaattggtctgggtgaagatgggcccaacgcaccagcctgtcgagcagattgctaa

SEQ ID NO: 217 - DNA, 2970 bp, M.catarrhalis
ttaaatgtcattttttattataaatcatcagagagttatcccatgagcatagataatttatcaaccaattataatccagtaaatattgaacaaaaatggtacaagatttgggaacaacaaggctattttaaaccccaaccaaaccccgccatgagcgacaaacaaaacgctttctctattgccttgccgccgcccaatgtcacaggttcgctccatatggggcatggctttaacaacaccatcatggacacattaacccgctatcatcgcatgatgggtcataacacgctttggcagcccggtaccgaccacgcaggcatcgccacacagatggtggtggagcgtcagcttgggttacaaggcatcagccgtcatgatttggggcgggagaagttcattgacaagatttgggcgtggaaagagcagtcaggtaacaccatcactcgccaaattcgccgtttggggtcgtccgtggactggtctcgtgaacgctttaccatggacgacggtctgtcgcaggcggtcaaagaggtgtttgtgtggctttatgatgagggcttgatttatcgtggcaaacgcttggtaaactgggacccaaaactacacaccgccctttctgacttagaagtagaaagcgtagaagagcaaggcagtttgtggcattttagatatcattttgccgaccaaagtttgacaacccaagacggtaaaaattatctggtggtggcaaccacacgccctgaaaccttgcttggcgacagtgcggtggcggtacaccctgatgatgagcgttatgcccatttgattggtaaaaccatcgtcctgcccattagcgggcgtgaagtgcctatcgtggcggacgattatgtagaaaaagattttggtacagggtgcgtcaaaatcacgccagcccatgactttaacgaccatgagcttggtaaacgccacgaattaccgctcattaatatttttgatgaagatgcgtgcataaaagctgaatttgacttgattgccaaagtgggagagccgatttctaaccacatcaccgcccctgccgactatgcagggcttgagcgttttgccgctcgtaaaaaactcatagaacaagcccaaaacgaaaactggcttgaaaaaattgaaccttataccctaaaagccccccgtggcgaccgctccggtacagtcattgaaccacttttgaccgaccaatggtatgtggcgattgaaacccttgccaaaccagcgattgaagcggtgcaaaatggcgacattcaattcgtgccacaacaatacaccaacatgtacatggcatggatgcgtgatatccaagactggtgcatcagccgtcagctgtggtgggggcatcgtatccctgcatggtatgatgacaatggcaatgtgtatgtggggcgtgatgaaagcgaagtgcgtgccaaatacagcttagccgataccccccttcgccaagatgatgatgtgctagatacttggtttagctcggctctgtggacatttagcacgcttgactggacaggtcagaccagctttgatgattatggcgatgccctacaaacctttcacccaacaagcgtactggtaacaggatttgacatcattttcttttgggttgctcgcatgattatgatgaccatgcactttatcaaagacaaagatggcaagccccaagtcccctttaagaccgtttatgtgcatggtctggtcagagacagccaagggcaaaaaatgagcaaatccaaaggcaatgtgcttgaccccattgacttaattgatggcattgatttggaaaatctggtcaacaaacgcacccaagggttgatgaacccaaaagaggcggacaacatcgccaaacaaacccgccaagaattccctgacggtatcccagcctttggcacagatgccctgcgatttacctacgcatcacttgccagcacagggcgagacattaactttgacttaaaacgcattgaaggatatcgtaatttttgtaataaaatttggaatgccactcgctttgtactcatgaactgcattgacaaagatggccgtccccaaaacattgataaatccgccaaccctaagctttggcagttgcctgaacactggatcatcagccgcctaaacgccaccatcaatgacattcacgagcatataagccagtaccgttttgacttgatgagccaagccatttatgaatttatttggaatgaatactgcgattggtatgtggagtttgccaaatccagcttaaacgcatcagaacaagacagcacagtcagcgatgagcgaaaagctcaaatccgttatgtgttgctctttgtgcttgaaatggcaatgaaaatgacccaccccatcatgccctatctcaccgaagagatttggcaaaccatcacaccactgctgggcaaaacaggtaaaagcatcatgctaagcacctaccccaagtgcgatgacagcaaaatcaacgaacaagccgaaagcgacatggcatggctacaaagccttatcggtgcggtgcgaaacattcgtggcgagatgaaactgggcaatgccgtgcgtctgcctgtgctaattcaaggggtaagcgatgaacaaaaagcaagccttgtacgcattgacaatcaatttaaaacccttgccaaagtagacagcctaacgattgtcaaaactggcgaagaggtgccattatcatcatctggcatggttggacaaatgaaagtgcttgtccccatgaaaggcttgattgacccgaccgctgaactaaaccgcctaaataaagtgcgtgataaactgcaaacccaagcagatgccattaacaaaaagatgtccaatgacaactttatcgccaaagcccccgctcaggtggtagaagcagaacgagccaaactctctgagttacaagggcagttagcagaagtggagaagcaggtgggggcgttgaagcagttgtaa

SEQ ID NO: 218 - DNA, 333 bp, M.catarrhalis; identical to SEQ ID NO: 64

SEQ ID NO: 219 - DNA, 1308 bp, M.catarrhalis
ggtttattaattatatttattaatcaaataaaaaatgtgattaaaataaatttaaggataataatggcagatacgcttcaatctttggcaatacttggtgcaacaggttctatcggtgatagtacactggcaattattcgtcagcatcccaatcgttatcgcattcatgcactgacaggattttctcgtgtcgataaattattggcattggcgatggaatttcaccctgtcaagatttgcacctcgcctgataattatgcacaattaagccaaaaagttactgatgcaggattggatactatcatactttcaggggatgaaggtttgattgagattgccagtgatgaagcggtagatacggtcgtggcagccattgttggtgcggcaggtctgtcgtctacattggctgcagcgggtgcaggcaaaagaattttattagccaataaagagtcacttgtgatggcaggtgatttggtcatcaaaactgccaaaaaacacggtgcaaccattttaccaattgattcagaacacaatgccatttaccagtgcttgcctgccgccattcaagcagataataccgccattcaccatacatcctatggtatcaaaaaactgtggctaacagcttctggtggcagctttttggataagtcaatcaaacaaatgcaaaatgccagtgtcaaagaagcggtaaatcaccccaattggtcaatgggtcaaaaaatctccattgattctgctacgatgatgaataaagggcttgagctgattgaagcttgtcatttatttgacctaaaagagcatcaaattcaagtggtgattcacccaaatagcgttgtacattctttggtggaatatgttgatggcagttttttggcacagttaggtacgcctgatatgaaaacgcccattgcacatgcattggcatatcctgagcgtatcaaatcaggcgtcatgcctttagacttgtatcagcttggcagtcttaaatttttggcaccagatttggataaatttgcctgcctaaaattagcacgatatgccgcaagattgggcacgggggcatgtattgcactaaataccgccaacgaaattgcggtagaggcttttttagcagaaaaaatttgcctcacagatattgctgtgattgttaaggcttgtctagatgataagacaattgcccaagattattcacaggattttggtgatgaagtgttagggcttgagcggatattgacgatggataaaaaggttcgtaagattgccacggctaagataaagttacttaaacaaggtgatgtgttatga

SEQ ID NO: 220 - DNA, 282 bp, M.catarrhalis
ttggtatcaatgatgaaaatgatgggtttaactgtggtatataaattaacccctaattttaccacaaccctatcaaataaagctatgataaaccgccatatcacccaacctattaacatagctttatcacttatggtctataaatataccaaagtagacagccattttatgatacaatacaagttcatctaccaagcgtacattagcgttaaaaatctgagttgcttggtggtatttatgatattttggctgttggtgtgtgatttttactcaagtatctga

SEQ ID NO: 221 - DNA, 246 bp, M.catarrhalis
cttattatgataaacaatagaaaagtcatgaaaccttttataaaatgggcgggcggtaagaattctttgcttgataaaattcaaaaacgcttgcctgattttgtttactcacaagatttttgtttggtagaacctttcgttggtggtggggcggtgtccttatgggcattgtccgatttgccacatctaaaacagcttatcatcaatgattataatgccgatttaatcaatgtttacccacattag

SEQ ID NO: 222 - DNA, 231 bp, M.catarrhalis
cccataaggatttatcatctgatcgacttttgtatcaacgaagccatcttgtctgctaacagcgtttggcttgatttgagtggtatcagtgatgacattggcagcataagatggcaaactcatcacaaatggcagtataaagatgcccaaagatatggcgctaaatttggtggtatgcttcaaactatcttccaaaatctcaataatacggcttattgtagcacagcttaa

SEQ ID NO: 223 - DNA, 192 bp, M.catarrhalis
aaccggcaagtaaggggaaaaattaacccaggtgatttccaaggcaaatcaggactaaaaatttgggtatataataatccagtgaagcaggcaaaagttggggcaaatattttatgtgccaaaaaaaaagcccgtcaagaccgtgcacaatcaaagcagttcatgcccaattttttaaaaattattttttaa

SEQ ID NO: 224 - DNA, 297 bp, M.catarrhalis
  unsure (198): Identity of nucleotide sequences at the above locations are unknown.
aaattgcctttaccccgattgggatttggctgggctttggggtgggtagcttttcttttattgtccgggcagtgcaacccgtccttgctgaacttttataaaaatttaaaaaaccgcaccggtgaagggtgctgggcccttgaacaccattttgccggtggaatttaccccaaaattaacccaccaatgcttatacgngcttggaagaagtttgccttcggcccccaggggaataccggttcaaggatttttattcgtgggaaaaatccccaatcaaacgggaatattgccctttaa

SEQ ID NO: 225 - DNA, 495 bp, M.catarrhalis
agctatcttttgaatttatcaccaagtatccatcgtatcattaggattgttatcatgctaaatcagccaatacccctcaaaaatcgtgcacgccgagtgatgccattttttgggctaagtatgggtattagtatctttgcacttggtttgttggtgattttaccctttttgatgatgattttgacgacattacaaatgagttttgatgacatcatgcagacgattcgtgagccacaagtgtttgcagcaattaagctatctttatccatggcaatgcttgccaccctgactaatttgatttttggtacgctggcagcttgggtgttggtgcgttatgagttttggggtaagtcctttttaaatgctttggttgatctaccgtttgccctgccaacagcggtaactggcatcgctcttgccacactttatgcacccaatggcttgtttggtcaatggtttacacaccttgggatactgctgttaatgagcccataa

SEQ ID NO: 226 - DNA, 813 bp, M.catarrhalis
tcacaatgctataagcttgatggtatttttatgaccgaaacgactgttaaaaattttgatgatttaccactatccgagccaattttaaaggcggtgcaagcattaaaatttgatcaattaacccccattcaagcacagattttgccacatacattggcaaatcaagatgccattggacaggcacaaacaggcacaggcaagacagcgacatttttgattaccatcattgagtcgctgttaaagcgtccgtttcaagctgatgaaattcgctatcttggcgaacctagagcattggttttggcacctaccagagagcttgcacagcagattttggcagattgccgtgaactgacccgatttagccagctttataatttgtgtattacaggcggctctgattttgataaacaacttgagcagttgcataaaagaccgctggatattttgattggcacaccggggcgtatcattgattgggtgaataaaggcgagctttttttggatcgtgttgaggtatttgtgcttgatgaagctgatcgtatgttggatatgggttttatccctgatatcaagcgtattgtcagacatatgccaagcaataccgaacgccaaagcctattattttcggcaacttttaatcaagatgtgatgaatctggcttatcgttggctacatcagccagcatttgttgagattgcacctgaaagtaaaaccaatcaggcgattgatcaacaattttatttggtcactgagcgtgaaaaaacgagcgcacttaagcaaattttggcagatgattcggtgaaaaaaacgatc

SEQ ID NO: 227 - DNA, 468 bp, M.catarrhalis
tctaaaataaactataaagagatgactatgatgatgaaaaataaatggatgcgtggtttggcgattttggtgttgagcttaccgacagtgacttatgcaaaaactgctgcccccaaagcgtctgaagcacctgaagtatcgttaacccaagaagagcaaatggctatagatttttgtgatttttcagcgtatggtgtgatgcatattgctggcgatcatcaaggtggtgcaacaaaatctgaggcactaaccaaccatgataagcgtatggctgagctgaaggatctcatcgaccttgacccagagaccgccacgatgcttgataagtattggaaaggtgctattgatagaatattccaagaatcggttcaaaaaaccgacgccgaaaaacaagcgtttgtgatgggtgtgggcgagtcatctttttattcttgccttgatcaagtgcttaaaactcccaaaaactaa

SEQ ID NO: 228 - DNA, 1533 bp, M.catarrhalis
agcgttaaagcattttggatgcttgatgtaaaattatgctttgagttattttgcaatatgttacaatggtcaaactttttgaacctaactttcgagcattcaatgggttttttgtcaaatttcttctcaaatctgggtgcgtctttatggatgcttgtcggtagtgagcgtgcttttaggcttacgaagccgacttttgctcaagcagtcgcttttatggtggtcgcattagcagcaaatattttatttgcttggcttgctgcacccaatgacagttattttaatgagcaaggattaatcagctatttggtttggccaaccatcattgttgctgcaggtatcatcattgcacagcggtcattaaattacgccttgttatttgtaccagcaatattatggctggcggcagatactttgcttgttttatttcaaagtggcatacaatttcttgaaaatgaaagcctattgccgttttggcttcatagcattttgcccacattgtttttattattatttgtatggcagacagcggcattattactgatttttgctaagcgttttaattggccttggtatgaaaccgtcttgatgttgattgcaagtattgtcttattggttgtttggcaaaaaaacaccatcaatcagcctattttcaagatggatgaggttttggtggagttagatgagttggtattttatgagcaagcagcacaactgcccaagcagttgcaagcgatgaaggcaggtcgcaagggtcggcatgaatggtattttttgggggcagccagctacagcgagcaagatgtctttgccagtgagatcattcaagcacgccaactatttgatgtcaaatttgatacggcagggcgttcgattgctttgattaacaacccaagcacttggggcgagtaccccattgccacacgcaccagcattgagcgaagccttgagcatatcggcggactgatgaaccctgatgaagatgctttatttttggtattaagctcacacgggtcggtcgatgaacatggtgagccgattggtgaattggcggtaacaaatcccccgatgaatttgcgtcagattgacccattttggttaaaatccgctttggataaatcaggcattcgttggagtgtcattgatgtttcggcgtgctattcaggcacttttatcaatgcgttaaaagatccttatacgatgattatcacagcgtctaaggcggataaagcttcttttggctgtactgatgatgcggatatgacttattttggtcgagcattttttaatgaaagtctgccacgctcagatggggtaatgacagctttttatgatgccctgcccaagattaaagagcgtgagattttgatgggttttgaaccttcggagcctcagttggttattggtgaagccatgcagcttgccctacctgagctgcaaaaggcgttatttcatcatcaggacaatccaaatatcagcattccttatggattgattgataaagtgacggataccaagtctgtcttgaattaa

SEQ ID NO: 229 - DNA, 810 bp, M.catarrhalis
tctgtatggcaaagaaatgcattgagtttatttatgtcaaatttcattagcaatcaatattatcgtactaaagcagcatttggattgacaaatactttattaaatggttttcagatgctttatgaatcaaaggcatatcgctctgatgtaccacgcaatcgattgatgccctatgtaaaaaaattttgccaaaaaatggcaaattcatttggtgtaactgtgattcaaattgagccagttccacaaaggcacgggctttgggtcagtaatcatgtctcttggcttgatattcctgtggtgggcagtgttgcacctgtctttttcttgtctaaggctgaaattggtaaatggccaatttttggacgcttggcaaaagcaggtggcacgctttttattcagcgaggctcaggagatgtgggttcggtgagtgatcagattgcagagtttttgagtgaggggtcatcggtcatttttttccctgaggcgacaacgacagatggtaagcagattaagaaaatttatggtaaattattaaaagctgctattgataccaacttaccaatctgcccaatggtaattgcatatgtggataaagaaggtgggctgtccgataaagctgcttattatggcaaacggactatggtgcaaagtttaaaatcagtggcagatgctcgagggattacagcgtatgtattaccccttgagccgatttatcctgaaggtcgagatcaccgtgaattaactgaggttttgcaagcagtgatgcaaaaaggcctaacagacttgcatgggcgcgtactagcagcctaa

SEQ ID NO: 230 - DNA, 189 bp, M.catarrhalis
  unsure (136): Identity of nucleotide sequences at the above locations are unknown.
aaaaatagaaaaaattacgcccatcaaccccaattcatcccagcggttcaagaaatcgctatgacgattgagaaacttattgacataatcctaaatttgcagaatttaaaggtgtttgagcgtttttgtgagccanaccgcattataagctttcgtgtgaatttggaaaaagaaccacgggcagggtga

SEQ ID NO: 231 - DNA, 867 bp, M.catarrhalis
aaaaattacctgcggaccatcggcggggaaaatcaatgtttgggcccaaggacgcctggatttaacggtgttcagcttgccattttagtcaaagaacccgccttatttgttgcccgccgaaataaagcaagggttatatggattattttaggaatgccaaagataacggtttatgggcctgaacgcaaatcgatggtacttcgtaaaaaagaacccggtgcaacagcgtaccaagaagcagggcatgcattggtggcagagctgttacctggtagggcccccgtacataaagttaccatcatgcctggtggttgggctttgggtgtgacttggcaattgcctgaacaagatgcgatcagcaattataaagataaaatgcttaatgaaatctccattttgtttggtgggcgtatcgccgaagaaatctttgtaaaccgcaaatcaactggcgcatctaatgactttgagcgtgctaccaagcttgcccgtgccatggtaactcgctacggcatgtcagatgagttgggggtgatggtctatgaagcagaagagcatggcggttattttggcggcagcacccgcacaatctcagaggcaacacagcaaaaagttgatgacgaaattcgtcatatcttggaagctcagtatggtgttgcttatcagctcattgatgaaaatcatgacaaaatgcatgccatggttgaagcacttatgaagtgggaaaccatcgatcgtgagcagctattacaaattatggcaggtgagacacctcgtgaacccaagaactatcagcacatcgtgcagacacctgtggcagccgaagaacctgccgatgacgatgctttaccgccgccattgccagtgtga

SEQ ID NO: 232 - DNA, 2040 bp, M.catarrhalis
catttgcttgaaaaaatattcatcatccctatcttgataagcgaaaacgaaatcaagtatttgatcaaatactcattacaattgttatgttataggaagaaaattatgaccaatcctaccgctcatcattttgaagctgaagtgtcacagctattgcatttggtgacacattcactgtattcaaatgctgatatttttgtgcgagaactggtgtcaaatgcctctgatgcttgtgataagctgagatttttggcaacctctgatgatggcttgtatgaaaatgatggcgagcttgcgattcgtatcgacattgataatactgccaaaaccattacctttagcgataatggcatcggtatgaacgaagaggatgccattgagcatttgggtacgattgcaaaatctggcactaaggcatttttggataaattggctgatagcgataaaaaagatggtcatctgattggacagtttggcgtcggtttttattcaggatttattgttgctgataagattgttgtagaaagccgtaaagcaggcgaatctgctgataaaggcgtgcgttgggtgtctgatggtacggggcaatttaccaccgagagcattcataaacccaatcgtggaacatcaattacgctatatcttaaagatgagtatgctggtggcggcgagagtgagacaaattatttaaacgaccagcacataaaatcactggtaaataaatactctgaccatatcagcctgccgattcaaatgcataagcaaatttggcaagatgagctgggtgaagatggtgaaccgacaggcaaaggtgaatacattactaccgatgactatgaaacagtcaaccaagccaatgcgttgtggacaaaaagcccaagcgatattagcgacgatgagtatcatgaattttataaaaacttaagctatgattatgccaagcccctagcctatacgcataatcgtgttgaaggacgagtgcaatacacgcagcttttatttattccaagtaaagcacccatggacttgtacgctcgtgaacagcaacatgggctaaaattgtatgtcaaacgagtatttatcatggaagatgctgagcagttattacccatgtatttacgctttgtcaaaggggtgattgatactgctgatttgccacttaatgtcagtcgtgaaatcttgcaagaatcacgagatgttaaggcaattcgtgagggtaatgctcgccgtgtattgacgctactatcaagtcttgccaactctgaagatgctgataagcaacaaaaatttgccgatttttatcaagaatttggcgatgtactcaaagaaggtttgggtgaagatcagaccaatcaagaacgcattgccaagctattgcgttatgcaaccagtaccgatgataagattgcaacaggttttggtgattataaagcccgcatgaaagatggtcaaaaagccatttattatctcaccgcagataacttggcggccgccaaaaacagtccacagcttgaattattcaagaaaaaaggcattgaagttatcttaatgactgctcgtgtggatgagtgggcaatgaactttttacatgaatttgatggtacgccattgcaaaatattgccaaaggtgctgttgacttgggtgaattgaccgatgaaaatgaaaagcaggaagccaagcaggctgaagaaaaaatgcagcctgtggttgaaaaattaaaaacaacattgggcaagcgtactaaagatgtgcgtgtctcaagccgtctggtagatagcccagcctgtttggttgttggtgaaggtgagcttacgccacagatggcacagatgctcaaagccatggggcaaagtgtaccagagattaaacctgtgcttgagattaacccaaaccatcctttgattgataaactgcaaaatagccatgattttgatgacttggcacaagtcatttttgatcaagctttattggcagatggtggtcagcttgatgacccagcaggctatctaaagcgtgttaataagcttttgatgggctaa

SEQ ID NO: 233 - DNA, 2376 bp, M.catarrhalis
caagcaaaagaatttatgtctaaaaacactttttctgcgtcattcatcgccattttatcaaaagttattttgggcgtattggcattatttgcaatcttaattttagcatttcccattgggttttatggcatggtcatgtatcttgagccaactttgcctgatgtcaaaaatttggacaattcccgctttgagatgccgctacagatttatactgccgacaacaaactgatcggacaatatggtaatcgctactctttgcctgtcacctttgacgaaattcctgagcgtatgattcaggcatttttggcggcagaagacgatactttttttgaacacagtggcatcagtgtcaaaggcatgggacgagcattgaccgaagttatcagtgataatgacgctcaaactggtggttcaaccattaccatgcaagtggcaaaaaactattttttaagccctgagcgtaccattaatcgtaagctgaccgaactttttatcgcccgcaaaattgaaaatgaactcacaaaaaatgaaattttaacactatatgttaataaaatttatttaggtgaaggcacttatggtattcaagctgcagcacgccgctattattccaaaaatctagaaagcttgaccattgcccaaatggcgatgatcgcaggcttaccaaaagccccttcggcctacaatcctgtcgttaatcctgaacgggctatggagcgacgcaactggattatcggacgcatgcaccaagaaggctttattaccgcttctgaaaaagatgccgccattgctgaaccaatggggctaaatatctatcaagaaaaacttgatctaaatatgccttatgttgcagagatggtacgctccactttggttgaccgctatggtgaggcggtgatggattcaggttggcgtgttcaaaccacaatcaatagtagctcacaacttgcggccaatgctgccttagtggggggtttgcgtgattatgaccgtcgtcatggttggcgaggtgttgaagcagaatcagggtcgcttgaaggtcgtaaaaattttgatcatatttatcctgccaaagttactaaggttcataaccaaagctttgaagccaagcttcaatctggagaaaccgtaaccatcggttggtcaggtatgaattgggcgcgtcgctactatgatgctaaccgtgtcggtggtggctacagtaatgctcatcagatggtcaaggttggtaatattgtgcgaatctctccgatcaatgaagcaaaaacagcttggcgtatggaatctattcccaaagttcaaggtgcattggtctctttagaccctgaaaatggtgctttgcgtgccgttgttggtggttttcattttaatcacagcaaatttaatcgtgccatccaaggctatcgccaaccaggatcgatcattaagccttttatttttgctgcagcacttgagtctggtcaatatacgccagatagcttaatctctgatgctgccattcgtgttggtaggtggcaaccaaaaaatgccgatggacgctacacaggcgatatgacactacgccgtgcacttactttatcacgcaataccccagccattcgcctgctgcgttcagcaggtgttgatgaatctcgccacctaatgaatgccatgggtggacttgagatagaacgcatgccgtctacattggcattggcattgggtgctgctgacgctacacctttacaaatggcaactggttttgctaccatcattaatggtggtcatcgtatccagccttattttatcgaaagaatctataattttgacaatgaaaccatctatcaagccaacccacagcaagcctgtgcactttgctttaatgaaaatctttcggcaactaatgccaaattgcttgaattatttgaagccaataaatcagagatttctacagacacgcctagcgcaccagctggcgataggctacaaccaagaagcgctccacaatatgtcgctgccactcaagcaccccgcgtgctttcccaccaaacggcttatgacatctccaatatgatgcgagaggttattactagcggtacgggtcgcagagctcgtgctttgggtcgtagtgatgttggtggtaagactggtaccactaaccttgccaaggatgcttggtttgcaggctttcatcctactaatgtggctgtggtttgggtgggttttgatacgccatcaactttaggaaatagtgagtacggtggcgtggctgcattaccaatttgggtgaattttatgagccatgaacttcgcaacacgccttcgcaatggatcagtcaagaagatcggtcaaaagccgtcaaagcgacccaacaagttattgatttgaaagattaa

SEQ ID NO: 234 - DNA, 1755 bp, M.catarrhalis
cacaaaaaccctaacaatgacttacttatattgcaatttggatggtttatgctcatttctttgacttttgaaaacttagcactcattgagcaaaaacacattgattttgatgatagattcaatgtcattacaggcgaaacaggtgcaggcaagtcactgattttagatgcattatcgctgtgtgtcggtgaacgtgctgatagtagtatggtgcgtcatggctgtgatgaggcaagtgtttttggtgaatttgatatcagtggcaatgcccaagtgattgcttggtttgagcaacatgacagaaaattagaagatgaaacgctgctcattcgccgaaaaattagcaatcagggacgctcaaagtcttggattaacggcgtaccagccagtatcagtgagctaaaaagcttgggatctatgcttgtgaatatccactcgcagcatgctgggcttgaactgctaaagcctcaatttatcgtggattggctggatcgcattggtgggtttggtgatttaaaggcagcggctaagaccgcttttcatcactatcaaaccctaaaaaggcaggctgatgacgcacgcagccagtcagcacagcgagcggatcggatggcactgttgtcagccaagcttaccgatattgaaccattgcttttggtggattttcaggaaattgaggcagaatacgatgagctatccaatcttgaaagtctcatgcgtgaagccctagaagcagcggtacaacttgataatgatgacgatgccccatcggtgctaagcctacttgggcgagcgatgcgtatttgtgataacaacgctcaatccagtaaaacatttggcgaatgtagtcaactgcttgtacttgcccaagagcaaatcatagatgccgttgctaagcttaccgattacgcagagcgggagctgcctgatgcggcgcgccttgatgagctaaatggcttattgagccttgcacatcgcttatcaagcaaataccacacgccgattactgagctgattgctgatgcagtgcattggcaagatgaattggatatgctaagcagtttgcctgataacgatacgatggatgctaaggttttagaggcttatcaagcctatctggtggcagcagacgcattggatcaggcacgcattcaaatcgcacctgatgtctgtgagcggcttgaggcacggcttgtgcctttggcactgccaaatgctcgctgtcagttttcttttaacgaaaaacctgttgagcattacaccgcccaaggcaaatacgatattgccttactatttagtgccaatgtgggcatgccacttcagccgttgcacaaagttgcatcaggcggcgagttgtcgcgtatggcactgaccatgcaagtgatggcggcggatgatggcataggtgcacatccaacacttgtatttgatgaggtggatgtgggcattagtggcgggacagcccaagtggttggcgagcttttgcgtacgctgggtaagcagcagcaactgcttgccatcacgcatcaagctcaggtcgctgctgcggcacatcatcatattttggtgtataaagaacacggtgaacacaccaaaagtcagatacaagttatcaccgatgaagcacaaattgatgaattggcacgaatgtcaggtggcgtgaatattaccgaagcgacacgtgctcatgttaaaagcctgctggcagacattcgccatgctgataagatggctcaaagaggtatggctacatga

SEQ ID NO: 235 - DNA, 198 bp, M.catarrhalis
gcttttcaagccattaatggccctggcccattcacccaaaacaaaaccattccgggtctttgttcaaaagttgggctggggcgtgttggctcatcatttcgtgttgaaagtgcaggattcgcccaaaagcttgatagcccaagtggcgttgaggctttttcgctgccaccaaccaataccgcatcacagtcaccataa

SEQ ID NO: 236 - DNA, 585 bp, M.catarrhalis
tatcgtatttaccaccgagataacaaaattatggcattattacctattttaacatatcctgacccacgcttacgcactttggcaaaacctgtcactgtctttgatgatagattaaagcagttgattgaagatatgtttgagaccatgtatgacgcacgaggtattggtcttgcagcaacgcaagttgaccgccacatacaactgattgtgatggatttggcaagaaaggacgaaccgccatcaccgcaggtatttatcaatcctaaagtgacaccgctcgtagatgagcattcgtcttatcaagagggctgtttgtctgtaccagaggtttttgataccattgagcgacccagccgtgtacgcattgaggcacttgataaagacggtcagccgtttgagatagaagctgaaggcttgttggcggtatgcattcagcatgagatggatcacttaaacggtaagttatttgtggattatttatcgacactcaaacaaagccgtgcaagagataaagttaaaaaggcactcaaagcacgagaaaaaacagtaaacagtacaactgataacacacttaaaaatagctaa

SEQ ID NO: 237 - DNA, 858 bp, M.catarrhalis
gataaaactaagcaaactgaattaaaatttggatacatcatgacacagtcagcaaaaaacaagtctgccaaacctgcttatcatgaaaaaagcgatgcagcacgcattgtcattacaggcatgggagctttaacgcccatcggaaatagtttagatacaatttggcaaaatcttacccaaggtgtaagtggtatcagtcgccttgatggatttgaggataaatcggtagcgattgatggatttcgtgcccaaatcgctggattggttaagaattttgatgccaaagattatttaaatcctaaagaagcccgccgttttgatacatttgtacattatgcccaagttgccgctgccatggctttgtatcatgcagggctgattgatgatatcaaaggtgatagcttgcccatcaatgtcgatggcgagcgttttggcgtggtcatgggttcgggcattggcggtattcaaaccattgaaacaagtcgtgataccctaaagtcctatggtgcaaaaaaagtatcgccattcatcattccaggtgccatcatcaatatgccagctgggctgattgccatccgtcatcatctcaaaggtgcaaatcttgcaacgacaaccgcttgcaccacctcgacgcacgccattggcttgggggcaagactgattgcttatggtgactgtgatgcggtattggttggtggcagcgaaaaagcctcaacgccacttgggctatcaagcttttgggcgaatcctgcactttcaacacgaaatgatgagccaacacgccccagcccaacttttgaacaaagacccggaatggttttgttttgggtgaatgggccagggccattaatggcttga

SEQ ID NO: 238 - DNA, 273 bp, M.catarrhalis
attttatccaaaaaccagagtaacaaaacaaccatggccatgattaaccacacattagataccaaagggctgatttgccccgaacctgtcatgctacttcataagatcattcgccaagcgcttggcggtgagcatattgagattttggcaaccgatcctgccacgatgcgtgatattcccaatttttgccgttatttggggcatacgctggtcaatcaagaaacactcgatgacggcagctatcgctacttagttcaaaaaaagcaagcataa

SEQ ID NO: 239 - DNA, 504 bp, M.catarrhalis
gttcattacaacaactggatatgcctaatgacaagcgaaaccttgacacttgctttagattatggagtcaaaaaaatgggcatggcactgggcaatagcatcacccataacgcacgcccctttgatattttggcgatgaataatgggcaacctgattgggataatctgcttggtataattgagcattggggtattgatagggtgctggtgggactgccgctgaatatggatggcaccgagtcgatgctcaccaagcgtgctcataaatttgcacggcgattggcacatcggctgggcgagcgtcgtcaggcggtttcggtgtttatttatgatgagcggcttagctcaaaagaagccaagatgattgcacttgataacggctggattgcatcatcatctgaaccaatcgacgatattgccgcatgtcttttgcttgatagctattatcatgcacctaatcatgccatctatgtcagtgaacgaaaagactctcacaaagactga

SEQ ID NO: 240 - DNA, 582 bp, M.catarrhalis
gatggctcaaagaggtatggctacatgacacagacccaaaaactgattcatcattttttgattccaagtccacagatgactgatgaaagatttatggatgctgtcatttatatctgtcgccataccaaagatggtgcatggggttttattattaatcagtccctgccaaatagcgtaggcggtcttttgactgagcttgaggtgccagtgactgcaagcaccatgcaagtacctgctatgaatggcggacctgtacgccctgaggctggttttattttgcacacagggcagcccatttataagtcatcttttgccatttctgaaaatgtctgcttgacgaccagtaaggatatcttggagcggttgtcttatgatggtttgaggcattatttattgtgtatgggctattgcaattggggcagaggtcagctggatgctgagatggcgtttggtgattggtatgcttgtccagcagacttgccaactttattttcaacgccatttgaagacaggcttaaggcttgttatgataagattgggattaatctgaataagttcattacaacaactggatatgcctaa

SEQ ID NO: 241 - DNA, 927 bp, M.catarrhalis
gcgatggcaaaatctaccatacctcgagccgatagtgcggtgatctatgacgacgacccagagtatctgagtgaatttcgtgcagcaatgttggcgcgtgggttgtcgatagccaccagaaatgcgtatagccaagatgtacgcttgtgcattcgtttatcagatacgccagtgaatctatggcagccatcagatgtgcgtaatcacttgatgtgtctaaaagatgccaagaaatccgagcggtctatcgcacgcgcgttggcaagtctgtgccagttttttttgtggcaaattgagtcaggctatcgagaggataacccttgtgaatccatcaaaacacccaagcttggcaaaactttgcccaaaacgctctctgagcaagaagttagctcactactagatgcaccagacatctcaagcgtgcgaggccttagagataaagccatgcttgaggttttgtatgcgtgtggcttgcgtgtcagtgagctgacaagtttatcacttgagcatctaaacttaactgctggttggctgtcggttacaggtaagggtaataaaatgcgtctgattcctttgggagaatatgcactgtctgcactcaatgagtatttggctgtgcggggcagtttgctgattggtaaaaaagactgtcaagcggtatttttgaccgaacaaggtggttacatgacacggcataatttttggcatttgattaaaaaatatgccttaatggctggtattaataccgccatttcgccccatacattgcgtcatgcctttgcaacgcatttggttaatcatggtgctgatttacgcagtgtacaattattgcttgggcatagtgatttatccaccacgcagatttatacacatgtggcgaccacaaggctacaaaatctccatgccaagcatcatcccagagggtga

SEQ ID NO: 242 - DNA, 309 bp, M.catarrhalis
aaatgtatgaaaaatccatttcacttgacacccaccccacgcacttgcccacatggtgattgtggcaagatgttttgtgatgcgatttataaacatggtatcatcttttgtctgcattgccaaaaaagcctattggtcaatccatttacgcctgatttgcagcaaatgactttttggcaatttgtcaaagatttcaccaaaagatattataaaatatatgttgtttgtactggcatgcccatattgatttataccgccatatttgcttttgatggtttagataaattcaatcttacaacaggattttag

SEQ ID NO: 243 - DNA, 510 bp, M.catarrhalis
acgaaaagactctcacaaagactgattttgtcaggaaaagctatgcagcaccatactttgattgctcatcaatttgaccaagccatacgccaagcaaccttaagtgtccgttttggctttggggcgattgtatgcttttgtatttttggaactttggcaagcctacctgcattcaaagacagcacatggatttattatgcctttcattatttgccgtacgcactcatcgccatgacgatgcccatcagcctgtatcacggctttttattgatgcgttatcgggtgatggacggctcaattttggcggtcattttggcaactgggatagcgctgcttggatttacggtcgtgtggggattgagcattggcatagatacggtgttttttatggcactatttttggcgatgattgcttggtttgggatgccgtttttatttcgggtcaatctaaaaaaatttgccagttttttggaagaaaaatcttcaaaatcaccccaagagccaatttaa

SEQ ID NO: 244 - DNA, 1086 bp, M.catarrhalis
gattgtagaggattacttatgagcattcatacaacggtcgccagacgcccttcatggcgtggcatttttgcaggacttttgatgggtcttgttgtatctatgataatgctggctttggccctagtgctaagctcttttttatcactagatttgcgtggggcaggtattgctgctggcgtttatgccgcagtaaccgctttaatcagtgcttttgttgcagggttttttgctgtcaaagcatcggcaccagaggcgttatttggcgatggtaccgacattttgccaaaagacgctgctttaacaggtatgctaaccgcagcagccatcgttgtcatcagctctgtatttgcttttaatagtgtaactggcattgtaagaactgctggcaacgctgttggcacaaccgcaggtgctattggaggggctgccagtgccgttacatcaacggtaacaacagtagctggtgctggtgctaccgcagcagctggctcatctgatgccgcaggtggcgatatcactgccaaagcacaagagctgtaccaaaaagccacaggcaatatcagccgtcaagacatcgaagcttgggttgctaagaataacgaaacttttgatgaagcacaaatcagtgcaacagtgaatgtacttgaagacatgcttaacaaaaccaaagctgaccttaatggcatggattttaccaatcttgacacatggaaaaatattgatgaatatgccaagcagcgtgccgacgaggtacaagccattgttacaggcgatgaacttattgccagactacaagcagagggtttaacccaagagcaggcgttggaagtgcgtgaagaaactgccaccgcttatcatgaatatcgtgccagcaccgaacaagccattgctgatgctaagatgaatattgagcaaactctacaaagtgcagaagatactgctcgtaaagctgctctatactctggtctgttttggttgattagcacgctactgacttttgtggcaagcatcatgggtgcaaaaacagccgcagcaaattaccgtttggcatcacccatcactgttcgtgagcgtgaccttcgttaa

SEQ ID NO: 245 - DNA, 636 bp, M.catarrhalis
ggggttgttatgactaaagttgcgttacttgattatggcgttggtaatctgtattcggtcgctaatgcactcaaagtggcaggtgctgatgtcatcaccaccgatcgagccgatgatattaaaaaagcagataaaattctgctgccaggtgtgggtgctatgcgtgatgcaatggcacatatggctaaacatggcattgatatcgccgttaaagaagctttgaataccaagcctgttatggcaatttgtgtcggtatgcaggcgatgtttgatgtctcagaagaaggcgatgtcccttgtttgggcatcatttctggcacggtacgcagatttgatgacgcttggatacaaaatgatgaaccaatcaaaataccgcatgttggctggaaccgtgttgatacagataccgatcatatgctatggcaaggctgcaatcatgagtatttttatttcacgcacagctattattgtgaccccacgccaaataatcagctgattttagcgcataccacttatggtcagaagttttgttcaagtatcatttgggataatctttttatcactcaatttcatcccgaaaaaagccatcatgcaggcttaaaactgttgtcaaatttcattacttggcaaccttaa

SEQ ID NO: 246 - DNA, 621 bp, M.catarrhalis
ttaagaaaaattatgaagttgatttatctacatggattagatagtgatagcaatgcaataaaagcacaaatcacacaaaattattgccaagctaactatccaaatatcgaagtcattcgacctgatcttaatcgtacacctgatgaggtggtcaagctcttaaaatctctgatcattgatgatcgaaataccgtcttaattggttcatctcttggcgggtattttgcgaatttattatctgatttgacgggtgtgcctgcggtgctgctcaatcctagtatctggcctgatatcagttttcgccgatttttggatcaaaattttgatgaacgtgctttgtctgatgagacagtgatttatacaacagcgggcggttggcagattacttatggtgatttggcatggtttgagcggcatcgattggctgttaaaaatcctgatttaatcaaagtattacttaagatgggtgatgagcttttagacgcacaggtaacccaagctttttatgatcaaaaaggcgtgcaagtattggcacaagcaggaggcgatcatcgtattagtgattatgaagtgcaggtggcaacagtgattgactgggctatccgattgcatcaaagatag

SEQ ID NO: 247 - DNA, 1914 bp, M.catarrhalis
cctatatttttatccataatatttatgagcacatataattcacaaaaattagaagttttagaaggtttagaaccagttcgccgccgcccaggcatgtatactgatactatgcgtcccaatcatcttgcccaagaggtcattgataactcggtcgatgaggcattggcaggatttgctcgtcatatcatcgtcattttgcataaggatggttcgctgtctgttgaggatgatgggcgtgggatgccgaccgatattcaccctgaatttaatcaatcaggtgttgagctgattttgacacgcctgcacgctggcggtaaatttagcaccgaaaactatcaagtctctggtggtctgcatggcgtgggtatcagtgtggtaaatgcattgtccacacgcgttgaggtgacggtgtggcgtgatggactgatgcacacgatggcatttgaacacggtgagcctgttaccgctttgattgctgataaatcagccaataaaaaaaagcgtggtaccaaagtacaattttgggtggatgggcagtattttgatacgccaaaattttcaattaaaacccttaagcataacctaaaagccaaagcagtgcttgcagcagggttacacattgattttatcagtgagattgagccaaatgacagtgaaagttggcagttcaccgatggtgtggtgcaatatctgaccgagcagctggatgggtctgatacattacctaaagagccattttatgttagccaagagcctactttgggtgagcgtggcggggcgacttttgcgttatcgtggcttgctgagggcggtacaccaattaccgaaagctatgtcaatcttattccaactgctcaaggtggcacgcatgtcaatggtttacgcacaggtgtgcttgaggcactgcgtgagttttgtgatattcataatttattgccgcgtcaaatcaagctgtctggtgaggatgtgtgggatggcgtcaactacattttatcgctgaaatttgttgaaccgcagtttagtggacaaaccaaagaacgcttatcaagccgagaagctgcgccattggttcaaaccttggctaaagatgcttttagtctttggctaaatcagcatccagatcacgccaaagccattgccgaacttgccatttcaaaagccaccaaacgcctagcaactgcacaaaaagtggcgcgtaaaaaagtcactcaaggaccagcactaccaggtaagctgtgggattgtcgtgggggattaaaagaaggttcagagctgtttttggtggaaggtcagtcagcgggtggatcagcaaagcaagcgcgtgacaatgcatttcaggcaattttaccactgcgaggtaaaattttaaatgcttgggaggtgtcatcagatactgtattgtccagccaagaaattcatgacattgccatcgcgattggtgtagatcctgcatcagatgatttatctgagcttcgatatgataaaatctgcatcttagcagatgctgattcagatggtctgcatattgcgacactgatttgtgcgttatttgtgaagcattttcctgcactgattgaagcgggtcatctgtatgtggcggtaccgcctttgtatcgtattgatgcaggtaaggatgtgtattatgcactggataatgaagagcttgaacaagtacttgcaaggcttggtaataaaaaaacgcaaatcactcgctttaaggggctaggtgagatgaatccaagtcagcttaaagaaacgacaatgaaccctgatacacgcaagttgattcgtttggatttggatgataccgcaagcacaaacagcatcatggatatgctgcttgccaaaaaacgctcagcagaccgaaaacagtggctagagaccaaaggggatttggcggatatttctgtttaa

SEQ ID NO: 248 - DNA, 669 bp, M.catarrhalis
tcacgactattggcaattttaggcttttatgcaagaatagcggtgaattattatccgtcttatttttcaaggattatcatgactcgcttttctagtgttacaagaaataccgccgaaacccaaatcagtgtcaatatcaatttagatggtagcggtcaaggcgtgcttgatacgggtgtgccgtttcttgatcatatgcttgatcaaatcaagcgccatggactcattgatttggatgtcaaatgtgtgggcgatacccacatcgatgatcatcatagtgttgaagatgttggtattgcaatcggtcaagcactcaaacaagccttgggcgacaaaaaaggcattcgccgttatgggcatttttatgcaccgcttgacgaaagcctatctcgtgtggtggtggatatctctggccgccctggtttacacatgaatgtaccattcacacgctcacacataggctcgatggatgtcgatttattttctgagtttttttatgggctggttaatcatgcctttatcaccttacatattgatactctaaaaggtaaaaatagccatcaccaaattgaaagcgtatttaaagccttagcccgtgcattgcgaatggcggttgagtatgatgagcgtgccaaggatcaattgccttcaaccaaaaatatgctctaa

SEQ ID NO: 249 - DNA, 405 bp, M.catarrhalis
cctaagatattatcaaaaataaaaaacaaacccctactaaaaggcgtggataactatgatgacatcaaaaatgattttaacatctctgttgcccatgataaactagcaacctcttttgatacacatgcaccatattgtccacattgccaatctcaaagatttcacaatacagcagatgatgattatgtgtgtcaaaaatgccatacaaaatcatccctaaatccaaaattaaaaaaaacgaataccatccaatttgcatcaatctacaccatcttatttttgataatgagatatgtcagttttgatttttatttgtttatttatattttggctgtctttgtgatatttttaatcagcttatccattaactattattggtacaaaaccccaaaatggctaccttaa

SEQ ID NO: 250 - DNA, 219 bp, M.catarrhalis
catatctcattatcaaaaataagatggtgtagattgatgcaaattggatggtattcgttttttttaattttggatttagggatgattttgtatggcatttttgacacacataatcatcatctgctgtattgtgaaatctttgagattggcaatgtggacaatatggtgcatgtgtatcaaaagaggttgctagtttatcatgggcaacagagatgttaa

SEQ ID NO: 251 - DNA, 237 bp, M.catarrhalis
gattctcacccgctgccacatgcggaatacgcaaaccccgcttataaatcacgtacgataacaaaagataatcaacatggcttctatgacatggaacataaacaacctgataatctggtgcaagtgtacgcacacgctcaaaatgacgcacttgaacgccatcatacagccgtgtccaaagccaagttaaaaaatggtcaaaaaaacgcaccactgaatgtgaataattgctggtaa

SEQ ID NO: 252 - DNA, 915 bp, M.catarrhalis
ataaaaaagtttacacaccaaccaattgtcattagagtgaaaatgattatgaacaccattacccatgccatcattcccaccgcaggctttggtactcgtatgctgcctttatcaaaagctgtacccaaagagctgttgccactgggtgataaacctgctattcattatgtggttatggaggcggtgcgtgcgggcattaaaaccattgtgttggtcaatcatgctcaaaagcaggcgattgaaaactattttgatatcaataccgaacttgatagccagttacgccaaaaaggcaaagatggcttggcagatggcctaaactttttacccaaagatgtacgcattgtcagtgtgcgtcaaggttatccgttggggcttggtcatgcagtgctacaagggcgtgctgtggtgggcgataatccatttgttgtgctgttgcctgatgttgtgctagatccatttatgaccgattttagggcagataacttggcatatatgatgacaagatttgcccaaactggccgcagtcaaattttggttgaacctgtggcagatagtcaggtgcataaatatggcattgctcggctaaaggatcggcaaagtgtacaaaaatcggatgctaatcacccatttgatgtactgggttttgtcgaaaaaccaagtttggatcttgcaccgtccaatcttgctgtagtggggcgatatgtatttagccctgaaatttttgagtatttggcaaaaaccaagccaagcgtaggcggtgagattcagctcaccgatgccatcgatgcactcatcagccagcagggtatggatgtggtaacaataaaaggggcaagctttgacgctggtgatatgacaagctatattcaggcatttgcttattttgccagtcaagtcgatcagtcgttttaa

SEQ ID NO: 253 - DNA, 993 bp, M.catarrhalis
attcagttaaccaataacgttgccccaaggcccggcaatttattttggaatggttcccctattttttgggccaatttatcccaacgggcaccttttggggggcagtcattggtttggggcttgtctaccaatcccagtaggcttatcgtaatgaaagctggtgccatgagcaaatatcgtatcgtaagttggcgaatgttgcctcgggtcatttttgtggccaaatcgttgggtgtcaatcattttgtcttcccaccggccaataagcatgccgctaccatcagagcagataccatttatgataagcttatcacgattgatggctattggtcagtcaatcatgatggcgataatcaagatgtggtttatatcagctatgccgacaacgaaggtgggtttggagaggtcaaacgatatcagctcaaagatggtcagctaatcgctgcactcaaagcaaaatcaggcgtatatttgccacagtctgatgatgtgatgaatgcacaaaaagcccgctatacttggcagttatcaggcattgatgagattggcatcggtacatcacaagtgcaacaagcacacagcgaaggcaaaatactgaccttaccgattgcaccgaccgatgtgtatttattgaccaaagagcctgaagatttatcacttagcagtttgtacgcccacaggcagctcatggcacatcaaggcacacgctcactgcgtcatgaattggcattttggcaaaagctactttcgccctttgcggtgctttcgttagtattggtggcatcatcatttgtctttggttcactgcgttcccaaggcttggcactgcgagtggtcttggcacttttaacgggtcttttatttagttatttgactgatttgacgggctttgtggctttggcaacgggtctttcgccactgttaatggcactggtgccgatcgtgctatcagcgatggcgggtatgtatttactaaatcgcaaatcaagctaa

SEQ ID NO: 254 - DNA, 537 bp, M.catarrhalis
tgtatttattttaaggagataatgatgagatttttattagttggatgcttggcaaccttatttttacttgggtgcagtaataattctagtcaagaattagagacgaataccattgaacaatcaagcccaagaattacaataaaaaatgaaatgattgaagctcaaccgttgccagagacaggggcaactaacaaacctaatttgtatggcgattcacctttacaaataaaaaccaactcaggaagtcattattgggtaaaaattgtcaatgcttatgacgagcgagaagagctggtgagttattttatccgtggtggagaaacattagatgttactctgcccgcgggaagttatgtcgtgaaatatgcttatggagatacttggtatggcgaagagtatttatttggcgaaaatacaggttattccaaggcggatgaagtgtttgaattttatcacaatcaaggctatgtcattgagcttattcaacaattaaatggcaatttacacacaaccataattgacgaaagtcagttttag

SEQ ID NO: 255 - DNA, 339 bp, M.catarrhalis
ataatgctcgctattgcttgggcttgtatcaatatttttcatgtccgttgtccctgtgtttgtcataaaagcaatcaaaaatactatgatataccagccttgtcaatcacccataaaccgcacctttgccatatgccccaaacaggtcagagacatatggcatgggcggtgagggtggataataataaggtggataaagtgagtttggatcaagtttttataaattatccttatttggtttgggatttggatttggcatcatacacgccacagatgaattttgacacatcctctccaatcgtatctggaaccatcctattccaattgctggatgaataa

SEQ ID NO: 256 - DNA, 933 bp, M.catarrhalis
gcacctgaagctgtcaagacacaaatcacagatctattaaatactctacatctaaaacgcattggtgatgatgtttttgaaggtccaagttttgactatgttgggcctagagtgtttggtgggcaagtacttgcccaagcgctgcttgctggtgctaacacattaacgattgataaaccttgtcatagcctacatggttattttttacgaggtggcgatattcgtctaccagtcatctatcaagtacgccgcttgcgtgatggacgcagtttatcagctcgagaagtcattgcggtgcaatatgtgccaaccaccgacaaaaacggtaatcatacgaccaatgaacaggtcattttttcgatgattgcctcattttcacccatggaaggcgggcttgattaccaagaaaccatgcctgattatccaccccctgaaagcctaaaaaccgagcaagaactcaaagcggattatttacataaaattcccgaaccactcaaagcaagatttatgcgtcagcgtcatgtcgaaatccgccccgtcacaccacgagaccctgtgacacccaagcctgagcgtccacaccaagccaattgggtgcgtatcgctgatattggggagcagccagttgccattcatcaagcactacttgcgtttgtgtctgattattatttggtcagcacaggtttaatgagtcatgggctaagcctgatgacacaaggtctacaaatggctagtattgaccattccatacatttccatcgcccttttgatatgaccgaatatctactatacgacatgtggagcgatacctcaagccacgccaagggtctaaaccatggtcaattttggcaagatggcaaacttatcgcttcaacgcagcaagaggggttgatgcgattgcatgatgacccaagtatctttaccagcagctaa

SEQ ID NO: 257 - DNA, 414 bp, M.catarrhalis
atggcactggcggcgaattggatgtccactggtgttagtagtaatggcaaagagacctatgaagtggactatgacagtatctcggcttatcattttaatagttatgataaaaacagctattatgtcaccgcttgggtaaaattagattatcccaccgcccaaaaattaaaggatggtcgcttgtatcgtcaaacaaaaggtcttttgtatgttgattgcttgggtaaaagagtgacttggggtgatacggtattttatgacagtaaaggcaatgtggttgatagtgggcgtaattatgtcaatacttattcatccagcaattggaataggatggttccagatacgattggagaggatgtgtcaaaattcatctgtggcgtgtatgatgccaaatccaaatcccaaaccaaataa

SEQ ID NO: 258 - DNA, 183 bp, M.catarrhalis
  unsure (33),(86),(88),(117): Identity of nucleotide sequences at the above locations are unknown.
tattctttttacaacttgtcaacttctctcttntataacgttattacgtcaatatatattcaacgttcactcgcattactactccncnccgaggagacgcgagaggagagacaacanattggacgtcctttcagacccggtgaagacataattggtggaaccgcattacccacttgtacataa

SEQ ID NO: 259 - DNA, 228 bp, M.catarrhalis
gatacattttatgcatctggtctacatcccaaactatttacacaggaaacactaaagacagtggagcagatgacgctcaaaaaggcatcttatagtaatttgacagttaattttcgtcaagtgcttgtacaaaaatacaccattgtgcaagaagtttgtaccaatttaagcacaatcattttggcacacactgtcaagcaatgcttcaggcaaattagctgctggtaa

SEQ ID NO: 260 - DNA, 1131 bp, M.catarrhalis
caaggctggtatatcatagtatttttgattgcttttatgacaaacacagggacaacggacatgaaaaatattgatacaagcccaagcaatagcgagcattatttacccaaaaaaatcttggtaacaggcggagcgggttatatcggctcacatactttgattgagctgatacaggcgggatttgtgccagtggtgtatgataatttatccaattcaagttttgttgcagtgcagcgagttgagcaaattgttggcaaacatattgaatttattcaaggtgatgttttggataaaacgcatcttgacgctgtttttaaggcacatcagttttttgctgtagttcattttgcagggctaaaagctgtgggagaaagcaccaaaaatcccttaaaatattatcaaaataatgttgtcggcacactcagtctgttagagctgatggcaaaatatggggttaaaaattgcgttttttcatcatcggcaaccgtctatggcagctcaaatcgcctaccaatcaccgaggatatgccgcgtttttgtaccagtccttatggtcaaagtaaattgatggtagagcatatattggaggatttggtgaatgctgatgatacatggaatgttgtctgtttgaggtattttaatccaattggtgcacatgaaagtgggcgaattggtgaggatccaaccgatattccaaataacctgatgccatacatcagtcaagtggcggtaggtaatcttaaacagctgtctgtatttggcaatgattatgagacacctgacggtacgggggtgcgagattatattcatgtggtggatttggcaaaaggtcatgtggcagcactgcattatttggttgggcaatctgtgggcattggattttgtcccatcaaccttggcacaggtcaaggaacttcggttttacagcttattaaggcgtttgagtcaaatactggtcaaagcgtaccgtatgttattaccagcagacgcacaggtgacattgcagcctattatgccagtgctgataaagccaaagctatacttaactggacagcagagcttgatattgagcgtatgtgcgtagatacatggcggtggcagtcaaataatccacacggctatttatcctaa

SEQ ID NO: 261 - DNA, 966 bp, M.catarrhalis
ctattcaatcagataaattttggtaggcaaattatgacaactcaaactcaacacacgcctaagcgtgattatcgtcagcgtttttttattgatggctcggtggtgcgtggcgatgtggtcaagctaaccgatgcttatcaaaccgtcatcacccaaaaagactatcccgttgcccttaaagcattgctcggcgagatgcttgtttcggcaagtttgttgattagcacactaaaaatagacggcaaattatccattcagctacaaagctccgattctgatgctcgcctaaattgggcaatggcagagtgtgatcacacaggttcggtgcgtgctttggcagggtttgatgatactaatcagaatcaaacagtatggcaacacctaaaatctgccgatgaagcctttggtgagcttggcaaaggggttttgttcatcagtatccaccctgataatggcgaggcttaccaagggattgttgagcgtgtcagcgacagcttgggtgagtgtttggcacattatcaaagacaatctgcccagattccaaccatcattaagcttgccaccaatgagacgacagcaggcggcatattggtgcaactattgccccaaagtgatgctgataaagaggctgaccctgatttatgggaccgtttgacagcactcaccgatacactaaagacagacgaactcaccgatttggacgccaatgagattttgtatcggctatatcatgaagaagatgtggttttgccaagtttgacaccgctacaatttgcctgtacttgctcaagccaaaaaagtgaaggtgctatcttacagcttggctatgacgaagccaaacaagctgcagcggcacaaggcggtgtattgacgcttgattgtggtttttgtggcagagaatatcggtttgatgatcaagcgttagcccagctgtttgctgatggcttatcaaatcatcataagtaa

SEQ ID NO: 262 - DNA, 1860 bp, M.catarrhalis
tcagagactaaggaacggcttatgtgcggtatcgttggtgccattcggacacatcataatgtggtagattttttaacagatgggctaaaacgcttagaatatcgtggctatgactcatcaggcatcgctgtgcaaaccgaatcaggcatccgccgtgtacgccgtgtggggcgggttgcactgatggaagaagctgccaaacaaaaacaaattcatggtctgacaggtatcggtcatacccgctgggcaacccatggcggtgttaccaaacccaacgcccacccacacatttcagcagggcttatctcggttgtacataatgggattattgaaaattttgagaccgaacgcacacgccttcagcacttggattatgaatttgaatcacaaactgataccgaggttatcgctcacagtgtacatcaagaatataccaccaatggcggtgatttataccatgccgtccaaacagcttgctcaagatttcatggtgcttatgccatcgcagttatcgctaatgatgcaccaaatcaaatggtcatcgcacgcatggggtgcccgctgttagttgcatttggcgataatgaggtttttgttgcgtctgatgtctcagcagtcattgcctttactcgccgtgtcacttatctagaagatggcgatattgccctacttcaagctgatggtatccaaaaactgcttgataaagacggcaatcaggtcaatcgcagcattaaaacctctgagatgtctttagcatccttggagcttggtccttatagccactttatgcaaaaagaaatcaatgaacagccacgagcagtttctgacactgccgaaatttttttagaaggtggatttgttgctgataacttcggtgaagaggcgcctgaaatctttgccaaaattcaaagtattaaaattttggcgtgcggtacttcatattatgcagcactcactggcaaacattatcttgagagtattgccaaaattcgttgcgatgttgaaattgccagtgaataccgttaccgtgatgtcatctcagaccccgacgagctggtcattaccatcagccaatcaggtgaaactttagataccatggaagcgcttaaatatgccatggcacaaggtcatcgctacagcttatccatttgcaatgtcatggaatcggccttgccacgcaccagtacacttgccatcttcacccgtgctggtgctgagattggcgtggcatccaccaaggcattcaccacacagctggtggtgttatttggtcttgcggttactttaggtatcttgcgtggtcatgtagatgaatcacaagcacaagactacgctgaggatttgcgtttattaccaggcagtatccaacatgccctaaacttagaaccacaacttgcatcatgggcgcaaagttttgccaacaagccaagtgccttatttttgggtcgtggtattcattatccgattgcccttgaaggtgctttaaaattaaaagaactcacctatattcatgccgaaagctaccctgctggagagcttaagcacggtcctttggcattggttgatgaaaatatgcccgtcgtcgtcatatcgcccaatgatggactacttgataaagtcaaagccaatatgcaagaggtctctgctcgtggtggtgagttgtttgtattatctgatttggacagtgattatactgccagcgaaggcgttcatatcattcgcacaccacgccatatcggtacactatcgccgattgtgcataccatccctgtgcaattattagcctatcatgtggcactggtcaaaggcacggatgtggataagcccagaaatcttgccaagtcagtcacagttgagtag

SEQ ID NO: 263 - DNA, 1272 bp, M.catarrhalis
tcaatgaataataatgcctatgtgattggccatcaacacgaagcgattaatacttgtctttggctggcaagcatgaaccaaacggtttatttgctggctgatgaactgtcagttttacaaacgcttgaatattatcaatgcgaccatcagatgaatacattatggcagctgtattgtgttcaacaaaaaattatcatcacagacagtcaaagacaggcatttttatcatcggctcaagctgggcttttgtggttatttttagatgatgtggatgatatcacgcttagccatatcatacatgtgctagacagtccgcacagtcggattattttaagcggtgtgcaaaagcttggtaagattgataagattgccaaacaatttaaatcatcttgggtgtattatttgcccatcagctttatgaaagatggtgctaattataatgcgttttatcattcggatttggtgatgattggtgaaaaaaccgcaggcagtgttgcttattgccagatattattaagcttaaaaacctatgccaagcattgccaagttgctgatattttaacggtggaatttgcccgaagtactttgatggcgatattggcaactcggctgtcttttatgaatgagatggcaagacttgctgataatcaaggggtaaatatcaaatcagttgaacgcatcattgcccaagatggtcgtatcggttcggcttatctgtcggcaggatggggctttggtggcaagacattgccacgagagcttgagcttttaatggataagtttaaacaaaaccgtgtcgacacttcgcttatcagtgctgtcagtcacatcaatgacgaccaaaaagagctgatttttcgtaagttttggcaatattttaatggttttattgagcataaaacggtcatgatttggggagcaggttatcgaaatggtgcatcacgcatgattaattctgccattcatccattgattgagctgctttggtcgtatggcatttgtacgctcgtttttgcacataataccgcctttgaaatgcaatcaacttatggcgatcatccattgttaagattgactgatgatccttatcaggatttggtacaagctgatgcactgttcatcatcaattggtctttattaaccaagcctgatattcatgtgctcaatcaaattaacattgcaatttttgatgccaaaaatgttttagatgatgaacaaatcgccatgctgacagcaccttattatggtattgggcgagaaaagtattcatag

SEQ ID NO: 264 - DNA, 2583 bp, M.catarrhalis
tttatgcaaaaacttgtaaatttgttcaaaaaatctggcagccaaccaagtgcgttacccaaaccgccccaaaatagccaagatcatggcaatgaacgcacaccaagcccttatcgccgtgcttcaaccaaaggattatcgcttgtggttaagccagctttattaggtgagataccaaagattgatgataaagtaccgactttttatgtgattcggtcgtattcacgctcaaacagtctgcttgttggtatgcaaaccgaggcactgggtttacctgcagcattagcagaggtgcatgctgaacagattcatgaaacttctgccatgatttttttaaaagaccgtcgtacaaaaagcacaaataggcatgtacctcgtcttaaacgactgatacaagcttgccttgataatcctgagctaaaaattaatctggtgcctgtgaccattctgtgggggcgagcaccagataaagaagaatctttatttcgcttactgatggcagatgagtgggagtcgccttcaaaagccaaacagttgtttaatattggtgtgatgggtcgtgatacttttatccatttttcccaagccaaagatttacaaaccctaattgcccaaactcaagcatctggcgaagatggcatgacgatcgccattgcacagcgtcttcaaggttatttggacaaacaacgcaccagcatcgtcggccctgatttatctgataaaagaaatgtggcaggtgaaattttatcctcacctaaagtggtaaaagccattgaagagcaagcagcgacatctggtaaatccatcgccgccgttaaagcagaagctcagggctatttgggcgagattaccagcaattattcacattcagtggtgcgtttttttgaccattttttaacttggctttggacacggctgtatgatggcgttcaagtgcgtcattttgagcgtgtgcgtacacttgcaccagattatcaggttgtttatgttccatgtcatagaagccatgttgattatcttttgttatcgtacgtgatttataagcggggtttgcgtattccgcatgtggcagcgggtgagaatctcaatattcccatactcggagaattgttaagaagcgggggtgcattttttatgcgtcgcagctttaaaggcaatacactgtatagcactgtttttaaagagtatgtacatagtttgatgcagcgtcaagcaccgatagagtatttcattgaaggagggcgttcacgcacaggtcgtctgttgccacctaagcttggtatgcttgcgatgacagtcaacagccatttgcgtaaacctgccaaacctgttgtatttatcccagcttatatcagctatgaacgcatcatggagggagcaacttatgtgggagaactcaaaggtaaacccaaagaaagcgaaaatttacttggcttattaaaaacggcacgcaaaattgagcgtatctttgggacggtgcatttgtcatttggcagtcctttatatttgacagactttatggaaaaatttcaggtcaacgcatgcgatgatagtgatgaaaacaccaaaaaagtccacgccatggttcaaaacttgggcgtcaaggtcatgcaaaatatcaataaagccgctgtggtgaatcctgtttcgctattggcattggccctgctgtcaacaccaaatgctgcacttgatgaagcccaatgccttgaacaaatccgtctgtatcagcacattgcccaagccttgccttatgatgatgacacccatgtcaccgatatgacaccaaggcagattttaaattatggggtgaagcttaagctcattgaacgcaccccacatattttgggtgatatgattcgtgtggcagataagcaagtgccacttttatcttattttaagaataatattttgcatgtatttatcatcgcaagtttactggcagcattggtacaaagaaatggtcgtatcagtcatcaaaagttggatggtattactgagcttttatatccatttttgcaaagtgagttatttttaaaaatatcacttaaaaatatcattgaaaaagttcatcaagtgctaaaattactgattgaacaagaggtaattgttgagctaggtcagggcattgtgggcagtcctgagggcaattcacaggcttatcaaaaactgatcgtactggcaagtccagcccagcaaagtcttgagcgttactttatggcattaaccttgctttccaaacaaggttcagaccgtctgacgaccgaacaggtggtgactttatgccatgttgtcggtcagcgtgtatcggtgctgcatgccgatgatttaccagatatgtttgataaagcattgtttacaagctttattgatactttggttcgcatgggttatatcagtatcaatacagagaccaatttattatcctttgatgagcgtattgaccgcattgctgaatttgcaaagtttgtactacagccagatatgatgcaagtactcacccataccgcaagcctttcttctgatgagctaggtttagcgatggcaagcatggagaaaaaacgcaagtttgggataagatag

SEQ ID NO: 265 - DNA, 1128 bp, M.catarrhalis
  unsure (1071),(1100),(1102): Identity of nucleotide sequences at the above locations are unknown.
ctattgagaaaggagagtagaatgtctttgtttattgatactaaaaatatcccaaaccaaatcacaataactaataaaaactctttaaaagtcatttccttattttcaggttgtggcggtatggatttgggttttattggtaattttaatagtcttggtaatttttatccaaaacaaccatttgagattatttttgccaatgatatttttgagaaagcttgccaaacttatcagcataattttaatcataatattatttgccaagatatatccacaattgatgatggtgatataccaaaagcagatattgttattggtggatttccctgtcaagattttagcttagcaggtaaaagaaaaggtctggacagtgagcgtggcaaattatatttacaaatgaaacgagtaataaagatagccaatccaaaagcctttgttgctgaaaatgttgatggtatccgaaaagcaaaaggtttaagtaaaaatgatgcttctgcattggatgtcattatcaaagatttttcccaaattggttataatgtggtttaccaagtattaaatgccagtcattatggtgttgctcaaaatagagttagggtaattattgttggtattcgtaaagatattgataaaaaaatgaaatacccaaaaccactatttggtgaattatccgatagtcaaaaacctgttattacttcaaaacaagcaatagatgatttatgggaattattagatgataatatcaacagccattcaaaaaatcattattccaaagcaaaattttatcccaataaaaaactgcaagggaattgtcaaataaacgcagacaagccagccccaaccattcgggcagaacatcacggaaatattgaagcccactaccgttcaaccaacaaaaaatcaccatatgatatgcagtattggcgtagattaactgttagagaatgtgcaagattacaatcttttcctgatgattttatttttccaacatcagcatcatcaagttatgtacaagtgggtaatgcggttccaccaattatgtcttcaccgggtctgaaaggacgtccaatntgttgtctctcctctcgcgtctcctcggngnggagtagtaatgcgagtgaacgttga

SEQ ID NO: 266 - DNA, 1182 bp, M.catarrhalis
atagtttgggatgtagaccagatgcataaaatgtatcctactagtattttattgtgtgccgtggttttgtcaggctgtgatgcagtcaagcagaccatcacagacaaacctacgctcagcgatgcccaaatcaccaaattaatccccaagcgtgtcaataacgccaagctatgggcaactgatattggcgatatttttgatgaattatcactaccgaaaaccgcacaaaatatctgtaccgctatcgctgtcattgaccaagaatcaaattttcatgccgatcccagcgtcccaaacttaggcaatgctgccctaaaagccattgatgacaagctagaagataaacttggtaaaaatatggcaggcgtatttcgcaacatgcttgagacacgcccaacgccaaaaaacaacttcatcaaacaaatcaaagctgtaaaaaccgaaaaacagcttgatgagctataccgagagatttttgattattttaccagaacctataaaatagcccctttaaccaacatcacaaaactctcaggacaaggcattgatgaacgcatcaaccctgtcacaacacttggttctatgcaggtacatatcgactacgcacgagcacatcgccgtgccagcatgagcgatcgggatttgcgtgccgatttatacacacgctatggcgggctttattatggcatacatcgattaatggtatatcaggcaaattatgacaagcctttataccgttttgctgattataattcgggtatgtattcaagccgaaatgctgcctttcagcagcggatcgctactttaagtggtgaaagcttagccattgatggagatttattgctttataaagatggcagccccataagcaaaatatcctctaccgaaactgccgccatcgctttacttgctaccgcatcaaaacccatcaacgcacaacaaatccgatctgattttaaaaaagaaaaaactcgtgattttgaaaaaaccatcacttatcgtgcggtgaatgatatgtttgccagtaaatttgggcgagagcctacttatgccattatgccaaaagttgtcatttcagggcccaagcttagccgagactttgataccaattggtttgccacccgtgtcaatgaacgctatcaaacctgcatcactaccgccaagcgtcaccgattaagctaa

SEQ ID NO: 267 - DNA, 1722 bp, M.catarrhalis
tatgacaagctatattcaggcatttgcttattttgccagtcaagtcgatcagtcgttttaatttttagcaaaaccaaaaaacaaggacgattgatgaatacttggcatgacttaaaaagacttgctcactcacccattaatctgcagcattattttaccgctgatagcaaccgtggccaaaaattttcagcgacagcgtgtgatatttatatggattttagtaagcaggccattgatgatgaaagtttgcttaagctgatacagcttgctgatgcatgtgaattatcacaaaaaattaaggcattattggcaggtgaaaaggtcaatgataccgagcaaagggcggcactgcataccgcattgcgtttaccaaaaggtgagtcgcttatcgttgatggcgtggatgttggggagcaggtgcatgacagtttagataaatgtgaagccttggttcatcgtatccgtagcggtatttggcgtggctattcaggcaaggcgatccgtgatgtggtgaatattggcgtcggagggtcggacttaggtccgttgatggcaacaacagcactgtctgagtgggcagatactgatatccatgttcactttgtttctaatatggatggcacacaattagaaagtttattaaaaaaactcaatccgcagacaactttatttatcatatcatcaaaatcctttggtacggtagatactttatccaatgccaaaacagcattaagctggttgctggccgcttatgcacataagccaacaattttacgccgccattttattggtatctccacacgacctgacaagatgagcgattggggcattcatccagacaatcagcttttattgtgggattgggttggtggccggtttagtatgtggtcagcgattggacttgcgattgcggtgcgtatcggcatggctaattttcgtgcattattggcaggtgcacatgagatggataagcactttgcacaggcagatttttataaaaatttgcctgtactgttaggcctcattggtgtttggaacgcaacttttttgggcattaatgcacatacagtcttgccttatgatggtcgattgagccattttcccaactatttaacccagcttgaaatggaatctaacggtaaatcggtcaaacgcacaggagaatcggtcaattataggacttgcccaattttatggggagacattggctcaaatgcacaacatgcgttttatcaattactccatcaaggaacacagcgggtgtcttgtgattttattaccccaattcatcgctataatgatactcaaatcataaataactctttggtttaccagcacaaactgtcattggccaattgtttggcacagtctcaagtcctcgcctttggcaacgctgcactaccgcatggcgtggcaaatgcggcagatgatttggcaaaatttaaaaaatatcggggcaatcagccttccacaacactgttattgggtgatttaaaccccaaaactttaggggcattaattgctttgtatgagcataaagtgtatgtcatgagcgtactttggcaaattaatccttttgatcaatggggcgtggaagttggtaaagtgatggcaaatcgtgtctatgacgagctgatcagtaagacaaatacagactgcttcgatcattcgaccaatacacttttgtctgtcatcaagcagtcaaggataatcaatgaataa

SEQ ID NO: 268 - DNA, 216 bp, M.catarrhalis
aattatattatgtcattaaattacaataatctttggaaactactgattgacaaagacctaaaacgcactgacctcatcaatcttgcagatatcagcagtaatgttttggctcgtatgggtaaaaatgaacctgtgtccttagaaagtttagaaaagatttgtattgcccttgattgttcaatacaagatgttttgactattgagaaaggagagtag

SEQ ID NO: 269 - DNA, 516 bp, M.catarrhalis
tataagtcagtagatcaagaagccatggatgctttgatgaaaattgaagagtttagaagcctaaatgatgatattgaagtggtcattaatcgctcggaaaaaattaaaggcttaaaagaaaaagccaaagacaatgacggcgaactatcaaaagaggataaaaaaacattaagcgatgaagaaaaggaacaaaaatctttgcgtaaacaaatccaagaaaaattgattaaatttgccacacgcattccaatttttatgtatttatcagattatcgagaacacagtttaaaagatgtgattacggtgcttgaacctgagctgtttacccgagtaacggggcttacgcaggcggatttttctttgcttgtgtcattaaatgtgtttgacgaagcagtgatgaatgatgcggtgtataaatttaagcgttatgaagatgccagtcttgaatatgcagggattgataaaaaagagggttatgtggggctttataatacccaaatcaaacgacaatggtaa

SEQ ID NO: 270 - DNA, 267 bp, M.catarrhalis
aatcaaaaattttggagagttatgtacgataatgataaaaaattgaccaccatcgtaggggtgttgtatacggtgtcttatattgccatatggttggtcagtggctatattttatggggctggattggtgtgacaggatttactcgtgcgatactttggctgatcgcttggatgattgtgggtacgattgctgatagaattctgataccgattattttgaccgtcgtggttgggttattttctatcttttttgaaaaaaggcgataa

SEQ ID NO: 271 - DNA, 204 bp, M.catarrhalis
aagaagagatcccaggccatgggggaaaaaaatacacggccggccggggttggtatcattcaaaaagtaaggccgtttgaaaagctttcaacccaagggcaatcaatcaattcccgttcgattttcgcttttggtcaatgcgaggaaggcattgtttctcgccctttgggggaaaaatgtgccctgcgcccacttagaaattaa

SEQ ID NO: 272 - DNA, 645 bp, M.catarrhalis
tacaatagcccaattctttttgatatatcaatcatgccaaacgcttctcatttagtctctacatccccatcacaacctaccgttgccaaacctatggtacgcttggttgccattatttatgatggtatgctgattttggcaatgttatttttggttggatcgatattggcggttttgggtacggtgctatttttggagattggaacaagttctcaagaggcccaaactttaccagattggtataaaaatgcaattatgacaccatcatttgtcttaactttggtggggttttatggcattttttggcgtaaatcagggcaaacgctgggcatgcaaacatggcgattaaaaaccgtcaatgatcaaggtggacttttaacatggcgtcaaagttttgtgcgtatcatcagtgcttgccttttgcctgcgttatgtgcattattgggggcacttttacatggctcaaagtttgccattttggtagcaacagtcttggggtttttgtttaatttcttattttgtctttttaaccgtcaagggcttgcggtgcatgatatgttgtcaaataccatcaccttaaaagtaccaaaaattgctcatcaaacactatggcaaaccatcaaacgccgcaaaaatcgtctttga

SEQ ID NO: 273 - DNA, 1566 bp, M.catarrhalis
tatttcaaccaatatattttattaaaaatgataacatgcgctaggctggttatcaaaaggagattgaccatgcaatctgtagaaacaggtgtatggatttcgttggctgtctattttattttgatgattgcaatcggaatttatgcttattttaaacaaaaaaatgacattgaaggatatatgcttggcggacgcaatctaagtcctgctgtaactgcattatctgcaggtgcgtctgatatgtcaggctggcttttgctgggcttgccaggatacatgtacgcttcaggcgtggtaagtatttggatcgcactgggtctgaccattggtgcttgtgctaattatctgattgttgcaccgcgtttgcgtgtttataccgagcttgcagataatgctgttactttaccagattatttttcaaatcgttttcatgataaatcacatcttttgcgtatcatgtcggcggtggtcattatcttattttttacggtttatacagcagccagcttggtggctggtggtaaactgtttgaaagctcattgaatttatcatatagcatgggtttgtgggtaacagcaggcgttgttgtggcttataccttgtttggcggctttttggcagtgtcattaactgactttgtccaaggcgtcattatgctgattgccatgctaattgtacctgtggtagcatttggcgagattggtggtgtgtctgaggcgatggcgattgccacacagacaaataccgaggtctttaattggatgaatggcgtgactgtcatgggtgttatctctttgatggcatggggttttggctattttggtcagccacacattattgtacgctttatggcaattcgctcagttaaagatgttccgactgccatggtgattggcatgggctggatgattttaagcctaattggtgctttgatggttggcttggcagggattgcttatgtggcacgcacaggtatagagcttaaggatcctgaaaccatctttttggtattttcacaagtgctgtttcatccgctgatttcaggatttttgttggcggcaattttagcagcaattatgagtaccatctcaagccaattgctggtggtctcaagttcactgacacgagatatttataagttatttttggataaacaagcctcagaggcacgccaagtgcttattggccgtatttcggttgttttagtcgcgatcattgcgattatgttggcaggcgatagcaacagttcagtattaaatttggtatcacatgcttgggcaggatttggggcagcatttggtccattggtaattttaagcctgatgtggaagcgtatgaaccgaaatggtgctttggctggcatgattgtgggtgccttgacggtgattatttgggtgtatggtggttttgagattggcggtcagccagctaatgatgccatttattcaattttacccggttttgcttttagtttggtgacaaccattgcagtaagtctgatgacagcaccgccgcctgtttatattgttcaaaaatttgaggatatggaaaaggggctaaaatag

SEQ ID NO: 274 - DNA, 1440 bp, M.catarrhalis
ttcatgttaaatcacccaaaaaggatagttatgaccacgccaaatccttatgcccatcgtaccgcccagcattttgatggtatccgctatgatgaagctttaatccaaaaatacaatcgccaaggtccacgctatacctcctacccaacagccttagaattcatgccaatcgaacaaggcgttgaagctcaaattttagtaaaccgaaatcctgccataccattatctttatatattcatattccgttttgtcatcatttatgctactactgtggctgcaataaaatcatcaccaaaaaaaacagtgatgcaggcgattatttgacctacttatttgccgaaatccgccataaaaaatctttattgcgtggtaagacttgggtcaaacagttacatcttggtggcggtacacctacttttttaagtgatgatgaactcatcacgctttgggattttttgcatgaagagtttttatttgctgatgagggcgatttttcaatcgaaattgacccacgagaactacgcccaaataccttaaaaattttaaaagatttggggtttaatcgtctaagctttggtgtacaagacttagataaaaaagtacaaattgccgtcaatcgtgtacaatcgcttgagttgattcaaaatgtcatgcaagaagcacaagcactaggctttagctcaaccaatattgatttgatttatggactgccacatcaaacacctgccagcatgaatgctaccattgaacaaatcatcaagctttcgccagaccgtctttcggtatttaattacgcacatttacccgaacgattttttgcccaaaaacgcattttggaagcagacctacccagccccaccgataagctaaccatgtttggcaatatcatcacatcgcttggtgacgcaggctatcaatatattgggattgatcactttgccaagccagatgatgccatggctattgcacaacgacaaggtaagctgcatcgtaactttcaaggctatgcaatcttaggcgagtgcgatttattgggttttggtgtcagtgcaatcagccaaatcggcaagcatattttgcaaaacccaacggcattggtcgactatcaagccactgttcttgccgatacactgcccgccatcaaacacatccaaagtgatgataaagatgcactgcgtcgccatgtcattatgaatcttttatgccatgattacatgagttttgaggatttgcacgcacgatttgacatcgatgccaaagaatatttcgccaatgaaattaaaaacctacaagatatgcaaaccgatggtttggttcaaatagatgaagatggcatcacaattttgcccaaaggtcgaatcttaggacgcagcattgcgatggtgtttgatgaatatttaggcaaaaaacacaccaatcgtttctcaaaagttatctag

SEQ ID NO: 275 - DNA, 297 bp, M.catarrhalis
acgattatttggaggctagtcatgaaaaaaggattttggagttcgttgttcggcaatcaatgcggtccaaacagtgccgatattgccacagaccgcctaaaagttatcgatgccagccacgaccgactcaatactcgcttgactgctgatcgcattgagcagatgaagcgtgaaatcttagccgtggtcaataagtatgttaacggtgttaatattgacgaccttaacattaatcatcgtcatgaggataacttggatatgcttgagatgaacatcagtttacctgatcgcaagtag

SEQ ID NO: 276 - DNA, 582 bp, M.catarrhalis
gtaagcaaaatgggcatcaaattaattgtagggcttggcaatcctggtgtacagtaccaacaaacacggcataatgcaggcttttggttcgttgaacagcttgccgataaatttggtattcggttgatttttgataaaaaatttcatggtcaagtggggcgtggcacgattcacaatcaggaagtacgcctgctattgcccgaaacttttatgaaccgatcagggcagtctgttgcaccttttactaaattttatggcattcatccagaaagtattttaatcgcacatgatgaacttgatattccagttggtagtattaaactaaaaacaggtggtggtcatggtggtcataatggcttaaaagatatcgtgccacatattggtgctgattttcatcgattgcgtattggtatcggtcgacccatgcactcatcacaagtcagcggtcatgtacttagcaaaccttctgctgatgaccgtatcagcattacatctgctattgattgtgccgttgcctcaatccatgaaattatcttaggcgatatggagcgtgcacgcaatcaaattaatggctttagataa

SEQ ID NO: 277 - DNA, 183 bp, M.catarrhalis
tttaaaaaagtgcttgacatacaaaataatcactgtataatagccgccacaacgaaagatattcagaatatctcagttgaacttgcacccgtagctcagttggatagagcacttggctacgaactaaggggtcgggagttcgaatctctccgggtgtgccatatgataaaaatcaccgaatga

SEQ ID NO: 278 - DNA, 705 bp, M.catarrhalis
catttgacatttatctatccaaaaggatctttcatgagccaatttactttaaatggtgttgcgcgtgctgaatcgcagcagggtaaaggtgcgagccgccgcctgcgtaaagacaatcttgttccagcaatcatttacggtggtaatgatgaggctgtggccatctgtgttaaaaccaacgaaatcgttaaagccttgtctaacgaaagctttttttctagcgttatcaccatcaatctagatggtgctgagcatgaagttatcatcaaagcacttcaacgccacccatcaaaaggctttccattacatatcgattttcaacgcatcgttcgtggtcaaaccatgaatttcaatgtgcctgtaaatatcatcaatgaagacagctctgtcggtaaaaaagaaggtggtattcttacaatcttggtgaatgatatcgaagtgaattgcttaccacgcaacctaccagaagccattgaagttgatgtagcaaaccttgccatcggcgattctattcatcttagcgatgtcacactgccaaatgaggtaactttggtgacgcatgatgaagctgacctaaaccgtaccatcgctaccatgcagccacctgctgtcattgaaactgctgatgatgccgaagcttcaaccgaagagacaacagaagcagaagtagcaccagctgacgctgaagagactaccgaagagtaa

SEQ ID NO: 279 - DNA, 219 bp, M.catarrhalis
cctatgccttcagtaaaggtaaaagagaacgaaccagttgatattgcgatccgtcgcttcaagcgtgcttgtgaaaaagctggcgtgctagcggatgttcgtaaaaaagaattctttgaaaaacctacgcaagagcgtaagcgtaaaaaagcggctgccgttaaacgctataagaaaaaagtctatcgtgagcaagtgcgtcatcagcgtaagtactaa

SEQ ID NO: 280 - DNA, 1368 bp, M.catarrhalis
tttaagtatccgcttatgattaccatcaaaaaaggcttggatctgccaatcactggcgagccctccaagcagattagcgagcacacgcccactaaggtggcgttagtcggctacgattatgtcggcatgcgtccgaccatgcatgtcaaagaaggtgataaggtcaccaaaggacaggtgctttacgaagacaaaaaacgagcaggcgtcctttatacagcaccagttggcggcactgtcgttgctgtcaatcgtggcgaacgacgagtatttgaaagcttggtcatcgccgtcgatccaaatgcaagtgaagaaatcacttttaatgcttatcgctctgaagatttgtcaatgctggatcgcaagacagttgttgagcagttggtcgcttcaggtgaatggaccgccctacgcactcgtccttttagccgtacaccagaaattaatagcataccttctgccatttttgtgacggcaacagataccaatcctttggctgttgaccctgccaccgtattatttgaagaaatacaagcatttaatgatggcttggcaattttatcaacgctatccccaaaaacctatgtctgtcatggtgatattgtacctgagaccttaagtaaaaccgctgacggtaacgataccatctatgaagggtttactggtgtacatccagcaggcaacgcaggtacgcacattcactttttacaccctttggcacgaggcagcttagtttggacgattaattatcaagatgtcatcgccattggtaagctatttaccacaggtcgcatttacacagagcgtctgatcagtttggcaggtccagcagtggccaatcctcgcttggtgcgtaccactcgaggtgctgatttgaccgaattgacccaaggtgaactcaacggcgacgataaccgtgtcatttcaggctctgttctatcaggtcgcacagctgttggtgctacggcatttttgggccgctttcataatcaagtctctgtacttaccgaaggtcgtgaacgccctgcacttcacttttttacaccaggggcaaatcgtttttcaaaattgccaatttatatttcacagttttttaaaggcaaaaaatacgattttacgaccagtaccaacggctcgcctcgtgccatggtaccaatcggcttatttgaaactgtcatgcctcaagactatctacctacccagctactgcgtgctttgattgtcgaagatatcatcagtgcggttgaattgggtgcacttgagcttgatgaagaagatttggcactgtgtactttcgtatcaccaggcaaatatgagttcggtgatattttgcgtgataacttgacccgtattgagcaggaaggctaa

SEQ ID NO: 281 - DNA, 525 bp, M.catarrhalis
cccattaaaccgtcaaaccgtttaaacatcaatgaagaaatccgtgccaaagaagttcgcttagtcaaagaagatggcgaacaaatgggcgtggtagacattcaaactgccctaaaagctgctttggatgtaaatttggatttggttgagattgttgctgatgcaaaaccgcctgtctgcaaaattatggattataaacgctatttgtacgaacaaaaacaaaaagctaaagaagccaaaaagaatcaaaagcagactcaagtccgtgaaattaaactgcgtcccggtactgaagaagctgactatcaagtcaaattgcgtaaaattgttgaatttctagaaaataaagacaaagtcaaaatcagtattcgcttccgtggccgtgaaatggcccaccaagaaatcggtaaagctcaacttgatcgcatcatcgaagataccgctgagattgccatcgttgagcaagctcctaaggtagaaggccgccaaatgggcatgctgttaggtcctgccaagaaaaaatag

SEQ ID NO: 282 - DNA, 636 bp, M.catarrhalis
aggcttatcacacggaggaggtcactgatgggacattatgtcagtttatttatcacctcagtatttattgagaatatggcacttgctttctttttgggcatgtgtacctttttggcagtatctaaaaaagtatcaacggcaattggtttaggtgttgcagtaattgccgtcatggcaatctgtgtgccattgaacaacttattgtatcaattcttattaaaagacggtgccttggcatgggcaggctatcctaatgttgatttaagctttttgggattattaagctatattgcattgattgctgcgacagtacagattttagagatgtttttggataaatttgtaccgtctttatacaacgctttgggggtgtttttacccttgattacagtgaactgtgccatcatgggtggtgtattgtttatggttgagcgtgattataattttggtgagtctattgtatatggtattgggtcaggtttgggatgggcattagcgatttctgcacttgcagggattcgtgaaaagcttaaatattcagatgtacctgcaccgcttcgtggtcttggcatcacctttattaccgttgggcttatgtccttgggctttatgtcatttggcggtatgtcgctataa

SEQ ID NO: 283 - DNA, 813 bp, M.catarrhalis
gccatgtcaaccaagaataataatgtaagtaccgcagccacggcactgattttgtgcttggtctgttcggtcatggtttctgcggttgctgttggtcttaagccaaagcagcaagaaaacgcccgtctggatttgaataaaaatatcttgatggcggcagatatgtacgacccagaaacagagtcagccgatgtcattgcagagcgttttgctgattttgaaatacgcttggtcaacctacaaacaggtcaatttgcaacagagcaagaaattatggcgtctggtatcagtgatgtcaatagctacaatgtctcaaaagcagctcgcacacccagcctgtctacttcattaacaaatgatattgccaaaattggaggcaaaccaaattttgccaaagtatatttggcaaaagatgccaatggtcagcttgagcaaattgtgctgcccattcatggtgctggtttatggggaccaatttttggtcttttgaccttggataaagatttaaataccattaaaggggttaatttttatcaacacaaagaaacccctggcttggggtcacgcattgaagaagcacaatggcaagccacatgggtggacaaagagctgtataatgacgatggttcaagaaaaattgccgttgtaaaatcaggcaccgcacgtgagagtcaaattgatggcatcagtggtgctaccttgaccatccgtggtgtcaataatctacttcagtactggattggcgaagatggttataagccatttttggacaacctaagggctggtcaagcagacaagggtgaaggagtataa

SEQ ID NO: 284 - DNA, 570 bp, M.catarrhalis
aagttatgtgcgttatctgtgttttggagtgtggctgtgaattatttggctatcaaaaaatcagaactttctgagagtgattttaactatctgtgtcaaaagattgcggagattgagcagcttgttatgcatggcgatgcttggcatgcacaagcaattgcagagatgatgggtcaatttggtacacaaatgttaatacagacagatcatagcaaaacagataatagcaaatctgatattgattggagaatgatgacgattaagggatattgtatttatcagcgtgtctttgaaaatagtgagctacatcgtattggcactcatccaaattttcaaagacaaggggtcgccactcagctaatgactgggttgattgctgaggtgatgcatgccaaatgccaacaactgttattggaggtacgcagtgataataccaccgctattacgctttatcaaagcttaggatttttacgatttggtgtgcgtaaaaactattatcgttttggtaatcaaagtatagatgcactgatcatgcgtttgggttttgaagataccaaccatcatgtttag

SEQ ID NO: 285 - DNA, 237 bp, M.catarrhalis
acagcagtagctaggcgcgccatggcatctttaaaaattaatttttctaccatgattttcccatttaaaattaaaaaggatgtagttgatacacccttaaagttatttttgtattcaaaactgacttatgctaaattttttgctaataagcacggtttcacaaactcagttttaatcttagttatttaccaagcagttcacggcgaacaatcgccgccccttcacttagggcattga

SEQ ID NO: 286 - DNA, 1674 bp, M.catarrhalis
atatcataccaaaattattgctatactatgtcactatgttttttaatattaaatcaatctatcggaataaaaatcatgactttgcaatcacctaatgattttgatcaagctggtaaaacttcccacatgcaacgctttttaaaaggtgttgagtggttggggaatttattgccccatcctgtggttttatttatttggatgtcggtcattttactgggattatcagccatcttatctgccatggatgttgctgtcattgacccacgccctgagggtgccaaaggtcgtgctgaagatggcatgatttatgttgtcaatttgctcaatggcgaaggcttggcaaaaattgttgaaaatttagtcaaaaattttacagggtttgtgcctttgggtaccgtgctggtggccttactgggtgtgggtattgctgagtattctggaatgatttcagcggcactgcgtggcatggttatgaatgcccccaaaaaaatagtcactttagtcgtggtatttgctggtattatgtcaaatactgccgctgagcttggctatgtggtactaattccattggctgccatgatttttcatgctttaggaagacaccctttggcaggtttggctgctgcttttgcaggtgtttcaggcggttatagtgccaatttactgcttggtacggtcgatccattattatcaggtattagccaagaagctgcccgtatcattgacccaaattatatggttggtgcagaagccaattggtattttatggtagtcagtacttttttaatcagtgccttgggttacttggttactgaaaaaattgttgaacccagtcttggtaaatacaacccccatgatgctgatgaccctaccgtgcttgataataaaattgagcagttaaatgcccttgagaaaaaaggtctggtttgggcgggggtaagtatgctgattttttgtttactgttggcatggacggttgtaccagaaaatggtattttaagacatcctgaaacaggactgatcgcagggtcgccatttttacatggtattgttgtatttatttttgtattttttgccatccctggctatatctatggcaaagtgactggcagtattaaaacaaatcaagatgttgtcaatgcgatgagtcaagcaatgagttcattgagtatgtatattgtgcttgtgttctttgctgcacagtttaccgctttttttaattggtcaaatttaggatcagtaatggcggtgtcaggtgctaattttttaaatgagattggcttaacaggacctttgctactgattggatttattttaatttgtgccttagtgaatttgatgttaggttcagcatcggcacagtgggcgattacggcaccaatttttattccgatgctgatgctaacaggctatgcacctgagatgattcaggctgcttaccgcattggcgacagtacaaccaatatcatcacaccgatgatgagttattttggattaatcatggcagttgcaattcgttataagaaagatacgggtgttggtactttaatggcgatgatgttaccttattcgatgatatttttgttcggttggatgcttttattttatctttgggtatttgtatttggtttacctgtcggtccaggttcggcaacctattatcacatgggctaa

SEQ ID NO: 287 - DNA, 1314 bp, M.catarrhalis
tatcatgaaaatcatcacaccatcattatacctttgctttatttactcattcaacaaatgattgttggcttatccacctattttattgccaatcttgccatagacattgctaaaaatgatgattttttgctaaatttatctggttttgttttatcgttaatcattgtttatgtccctgcttattttgccaccatttatttagaaaaatcaaaatttgacctactaaataattatgtgcaaaaatttacgacaactttttttggcaaaactgtcttgcttaataataaagaactcaaagaccaaagcaccgtttttgttagtcaagagagtaaatcagtgatagatgacatgctggactttgcatttgatggtgtggcactgattttaaatttattgattaacatcttagtcttgggattttttcttgattatgatttattggtggcgtatgctgttggatttttattggtggaattttttattttttaccataaaaatcaaatatctaagatgtcaaaaatatctcaaaaatccagaatatattttattgccattttaaataaaatttgggacaatgtgattatttttaatcaatataatgtgggtatttttaaccgtatttataaaaagaattttaaccgctcaaaaaaatatcatattcacagccaatcattcaatcaattaatttctagttttggtatgattttgtttatgattcctgtattgggcttgattgtttatttatttatcaaacaccacaatgattatgtatttttatcattgttggttgcaacattaccaagacaaatacagctattgcaaatggggcaggtacttgttttccaccaaaccaatttttctggcattaaagccagatttattggtttgcaaaattcgttaaatatgcctgatattgacatattaagcagaattaactttaaagagatttttgttaataacatgccattgagtgattttgatttaaatcatttgccaaaaaatggcagaatgacgattaaagggcgtaatggggcaggtaaaagcagttttttgttgtatttaaaaacattattatcaaatagggctttttatttgcctgtcagccatgatttattttttcatcaaaatcataaaaagtccacaggtcaaaaattatcatctcaattaatgcaaattaataacaatataagcgatattgatgtcatcattcttgatgaatgggacgcaaatttggatggcatcaacaaaagtcatcttgatgagttaatcaatgaattggcaagacaaaggttggttgttgaagtcagacattaa

SEQ ID NO: 288 - DNA, 606 bp, M.catarrhalis
gtcagttttgaatacaaaaataactttaagggtgtatcaactacatcctttttaattttaaatgggaaaatcatggtagaaaaattaatttttaaagatgccatggcgcgcctagctactgctgttcatatcgtcactaccgatggcgatacaggtcgtcatgggtttaccgcatcggcggtatgtagtgtgacagattcgccaccgtcactgcttgtgtgtatgaatgccaatgctcgctcttatgaacattttatcgccaatcaaatattggcagttaatactttatccgctgagcaggcacatttatcagatgtttttgcatcaccacttgaatcaaaggcacgatttgagcatgctgattggagtgtgttaagtacaggcgcaccagttttaacagatgctttggttagttttgattgtgaaattcaaaccatccaagatgttggtacgcacagtatttttatttgtaaaattatcgccattcgaaaaggtgagaatgaaaagcgcagtttggtttattttgataggcaatatcataaaataggtcaaccagttgccattgacagacagcctgcatcgcctcaagttcaaaaagtggactaa

SEQ ID NO: 289 - DNA, 1239 bp, M.catarrhalis
aagttccttcgttttaccaccgtatcaggcgagcggggggcggcggacgctgagcgtgatatccgtggttttgccctaaaattctacaccgaagaaggtaattgggacatggtgggtaataacacgcctgttttctttttaagagacccaaaaaaattccctgatttaaataaagcggtcaaactagacccacgcaccaacatgcgttctgccaccaataactgggatttttggacactgctgccagaggcgtttcatcaggtgaccattgtgatgagcgaccgtggcattcctaaatcttaccgtcatatgcacggctttggctcgcacacttatagctttatcaatgctgataatgaacgcttttgggtcaaatttcactttcgcacccaacaaggcattgaaaatctaaccgatgccgaagctgaaatggtggttggtaaagaccgtgagagcaatcagcgtgatttgtttgatgccattgagcgtggcgatttcccaaaatggacaatgtatgtgcaaatcatgccagaaaccgatgcccaaactgtgccttatcacccatttgatttaaccaaagtgtggccaaaaggcgactatccgctcattgaagtgggtgagtttgagttaaataaaaaccctgaaaacttctttttagatgttgaacaatccgcttttgccccaagcaatttggttccgggcatcagtgtgtcccctgaccgcatgctccaagcacgcctatttaactatgctgatgcccagcgttatcgcttgggtgtcaatcgtaaccaaattccagtgaatgccccacgctgtcctgtgtactcaaaccaaagagatggacaagggcgagtgggcgataactatggcggtcgtccgcactatgaaccaaacagctttgggcagtggcaagaccagccacatttggctgagccagcattaaaaattcatggtgatgctaagttttgggattatcgtgagaatgatgatgattattttagccaacccagagccttgtttgagttgatgagcgatgagcaaaaacaggcgttatttggtaatacggctcgtgcgatgggcgatgcccctgattttattaaataccgccatatccgtaattgcgataaatgccaccctgattatgccatgggtgtggccaaagcgttaggccttacggttgaagatgccaaaaatgcccgtgagaccgaccctgctcgccatctgcccagctttttataa

SEQ ID NO: 290 - DNA, 216 bp, M.catarrhalis
cgccaccttagtgggcgtgtgctcgctaatctgcttggagggctcgccagtgattggcagatccaagccttttttgatggtaatcataagcggatacttaaattaagaccaaaacataccagccttcaccaagtggtgattaattggctggacaccaagtttcctaaaaacatccaaagccgtgcgaccgatgagtggcgggctgattttgtctaa

SEQ ID NO: 291 - DNA, 2349 bp, M.catarrhalis
aaaaatattaggtataagcagttaggtagcccagcgatgactcaaacaacaaaaaaaaccaaatggaatgaccccaatgctgatattgaagcatcaaaatatcaaaaccccattccctcacgcctattgattctacaaaccgtggcggatatcaccaatcaaggcaagcctgccacgcaagaaacgcttgccatacactttgggtttttggatgatgaagataaattttttgctctcaccaaccgccttaaggccatgctccgtgatgggcaacttgagcgtatcgatggcatccattttagcatcgcaccattgccaaccatattaacaggtcaagtttcttgcaatcccaaaggttttggttttgttatacttgacgatatgccagatttatttttacacgaaaagcagatgcgtcttgtgtttgatggtgataccgttgaagcggtagcaacagagtatcgtggcaagactgaagcacgcattattcaagtgattaaacagagccaacttgagtttatcggtaaattaagcttggatgatgagggttattttgtacaattatcaggtgctaatgcccatcagcctattactgtcaccgctgagaatgtccaaacaatgaatgcagccgttggtgatgatgtgaaggtttccttgattgatttacccacttatcaagaatttgctactggtaaaattactgagcttttaaccagcttaaacgaccgtgaattaattattgaaaccacactgtataattatggtattccacatgaatttagccaagccgctttaacacaagcctcaaagtttgacgagccaaccgatgcagactttaaaaatcgtgtggatttgcgtcatcttcccctgattactattgacggggaagactctcgtgattttgatgatgcagtttatgctgaaaaacgcgctggcggtaattatcgtgttgttgttgccatcgctgatgtcagtcattatgtcacaccgcaatcagcacttgaccaagatgcttatgcacgaggaacctctgtttattttcctcaccgtgtgattccaatgctgccagaggcattatcaaatggtttatgttcactcaatcccaaggtagaccgcttatgtatggtggctgatattaaattatcacgggcgggcaaagtgacaggttatgaattttatcctgccatcatgcactcacaagccagattgacctataatcaagtcaatgcctatttcaatgacccaaccaatgaaaccctacctgatgaactggtgcgtaatagtgcagtgctaaaatccatcgataccttacaccagctttatttggtactcgatgcacgccgtgaaaatcgtggtgcgatggcatttgaaaccgcagaaacttacattaagtttgacaaacaaggagatatcatcgatattgtggcacgcacccgaggcgatgcacataagctcatcgaggagatgatgctacttgccaatacttgtgctgccaatttttcgctcaaacatgaattacccgttttataccgcaatcatgataagcctaatgatgaaaaatcaacacggctacatgaatatgttaaaagttttgggctaagctttccgagtgaagcaccaacgcatgaagactatcaaagaattatcaaagccactgccgaccgacctgatgccatcagtattcatagtatgttgttacgctcaatgatgcaagcaaattatagccctgataatattgggcattttggcttggcttatgatgaatatagtcattttaccagcccaatccgccgttaccctgatttgatgctacatcgtgccatcaaagataaggtgactcaccaaaaacctgcaacacccatttatcgctctttagatgatgcaggcgagcaaaccagtttgacagaacggcgtgctgaagaggctgctcgtgatgttgaaacttggctaaaatgtcattatatgcagcgacatattggcgatgagtttaatgcaacggtaaccacagtgaccaattttggcttatttgtgacgctggatgcgttgtttattgaaggattaattcacatctcacaactgggtgatgaatattttacttacgatgagcgtgaacaaaagcttattggtgaacgaggctcaagatttggcttgggtgatggacttattattcaagttgctggcgtcaatatggatttattacaaattgatttttgcttaattgagcaattaaatcgtattgacaaaaatggcgacagccaaatgataccctctaagcctaccaatgacaaatcagataccaaaaatgagaggtctaaaaagcatcgccgaaaatcaaataagtcaaaataa

SEQ ID NO: 292 - DNA, 678 bp, M.catarrhalis
actaaaagcagatcctgccccaccgcaggcacactcattcacaccatccatggtctaaaacccattgaaaccattgaacatggtgatttaatttggtcaagacaagagtttggcacagaatatggctaccgtcctgtcatcgctactaaggtcacgcccaatcaagaaatctatgaagttgttgtcaaacacagcaacaactccacagaaacctttaaaaccactaaagaacacccattttgggtagaaggcattggctggcttaaagcttctttactagaacaaggcatgaccctacttgacaaacatggtctgcctaatgttacaatcatcagccaaaccaaattagatcgcaaagagacggtttataactttgaagtagatgactttcacacctatcatattggcgagtttggggtgtgggtgcataatgatgggtgttgtggggtagccctttctacgcttgaatcatatgttgagaaatcagcaaggggtatgggaaagttgcatcgtgttaatgaaaatgagttaacacagttaattttagatattggctacaataaagatgaattattaaaagccaaatccatattggagcacagtattaaaatcaggaaggcagaaaaggcaagccaaccaggtgggaggattagatgctggtcatcaaaaaagggttga

SEQ ID NO: 293 - DNA, 1248 bp, M.catarrhalis
gcaggaaggctaaccatgaagttcattcacaatatctttgaccgtatggagccatcctttaccaaaggtggcaagtacgaaaaatattatgctgtatttgagatgtttgacactttctttcgtcagccatcatctcaaacttatagtgcatcgcatgtgcgtgacggcgtcgacctaaagcgtatcatgattaccgtttggctttgtacattcccagcgatgttttggggtatgtataatgtcggatttcaggcactaagtgccatccaagccatggggattacaccagaaggctggcgtaccatcatcacgaatatggcaggctatgacccaaatagtatttgggcaagttttgtttatggggcgatgcaatttttacccatttatgccgtaacttttgcggtcggcattctttgggagattatttttgcggttgtgcgtggtcatgaagttaatgaaggcttctttgtgacttcagtattattcgcactctcgctccccccagatattccgttatggcaagtagctttaggcatcacttttggggttgtggttgctaaagaagtatttggtggcacaggcaaaaactttcttaaccccgccttggcaggtcgggcatttttgtactttagctatcctgcttatatgtcaggcgatgccatttggaccgctgtagatggcttttcgggtgcaacgccattaggtctagctgccataggcgttagcccagatcagtttgtcgatgcctacggtcagaccatcacttggatggatgcatttttgggtaatatgcaaggctcaatcggtgaagtgtcaacacttgccatcttaattggtatggttggacttctttggactcgcattgcttcttggcgtgtgattgcaggctcagtcattggtttggttgttactgccttactgtttaatgtgtttggttcagacaaaaatgtgatgatgagcctacctgctcattggcacttggtgattggtggctttatgtttggtgcagtatttatggcaaccgaccctgtttcagctgcccatactaacattggtcgctggtgctacggtctgcttatcggtgttatgacggtggctgtccgtgtggcaaaccctgcttttccagagggtatcatgttagccatcttgtttgccaacttgtttgccccattgtttgactattttgtcactcaagctaatatcaaacgccaaaacgcacggagattaagccatgtcaaccaagaataa

SEQ ID NO: 294 - DNA, 186 bp, M.catarrhalis
taccctctaagcctaccaatgacaaatcagataccaaaaatgagaggtctaaaaagcatcgccgaaaatcaaataagtcaaaataatctgatcaaaatcattcaaagcttgcctgctgtgcatttgggcaagcttaacagccaatcaaacacaccaagggcattgacaaatcaaaaactaccctga

SEQ ID NO: 295 - DNA, 1251 bp, M.catarrhalis
ataggagaaagtatcatggaatttggtaccgcaattggcggtgttatcatgtttaccattattatcatgagcttggttgctgtcattttggtggctcgctccaagctggtgagttctggcgatgtcaccatccgcattaatgacaatccagataatgatgtggttactcccgcaggtggtaagctactacaaacccttgctaacgaaggcatatttttatcttcagcatgtggtggcggtggcacatgtgggcaatgtcgctgtaaagtaactgaaggcggcggttcaattttgcccaccgaagaggggcattttactcaaggtgaaatccgtgacaatatgcgtttggcatgccaagtggcagtcaaacaagatatgaagattgagattgacccagaattttttgatgtacaaaaatgggaatgtgaagttatttcaaatgataatgttgcaacattcattaaagagttgaccttgaagattcctgaaggtgaagttgtaccgtttcgtgctggtggctatgtgcaactagaagcaccgtctcatactgtacattataaagattttgacatcgccaaagagtatcatgaagattgggataattttaatttatggcgttacacatcaaccgttgatgagcctgtgattcgtgcctattcaatggcaaactatccagaagaaaaaggtattattaaatttaatatccgtatcgcaagtccgccgccaagagctcctgaaggcattccaccaggtaagatgtcatcttatgtattcagcctaaaaccaggcgataagattaccgtttcaggtccttatggtgaattctttgccaaagataccgatgccgaaatggtctttatcggcggtggtgctggtatggcacctatgcgttcgcacatttttgaccagctaaaacgcctaaaatcaactcgtaagatctcgttttggtatggtgctcgctcaaagcgtgaaatgttctatgtagaagattatgatggcttggcagaagaatttgacaactttgaatggcatgttgcactgtcagacccccagcctgaagataactgggaaggttatactggctttatccacaatgtcttatatgaaaactatcttaaagatcaccctgcaccagaagattgtgaattctatatgtgtgggcctccagtcatgaatgctgctgtcatcagtatgctcaaatcactgggcgtcgaagatgaaaatatcttattagatgacttcggtggctaa

SEQ ID NO: 296 - DNA, 1929 bp, M.catarrhalis
ggcaatattatggtcgcaattaccctacctgatggtagtatcaaacaatttgacggtaacaccaccgtgatgcaagtggctcaaagtatcggtgctgggcttgccaaggccaccgtggcaggtcgggtgaatggtcggttggtcgatgccagcgaccccatcaccaccgatgccacggtagagataatcaccccaaaagatgatgcaggcgtggagattatccgtcattcaaccgcccaccttttaggtcatgcggtcaaacagctctaccctgatgttaaaatggtcatcgggcctgtcattgatgatggcttttattacgacatttatagcgaacgcccttttacccttgatgacatggcaaagattgaagctcgcatgacagaactcatcaaccaagattatgatgtcatcaaaaaaatgaccccacgagatgaagtcatcaaaacctttttggagcgtggtgagacttataaacttcgcttggtggaggacatgcctgatgaaacccacatgggcttgtatcaccatcaagaatacattgacatgtgccgaggcccacatgtgcccaacactcgctttttaaaggcgtttaaactcaccaaaatgagcggtgcgtactggcgtggcgacgccaaaaacgaacaattgcaacgcatctatggcacagcatgggcggacaaaaaacagcttaaagcctacttacaacgcctagaagaagccgaaaagcgagaccatcgcaaaatcggtaaagccttgaacttatttcacatgcaagagcaagcccccggcatggtgttttggcaccccaatggctggacaatctggcaagtacttgaacaatatatgcgaaaagtacaaaaagacaacggctatcttgaaatcaaaaccccgcaaattgtggacagaagcttatgggaaaaatcagggcattgggataactatggcgagatgatgttcaccaccgccagcgaaaaacgagattacgccatcaaaccgatgaactgcccttgtcatgtgcaggtgtttaatcaaggcttaaaatcctaccgtgatttgcccctacgcttggctgagtttggctcatgccaccgcaacgagccatcagggtctttgcatggcatcatgcgtgtgcgtggctttacccaagacgatgcccacatcttttgcaccaatgcccaaatcaggcaagaagcccttaattttatcaaacttacccttgatgtgtataaagactttggatttgaccacattcaaatgaagctgtccactcgcccagaaaaacgggtgggggcggacgagttgtgggacttggcagaacaagccctagccgacgccttagataacgctgggcttgactgggagctacaagcaggcgaaggggcgttttatggtcctaagattgagtttagcctacaagattgcatcggacgggtttggcaatgtggcacattacagttggactttaacctacctgaacgcttggacgctgagtttgtgggagaatcaggcgagcgtgaacgccctgtcatgctccaccgtgcgattttggggtcatttgaacgcttcattggcattttgattgaacattatgcaggtctcttccctgcgtggcttgccccccagcaagtggttgtgatgaacatcaccgacaagcaagctgacagcgtgggcgatgtggttagcaagctaaacaccaaaggctatcgtgccatcagtgatttgcgtaacgaaaaaattggctttaaaatccgtgaacgcaccttagaacgcattccgttcatgctgattttgggtgataaagaagtggagagtggtacggtcaatgtgcgtactcgcacgggcgaaaacttaggcagtatgagtcttgatgactttatcgctgttttagataaggcgattgagaaaaaaggtcggctaaatttgtga

SEQ ID NO: 297 - DNA, 684 bp, M.catarrhalis
aggagtataatcatggctgataccaaaagtattttaacgacaccaatttttaataataacccaattgcactacaaattttgggtatttgttcagcacttgcggttaccacaagtgttgcaaacgctttggtcatgtgtatcgcattaaccttagttacagcattttcaagtttctttatctccattatccgtaacaaaatcccctcatccattcgtattatcgtacaaatggtgattatcgcttcactggtgatcgtggttgaccaaattttacaagcctttgcttatgaaatcagccgttcattatcggtatttgtcggcttaatcatcacaaactgtatcgtcatgggtcgtgctgaagcctttgccatgagcaatccacccatcccaagctttttagatggtattggtaatggacttggttattcagcagtattgatttttgtggcaacagtccgtgaagtcattggtaatggcagctggtttggtattactttgcttgaaaaaatcaccgaaggtggctggtatattcccaatggtttgttgttactaccgccctcttcattctttgtgattgcaggttttattgcaattattcgtctttggaaaaaagaccagcaagaagctgctgaatttatcatgaaacctcaatctaaaggcttatcacacggaggaggtcactga

SEQ ID NO: 298 - DNA, 231 bp, M.catarrhalis
aattactccttaaaggttattttggtaatgcaatattgggaatgctccaacgctgacccagttttattagaccagcacgatggttggatgtacgccagcataattgccagaagcaaaatattttataaaattacttatgatgtctcaaaattcatattatacgctcatttagttatcgccaccaataaaaaactttgttataatccagtattttatactcttttaatttaa

SEQ ID NO: 299 - DNA, 759 bp, M.catarrhalis
tttgacacaattttaaggaaaattcagatgtctatgctgattatacccgccattgacctcaaagatggtcagtgtgttcgtctcaagcaaggtcgcatggaagatgatacagtttttgggagtgatcctgttgcaatggcaagccaatgggtcgcccaaggtgcacgccgtctgcacttagtggatttaaatggggcatttgatggcgtacctgtgcataaagatgtggtgactgccattgccaaagcacatccgcagttgcccattcagcttggtggtggcgtgcgtagtcttagcaccattgagcattatttggcagctgggctagacttcatcatcattggtactaaagcggttgaagcacctgaatttgtagaagaggcgtgtcgtgaatttgcagggcatattattgtaggtattgatgccaaagatggtatggtggcaacgcatggctgggctaatgttactgatatcaaggcaaccgagcttgccaagcgttttgctaatgctggcgtgtcaagtatcgtctataccgatatcgccaaagatggcatgatgcagggtgtgaatatcgaacagacggttgagttggctagctttagtggtctgccagtcatcgcatctggcggcgtaaccaatcttgatgacatcgtggcactcaagccatatggcgattatctgttgggtgcgattacgggtcgtgcgatttatgaagggacattgaatttgtcggtagcacaagcactcttggatgcgtaa

SEQ ID NO: 300 - DNA, 357 bp, M.catarrhalis
cagacacttgtcaatgaatggcgacagtacgaggagagtttcccaaatcttcaacaatcaaaaattgacattgtctcattagagtgtcaaaattcacatgtgccaatggatttgattgaactcattcgtggcaaaaccgtcatggtgggtgcaattgatgtggcaacaaaccaaattgaaacgcctgagcaagtggcagatacgcttcgtaaggcgttacagtttgtggacgctgataaattatacccatcaaccaactgtggcatggcacccttgtctcgcacagtggctcgtggcaagctcaatgccctaagtgaaggggcggcgattgttcgccgtgaactgcttggtaaataa

SEQ ID NO: 301 - DNA, 261 bp, M.catarrhalis; identical to SEQ ID NO: 123

SEQ ID NO: 302 - DNA, 501 bp, M.catarrhalis
attatgatcacattgccaagtctgccaagcaagctgccattgccagcgaagatggtaaatttgttgcgccattatggatttgattttgacagtatacaaaaagccatgcaccgtaacgagagtcagggtgcggtatcggtaggcggctcaaccatcagtcagcagctggcaaaaaacttatttttgacatcgcatcgctcttatgtcagaaaagcagaagaagccatcattgttgtgatgatggaaaccttatggtcaaagcagcgtattttggaggtatatctcaatgttgctgaatttggcgaagggatttatggtattgaagctgcgtcacggcattattttgggcgttcggcagcaaatttaagccgtgatcaggcggctttattaatcagtttgttaccaaatcctaaatattatggtaaaagacccaatgccaagcgtcttaaaaataagcaaaggattatcatgcggcggatgaatggtgtgcagattccttga

SEQ ID NO: 303 - DNA, 240 bp, M.catarrhalis
aaaaaccaggctcaactgtggttgagggcttttttgatgccaacactgccaaagaggtcatcaaagaaagccaaaaacgctggacagagcaataagtcatacattaaaaaaaattactgttctttaaataatatcattataaataaaatggctaaaaaagatgagtttttagccattttattgatttgttacccattgatattacaaagtttgactaataggatgttgctggcttattga

SEQ ID NO: 304 - DNA, 201 bp, M.catarrhalis
gcaaaggattatcatgcggcggatgaatggtgtgcagattccttgagactgtttggctatatatttgcttcatgtgtcatgcaattatcattaatttttggtattttaataaagatgcttaagcactcacatggcagtagggcagccagttatgagttagttaagataaataataacttaattttaatcattaaaatttaa

SEQ ID NO: 305 - DNA, 372 bp, M.catarrhalis
acttggataaaacttatgagcgtgattttaaatgataatcagcccatcatcacctcgctgcttgataatgatttgtataaatttaccatgctacaagccatgttacaccaattcccacaaacgcatggcgtatatcgatttcgttgtcgtaataatcatgaaaccgcctttgctttgggtgagattaaagcagatcttgagcaacagctggattatttgtgtcaactaaaatttactcaagacgagcttgattatctgcgtggcttaagatttatcaaatcagattttggggattatttagaaattatttcactcaaaccgccgttttattacccgtttcaacttgatgaaaatcatttttttaaaaattga

SEQ ID NO: 306 - DNA, 276 bp, M.catarrhalis
ttaacagatgagtattttagcgtgtttcgcacattttttaaatggattctgacacctttattgatgctattttttagttttcatatgatggtgatggggctgttggtggtgtgggggaatttgcctgttcaaaattctgcttttatgctttggcataagttatcacgcggtcgtgttacccacatttgggtagattatgatcacattgccaagtctgccaagcaagctgccattgccagcgaagatggtaaatttgttgcgccattatggatttga

SEQ ID NO: 307 - DNA, 207 bp, M.catarrhalis
  unsure (109): Identity of nucleotide sequences at the above locations are unknown.
gcattcaagtgggtttttgacctttttgccatgaaaatcatccagtttgcccaacgggcggataattcaggctcccttaccaaggccaaaggtcccaaaattcttcaanaaacattcgctttggatcaattggaccttcaattgtcaatttttaaaaaaatgattttcatcaagttgaaacgggtaataaaacggcggtttgagtga

SEQ ID NO: 308 - DNA, 540 bp, M.catarrhalis
gtattacagctacagcatcaacacaactcaaaagctttagaatctgattatatgcagattattgatggcaaaacctccagattatttatgatggcgacaaaaggcgctgcattgctacaagggcgtgaggagtttttggatgatttgggtgcatttgcgtatcattttggtaatgcatttcaaatgattgatgatgtgcctgatgttagtggcgatgctgccatcatgggcaagaacttaggcgatgatttggcggaaggtaaaccgactttacctattatcaagactttggagtttttagaacatagcaatccagccatgtatgataaattgcgtattgcggtgcaaacgggcaaagtagtagatgatgtgcaaatgcttatcaagcttgttcagtcttcaggtgcacttgattattgtaaggcacgcgcgcttgaagaaactaaaaacgctcaacacgcccttaataatctacccaacaaccgttatcgtgaggggctatatctacttaccgagcttgccagttctcgtcttgtatag

SEQ ID NO: 309 - DNA, 576 bp, M.catarrhalis
aatgagcttggtttttattatcttatttactttatggagcaaatcatggctgactttaataaaattctagatgctggcaatgttgatgatggtatcatcaatgtggttgttgaaattccgactggctcaaatcataaaattgagtggaatcgtcatttggcatgctttgagcttgatcgtgttgagccaattgcctttgccaaaccatgcaactatggctttattccccaaaccttagatgaagatggtgatgaattagacgccttaatcatcacagaacagcctttgacgacgggtatttttcttaaagccaaagtcatcggggtaatgaaatttgtggatgatggcgaggtcgacgataaagtcatcgttgttcctgccgatgatcgtaataatggcaacgcctataatagtcttgacgacctaccaccacagttaataaagcaacttgaatttcattttagtcattataaagacttaaaaaaaccaggctcaactgtggttgagggcttttttgatgccaacactgccaaagaggtcatcaaagaaagccaaaaacgctggacagagcaataa

SEQ ID NO: 310 - DNA, 1125 bp, M.catarrhalis
tccgataaaggcagcatcatggcaggtaataccattgggcaactatttactgtaacaacctgtggagagtcgcatggcacaggtttgatggcgattgtggacggcgtgccaccagggcttaagcttgatgctaaagatttacaatgtgagctcgatcgccgaaagcctggcacatccaaatttgccacccagcgtaaagaagaagataaggttgagattatctctggtgtctttgagggacatacaacaggcacaccgattgggcttttgatttataatactgatcaaaaatccaaagattatggcaatattgccaatacatttcgcccaaatcacgccgattatacttataccatgaaatatggttttcgagattatcgtggtggtggtcgttcatcagctcgtgaaacagccatgcgtgtggcagcaggtgcaattgccaaaaagtacctcaaagagcgtttgggcatcgtgatacgagggcatgttacccaaattggtacacaaaaagcccatgcacttgattggaacttggtgaataccaatccgtttttttgtggtgataaagatgccattcccagatttgaagcactggtgacatcgctgcgtgaacaaggcaccagttgcggtgctaagcttgagatatttgccgaaaatgtccctgtcgggcttggtgagcctgtttttgatcgtctggatgccgatattgctcatgccatgatgtcaatcaatgccgttaaggcggtagaaattggcgatggttttgatgtggtagctcaatttgggcatgaaagccgagatgagctaacgcctgatggatttactggcaatcatgctggcggcattttgggcggtatctcaagcggtcaacgcattcgtgttgccatcgctctaaagccgaccgccagtatcaccacacctggtaaaacaatcaatttggctggtgaagcggttgatgtgattaccaaaggtcgccatgatccttgtgtgggtgtgcgtgccacaccaatcgctgaggcgatgcttgcaatggtgattttagatcattatttgcgtcatcgtgctcaaaatgctgatgttgtgccaccaattgaaccgatcaataagccagcaacatcctattag

SEQ ID NO: 311 - DNA, 489 bp, M.catarrhalis
atgataaaagtagatgataactgcccgtgtggctcactaaaatgctatactcactgctgccatcgatatcatggcggtgatgagtttgcacccactgccgaatgtttgatgcgatctcgctacagtgcgtttgtcattcaaaatattgattacatcgtacaaaccactctaccagctttgcaaccgcttttggatgtcgctgcactaaaggcatgggcagagcaaacttggtggacttatcttaagataatatctactacgcctaaaattggtaagcgtcatgcccaagtgcatttttgtgcgtattttgaagagttgggcgttcaagggtgtcataatgagtgttcggcatttgttaaaatcaatgaaaatggacaaaatcggtggtattttcttgatccgacattgccaatcactttgagtggcaagcagccatgtttatgcggttctggcgaaaaattcaaggcatgttgcggtaaatttttataa

SEQ ID NO: 312 - DNA, 777 bp, M.catarrhalis
catcaaccatttaacaaaccaaatcgctttattatgaataaaatcactccatcttcataccttgatttacttgctttgtccaccgatacgctgacagtgcgtcttttggataatgccgattatcagaccgtgcatgaatccatgctaaaccacacattaaaacgcattgagaataagaaaattaatcagcatcatgccgatgagctgtggattgttgagcatcaaaatgtctatacacttgggcaagcaagcaaacctgagcatatcttatatcgtacagacacgcccatcattcaaacagatcgaggcggtcaggtcacttggcatggagatggtcaattggtcgtgtattggctatttgatttacatcgtttaaattttggcgtaagagacttggtcagccatgccgaacaagccatcattgatattgtggcacactatttacccaaaacactcaccgtcaaagcacgccgtgatgcacccggtgtgtatatttataatcatacaggcgatatgcttggcaagattgcaagtttaggatttaagattaagcaaggttttagctatcatggtatcgccattaatcttatcaatgatttaagtgcctttcatgccatcaatccttgtggctatgcagggatgccaatggcgaaattatcaagttttgggcaatttacagcagatgatatgggggtatttatcacccagttgattaaaaatattgctcgtcggcacgctggtttggttgaattacgaacccaagatacgctaaaatga

SEQ ID NO: 313 - DNA, 417 bp, M.catarrhalis
ccttgcaaatttatgtcaaattatcttagctcacagacacttaaggcactcgatcagcttttggatgatcgccatgctctatcaagattgcccaaagaaacttatcagcacatttacgcacaaattttggcgaccttgggtgtaacaaataagggttggtatttgcttggtacagaaggctgtcatttatgccacaacatccaagcgatcattgagcatgctttggcaatgactgccgtgccgattgtttttcgtgttttggatttagcagatagtcaagatgaagcattgattgacgcacttggcgtatacattcccatcttacttacccaagatcaaatgatgctgtacccatttgggctgatggatgtgatgaatttacttaaatcatccgctgttaaaccatggattgtctga

SEQ ID NO: 314 - DNA, 2238 bp, M.catarrhalis
tcattaaaatttaacatgaatcatcaatttcgccttcaggcattatacacatctatccgccaaattttagcaacttttagggaatatgccatgattaacactatgaatgatgtcaatcaagccaatcacgctgatcataccaacccaatgacgcagattgatcatttatttgacgaaaaaggtgcttttacgcctaaatgctatattaaccgtgatttatcagcgttaagatttcagcttagagtattggcacaagctgccaacccaaatcatcctttgctggagcgtatgttctttttgaccattttttcctcaaatttagatgagttttttgagattcgtgttgcaggcttattgcaaaaaatgaaacaaggcgatcaggtgagtagcttagatggtcgaaagcccagcgaaatcttgcaaatcatcagcgatattgctcatggtgctgttacgcagcagtatcagattttaaatgatgaaatcctgccgcagcttgccaagcatgaaatccgctatttgcgtcgtgatgagttgaatgccaagcagcgtgcatggctaaaagactattttgtcagccaagtcaagccagtattgacacccatcagtattgaccctgcgcacccatttccaagactggtgaacaaatctttgaactttatcatcagcttagaaggcaaagatgcctttgggcgagatatcaatcgtgcgattgtgccagcacctcgttcattacctcgtgttattcgcttgcctgatgagattactgatggcaaggagcatcatgtgatgctctcagcggtcattcatgaacatatcaatgagttatttttgggcatgaaagtaacgggttgctatcagtttcgcctaacacgcaacgcagatttggcactggctgacgatgttgatgatatcgccaaagcgttagaaggggagcttgataatcgccgctttggtcatgaagtgcgattagaggttaccacaaattgccctcaagacatttgtgattttttattagatgaatttgagcttgataaatctcagctgtatcgtgtcaatggtcctgtgaatttaacacggcttttgaccagctttgatagacctgaattaaaatttaagccctttacgcccgccatgccaaaggcatttcgtgatatagatatgagtagtgcaggctctatgtttttggcaatatcacgccaagatgtgcttgttcatcatccatttcataccttcaatccagtgattaacttactgtggcaagcagcaagcgatcccaatgttcttgccattaagcagactatttatcgctcaggggtaaactctgagattgtacaagcacttgccgccgccgctcgaagcggtaaagaggtgactgcggtcattgagctgcgtgctcggtttgatgaagcgtcaaatatcgctgtcgccaatatgctccaagaagcgggtgctgtggttgtttatggtatcgtaggctacaagacacatgccaagatgatgctgattgtacgccgtgaaaatggcaaaattcgccgctatgtgcatttgggtacgggtaactatcatgcaggcaatgccaaggcgtatacagattatgggctgtttaccgctaatgctgaggttaccgaagatgtggcaggtgtgttccagcagctgacaggtatgggtagaccactgccatcaaaacaaattttacatgcaccatttacgctccatgataccttgatgcgtttgattgatcatgagattgcccatgtcaaagctggcaaaaaagggcgtatcatcatgaaatttaatgcactcaccgaatgcaaaatcattaataaattatatgaagcaagtatcgcaggcgttcaaattgatttgatcgtgcgttctatttgctgccttcgtccgcaagtggtcggtctgtctgagaatatccgtgttcgctcaattgtcgggcgttttcttgaacatacccgagtatattattttgccaatggtggggaagagcgtctgtactgtagctcagcggacttaatggatcgaaatttattgcatcgtgttgaagtggcatttcctgtacttgataaaaagatatttaagaaaatctatgaagatggcttgatgaattatctaaaagatgatgtacaggcttgggagctgttgggtgatgggaagtggcaaccgcttttagtatcaggtggcacacacgatgcccaaaaaaccttacttgagaaaatcaccttgtga

SEQ ID NO: 315 - DNA, 1209 bp, M.catarrhalis
aaggatgcatcaatgtttgaacatgtaaccacttatgcaggcgacccaattttaggcttgatggataaatatgcccaagacccacgcactgacattaaagtcaatcttggtgtgggcgtgtactataccgaagatggtcaattgcctgtacttgaatgcgtcaaaaccgccgaatccaaaatcaccaatccacctcgtccacgaggatatttgccaatggatggtttgccaggttatcgtaaggcatgccaagatttgttatttggtaaaaatcatcctgcagttttagaggggcgtgttgccacgattgcaactttgggcggttctggtgcgttaaaggttggtgctgattttatccatgagtggtttcctaatgccaaatgctatgtgtcagacccaacttgggcaaatcatgtgggtatttttgagggtgcaggttttgaggtggcaaagtatccttattatgatccaaaaactattggcgtaaaatttgatgagctgtgcgaatttttcaagactttaaatgaaaatgatgtagtgctactacacccatgttgccataacccaactggtgtggatttgacccgtgaacagtggaatgtactattacaaatcgtcaaagataaaaaacttattccatttatggatattgcctatcaaggttttggcgatgatatggatggtgatgcgtatgccattcgtcgtgcggtggggctgggattgacggtatttgtctctaattcattttcaaaaaacttgtcactttatggtgagcgtgtgggcggtttatctgtcgttgcaccaaccaaagaagaagcagatgtggtacttggtcaattaaaatttaccgtccgtcgcatttattcaagtccagctgcacacggcaactatgttgttgatgcggtcatgaatgatgaagcattatttgcgttatggattggtgaggcatatgaaatgcgtgaccgcattcgtgatatgcgtcaaaaactccaagaagcattaagcactaaactgcctgagcgtgattttagctattttaccaaacagcgtggtatgtttagctttacaggactaaccaaagagcaagtgattcgtttgcgtgaagaatttgcggtatatatggttgaaaatgggcgtatgtgtgtggcaggtctgaataattctaatgtagaatatgttgccagtgctatggctgaagtgcttaagtaa

SEQ ID NO: 316 - DNA, 783 bp, M.catarrhalis
aacatgacaaccatgcgttcacatgatgcaattcgtgattttcaattcaccaaagacagtctaaaagataaaattattttggtaacaggtgcaggcgatgggataggcaaggtagctgctttgacttatgccaaatgcggtgcaacggttcttttgctgggtaaaactcaatcaaaacttgaagtggtttatgatgaaattgaggcacttgggttggcgttgcctgccattttacccatggatcttgagcgggcagattttgcacagatgcaaaagctggcaggcttaattgaaaaagaatttggacatcttgatggcgtgctacataatgcagccattttgggggcattgacgccacttgagatgtacgatccgatcacctttgagcaggtcatgcgggtgaatatgacagccgtattcatgctgacccaaagcctaattccgctactgcgtgcagcccaaagcggctcggtggtatttacaagcagcagtgtgggtgcaagaccaagagcgttttggggtgcttatgcactctcaaaacaagcggttgaaggtatggcaaccattttcacccaagaaacccaaaacatgacagcacttcggtttaattgtatcaatcctggtgcaactcgtaccaatatgcgtgcacatgcttttccaggtgaggacccttatacacttaagacgcctgaggatatcatgccagtttatgtgtatttgatgacagatgaggcaagcggtattaaaggtcaagtgattgattgccaaccaaaaaatacttag

SEQ ID NO: 317 - DNA, 597 bp, M.catarrhalis
catcatgactatcatcaaatcagccttaacctacgctttttaaaccagtcgtggcaaatttttcaatcaaaacttcaccaaatgggtgttactgtgagtttgtttcaaaactttatgattattcttgtactgattttgacatcgagttttttctcgatttcagaaattgctttggcaggttcaagaaaaatcaaacttaaattactggcagaatcaggcgatgaccgtgccgagaaagtcttgaaattgcaagaaaattcagctgatttttttgccacttcacaaattggcctaaatgctgtcgccattttgggcggttcggttggtgaaagtgccttgcgtccttatttttccgaatggattggcttggtatatcaagggatttggcttgacagcatcgcttttttttcgtcgtttgttttggtaacactgctatttattttatatgctgacctgattcccaaacgcattgcaatgattaatcctgagcgagtgggctttggtggtcatcaatccgattttgtggacaattcgtgtggtcaagcccttggcatggattatcaataccatcgcagatgtgacttttcggctttttaa

SEQ ID NO: 318 - DNA, 279 bp, M.catarrhalis
ttttttagcctaagactagcccatcttgactatcatttaactgtcaaaaagcaccaaatttttaaaaatttggtgcttggttttatgacaggtgacttagcttacttaagcacttcagccatagcactggcaacatattctacattagaattattcagacctgccacacacatacgcccattttcaaccatatataccgcaaattcttcacgcaaacgaatcacttgctctttggttagtcctgtaaagctaaacataccacgctgtttggtaaaatag

SEQ ID NO: 319 - DNA, 699 bp, M.catarrhalis
agacggtgggatcgcatgggtgcgtttaaatcattgcatgatatcaacccactgcgtctaaactggattgaagatcgtgtgaatgactgttatggttcatcgttggttgccaaatcggtggtagatatcggctgcggtggggggattttggcacattcgatggcggtgcgtggtgcgagcgttttagggattgacttgggtgatgaaaacctaaaagcggccggtatccacgccgccaaaacaggcatagatgggcttgattttcgctgcgttgctgcagaggagttggcggcagaacacgcttctggttttgatgtcgtgacttgtatggagatgcttgagcatgtgcctgatcctagtgcgattgtgcaggcgtgttatgatttattaaagccaggtggtgtgtgtgtgatgagtaccattaatcgcaacccaaaatcttatctgtttgcgatcattggtgctgaatatgtcttaaatttggtggataaagggacgcacgattggcataagttcatcacgccagcggagttagaccaaatggcgatgagcgttggttttcaaagatgtgatttgacgggtctgcattataatcctattacccagcattattggctgtctaataaaaatgttgatgtcaattatatgatggcatttaccaaaccaaacacacaaacagataccccaaaacacacctaa

SEQ ID NO: 320 - DNA, 927 bp, M.catarrhalis
ttaatcctgagcgagtgggctttggtggtcatcaatccgattttgtggacaattcgtgtggtcaagcccttggcatggattatcaataccatcgcagatgtgacttttcggctttttaaatttgatacggctcgtgatgacagtatcccctttgatgatatttctgccattgttgatgctggggcagaggctggcgttttgatggaacaagaacagcactttatcgaaaatgtttttgaacttgaagaacgcaccgtgccatcatcgatgacggctcgtgaggatgtggtatattttgcactcagtgaaagcgaggagagtattcgtcaaaagattgccgattatccttattctaaatttttggtctgtaatgagcatatcgaccaagtcatcggttatgtcgataccaaggatattttggtacgaattttaagcgaacagccaatttttcagctgaatgaatctaccattcgtaatgtactgattattccagatacactcactttatccgagcttttggataaatttcgtgccagtaatgaaaaaatggcggtagtcattaatgaatatgcattggttgttgggctaattacactatcagatattatgatgactgtcatgggcgattgggcagccgctgagcctgaagatttacaaatcattcgccgtgatgaaaattcatggctgattgatgggattacgccgattgatgatgttaaacatgcccttgatattaatgagtttcctgattgggatcactatgagacgctggcgggctttattatgtatcgcctgcgtaagattccacgccctgcagactgggtagagcatgagggctttaaatttgaggtggtagatatcgaccattataagattgaccaacttttggtaactcgcctagagcaactgcccaagcacgaagactga

SEQ ID NO: 321 - DNA, 702 bp, M.catarrhalis
ggaagctttatgacacagcccattcaagccgtgttctttgatttggacggtacattgattgataccgcacctgattttgttcgtatcattcagcagatgtgtgccgatgagggactatctgcccccagtgaagcagcgatacgagagcaggtgtcagcaggcgcgcgtgctatagttcagctgatgtttgccgagcaacttgggcaaatctgtgatgacgatccacgactattaagccgccgccaagcttttttggatcgttatgaaatcgatgtttgtgtagatagccgagtatttgaggggcttgaggtcttacttgaaaaactcgaggggtatcgtatcccttggggcattgttaccaataagccacgctatttgacagaaaacttattggacaagctaaatttatcatcacgatgtggtgttttggtctgtcctgatgatgtcaaaaatcccaaacctgaccctgagcctttatatttggcgtgccaaaaaattggcgttgaaccgttggcatgtatttatattggtgatcatcgccgagacattgaggcagggcggtctgctggtatgcagacagccatcgcagggtttggttatttatcggcagcggatttggcaagtatcgatacttggggtgctgatgttatcatgcagacacccaaagcgttgacggattgggttttgcaacaagttttataa

SEQ ID NO: 322 - DNA, 1521 bp, M.catarrhalis
ggaaaagatatgccagcacatacatttcaaatcagcgtcaaaaatacgctgaccttaaaaaaagccaccaaaaacaaacccttacccattgttgtggtctttgttaacgatgaaggtcaaattttgggtaatttgggtgatgcccaatatatatcacgcgccacagcacttatccagcaaagccactttaaaggcacgcttggtaaaagcgttaccgactatgctttagatgaccaagcatctccagccatcagtattgttggcgtgggtaaacttgataagcttgctgataatatcgctaaagttgccgtggcaacttatgatgtgattaaaaattctcaaagtgcggcaattttgtggggtgataccatttgccaaattcactttacacaatttgtcaccgccttaattggtgcaagctatcgttttgagcatcacaaaaccaaaccaaaagatgccgatactttgcgtgaaattgttatcatcagtaataaagacactcaaaccgactatgataaagcacttgtatttgctcaagcaactgctgctggtattaccaccgcacgagatgtcgccaatgaagctcccaatgtgcttaaccccagcgagcttgcaaaaaaagccaaacaacttgccaaggattatgccgataccgtttcggttaccgtgctgaatgaaaaagacatgaaaaaacttggcatggggtgctttcttgctgtctcacaaggctcagatgcagaaggcaaacttgccgttattgagtattatggcaaatccaaaaaatccgataaaaaagctaagctagataagccatttgctttggttggtaaaggtctaacctttgattcaggtggcatctcactaaaacctgccgctggcatggaagagatgaaatttgatatgggtggtgctgcctctatcttgggtactgtgcgagcagtcgccgaagctggacttgaaattgatttggtcgctgtacttgcttgtgctgaaaatatgccttcatctcgttcagctcgcccaggtgatgttgttaccgctatgaatggtactactgttgaaattttaaacaccgatgccgaaggtcgcttggtgctgtgtgatgcactttgctatgtccaagagcattacgatgcacgcattatcatcgatacagctaccttaactggtgcttgcgtgattgcactgggcagcgttcgttcaggcatgtacagtaatgatgaagatgcactctttgccctgcaagcagccagtgagtatacgggtgatttggtttggcatatgcctttagatgatgcctatgatgagcagattaattcaaaaattgctgatgtccaaaatattggtgggcgtgaagcaggttcagttaccgcagcatgtttcttgcaaaggttcatcaaagaaggtcaagcttgggtacatcttgatatcgcaggtcctgcttggaagagtggtagcaccaataccgcctcaggtcgtcctgtggcgttgctaacccagtatctacgcagccaagcctaa

SEQ ID NO: 323 - DNA, 1089 bp, M.catarrhalis
ggagcctgtatggcatcaaatacacgatttggtttacccatttggtcaatgctcttgccattggtggcttgggggttattttttgtgggcataaaaacccatctgctgttacaaattttggggggcgtgtttttaattggtagtgtgttatcggcagtttatcacacagaggtggtcgcgcataaggtcggagagccttttggtaccattattttagcgttagccattaccatcattgaggtcgcactcatcatctcgctgatggtcacaggcggggataatgcagcgtatttacctcgtgatacggtttttgcagcaattatgttgattttaaatgggattcttgggatgtcgctgatgattggcggtctaaaacatcgagaacaattttttgggcaaaaatctgccagcaccgcattaattacactggtctcaattttggtgatgaccttaattttaccaaattttaccacttccaccacacaaggcacttattcatcagcacagcttatgtttgtggcggtggcctctttggtattgtatggttcattcatcatggttcagacagtgcgtcatcgtgattattttttggcagctgatgatgatttggatcaccatgcccaaccaccaagcacaaagattacaaccatcagctttatatttttgttaatctgtttgggcattgtggtcatgcttgccaagagcctaagccccagcattgaggcggcagttgcttatatgggtgcacctgtcgcgttggttggggtgatcattgcagcggtggtgttactgcccgagggattggcggcattaaatgcggcacgccacaatcgttttcagaccagcttaaacttagcattaggttcagcattggcaagtattggcttaaccattcctgctgtcaccattgtttgcttaatttatgatattccattggtgctaggtttagatggtaaatctatggtattgcttggtttatcaacttttattgtcatgctgtcacttaatcaaggacgcacgaacattttatacggcattgtattgttggtgaatttatcggcgtatgttttcaccatcattgcaccataa

SEQ ID NO: 324 - DNA, 939 bp, M.catarrhalis
ttaaaaggaattgcggtgagtgtaactctaagacagctcaaagcctttttgttggtagctgaacaaaatagttttaccaaagcagccgagacattgtgtctcacacaatcagcattgtctggattaatcaaagagcttgaacagaatttgggtgtcaaattatttgaccgcacaactcgcaaactgcatttatctgatgctggtatgcgacttttgccacaagctcggcgtgtgcttaatgagatgtcagttttaaatgaaaaggtgaataacctaaaatcactgcatcaagggcatgtgcgtttggcagtttcgcaacaattatcagcaagcacgatgccaaaatttgtggcaaagttttgtgatattcacccaaatattcaagtgacactcaccgattgctcggttgatgatgtggtggagcatattgaaaatctagaagcagatttgggcgttgccccagagcgggtgcattctgatgatttgcaggcggtggtgttattttcttcgccattttatttggtgttgcctgccactcacccatttgccaaaaaagatgttttgcgttggacggatttattgaatgaacggctgattacgcttaatggcccgtttattaaaagtctacaaaatgaactgcctgctcaaatttcaagccgtatttttaactctgagtttgaggtaaattttttatcaactgcacttggaatgacccgaatgggacttggcgtaaccttatgcctattatacgctgctgaatgggtggagcaaaatggcttggtgatgcgtcctattgccgaccctgtggtagagcgtaaatttttattatatacgcacaaaaatcgctcattatcacctgcagcgttggcatttaaggagtttttagaacaaaatgcccatgaatttttagtcagtcattcaaaagtatcaggtatctaa

SEQ ID NO: 325 - DNA, 297 bp, M.catarrhalis
  unsure (46): Identity of nucleotide sequences at the above locations are unknown.
agtgtcaggttttacgccggatgcaggtgttgttgtgggcataacncaaaaaaaagcctgttttcaacagtgacaccaacggtggctgcccaatcaagaactacccacagtcaaaaacaagaaaccaaggttggttttggtgtgctggctggggcgcaatatgccatcaacccacagcttagcgttgatgctggcgttgagtataattatctgggtaagtatgataaattggatacagccagcaagcttaaggctcatcaatatggtgcgaaagtaggtcttcgccataacttttaa

SEQ ID NO: 326 - DNA, 270 bp, M.catarrhalis
atgatgttaacgaataaagatcgtgaagcggtaattgcaaaatatcagcgtggcgagaatgatactggtagcccagaggtgcaagtggctttattgaccgctcgcattaatgacttacaagaccatttcaaagcacacaaagccgaccaccacagtcgccgtggtcttatccgcatggttaaccaacgccgtaagctattggactacctaaaaggtaaagatttgaaccgctatactgacttaatcggttcattgggtctacgccgttaa

SEQ ID NO: 327 - DNA, 660 bp, M.catarrhalis
ctcatgataaccatgacagaaaatttttcaggcttaaccattgctctatcaaaagggcgaattttggacgaaaccttgcctttatttgctaaggcagggattgtaccgctagaaaatattaaccagtctcgaaagcttatttttccgaccacacatcccaatgttcgtttgttgattttgcgagcttctgatgtgccgacatatgtagagcatggggcggcagatattggcgtggcgggtaaagatgttttgatcgaatatgatgcacagatttatgagctgctggacttgggcatcgccaaatgtcgtctgatgactgcaggtgtcaaaggtgcagtactgcctaatcgccgcttgcgtatcgccaccaaatacaccaatgtagcacgcaactattttgcgtctcgtggtgaacaagtagacatcatcaagctgtatggctctatggagcttgctcctttggtggggcttggtgatttgattgtggatgtcgtagatacgggaaataccttgcgtgccaatggtttagagcctttggaaaccatctgccaagtgtcatcacgcctgattgtcaatcctgtcagctataagcgtaaattggtacagattgagccaattttacaaattttggaaaaagctgtcttggagcagggtgcttaa

SEQ ID NO: 328 - DNA, 498 bp, M.catarrhalis
acaatggtaacaaatacagcagtgtcgcacagtcctcagtacgatgattctgaatttgaatatgcaggattttggatacgatttgtggcatgtcttgtcgataatttaattattatgattataattgcaccgtattggttttataattatcagcaaatgatggccatgcctgctgaccaaataccgttttatagtgttggggatgccatcctttatagtgctggggatgctatcctaaacttagtgatggcggcggcggttgtttggttttgggtaaaaaaaggtgcaacaccaggtaaaatgctctttgggctgcaagtccgtgatgccaaaacagggcaatttatcagtgtgccaagggcattattgcgatattttagttatctgatttcatccgtgattctttgtttgggacttatttgggttggttttgataagaaaaaacaaggctggcatgataaaattgccaaaactgttgtggtaaaacgcattcgctga

SEQ ID NO: 329 - DNA, 291 bp, M.catarrhalis
tgtaattattttgggtggattaaccgccctatggcaatgagaaaacctatgaatgcacaagctttaattgagctacttcgcccacattttgccgatgcccacattgatgcggtgaatgaaggtaataaatttgaattgttgattgttgatgatgcctttgagggcaagcgtttggtggcgcgtcagcagatggtttatacacttgttaatcaatatatccaaaacggtgcaatgcacgctttgacgattcatgcgcttacgcctgcagaatatactgccaaaaaagcttaa

SEQ ID NO: 330 - DNA, 1578 bp, M.catarrhalis
gcaaagccagccgtttgtgttttgcacaaattagccaaaaggaaaataaccatgaccatcattaaacaagatgatttcattcaaagtatcgccgatgcatttcagtacattagttactatcacccgacagattatattgaagctttggttgaggctttggcgcgtgaagaaaaccctgctgccaaggatgccatgacccaaattttggttaatagtcgtatgtgtgccgaaggacatcgtcccatttgccaagatacgggtattgcaactgtatttttaaaagttgggatgaatgtcacttgggatgcgaccatgagcgttgaagatatggttaatgagggagttcgccgtgcttataatcatgctgataataccctgcgcgcttcggtattgactgacccagcaggcaaacgccaaaataccaaagataataccccagcggtcatccatatgcagattgtggcaggtgataaagtggaagtgacttgtgcggccaaaggtggtggttctgaaaataaatcaaagcttgccatgctaaatccatcagatgatattgttgattgggtactaaaaactatccccacaatgggtgcaggctggtgtccacctggtattttgggtattggtattggtggcacaccagaaaaagcagcactgcttgccaaagaatctttgatgagccatatcgatattcataaacttaagcaaaaagccgactctggtgcccagctgtctacgacagaagcgttacgcttggaaatttatgataaagtcaatgcgttgggtattggtgcacaaggtttgggtggattgacaacggtattggatgtcaagattttagattacccaacacatgccgcttcaaaacctgtggcaatgattccaaactgtgcagcaactcgccatgtggaatttgagcttgatggttcaggtcccgttgagcttatgccaccaagcttggatgtgtatccagatgtgacttataatcctgaaaatggtaagcgtatcaatgtcgatacattgaccaaagaagagatagccaattggcaaacaggtgatgtgcttttactgagtggtaagatttacacaggccgagatgctgcacacaagcgcatgacagatatgctcaataatggtgaaacgctgccagttgatttcaccaataaaattatctactatgttggtcctgttgatcctgtgggtgatgaggtggttggtcctgcaggcccaacaacagcaacacgcatggataagttcacccgtcaaatgctggagcaaacgggtttattgggtatgattggtaaatcagagcgtggtgaggcagcttgtcaagcgattgctgataataaggcggtctatttgatggcagtgggtggctcggcctatttggtttctaaggcgattaaaaatgccaaagttgtggcattccctgagcttggtatggaggcgatttatgaatttgaggtttgtgatatgccagtgactgtggcagtggatagtagtggcagttcggtacatgcaacagcaccaaagatttggcaagctaaaattggtaaaatcccagtagtagaagcttaa

SEQ ID NO: 331 - DNA, 1365 bp, M.catarrhalis
ccaagatttaatcatgataaaacttgtattgaatttgtatttattaaaagagtatccatgccaactttaaaaattctaaaaagtcaagatgataactttgccagccaattaaaagatttgcttgcctttgaaacggtaactgatagtacgctgattgctactgtgaatgatattatcgccacagtacgagaagatggtgatgacgcagtgcttaaactcactcaagaatttgataagcacccagccaagagtatgcatgagctgtttgtcagtgctgatcaattaaaagcggcatttgacggtttggctgatgatgtcaaacatgccttacaatacgctgctaagcggatttttgagtttcatcagcatcaagtcgaggcaggttttcgctttaccgatcatttgggcaatagtttgggacaaaaagtcataccccttgaccgtgtgggtatttatgtgccggggggattggcaagttatccgtctagcgttttgatgaatgccatacctgccaaagtcgcaggcgttgggcatatcacgatggttgttcctgcaccgaatggcgagctaaatcctttggtactggcggcagcacatctgtcgggtgtggatagcgtcattacaattggtggggctcaggcagtggcagcattggcatatggtacagacagtattgccaaagtagataaaattacaggaccgggcaataaatatgttgctgctgccaagcgtgcagtatttggacaagtgggcattgatatgattgcagggccatctgaagtgctggtctatgccgaaggtgaacctgatgataatgctgactggcttgctatggatctgttatcccaggcggagcatgacactgtagcacaggcgatttttgttaccacttgcccaagccagttagatgcggtcaaagatgccattgatcatgcgttggcagaactaccaaaagcggatatcgcaaagcaggctcttgccagtcgtggagcgttgattttggtcaaaaaccgagctgaagggattaacatcatcaatcaagtcgcccctgagcatttggagctgtcactgaataaccctgaagaagtggagcaatatgtacgccatgcaggagcaatctttctaggaaggcatacgccagaagctatcggcgattactgtgcaggttctaaccatgtcttgccaacatcaggcacggcacggtttagctcgccacttggggtctatgattttaccaaaaaaacctcgcttatctattgtacaccaaatggtgccaaacctttggcaaaaacagcagatattttggcagtacaagaaaacttggatgctcatgccttatcggcacgctatcgtcatcatgattga

SEQ ID NO: 332 - DNA, 1266 bp, M.catarrhalis
gttatggataagtttaaaattataggggcaagtcgtatcattggtgaggtcaccatttcaggttcaaaaaatgctgctctgccactgttggcagcaatgctactacccaatggtgaaacggtgcttcataatgtgccaacactaaaagatacagccactttgattgaactgattgcaggtactggcgtaaaaatttataaagaaggtaatacggtcacagcagatgcaagtgttgtgacaaattattatgcaccttatgagttggtgcgtacgatgcgtgcatcgattttggtgctaggtccattgcttgcacgctttggtgaagcggaagtcagtttaccaggtggctgctctattggctcacgacctgtggatcagcacctaaaggcactagaagccatgggtgcaactatcgaagttgaaaatggctatgttaaagctcgtgcaccagcaggcggtcgcttgataggctgtgattttagctttgatatggtgacggtcggtggtaccgaaaatatcatcatggcggcaacgcttgctttgggtaccacacgcttagaaaactgtgcgactgaacctgaggtggtagatttggcaaatatgttggttgccatgggtgccaaaatcagcggtatcggcacaacaacaatggttattgagggcgttgagagcttgcatggctgtgaatacagcgtgatagcagatcgtatcgaaacaggctcttatttggcaggcgcactcatgagccgtggtgatgtcttagtgctcaatacatcggcagagtttttacatcctgtactcaaaaaatttgaagccatgggtgcgaccattaccacaggtcacaactggattcgtgcggtgatgaccacgcgtccaaaagctgttgatattcgtactcaagtacatccaggatttccaaccgatatgcaggcacagttgatggcggtgtgctgtttggcagaaggtacaagcacgattattgaaaatatctttgaaaatcgtttcatgcatgtgccagagcttcagcgtatgggggcaaatatccgcatcgatggtcatactgccattgttaaaggtgttgaaaaatttatgccagcgcccgttatggcaaccgatttacgagcatccatgtcgcttgtgatggcggcggcgtgtgccgaaggtgaaagtgttattgatcgcatttaccatatagaccgtggctatgatgatgttgaaaataaactgcgtgggttgggtgttaatattgagcgtatcaaaggctaa

SEQ ID NO: 333 - DNA, 186 bp, M.catarrhalis
ttgtcaatcctgtcagctataagcgtaaattggtacagattgagccaattttacaaattttggaaaaagctgtcttggagcagggtgcttaaaggtcgtgtcatcttttttgtttatgatacgcttgttcctgatagcatgttgggtaaaatatatcttgagcaaagccatatcatattttgctga

SEQ ID NO: 334 - DNA, 828 bp, M.catarrhalis
attaaaatcaatcaagcaatccgtagctttactataagatatatcccagtaatatggaaacatagcatgatgaaaaaattattaatcgttttgacgagcatggcaatgattggtttgacagcatgtgtcagcaatggcacacaaagtgtcggcgctgatgcgatgggtcgcaccattcctgagcgtatcagtgatagtagtattgagcttaccgcacgccgtaatcttgcaaccattccgggtgtcagtccaaatacagtgcgtattgatattgccagttttcgccgagaagttttattgactggcgaagtacccagtgaacagattaagattgaagttgggcgtacgattgactcgatgagagatgtcgaaaaagtctttaattatttgactgtcgttgagacacccaaaagccaaagccatactttgcatgaaaattatttacgctcaaaaatcaatacccgcttactaaccaaccgccatcttaaatcatcacaatataaggttgttgttcgtgaccgtaccgcttatgtactgggctatttgacatccgagcagcaaggttatatcttagaagccattcaagcgacacccggtatggaggctgcggtaactttgacgactttggtgagtgttcaggagttagaaagttataccaatcatgaagtgaatacacaggcgtataccaacgatgatggctatgatgccatggtggcaaagcctgatacgcaagaagatagtggctatatattgcaagaaatttatacacccaatgccagtaatgtagccccagccaatacagcacctgtatttgagatctctcaatag

SEQ ID NO: 335 - DNA, 450 bp, M.catarrhalis
aattgccaaaactgttgtggtaaaacgcattcgctgatgggtcgccagttaaacaataaaaccatcaaacgcaagcagggcgatgtgtttgagcagttggcggtagataagctaaaacaagcaggctatgaaattattttaaccaactttaccaccccatttgttggtgagattgatattatcgccagacagcctttggagcaatcgcaccgtttggtgcagccaagattttgtacggtatttgttgaagtgcgtagccgaacaagttctgtgtatggtacagcgcttgagagtgttacctcaaaaaagcaggcaaaaatctaccgaacagcagaacgatttttaatcaattatcccaaatatattgatgatgcataccgttttgatgtcatggtttttgatttggttgatggattgattgaacatgaatggataaaaaatgcgttttga

SEQ ID NO: 336 - DNA, 360 bp, M.catarrhalis
tatacgctaagcgcggatccttgccgccccgtggtgaacacccctggtacaaatcaagcgggcaataacccagagcaattttttgcaatgggatatgctgcatgttttgatggtgctttagcgcttgtcaaaaaatcagctgacaaatcatttgatagcagaaccgaggtaaccattgagcttaacaaagaaggtgattctaacttctttttcactggtgctattcatgttgttgccagtaatggcgatatcaccgaagatgagctgttatcattggttgaaaaaacgcatactgtttgcccctactcaaaagcagttcagggcaatattgacatgaagctgagtgcttcggtagagtaa

SEQ ID NO: 337 - DNA, 492 bp, M.catarrhalis
gaagctttgatgaaattacgaattttaagtattgggcacaaaatgccaaattgggtacaacaaggctttgaagaatacctcaaacgcattcagcccatgattagtgttgagatggtggaattacctcccgccaaacgcagcaaaaccccctcacctgccgagattgataaatataaagccatcgaagcgacgacaattttaaatgccaaacatccaaaagagcgattatggctgcttgaagttaagggtaaaatgctgtctactgagcatttgagtgataagctgagtgtggcgatgcaagatggtgcagatattgccttggtgattggcggtgctgatggcgtttcgcctgagatattgcaagcagcagattttaaatggtcattatcggagctgaccttgccgcatccgttggtgcgtatcattgtcatagagcagttgtatcgtgcgatgagtctgattaatcatcacccctatcatcgtggtgggtag

SEQ ID NO: 338 - DNA, 1113 bp, M.catarrhalis
aagtgtcggataatcatgagtattgacaaccgtttgtggagtactaaggcaaaaaaccttagcccttatgtacctggcgagcagcccaagcatgataatttggttaaactaaataccaacgaaaatccctatccaccaagcccaaaagcagtgatggcaatgcaggcagtgctgagcaatgaggcttgtgcattgcggctttatcctgaacctgagtcagacgaactccgccaaactttagcagattatcatgggcttgggttagatgaggtgtttgttggtaatgggtcggatgaagtattggcattggtatttgcatgtttttttatgaaacagcgtccattattgatgcctgatattagctacagcttttatcctgtttatgctgatacctttggtgtcacaacccaaagtatcccacttaaggacgattttagcattgatataaaagagtatcatcagtcgtgtgatggtattatcttggcaaatcccaacgcaccaacagggcggttgctgcccatcgaagatatcaaaaagctgattgccatgcaccctgatgcggttgttgtcattgatgaggcatatattgattatgctgatgatgtcaagcaggcatctgcggtgagactgattcgccagtttgataatttggtgattacccaaactttttcaaaatctcgtgccttggcaggtttgcgtgtgggcatggcatttgccaatccaaatttaattgccgcattgatggcaatgaaaaatagttttaattcttatccacttgaccgcttggctcaagcaggtgccaaagccagtgttgaagatgtggcatattttgaagataaacgcactcaggtcatcaagcttcgcaaagcactcacccaagacttgcagacgcttggctttaccgtactgccttcagcggcaaattttgtatttgcaactttgccaaaccatcaagcagctgatttaagtcaggcactacgccaagaaggtgtgattgtgcgtcattttaatcagccacgcatcaaggattatttgcgtattagtgtgggtacgcaagcacaaaatcagcgattgattgatgtattgacgcagattttggcaaaaatggattaa

SEQ ID NO: 339 - DNA, 2100 bp, M.catarrhalis
aaggatcaatttatgtttaatcccattcgtcaagaatttcaatatggcaaccaacaagttgttttagaaacaggtcgtatcgctcgccaagccaatagtgtgcttgtgcatatgggcggcgtttcagtcttggttgctgtggtcgtgcgtcctgaagccattgctggtcaaaacttttttcctttgacggtgaattatcaagaaaaaatgtatgcttcgggcaaaatcccaggcggttatggcaagcgtgaaggtcgtgcgtcagagtttgagacgctgacttctcgcttgattgatcgcccaatccgtccgctatttccagagggctactttaacgaaattcaggtaacagcaacagtcatttcatcagataaaacccaagatgctgacattgcagcgatgattggtgcatcagcagcgttagcaatttcaccagcaccatttaatggtcctatcggtgctgctcgtgttggttttatcaatggcgagtatgtactcaacccaactttggctgagatgaagcaaagtgatttggatttggtcgtggcaggcaccaaatcagcggtactgatggttgagtctgaagctaaagagctatcagaagaccaaatgctgggggcggtgctttatgggcatggtcagcagcaggtggtgattgataatatcaatacattcgcccaagcggtaggcaataccaagcaagaatttgtcgcccctgccatcaatgaagagctaaatactcagctaaaagagcagttcaccgctaaagttagtgaagcctacacgattaccgtcaaacaagaccgctacgcacgcttagatgagcttgccgcagaagctttggtactggcaggcgatgagacaagtgatgactatgccgataaagtcgcccaaattaaagagctatttgaaaccctaaaatatcgtaccgtgcgtgataatatcttatcaggcaagcctcgtattgatgggcgtgatttggagactgtgcgtgccttggatattcaagtgggcgtcttgccttatacacacggctcggcactgtttactcgtggcgaaactcaagcgttggttgtaaccactttgggtacaacacgggatgtgaaccttgtggatacgctggcaggcacaaagcaagatcactttatgctacactataatttcccacattattcagtgggtgagacaggtcgtgaaggtgcaccaaaacgccgtgaaattggacatggtcgcttggcacgccgtggtgttcaggcgatgttacctgccgctgaacgcttcccatacaccattcgtgtggtctctgaaatcaccgagtcaaatggttcatcatctatggcgtctgtctgcggtgcgtcgttatctttgatggatgcaggcgtgccgctaaaagcccctgttgcaggcatcgccatgggactggtcaaagaaggtgagcgttttgctgtgctgtcggacattttgggtgatgaagaccatttgggcgatatggactttaaagttgcaggttcggtaaatggtatcacagctctacaaatggacattaagattgaaggcattaccgccgatattatggaacaagccctaaaacaagcacacgcaggtcgtatccatatcctaaatgccatgaatgaggtcatcgcaacctctcgtactgagattaacgctcatgcaccaaattatgccaccatcactatcaaccctgaaaaaatccgtgatgtgattggtaagggtggggcgaccattcgtcagctgactgaggatacaggtgcaaccattgatattgatgataacggcacaattcgtatttttggtacagataaagcatcaacccgtgccgccattactcaaattgaggcgattaccgccgaggttgaagtgggtacagtgtacgaaggtacggttgctcgcattgttgattttggggcgtttgttaccattttaccaggcacagatggtctggtacacatcagccaaatctctgatgagcgtgtggagaatgtgagcgattatctaaaagaaggtcaaactgtcaaggttcaagttcaagacattgataatcgtggtcgtattaaattaaccatgaaaggtgttgaataa

SEQ ID NO: 340 - DNA, 222 bp, M.catarrhalis
agttctaaattcatgctcaatgcaattgatgatttaaataacaaacaaataattaataaaaaacggcacgcaaaagcacgccgttttcggtatcgtatacaggttaaaaacccaatgccacaaggacaaattaacggcgtagacccaatgaaccgattaagtcagtatagcggttcaaatctttaccttttaggtagtccaatagcttacggcgttggttaa

SEQ ID NO: 341 - DNA, 219 bp, M.catarrhalis
tgccaaggattttgcaagtctgctttgatgactgatgagtcaaaagggaggtttgcattacaagagggtattggctattttattaggagaattttgtatatcggttttaattgctcatatcatgatgctgttaccaagccatgctttgatcaagcttatcagctggaattggtcaagtttcatacagtctatttgagcagttttattataagggaatga

SEQ ID NO: 342 - DNA, 414 bp, M.catarrhalis
tttttggtgtcgctactgccaagccacagagcggataatttagcaaatgcccaaagtggtatcagagtgctgattatgatggtcgccgaaaccgatagtaaatcctcgccaagcccaaataacaaaatccctgcgcctgctgagactggtaaaaaggcaaagccactatcaacaagtaaggtacttgctgagcttgatagccatgctggcaaccctaccgacatacgcacacccaccaacacaataaataagctcaccaagccgacaatatttgccgccgttggtatcccaagccaagtacataccaccaatgccaattcacgaaaacccaccacgatggcggccgttacgatcatggcaagccaaaatcttttattgcctaatttaagcgtcatatttattcctttaatataa

SEQ ID NO: 343 - DNA, 1683 bp, M.catarrhalis
ataatgcagtatgttgctcctatccgtgatatccagtttgtgatgcatgagcttttggacagtcaatcacactacagtaaactgtctgcttatgcagagcttgatacagatacaatcaatagctatcttgaggcggcggctgattttgcacagtccgtgattgcccctttgaatcgtacgggcgatatcgaaggctgccaatttaatcatggtgttgttacgacaccgactggctttaaggaggcatacgcacaatactgcgagcttggttttcctgcgatcaatgctgagcctgagtttggtggcttgggcttaccagtatcattatcaagtgcggtcagtgagatgatggggactgccaactggtcatttgcgatgtatccggggctatcacatggtgcaattcaaaccattgaacatcatggcacagaggttcaaaaagccacttatcttgaaaagatgaatacaggggcttggtcaggcactatgtgtttgaccgaatcgcatgcaggctctgaccttggtatcatcaagacgcgtgctgtacccaatgaagacggcagctatgccattactggtcaaaaaatctttatctcagcaggtgagcatgatttaaccgaaaatatcattcatatcgtactggctcgcttgcctgatgcaccagcaggcaccaaaggcatctcgctatttatcgtgccaaaattcatcgtcaatgatgatggttcggtgggtgagcgtaatacggtcagctgtggctcaattgagcataaaatgggtatcaaagcatcagcaacttgcgtaatgaattttgatcatgccaaaggctatctcatcggaccaaaaaatcgtggtctaaatgccatgtttacttttgtgaatgtggcacgcttaggcactgccatccaaggtttggcagcgcctgagcttgcttttcaggggtcgctaacttatgccaaagaacgtaccgccatgcgtgctttatcgggtgtcaaagagccgaataagtcagctgatagcatcattcatcatcctgcggtacgcaatatgctactgacccaaaaagcctttagcgaaggtggtcgggctttggtgtactatttgtcttactttgcagatactgtcgccaaaggtgaaaacccaagcgaggttaagtttgctgatgaaatgttgtcattattaaccccaatcaccaaagcattcttgaccgaaacgggtcttgagtcggcgaatatgggcgtacaagtctatggtggtcatggctatatcagtgaatggggcatggagcaaaacttgcgtgatacacgcatttcatgcctatacgaaggcacaaccgaaatccaagctttggacttgcttggcagaaaagtacttggctcacaaggtcgtatgttggcgaattttactcagataattcatcaattttgccaagaaaatgcagataatgatgaagttggtcagatggttagtacactggctaagctaaatcagcagtggcgtgatttgacttctcgtatcgccatgcaaagcacgctaaaccctgaagctgttggtgctgctgcggttgattacttgtattttagcggctatgttaccttgggatatctttgggcaagaacagcggtcttggcaaaagccaaattagctgagtttgatgctgatcttagcactgataaatcattgtaa

SEQ ID NO: 344 - DNA, 294 bp, M.catarrhalis
cgacaccaaaaatcacagaggtggattatgatgcttgacaccaccacgattgttattgcttttatcattactttgattgcacatattggggccaaatatgtccttcgctatttaaataagtttatcaaaggcgtgcctatgatcatcggtgctatcatattgacgctgattttattattcgtcattgggcttgattatcatacttattacgcacatgccaaacctgtttttgatcgcttgcttggttattgtaccaaaactggtaaccgggccctttacgggcatggattttaa

SEQ ID NO: 345 - DNA, 2391 bp, M.catarrhalis
tcaaaagacagccaatctcactgtccaattggttacaatctgatgttattgatgggcaaaatcatccagcggagtttcattgtgctagaaaatgacatgtcaaatcttgaacaaatattacagcgtatcgttgtgctacaagagctgccagaacctgaagccttaaaacgcttgatcgatgctttgcgtgttactgacgaagatgaagataatgaaattgtggatgccaaatttgatgagctgattgcacttttgcgtgagcatcctgagtatggttcaggattggcggcctttattttacggttaattaataaatatcgtcaaattactttatatacagatacaggcattgcatccgatcaaagtttttcaagtagtgtctcacgcttaatcagccaccgttttttgccattactgcccgaagaggattcggtggttgagcttgctaattatctttttgataggaataatgattggaagtgggtagaatccatctcggatgaacgatgggatgctttggtgccgttgattcgtcctgatgaacaggatctaagtttggtggctcaagccaaaaacagcattctaaatgccatcgtggtattgtcatatcgcatcagcggcattggcctacatcctgagctgatgaatttttatcctgagctgctgaattattcggcggcatttgtggcacaaaatcaagaagcggtgttatttgtcaatcaatatcgccaagctcatgaactggatttgatgacagatgtcatccctgatcaagacatcgaccctgcccctttgatggtgatggtggagcaatgtgaagatattgtcgatacactcagaaagcgagtatataaaacaggtatttcaattcgtctgacaaatatgttagcacgccttgagcaaagtttacagcgtatgcggactttggttgagcttgtgagtgatgcagagcataagcgtgatcaagcgattgcggatttgaccattgaagtggtgcagactgccaaaactcgctacagttttagctcattgattgagtcaaacacccgccttttatcacgcaaagtaaccgaaaatgcagggcgtgttggtgagcattatattagtaccgatagaactggctaccgtaaaatgtataaaaaagcagccattggcggcttatttatcggctttatggcgacattaaagatgctgtcttaccatgtggtattagcaccaattggacgcgcttttgttaatagtatgatttatggcttgggctttgtttttatccacattgccaaaggcactgttgcaaccaagcagccagcaatgacagcagcagcaatcgcatcaaccatctctggctcatcaggcaaaaaaactcagcagctggcaaaattagctgaattggttgttgatattttacgcacacagtttatcgccattttgggtaatatttcagtggcgatgccagtggctttattgattgcactggcatgggggtatttttatgatacgccgatgattgatggcgctcaagctgctcatttattgcatgacttagacccaattcgttctttggcattaccacatgcggcaattgctggggtgtttttatttgtctcaggattggttgcaggctattatgataatttggctgcttataataaaattggtgaacgcatacgcaagcattgggttttgatgcgtgtgatgccaaagcggtggctggataagatgagtagttttgtagaagccaaccttggtgcgatcatgggtaactttatttttggctgttttttgggcagtacagcaacggttggctatatgcttgggttacctttggatatccgtcatattgcttttgcttctgccaactttgtgcatgggctatattatctatcgcctgagcatttgacttggcaggtggcaatattgtcttttgtgggcatgttgctgattggtatgatgaaccttttggtcagcttttcgcttgcgttgatggtggcattacgctcaaaagaggtgaaattcacagaatggaaacagctttacaaactggttaccaatcattttatcacacgccccttagattttgtctggccgcgtaaacaaactgtcaaatatgccaagattaatagcttgggtgagattatttttgaggaagcgacggacgaaaaagccaatcacatttttgctgattcaattgtccgccgcttaggacgcaataaacccaaagacgcatcaaagggtgaagtgcccgatgatatccgagaagcgatcgaagcgtatcataatgatgaattggatgagtcaggtaatctggtggataaatcatctgacgactataacgataatggcatcaattctttaccaaaaccctcaacgccgcctaatttaccaggttga

SEQ ID NO: 346 - DNA, 1491 bp, M.catarrhalis
tgcccaccaagagacaaaatacacatgcgtgaacataatcatatcaacgaagatcacgacgcttcttcatcacagttaggtgcactgattcgcctaggcaaggagcaaggctatctcacctatgctgaagtgaatgaccaactgccagagtctgtcaccgaaagcgatcaaattgaagacatcattcagatgttgaccgatgtgggcattcaagtctttgaggtagcaccagatgatgatgatattttattatcagacactggtagcgatgatgacatcgcaaccgatgaagcagcagcagtactagcctctgttgaaactgagcctggacgcactaccgaccctgtgcgtatgtatatgcgtgagatgggtacggtggatttgctgacccgtgaaggcgaaattggcattgccaaacgcatcgaggaaggcactcgtgaggttcaatatatcatggcgtattggcctggcacagtaaaatttgtgcttgatgaatatcagcaagtgcttcttggtgaaaaaaagatttccgacattgtctctgggtttttaaatggcgatgatggcgattttattttaaacgaagaagaaattgagctggatcttggatcacccaaaaccaccgataaagatgatgctgaagaagatggtgagtctgatggtactgaacttgatgataccgatgattcaagcctagaccctgaagaggtgcgtgtccgttttgaggagattcagcgtttgtatgatgtagcccaagaagccttggctaagcatgggcgtggtagtgaagcggtcaaagttgcttatgatgagctggccaatcatttcatgctcattaaactcaataatcgcttgtcggatcaagtcatgagtttgatgcgtgaagtttatgaagatgtgcgaagtaatgaacgccgcatcatgaaacttgtgattcgccatggtaaaatgcctatggatgagttcaaaaaaaccttcccaagcaacgaaactaatgtcgaatggctgtctcatcgcatcaaaggcggtcctgcttttgccgaaactttagccaaaattgagcctgaagtggttgccttacagcaaaaactcttagcacacgaacaggcacttcaaatggacatccgtgatatgaaggcagtcgctcgccaaatggccatcggtgaggctaaggctcgtcgtgccaaaaaagatatggtggaggctaacttgcgcttggtgatttctatcgccaaaaaatacaccaaccgtggcttacaattccttgatttgattcaagaaggtaatattggtcttatgaaagcggtggacaaatttgaatatcgccgtggctataaattctcaacctatgcaacttggtggattcgccaagccatcacccgctcgatcgctgaccaagcacgcacaatccgcattcctgtgcatatgattgaaacgattaacaaatcaaccgagtatctcgccagctacttccaaaggatggggcggtga

SEQ ID NO: 347 - DNA, 1545 bp, M.catarrhalis
cctgagagcggctcatggcagccccgcggtgaagaccgccacgcaggtttgcgtgaaaaagtgatgagtgctgacaaagccgctcagttcatccaaaatggtatgatgcttgccatcacaggctttacaggggcaggctacccaaaagccctaccaactgccatcgccaataaagccaaggacgctcatggcaaaggtgaaaaatttagcgttggtatggtaacaggggcatccaccgctcctgaatgtgatggcgtgcttgccgaggcaaaagcgttgcattttcgttcaccatttcagtctgacccaatacttcgtaatggcattaatgcaggcgagactgcctatcaagacatgcacttatcgcatgttgaacagcagatgcgtcaaggcttttatggtaaatttgacattgccatcgttgaggcggctgccattaccgaaaatggtgagctgatttttgcgatgggcatcggtcatggcgtagaagcgattaaaaacgccgataaaatcatcattgagattaatgatgctctaagtgtaggcttagagggcatgcatgacatctatgatgaggtgggtttgccgccacaccgtaagcccattcccatcgttggggcatttgaccgtattggtacagcagggcttgccattgaccctgataaagtgcttgccattgtattaacgagtgctggcgaccgtaattctaaatttgccgagcctgacgatgtgtctaagcgtattgcagctcaggtgattgattttcttgaccatgaggttaaggcgggtcgcttgcctaagagcctgctgccacttcaatcaggcgtgggtaatgttgccaatgccgtcatggcaggtcttttggatgcaccatttgatgatttggagggttataccgaagtacttcaagatggcatgcttgatttgattttggccaaaaaaatgaaaaccgcttctgccaccgccttgtcatttagtccagatgcactggcacgctttaacgaaaatattgagtttttaaaagacaaaatcatccttcgccccatggagattagcaacaatccagagattatccgccgtttgggggtgattggcatgaattctatgattgaggcggacatttatggtaatatcaactcaactcacatcatgggtactcgcatgatgaatggcattggtggctctggcgactttactcgtaatggcttttttagcatttatgtcagcccatctaccgccaaaggtggggcaatctcagcgattgtaccgatggtcagccatcatgaccacaccgaacacgatgtgatgtttatcgtaaccgaacaaggcatggcggatttgcgtggtaagtcgccaaaacagcgtgctaaggtgattattgacaactgttcgcaccctgattatcgtgacatgcttcgtgattattatgaccgtgcatttgtggcaagccaaaaaacaggtggtgtacacacgccgcatctgttgctagaagcattgtcatggcatcaacgctttgttgagacaggcgacatgcgtattaagtaa

SEQ ID NO: 348 - DNA, 222 bp, M.catarrhalis
gttggtttaggcggtgatccagagtatggcggtcaaggcatgccaaaaatggttaccatgctggttgaagagatgttatttgctaccaaccaatcatttaccctatatccgattttgacggtcggagcaacgctaacttattggctaccgcaagttgcgagcaaaaatcccaatatcttgaaaaaatgtactcaggtcaatgggcgggtacgatgtgcttga

SEQ ID NO: 349 - DNA, 288 bp, M.catarrhalis
ggaaagtttatgacattgcactatactgcaccacttgatgaaatgtgttttactctaaaagaagtttttcatgccccaaaattttggacaaatacagaccgcttatcccatgttgatgaacaaacggttgatatgattttagatgaaatggcaaaatttgccaccgaggttttgttaccactcaatcagtcgggtgatgaagaaggtgccaaatacttagatgaaggcagagttgcgacaccatcgggttttcaagaggcttttcgtgcttatgcagatgcaggctag

SEQ ID NO: 350 - DNA, 480 bp, M.catarrhalis
agagatgttatttgctaccaaccaatcatttaccctatatccgattttgacggtcggagcaacgctaacttattggctaccgcaagttgcgagcaaaaatcccaatatcttgaaaaaatgtactcaggtcaatgggcgggtacgatgtgcttgacagaaagtcattcgggtactgattcgggtatcatcaaaacacgagccacgcccaatgaagacggcagctatgccattactggcaccaaaatattcatcacaggtggcgagcatgatttgaccgaaaatatcattcatcttgtgcttgccaagacaccaaacgcaccagctggctcaaagggcatgtcgttgtttgttgtacccaaatttttggtgaatagtgatggctcactgggcgagcgtaacggtgtgcaagcaggctcaatgcaatcatggcatttgataatgaattttttgcttaagcttggttgtattaagttatgttaa

SEQ ID NO: 351 - DNA, 486 bp, M.catarrhalis
accaagtcgatgtttcaatgtaatatcgcaaaatacccactggcatttgatgcttatattaaaggaataaatatgacgcttaaattaggcaataaaagattttggcttgccatgatcgtaacggccgccatcgtggtgggttttcgtgaattggcattggtggtatgtacttggcttgggataccaacggcggcaaatattgtcggcttggtgagcttatttattgtgttggtgggtgtgcgtatgtcggtagggttgccagcatggctatcaagctcagcaagtaccttacttgttgatagtggctttgcctttttaccagtctcagcaggcgcagggattttgttatttgggcttggcgaggatttactatcggtttcggcgaccatcataatcagcactctgataccactttgggcatttgctaaattatccgctctgtggcttggcagtagcgacaccaaaaatcacagaggtggattatga

SEQ ID NO: 352 - DNA, 222 bp, M.catarrhalis
ttttattattcgtcattgggcttgattatcatacttattacgcacatgccaaacctgtttttgatcgcttgcttggttattgtaccaaaactggtaaccgggccctttacgggcatggattttaaaggtttgccaatcaaaaaacctggccgtgggggggatattggaagtattgttggggcaattttcccaatgtctttggggtatttttttgacccttaa

SEQ ID NO: 353 - DNA, 444 bp, M.catarrhalis
aaagggaactctcgcccgagaataactataggccaagcctttagccgtctattgccctactcatcgctcatcacgccaaatactcacgaaatccgagcattgagtgggcaacaagatttacatgatgctgccaaagcattaaatgaccaaggtgcaaacgctgtactggtcaaaacctcgcatgattttaatacaggtgatattgaacaatttttatacataaatggacgcatccatcataccagcattgtacctagattgactggtgaatttcatggatcaggatgctcattagccagccatattgcagggcgtttggcgatgggcgatgacatcattgacgccattacagcggccgatgcttggattcaccaaacacttatccatgccgacaaacctcatcaatctgataatacccagcttatcccaaatcgttttatttaa

SEQ ID NO: 354 - DNA, 240 bp, M.catarrhalis
atgatatccaaaaaattcccaaaaccgaatacgataaacattggtaacattagatataaaggcaaaaaattggctcaaaaattacgcatacctttttggctaagagacagcttatggaaaatcaatcatcaaggtcacccatatttgattgcaccgatgatggtgtgggatttgagcagtggtcagcgtttggatagttttgcaccaatagggcgaatggtgtacaatgcacttgattaa

SEQ ID NO: 355 - DNA, 921 bp, M.catarrhalis
aacggtactggtggtttttattggtatgattgtaagataaaatcactcagccctaaaaaattacggagaaaacttatgacagattttagtatgcttaatggtaaaactatcagtttcattggtggcggcaatatggcacatgcgattattgatggtcttttgcaagcaaaaaatcagcataatttggcattgacattgtgcgtctcagacagcgatgacgataaacaagccaaatttcgtgataaagggttgatagcaaccaatcctgataatgcccatcagattatcgagggtgctgatgttgtggttttggcagtcaagccacaaattatgcatcaagttgctggcagtatagcaccttatttgcagcaacaaaccgttttatccatcgcagcggggctgtcgattcaggcgttatcacatatgctgggtggctacgataaaatcgtacgctgtatgccaaacctacctgccagtaagggctttggtgcatctggactttatgcttttgatgtgagtgatgaggtgcgtttaatgacccaaaatatcatgcaagcttcaggtaaggtgtcttgggtggaagatgaatccttgttacatgccgtaacagcagtggcaggttcagcacccgcttactttttttatgtgcttgaaaatatgattgccaaggcggtagaaatggggttatcaccagaagatgcacagactttagcggtacaaagtatgcggggggcagcagcattggcggaagaaaataaccctcccgttttgcgtgagcaggtaacttctaaggggggtacgaccgctgctgcacttgatagcttatatcatgataatgtgggcgatgcttttgcccgtgctatgcaggcatgtagtgaccgcagctttgagcttgggcaaacattcagccaagcggactaa

SEQ ID NO: 356 - DNA, 576 bp, M.catarrhalis
tggatttatattatgaactccatgtcttttgttttaatcaatatggtcatcaactttgctttgatgcttatatttgtgcgtttcatgattcaattagcccaaattgataccaacatgccgatagcacgagcagcttatcgcttgactggcgtggtggatgtgtttgcacgcattttcccaacgatgggtaaagggcgtatcagtctagcggctgtggttttgatgttgcttttgtattttattaacattgccgctaataccatcatcttgggtagatccatgactgccattgagctgttttttattggttctttaagcggtatcatgaaatttttacaactgcttcgctataccatgattgcatcagcaatcagtagtttgcttgttgtatttttaaatattaataatagtgtgatgtttgtcttgatgcagttacccgagccgatagtcgcaccatttcgccgttttgtccccaatcttggcatgattgatttatcatttttggcagcactatttagtttgttgctgcttgaaaattttattggcattattggcagctacatttggggcggataa

SEQ ID NO: 357 - DNA, 729 bp, M.catarrhalis
gaaaaattctctatgactatgataacttttcccattattggttaccatcattcacccctaacgcaaaaatttggcataccaagacagcccaatcttgttcaagtatccagtcatattgaatttgtgccaccttatgataatgtggctgcttttgagggcattgaaaattatagccacttgtggattatttggcagtttcatcataatcgaccccaagctaactttcgtccacaagtgaggccaccaagatttggcggtaatgctaaaatgggcgtctttgcaacccgcagcatgtatcgaccttcacctttggggttgtcggtagtccgtctagagcgtcttgaggtgattaatcataaagttaggctgtatatcattggcgcagatatggcggatggtacgccaatttttgatatcaagccttatttggctttttctgatagtatcaccgatgccatcagtcagcagatagacacgccatccatgcgtaaaactgccatagataccaaggctaaacaggtgtttgatgggcttattaggcaaggtgtgttagaggatgctgatgttcagattatccaaggtcttatcgctcaagacccaagacctgcttaccgtcaagatgaggtgggcaccatttttgctttgcgttatgatggcgtggatgtggattttttgatgaatgagataggcgtgcttatgattgttggggttcgcttgattgggtcttaa

SEQ ID NO: 358 - DNA, 1281 bp, M.catarrhalis
aaattaacaacgatgatagcgatgcttgaagaagactttacacaggtgctacaagcactacaatttgatgatgcacctgctggcggggcattggtcatttataaagatggtcaagaggtggttaataccgccacagggcttgcattaccaaatttgccatggtcatcacaaactttatcggtgaatttttcaatcggcaaaggggtgatggcaactttaattgccgtgcttgtctctgaaggcttattggattatgaagcacgcataagccaatactggcatgaatttgctcaaaatggcaaaaccgacattcgcttaaaagatgttttatcgcatactgcaggattatttaatatcagcgtggttacaactgatgctgaggtattgctggattgggatgagatgctaaagcgtatcgctgccatgcccacctctaccccaaaatctcaggaagagtatcattatgccagtgcttatagtgccttagtttcaggctgggtgcttggtggattggtggagcgtgttactgatatgacgcttaatcaggcactcaatcagtatttggccaaaccgttgggggtaatcgatgagctgtattttggagtagatgctgatttaattgataaaattgccaagcctgagcgttattttggtgaaattcccaagaaaaatacacccagacgcaaaccgatacttaagcctgatagtgagactttattacaaaccttaactcatctacctaccagtccgctttggcgtgcatcattgggcgataaaccaataacaaccgctcatgtcaatcgtttgtactttgacacggctcgtatgaatttgaccaattataaaaatgctctgatgccaaatgccaaagatgggctagaatatcatcgctctgatgtgttgatggcaaccataccagctgccaacggtgtctcttcagccaatgcactggcacggatttatgccatgcacgccaatgatggtatttggcaagggcgaaccgttatttcaaaggatgtggtatcacgcatgagagcaatacaaaccgatgggtttgatgcggtgatgcctgcaaatatgcgttggcgaatgggttttcatcgattgtttagcctgcaagatgtgcctgatggctatgggcacatgggttataatgggtcggttgctttttgtgagccaagccgtcgcttatcttttgcatttattcataattttgataccaccatgctcaatgatgtgcgacaatttgcgttatctgagatggcgttacagtatttttaa

SEQ ID NO: 359 - DNA, 471 bp, M.catarrhalis
aataaggtgaccatatcactaactcaggaggatattatgacaacgcattatgacgatagtaatatttttgctaagattttaaggggcgagttgccttgccatcgggtctatgaagatgatcagactttggcattcatggatatcatgccagtggctgttgggcatgtgttggtcattccaaagtatccagcagttgagttgtcggatttgccattacaatatgctcaagcagtcattgccaccgctcaaaaagtcatgaaagcgcaaaggcaagttctacaaacacaaggcatcactcaagtgcagataaatcaccctgaagcaggtcagtcagtgctgcattatcatatgcatcttgtgccagcacactttagtgacattgccaaacatgaagccaaacatgaatcggtatctgccaatcaagatgagttggcacaattagctgcacaattatccgaggcaattaattaa

SEQ ID NO: 360 - DNA, 1296 bp, M.catarrhalis
gaaggatattttatgagcttaaataaggttgccatcttaggcggtaatcgcattccttttgcgcgtagtaatggcgtatatgctgatgccaacaacattgatatgctcactgcagcattagatggattggttgctcgttttgatttggcggataaacaaattggtgaagttgtggcaggtactgtcttaaaacacagtcgtgacctaaacttaacccgtgaggcagtgcttaacacccaattacctgcaacgacgcctgcttatgatatctcgcaagcctgtggtactggactacaagcagcttttgctgtggcaaataaaattgcgctaggccttattgataatggtattgcaggcggtacagacacaacctctgatgcaccgattgcattgggtgatggtctgcgtaagccgcttttgcgtttaggcaatgccaaaacagccaagcaaaaactgtctgcacttagcaccatcaaccccaaagatttattagccttcccccaaaatggtgaaccacgcactcgcctttcaatgggcgaacaccaagccatcaccgcacttgagtggaatatcagtcgcaccgatcaagatgaacttgcctataacagccatcaaaacttggctcaggcgtatgaatcaggattttttgatgacttaatcacaccttataaaggcttgaccaaagataataatttgcgtcctgataccacacttgaaaaattagccagtctaaaacctgcctttggcaaaaaaaatgccaatccaaccatgaccgcaggtaactcaacgccactcacagatggtgcttctgtggtgctactgtctagtgacgcatgggcaaaagagcatgggcatgagccacttgcttatatcactcaccagcagacagcagcggttgattttattggtaaagaaggtttaaccgaaggtcttttaatggcacctgcttatgccatgcctaagatgctcaagcgtgcaggtttgaccttgcaagattttgatttttatgaaattcatgaagcttttgcctctcaggtactttctactttggcagcttgggaagatgagactttctgtaaaactcgcttgggactagatgcaccactcggcagcatcgatcgcagtaagcttaatgtcaatggctcaagcttagcagcaggtcacccctttgcagcaacaggtggacgaattttggcgacagcagccaaactattggctcaaaaaggctcaggccgtgcattggtttctatttgtgctgctggtggtcagggcgttgtgtgtatcttggagagataa

SEQ ID NO: 361 - DNA, 1014 bp, M.catarrhalis
gatttaagggcttttatgtatacttttaatcgtcaatttccccatactcgcttgcgtcggctacgcatctctgatggcattcgtgagatggtgcgtgagacacagttagcaccatgtcatttgattgcacctgtctttgtcattgaaggtatgaaccaaaaacagtccattcatagcatgccaaatgtccatcgctactcgattgatttgttgattgattatgcgcgtgaattatatgccactggcgtgcgtatgattgatatttttcctgtcattgaccccaagctaaaaacgcctgacggtcaagatgcctatcacaacgatacgctggcggtgcgtgcggtgcgtgccatcaaagatgctgtgccacagatgattgtcatgacagatgttgcacttgacccttataccacgcatggtcaagatggtattattgatgagtcaggctatgttatcaatgacatcaccaccgaagcactgattaaacagaccctagcacacgcaaaggctggtgctgatatcatctccccaagcgatatgatggatggacgcatccaagcaatgagacaagcacttgaaaatggtggctatgtcaatactgccatcatggcatattctgccaaatatgcttcggcatattatgggccatttcgtgatgcggtcggttcatcaggtaatttaaaaggtcataaaaaacaataccaaatggatcctgccaaccgtgcagaagcattgcatgaggttgcactagatatccaagaaggggcggatatggtgatggtaaaacctggacagccgtacttagatatcgtgagtgaagtcaaagatacttttggtgtgccaacctttgcctatcaagtctcgggagaatatgccatgcatatggcagctatccaaaatggctggctcaccgatgcagttattttagaaagtttaatcggctttcgccgtgctggttgcgatggtattttgacatattttgcacttgatgctgcccgtatgctaaacgactga

SEQ ID NO: 362 - DNA, 1011 bp, M.catarrhalis
ttctcatttaaaataaaaattatgttagaaaatcgcttaattgacccaaaccccaaaaaagacgataccgccgaccgtgctattcgtcccagcagtttggatgaatatatcggacagccaaaagtgcgtgagcagatgaaagtttttattcctgccgccagagcaagaggggaggcgttagatcatacgctcatttttggcccaccgggattgggaaaaaccacacttgctaacatcattgccaaagagatgggtggtaatttgcgttcaacctcagggcctgtacttgaacgagcgggagatttggcggcaattttaaccaatcttgaagcgggtgatgtactatttattgatgaaattcatcggctaagccctgtgattgaggagattttataccctgcaatggaagattttcagctagatattatgattggtgaaggtcctgcagcacgatcaatcaaattggatttaccgccatttactttggtggctgccaccacacgggcaggattattatctgcaccattatttgaccgttttgggattgtccaaaggcttgaattttataatgttgaggatttgaccacgattgtcaagcgttcagccagacttttgggggttttgatggatgacggcggggcgttagaagtggcgcatcgtagccgaggtacgccacgcattgccaatcgcttgcttagacgcgtgcgtgactatgccgagattaagggtgatggcgtcgctacagctgatattgcttctgcggcactggatatgttggctgtggataagcaagggcttgatcagctggaccgtcgttatttatcggtgttgtcccaaagatttcatggtggtcctgctggcgtcgaagcactggcagcagcgatggctgaggatcgagggacgcttgaagatgtgattgagccttatttattgcaacaaggctacattcagcgtaccagtaaaggccggattatctcagataaggtttttcaaatggatgtacttgagtaa

SEQ ID NO: 363 - DNA, 1269 bp, M.catarrhalis
ataaagtctaatggcaaatctatgaatacacaagaacaaaagtcgtttatttttatgacggtagcggtcgtcttgatgctactgagtttttattatttaatacatgtttggctgattgtttttgcttcaattttaatggcggtttggctgttaagtttggttgaatatctaactttgataccttgggttggtcaatatctcaaaaaactaccacatggtattttattaacaatggttttgatggggcttgtgggggttttgtccaccttggcggcactgtttgggcatgagttggcacttcaactagaaaacttaaaattattggtgccacaagcatttgaatatatgaaccaatatttaacccagtatttacaaacccatcctgctgtttatgaatggctggcaggcttggaatgggcaagagagctaagagataatccgcagcaatttttgacacggtttagtgatggtgcgatggcgtatctaccaacttatttgggcggtatggtcagcggtatgggaactttggtcgtaattacaattattggactatttttggcaatttctccatctgtttatcgccgaagctttgtggcgatggtaccaaaagacagccgagataaggcagaatatttgttagaccgtagctatcgttctatgcagcagtggttattagggcagctggttgtgatggcgtttgttggcattgccacagggatagcactttggttgatgggcattccttttgccttagccttgggatttattgcctttttactggactttgtgcctgttttgggcccttggttatcagccataccgattttattattaactttaattgtctcaccaaaaatgttgttatgggtggcattgatgattgttgtggtgcagcagcttgaaagctatgtcatctcaccgattgtccaaaatcgtatggtagatttgccaccagtggcattgctgttatctcaggttattatgggttcaatcacaggcattttgggcattgctttggcaacaccattgatggttatggtaattgtttgggttcaggtgttgtacattaaatttactttaggcgattatgcagtgcgtattttggatcaaaatgaaagccaaatgcaggctgacccctttggtgattgggaagcttatcaaaaaaagcaatctattgaagaaaacccatcgcttaagcgtcgcttacagttaatgcgtcaaaaaagacaagccaaagccgctcaaatcaaagataatctctcagaataa

SEQ ID NO: 364 - DNA, 2352 bp, M.catarrhalis
cccaattataatggatatattatgacctcagcaacaagagaccaaaaggttgatgataccacttttaataccaatgccgacctacaaaaacaacaatttgaacaagctgcattacactatcatgagcacccacgcccaggtaaaatctctattacaccgaccaaaaaaattgccaaccaacgagatttggcattagcatactcgcctggtgttgctgttccttgccttgaaattgaaaaaaaccccaaacttgccgccaaatatactgcacgaaacaatttagttggtgtcattacgaatggtactgctgtgcttggcttgggcaatatcggtgcattagcctcaaaacctgttatggaaggtaaaggcgttttatttaaaaaatttgctggtattgatgtttttgatattgagattaatcaaaatgacccagataagtttatcgaagcggtcgcaagtcttgagccgacctttgggggtattaacctagaagacatcaaagcaccagagtgctttaagattgagcgtgaattgcgtgaacgcatgaatattcctgtatttcatgatgaccagcatggtacagccatcattgccgctgctgctttgttaaatgctctaaaactggtgaataaagatatcgcagacattaaaattgtctgctcgggtgctggtgctgctgcaatcagttgccttgagcttatcatcgcacttggtgccaaacgctcaaatgtctatgtgcttgattctcgaggcgttatcacaacacgccgtgacaacctagacccctcaaaacagctatttgcccaagataccaatgcgactactttaagcgaagtgattgatgatgctgactttttcttaggtctgtcaggtccaggtattctgacccaagatatggttaaacgcatggcgggtaatccaatcatttttgcacttgccaatccaaatcccgagattatgccagagcttgcccatgccgctcgcccagatgtcatcatggcaacaggtcgctcagattatcctaaccaagtcaataatgctttgtgctttccgtatattttccgtggtgctttagatgtcggtgcaaccatcgtcaatgaagaaatgaaaattgcgtgcgtgcacgccattgctactatggcacatactgaggtttccttatccgaaaccgataagaataccgaaagcaagcaatttggtcgtgaatatcttattccaggaccacttgagccaaatctcatcttaaatatcgcccctgctgttgcaaaagcagcaatggactctggcgtggcaactctacccattgaagactttgatgcttatcgccaaacattatctgagtttgtttataattcagccttggcaatgaagcctgtctttacccaagccaagcaagcaccaaaacgaattgtctatgctgaaggcgaagatgccaatgtcctgcgtgcggtgcaagttgtggttgatgaaaatatggcacagcccattatcattggtcgccctgatgtgattgaagcaaaaatcaaagagttgggtttgcgtttaacaatgggtgagcatgttgaggtggttgatatcaataataacccgaaacatgaacaatactggcaacattatcatcaagccaaccaccgtttgggtgtctcagctgagcttgctcgccgtgatatgcgtcgcaaaagctcgttattaggggcaatgatggttgaacaaggcgacgctgacggtctattgtgcggtacatttggttattatgatttacacttaaattatatccgccgtgtcatcggtaagcgtcaaggtgtgagtgattactatgccatgagcggtgtgattttacaggatcgtacgctgtttattgctgatccttatattcatgaaaatccaacagcagcacaaattgctgagatgacggttttggccgctcaaagcatacgccgatttggtgttgagcctcgtgtggcgttgttgtcacattctgattttggtacttctcagcgcacctcagcagttaagatgcgtgaagcttatcaaattttatgcaatatgaatgttgattttgagtttgatggcgaaatgcacggcgatgccgccttagatgtgcgtgtccgtgaacaaagccatccatttagcacactacatggttcagccaatctactgattatgcctacattagatgccgcacacattgcctttaatctacttaaatcaagcagtggcagctcggccatcggtccaattttattgggtgcagataagcctgtacatatcctagtacctgcatcaacagcacgccgtatcgtcaatatgactgctattgttgttacagatgcccaaaaagtagatgtttaa

SEQ ID NO: 365 - DNA, 819 bp, M.catarrhalis
gtaattttcaaaaaacatctgtcactaggctttgacaaaaaaggaaaaatcatgataaaaacagcacttatcacgggcggtgccaagcgtattggtgctgccattacaaatctactacaccaacatggctttaatgtcatcattcattaccacaccagtcaagctgaggcggacaaattaagccacacactcaaccagattcgaccaaattctgcaacaacgctttgtgcgaatttagacatcattcatcaccaagaacaactgtctgaatttagcaaactgtgcattgcccaatttggtcgtattgatgcactgatccataatgcgtctagtttttatccaagtgatttaaacgatacacatcaaaccctgcttaagcattgggataatttattcttaaccaacgccaaagcaccgttactgcttagtcatgccttattgcctgccctcaaaaaatcacacggctgtatcgtaagtttattggatattcatgctgatgctaagccttttattggctatcccatctataatatggcaaaagcagcacaccgcatgatggtacaaagcctagccctcgagcttgcccctgagattcggattaatggagtgtcacctggtgtgaatattttccctgaaaatcatcattcttcatttagccatcaaataaaatccgacctcatcgcctctattccacttgctcgtattggcaccccagaagagattgctcaggctgtcttatttttactaaaaagctcctatatcacagggcaaattattgccatcgatggcggtcgcagtctgaccttaaagggtggctga

SEQ ID NO: 366 - DNA, 1731 bp, M.catarrhalis
aattttataaaaattgaggggcttatgagtgcatcacaaccaccttctcatcaaaaaaatcataaagacatacaaattatgaatcaaggcgttaagataagtcggtttggtgtttttccaaaggttagcgtccctgtctttgccgtttctgcttttttggtcatagcatttatgctgtatggtgcgatatttagtgaacaagcagggcaagtatttggacaaatgcagcaatttatcagccaaaattttggttttgggctggtgattttgatgaatcttgctttggcattttgtgtatatttggcattaagtcgctatggtgatattcggctcgggcatcaaaccgaagtgccagcgtacagttttggttcatggattggcatgctattttcagcaggtattggcattgggcttttatattggggtactgctgagcctttatatcactttgccgcaccgcctagagccgaacctgagacggttaatgcagccgttgaagcgatgcaaatttcatttttgcattgggggctacatgcgtgggcagtgtatgcggtggttgcattatctttggcatattttcactatcgccgaggattgccgctgtctgtgcgttcggtattatttccattgattggtaaacgcatttatggtggctggggtcatacggttgatatcttggcggtatttggcacgatgtttggtgtggtgacctctttgggtcttggcgtaatgcagcttgagacaggattggcacaactatggggcgtgacaccaagtttaacactaaaactaggattaatcgctgggattacggtatgtgcggcactgtcggtgatggcggggcttgataagggcgtaaaacgcttaagtgatattaccatcttagctaccttggcgatgcttgcttttatgattttggcaggtccaacacggtttatttttgacagctttattgaaaatattggtaactatgcaggcaatctgattacgcttgggctttggaatgaagcttatgttgatacagattggcaatcatcttggaccatcttttattgggcatggtgggtaagttggtcgccatttgtggggatttttattgcgcgcatttctcgaggtcgtaccattcgtgagtttttatttggggtgctgtttgtgccgatgctacttttatttttatggtttacaacttttggcggcgtagcggttcatatggagatgcttgggtcgtatggttttgttgaagcggttcaagctgattacggcagtgctatttttagattcattgaacattacccattcaccaaaggcttgatggttgtgattatgattatgattatgattgtgttatggtttgtcacatcagcagacagtgcaagcttggtggtggatatgttgacggctggcggtgaaacagatccaccaaaaattcaaaggttattttgggtaacctctgaaggtattattgcagcggttttattggcagctggtggacttggtgcattgcaggcggcggcgattgtggcaggattgccgtttgcgattgtggtttttgtgatgatgtattgtctgtggcgtggtttgggtcgtgatcgcttgacgctgtaccgcaatagccagtggtacatcaccgaagaatccgctgagcataattctcaaaatgaaatgatcgatgagtatcttttaaaagggccgttacccttgcctaaatcagaccaatcaactcaatcataa

SEQ ID NO: 367 - DNA, 366 bp, M.catarrhalis
aatgctccaaaaaagtattcggcaattttatacaaccctttaatcatttccatgacccattcatcgctttacccaacatctcaggcaacgctttggcttgaattgcttgaacgcacgcaagcacataaagacagcacgaaactgatacagctttatgacgcttgtcatgcctaccaaggcagccctctgagttatcccaagcagtggctatttgacgccattacttgccatcaaagcataagtattgccgacattgacccaactttaacaaaaaaagccattggtgatgccctgtcatatcttagatgccaagccttgcataaacttttaagtaattttcaaaaaacatctgtcactaggctttga

SEQ ID NO: 368 - DNA, 540 bp, M.catarrhalis
accaacccaaaattgattgatctgataatgaaagtgctttttaaagcccatcttatggcgatattgcctcagcttgaagccatagcatcaagagacaacatgcgtttatttttatgccgtatgccaaacactgttcaacggcttgggatgatactcttttttatgctaagcttgagcctttacactgtcgctttggcaaattctacgacgcctcgttatcaacgcatctcaaccccccaagccatcagcacacaagagatctatctgacagcgacacagtatgaagtagcactaattcaagttctatctgaaatctgcccacccatgctcaatgctcgccaaaaagccaattttaatcgagcttatgacagacaattgcgtatttttatgccgtactcagctgacccctatcaaagcttaagacagcttagcgctcagcgtgagtatcgtatcattttgcataatgtgcgtgcatggacagccagctttcctgctagcgaaaatcgggcactttgctatgagtttgctgccgccgcttaa

SEQ ID NO: 369 - DNA, 237 bp, M.catarrhalis
ttaaatcacctaacattaaatgccagcttggttgctggcattttttattggatttttgaaaaattattgttatatttaattattcatctttataaggattatccatgcaagtatatttggttggcggtgctgtgcgtgatgctgtgcttggcttgcccattaccgataaggactttatggttgtgggtgctacgcctcaggtgctgcttgatttgggatttatccaagttggggtag

SEQ ID NO: 370 - DNA, 255 bp, M.catarrhalis
ccagattcttggatttctttggcaaattcaatgattaaaatggcattttttgccgataaacctatcacagtcaatagggcaacttgtaggtatacatcattagcaagcccatggatttttgtgagtaataaagagccaattacccccaaaggaatgaccaaaatgaccgcaaaaggcacagaccaactttcgtacagtgctgccaaacacaagaaaaccaccaaaattgataaggcatatagtattggtgcttga

SEQ ID NO: 371 - DNA, 243 bp, M.catarrhalis
atggctggatggcagagtggtcatgcagcggactgcaactccgtgtacgccggttcgattccgactccagcctccaaagtaattcagcaaagacctaaagcatacttttgcaaaatgctttgcccgagtggtgaaattggtagacacaagggatttaaaatccctcgctcttacgagtgtgccggttcgagtccggcctcgggcaccatcattatctttggtattaccaaattcaacaaataa

SEQ ID NO: 372 - DNA, 1440 bp, M.catarrhalis
agtttaaagtgggttatcatgaaattaaatctaacagcagtgctggtcattgggctgatgaccagtatgggcgtgctgacggcgtgcagtcaacaggacgataccagcgtgcagcaacaaatgccaaatccgacggtagatgttcaaaccattatgctcgaaactgtgccagtgattcaaagttttgcagggcgtgttgccgccattgagacttcagaggttcgcccgcaggtgacgggcattattgatgaagtactgttctatgaaggtagtatggtgcaggcaggacagcctttatatcggattaatgtcgatagctataccagccaagtgcaagcaggtgaagcagcggttcaaaacgctgaggcggctgtcggtaatgccgaggccacacgagcatcagctcaagcaaatttagccgctcaagaagccaatttggctcaggcacgggcagatgtcatgcgacttgagggcttattggaggttgaggcgatctctcgtcaagcttttgaccaagcagtaaccgccatgcgaaccgctgaagcgaatgttttggctgccagagcggcagttgcgcaggcagatgctaatattcacagtgcaacagcatccgtgcaaagtgcacgcgccaatctaaacgcaagccaactggatgcaggtcgtaccattgtcaaggcacccatcagtggtgtaacgagcatctcagcggtgacagcaggtgcactggtatccgccaatcagccaacaccattggtgacaattaatcggttggatgaagtgtatgtggacatcagccagtcttcaacccaaatgctaagattgcgtgaacagattgagtctggtcaagtaggtcaaggtggtgcagatgttcaactggtgcttgaagatggtcaaacttatccaatcttaggacaattattgcttgccaatgcacaagtggatacagccacgggcaacatgaccttacgcgctgtgttcccaaatcctgatggtaagcttataccgggtatgtttgttaatgctcgcttaattcaaagtgtggtgcatgaagcagctttattgccacaatcagcgatcatgcgtacaccaaaaggcgaaacccaagtttatatcgttaacgcagataacaaaatcgagattcgcacggtaacgacagcaggtacttatcatggtaattggattgtaacaggtggtattaattctggtgatcgtgttgtgattattggcggcagtaaagttaagccagaccaagaggttaatgtgcgagaactgccagctgccagcagtgaagcaaatgctgatatcagcacgccaccgccttctaaaccaagcactgttaactcaaacattccaatggcaagaccacaaagtgatacgacggttgccaacttatccgccgaagaacaagctgcgatgaacgctgctgacgaaaccaagtaa

SEQ ID NO: 373 - DNA, 927 bp, M.catarrhalis
agccatcatcggctatcaaggaaaaaattatgtcggataaacattttagcgaattgccaaaaatgcacacgacctacgccaatgtcatcaaaagcttattaccatcttcaaacactaaggcaaaagacttaccaagctcagtctatacggtggataagcttgtcattgaacaaagcaaccttcgtgagtatcgtaagatttgcggatttgtggatgatgggcgggtacccagcgacttattttgcggtgctatcgcaaactttacaaatgaacatgatggcaaaaccagactttccttttgccatgcttggactggtgcatgttgaaaacagcgttacccagcatcgtgtgatttttgataccgaaacagtacgcctatcggtgcgtcttaataatcttcgcactcatgataagggtcagcagtttgattttgtaaccagcgtttgggtggcagatgaaatggtatgggaaggggtgtccacctatctatctcgccaaaaaaaatccaaagtacaaagacaagccactcatcaaggtacaaccaaacctgtattttcaagacctgataaatcagatgacagcttatttttggtgatgaacgttgaagaggatattggtcgtagatatgcgtttgtgtcaggtgattttaatttgattcatctgcatccactgtcagcaagagtgtttggtttcccgaaagcaattgcacatggtatgtggacaaaggcacgctcattggctatgattgctcgtcattttgagctaccagcggcgtatcgtatggatgtctcatttaaatttcctgtatttttgccatcaaagattgagctaatgaccgatacacccgatgagcttggtattgagtttggattgtatgccaaagacagcgaaaaagctcacttaattggtacacttgcctatttatga

SEQ ID NO: 374 - DNA, 216 bp, M.catarrhalis
cggcttattttagcacaaatccttatccaaaaccgctttaccacgatgctaaaaatcaagcattattatcaaaagattgaaaataagtatatcaagcgaaagaaatctccccaacttttgccaatgtgttaccaaatcagaagatatgctacaatacacatacatattatgtgggatttttttactaaaaaaacttatcataggcacttatcataa

SEQ ID NO: 375 - DNA, 351 bp, M.catarrhalis
caagctgcaagtacccctgaaagcaatccaaaaaacagttctgctaatttaaccaccagcttaatcaaacatgcagtcaaacaaacttgccaaacccagctgactggtcatcagtactggaaaattgccaccatgaaattgtcttcagaatccaaagccaagatttcagaaacggcatgcggctgtgtggctgataaagcacctgaagccgtcagcttgaccgagcttaccacagctgccattaatccaaatgcacgcactgaagttgcccaaaaaattgtgcgacactcgcttaaaccttgcatgctagagaccgtcaatgcttttattgtgccaactaccacacgctaa

SEQ ID NO: 376 - DNA, 1908 bp, M.catarrhalis
ggaatatgtatgccaatttatcgctcaaaaacttccaccgcaggtcgcaacatggcaggggctagggctttgtggcgtgccactggcatgaccgatgccgattttcaaaaacccatcatcgccattgccaattcctttacccaatttgttccggggcatgtgcatcttaaagacatggggcaattggtcgctcgtgagattgaaaaggcaggcggggtggcaaaagagtttaataccatcgctgttgacgatggcattgccatgggtcatagtggcatgctctatagcctaccaagccgtgacttgattgctgacagcgtagaatatatggtcaatgcccattgtgctgatgctttggtgtgtatcagtaattgcgataaaatcacccccggtatgttgatggcggcgatgcgtctgaatattccgacgatttttgtctcaggtggaccgatggaagctggcaaagtactcgccagcactttggttgatggcagtaatgtgcatgaaacggtggtcaatgaccaagggcaatccattcgcaaacttgaccttgttgatgccatgattgacgcagcagatgatttggtcagtgatagtgatgtgcaaacggtagaaaactcggcttgccccacttgtggctcttgctcaggcatgtttaccgccaattccatgaactgtttgaccgaagcgttggggttgtcattgcctggtaatggctcactgctggcaacccataccaagcgtaaagagctgtttttaaaggcggggcgaatgattgttgagattactaagcgtcattatgaacagggtgatgacagcgttttgccacgctcaattgccaccaaatccgcctttgaaaacgccatgagcttagacatcgccatgggcgggtcaaccaataccattttgcatctgctggcagcagccaatgaagcgggcgtggcgtttaagatggcagacattgaccgtctgtctcgcttggtgccttgcctatcaaaggttgcccctgccacccaaaaataccacatggaagatgtacatcgtgctggcggtgtgatgggcatattggcagagcttgaccgtgcaggattattagataccagcctgcccaccgtacatagccccaccctaaaagacgcattggcaacttgggatgtgatgaatcctgataatacgcaagctcgtgctttatacattgccgccccaggtggtgtacgcaccacccaagcttttagccaaaataagatctacccaaatcttgacttaaaccgtgaaagtggctgtatccgtgatgtgaaacatgcctattcacaagatggcggtttggcggtgttatttggcaacattgctgagcgtggttgtgtggtaaaaaccgcaggtgtcgatgacagtattttgacattcacaggcaaggcgcgtgtgtttgaaagccaagatgatgccgttgaagccattttggcagaccaaatcattgcaggtgatattgtcatcattcgttatgaaggcccaaaaggcgggccgggcatgcaagagatgctctaccccaccagctacctaaagtctaaagggctgggtaaagcgtgtgcattattgaccgatgggcgtttttcaggtggcacatcaggcttatccattggacatgccagcccagaggccgctgaaggaggtgcgattggtttggtcgaagatggcgacaccattcatattgacattcccaaccgcaccatcaacttggcggttgaccccacagaacttcaaaaacgccgtgaagcgatgcaagtgcgtggtaaacatgcgtggaagcctgccaatcgcattcgccatgtgtcccaagccttgcgtgcttacgcagccatgaccaccagtgctgacacaggggcggtcagagatgtcagtcaggtggaataa

SEQ ID NO: 377 - DNA, 1377 bp, M.catarrhalis
gagttagtcatgagcgaccattatggagaattggttcagtcacctttgggtaaaaaagttgccaaaaacttaggattgccgatgccgatgaagcttgaccgctatgaaacaggtcagcctgtcgtacgaggtgaggttgctttgggcatagcaagcggtgaagatgccgctgtgcagagtgctttggtagagattttggggggctatgaagccaaagtcaataccgatgccactttaaatcacctaaaaacaacttcgctcaatgaccgtctaaaagatgataatgctcgttttaaggtggctatttttgatgcaacaaatatcaaaaatacggatgagcttaagcaagtgtatgatttttttcatccgattgctcggcgtctgaaagcatcaggcagagtgcttgtcattgcacgccctgaatgttgtacaggtgatgatattggttttagtttggcacagcgtgcggtacttggttttgtcaaatcgattgctaaagagtttaagcgggggattaccgcccaagtgatttatgttcaaaagggtgctgaaagtgagctttcacatacgcttgaatttttcatgtccgctaagtcggcttatgtatcaggtcagccaatttatttgaccaaagctgccactcagacccacgcaacccttcagggtaaaaaaatcctagtcacgggcgcaagtcgaggcattggtcaagcgattgctgaggtgttggctcgtgatggtgctaaagtgtactgcctagatgtgcctgacagcctgccaaatctacaaaaagtggcggggcaaatcggtggttatgcactaccgctggacatcactgccaaagatgcaggcgagcaaattatacgcgcctgtggtacgcttgatggggtggtgcataatgcaggcgtcacccgtgataaaactttggctaagatgagtgaagataaatggaatcttgtcatgaacattaacttaggtgctatccatcgtgtgaatgattatttgattaatcatcacggacttggtgaggctgcgcgtattgtttgtgtttcatccatttcaggcattgcaggtaatttggggcaatcaaattatgcgacaagtaaagcaggtgtgataggcttggttgaagcaacagccaaggtatttaaagattcagctcgtaccattaatgctgtggcacctggatttattgaaaccaaaatgaccggtcaaatcccctttgccattcgtgaggcaggtcgccgtatgaactctatgagccaaggtggtgaacctgtagatgtcgcagaaacaatcgcttggctattatcacccaaagcaggcggtcttaacggtaatgtggttcgtgtctgtggtcaaagtttacttggtgcataa

SEQ ID NO: 378 - DNA, 753 bp, M.catarrhalis
ggattatccatgcaagtatatttggttggcggtgctgtgcgtgatgctgtgcttggcttgcccattaccgataaggactttatggttgtgggtgctacgcctcaggtgctgcttgatttgggatttatccaagttggggtagattttccagtatttttacatcccaagacacaggcagagtatgctttggctcgcattgaaagaaaatcaggtgtcggccataccgcttttcaagtacacgccgatccaagcgtgcgtcttgaagaggatctcattcgacgggatttaaccatcaatgcactggcgattgaggttaaaggcttatttgatgagacacccatgacaggcaaggtcattgatttttatggtgggctaaccgatatccaaaatcgcacgcttcggcatgtctcgcctgcatttagtgaagatccacttaaggtgttgcgtgtggcaaggttttttgcccgttttgcaccacttgggtttagcattcatgatagcactgccaagcttatgcaagacatcgccaaatcaggtgagatgagcagtttaagccgtgagcgtttatactctgaatttgttaaagctatgcgacagccacaaggcgatcaatttattgcctgcctgcaccaacttgacattttgcccttcattttgcccacattagcacagcattttaacacaccacaaaaccgccaacgcaccttcacacgggtggctttaagcctgtacgctgaatttgcctatttttag

SEQ ID NO: 379 - DNA, 354 bp, M.catarrhalis
aacttgctaatttatataaaatttatgaagccatcatcggctatcaaggaaaaaattatgtcggataaacattttagcgaattgccaaaaatgcacacgacctacgccaatgtcatcaaaagcttattaccatcttcaaacactaaggcaaaagacttaccaagctcagtctatacggtggataagcttgtcattgaacaaagcaaccttcgtgagtatcgtaagatttgcggatttgtggatgatgggcgggtacccagcgacttattttgcggtgctatcgcaaactttacaaatgaacatgatggcaaaaccagactttccttttgccatgcttggactggtgcatgttga

SEQ ID NO: 380 - DNA, 300 bp, M.catarrhalis
ttaatctcaatatcaaaaacatcaataccagcaaattttttaaataaaacgcctttaccttccataacaggttttgaggctaatgcaccgatattgcccaagccaagcacagcagtaccattcgtaatgacaccaactaaattgtttcgtgcagtatatttggcggcaagtttggggtttttttcaatttcaaggcaaggaacagcaacaccaggcgagtatgctaatgccaaatctcgttggttggcaatttttttggtcggtgtaatagagattttacctgggcgtgggtgctcatga

SEQ ID NO: 381 - DNA, 660 bp, M.catarrhalis
tgcactaagatgaacaagaccgataaaactttaattttactacaaaatatttttaatgatacaggttttacctttcgtatccataatgttaaactggctcagttaaccattgattttgatttaccgcaaatgtttttagcacattatgaccaattggctgatgagttaaaagcacgcatacctctcaccccccagcttttaaagcacatgaatacaccgatgaccgccgatgaagcagaaaaattgcttgggctgccacatgcaagcatcgccaaagcttggcatatcaaactaaaaggtacggcagtgattgcatgtgatgcattatcgttggcaattcatactcactttaccaatactgccaaacccgcccaagttgcctatggtgataaacaaacactcatccatcaagaagcggcccgctggcagatgacaggtggtgtgaatgtcttatttaaacatacaaattacgatttggtgagcattgatttggaagataacatactgacaatgcatgcacaaggcggttatatacgcctaccaaatagccattcattagccacaacccatgcaatcaataccctaaagcataccaatcttgatgccattggttatttaaatgatgcaatcatcgaaaccatcaccgcagcccaacgataa

SEQ ID NO: 382 - DNA, 942 bp, M.catarrhalis
aattttttcgtttatgtaaaactggtttatgctaaaataaaggctgcttattccaaaattaccctaaaacaactgggtaaaattcattatcatacaaaaaataattatcccatcggctgctgtaatcatctgccgataccaaaacatcatcacaatcagagaaattttatgtcaaagtttatcacagaaaccgtcacttatgtacatcattggaatgacagtttatttaccatcaagaccacccgtggcgatagcttgcgttttcgtaatggtgaatttgccatgattggtatcatggttgatggcaaacccttggcgcgtgcttactcgattgccagcccaaactgggcagaggagcttgaatttttttcaattaaagtgcccgatggtccgctgacttctcgcctgcaacacattcaagttggtgatgaattattaatcagtaaaaaaccgactggtactttggtgcttgatgacttattacctggtaaacatttgtatatgcttgccacaggcacaggacttgcaccatttttatcattgtgccgtgaccctgaggtatatgagcgttttgaaaaggtgattttggtacatggcgtgcgtcatgtcaatgatttggcttatcgtgatttttttgaaaatcagctaccaaatgatgagatttttggcgaatggattcgtgaaaaattcatctactaccctaccgtcactcgtgatgaatttcatcatactggtcgtgtcactgatttgataaaatcaggcaaactgtttgatgacattggtttaccagtgatgaataaagacgatgaccgtgtgatgatttgtggcagtatggcgatgaatgccgatactgctgccatcttagatgagcttggtctgacggtgtcgccccgtatgggtgagcctgccgattatgtcgttgaacgcgcgtttgttggttaa

SEQ ID NO: 383 - DNA, 237 bp, M.catarrhalis
cgtgtggtagttggcacaataaaagcattgacggtctctagcatgcaaggtttaagcgagtgtcgcacaattttttgggcaacttcagtgcgtgcatttggattaatggcagctgtggtaagctcggtcaagctgacggcttcaggtgctttatcagccacacagccgcatgccgtttctgaaatcttggctttggattctgaagacaatttcatggtggcaattttccagtactga

SEQ ID NO: 384 - DNA, 2925 bp, M.catarrhalis
cgaaaccaagtaaataaaggtatagcatgtctcgtttttttatacataagaccgatttttgcttgggtgattgcaattctcatcatgctggtcggtattttggcaattaataatttgccgattgaacaatacccaaaaattgcaccgcctcaagtaaaggtgcgtgccgtctacccaggtgctgatgctgagacggttgaaaactcggtcacgcagatcatcgagcagcagatgaaagggattgatggactgatgtacatgtcatcaaattcatcagcggcagggtctgcctctgtgactttaacatttgaaaatggcactgatccagatactgcccaagtacaagtacaaaataaattacaatctgccatgagttcattgcctgaaacagtacaacgcacgggtttgaatgttgaaaaatctgccagcgattttttgatggtgacagcttttgtgtctgaagatggcagtatggatcagtcagatattgccgactatgttgcaaccagtattgttgatcctatcagccgtgtggagggcgtcggtggtactaatgtgtttggttcatcttatgccatgcgtatttggcttgatcctgccaaattgcgtgcctacaacttgataccgtcagatgtctcatctgccatcagatcccaaaatgttcaggtttcagcaggacaattaggcactttgccaaccaatactgaccgtgtggtgattaatgcgaccgtcagcgtacaaagctatctgcaaacaccagagcagtttgaagatatcttattaaaaacagatactgcaggcgctcaagtacgcatcaaagatgttgctcgtgtcgagcttggtagtgaaaattaccaatttagagctcagtataacggtcaagcagcatcaggccttgccattatgcttgcaccaggtgctaatgcacttgaggtgcgtgaagcggtgggcgtgcgattagatgagctgtcgcaaaatttcccaacaggactaaaaatggtcgtgccttatgacacaacaccatttgttcgactgtcaattacacaagttgtatatacgctgttagaagcagttgtactggtttttttggtgatgttcttatttttacaaaactggcgagcgacaatcattccaactttggcagtgccagtggtcattttagggacttttgcggtattatcggtgtttgggtatagtattaatatcttaaccatgtttgcgatggtacttgccattggtcttttggtggatgatgcgatcattgttgttgaaaatgttgagcggattttggaagaaaatccatctatccaagtgatggatgccaccattcaatcgatgcgtgagattagtaaggttgttattggtattgcactgattttatcggtggtttttgtaccgatgattttctttggtggatcctcaggcgtgatttatcgtcagtttgcggttactttgatgaccagtatggtgctgtctgcatttattgcacttgtgtttacaccagctttgtgtgtgaccattttaaagcgtcaagcacataaagatatcaacattcaaacaggattttttggttggtttaaccgctttttttatcaaaccagtcgtcgttatgaaaactttattggtaaaacttatgcctcaaaattggcgtatttagcagtatatactggcattgtggcggttatggcattgatctttatgcgactgccaagctcatttgtacctgaagaagatcaaggtgcggtcatgactttggtgcaactgccagcaggttcaacacttgataagaccaatgcggtgatggataaactggcaaattattatcatgataaagaaacggataacatcgaatcggtgtttacgatttctggatttggcttcatgggcagcggccaaaattctggtatggcatttatcaaactcaaagactgggatgagcgagcaggcagtgaaaataccgctcaaagtattgcacgccgagcaatggtgatgaatatgatgatcccagaggcaagtctgatttttccaatcgcaccgccgccaatccaaggctttggtaataccagcggctttgatttacaattaaaagatgttggcggtgtaggtcatgaagccctgctggatgcacgcaatcagctgatgggtatggcgatgcaaaatccagcgattgcctcgattcgcccaggtggtcaagaggatgcacccaaactaaaagttgacatcaatcaggcacaagcagccgcttatggcgtacctttgacagcgatcaatgataccattgcacaagcgtggggaggcagctatgtgaatgatttcattgatcgtggacgcatcaaaaaagtctacatccaaggtgagccagacagccgtgtggtgcctgaggacatcaatcgctggtatgtgcgtaatcaatctggtgagatggtgagctttggtgctttttctggcagtcaatgggaatatggcagcccaagtttggcgcgttataatggtgtgtcttcgatggtgttgactggcagtgctgccctaggtgtgagtacaggcgatgccatggaggcgatggcacaaatggcatcacagctgcctgctggcattgattttgagtggacaggtctgtcgcttgagcaacaaaaatcagggggtcaagcaccaatactatatgccttatcaattttggtggttttcttgtgtttggcagcactgtacgaaagttggtctgtgccttttgcggtcattttggtcattcctttgggggtaattggctctttattactcacaaaaatccatgggcttgctaatgatgtatacctacaagttgccctattgactgtgataggtttatcggcaaaaaatgccattttaatcattgaatttgccaaagaaatccaagaatctggtcaaacgctcaaagcgtcaatcatgtct

SEQ ID NO: 385 - DNA, 558 bp, M.catarrhalis
atatttttattaggagtgattatgagtacaccacttgatttaacaatcatgatatcaagtgagcaaattgccacaaaagtcaaagaattgggtgtacaaattagtacacattatcaagacagcaataaagagctggtgttggttggtttattgcgaggctcagtcattttcatggcagatttatgccgtcagattgacaaaactcatgagattgattttatgaccgtctcaagttatatcaataaaacaaccgtttctagtggcgatgtcaagattattaaagatttagacagtgaaatccaaggtaaagatgttctgattgtggaggatattatcgattcgggtcgtactttatcaaaggttgttgagattttacaaactcgtgagcctaattctattgaaatttgtacgctggttagtaagccatcacgccgtgagataccaatgacggttaagttttgtggctttgaggtagaagataaatttattgttggttatgggttagattatgaccaaaaataccgccatttaccattcatcggtgaaatcggtctttaa

SEQ ID NO: 386 - DNA, 756 bp, M.catarrhalis
tcaatacctttggagaaaatgatgaaaaccgtctttcatgccgctgattctcgtggtgatgccgaacatggttggctaaaaagccgtcatacctttagctttgcagagtattatgatccacagcgtatgggctttggtgtgcttcgtgtcattaatgatgattgtgttgaaggcggaatgggctttggcagacatccgcatcaagatatggaaattatttcactgcctttgagtggtgatttggcacacaaagacagcatgggtaatggcagtatcattaaaaatggtgatatccaagttatgtctgctggtacaggcattactcacagcgaaatgaatgctaacgctgataagccagtgaagtttttacaaatttgggtcttaactcgtaaaaatggcataaaaccacgctatcaacaagtcaccattgccgatcaagccaagccaaatgattttcaacaaattttatcgccaaatgcagatgatgatggggtatggattcatcaagatgcttggttttcattagccaactttgataaagacaccagtcgctactatcaaatcaaaaagtcaggcaatggtgtttatgtatttgtgatcaaaggtagtgcaaacattggcgatcgacaacttggcgagcgtgatggtttgggtatttgggatacggatggttttgaattgactgcgaccagcgacgcccaagtcttattgatggatgtgccaatggatattgcacccaataccaatcagccttaa

SEQ ID NO: 387 - DNA, 1467 bp, M.catarrhalis
gccaaggtatctgttatgtcagaagaacaaaaaccaaagaaaaaaccccgccctgcccctgaaaaaatcattcccacctccaaagatatggatgcaaccaagcaccgtgtgcatccacgctttgctaagggcaaatataccaacattcgcctaattagcatgtatttgattttactgggatttttaatcgcaccttggcttcgttgggatggtagacaagcacttttatttgatgttatcgaacctaagttttatatttttggggcaacttttatgcctcaagatttttacttctttgcatttgtgtttatcattgccgctttaatgctatttatggtaactgtctatgctgggcgggtttggtgtggttacgcttgcccacaaaccatttatgtgcatctgtatcagcatgtagaaaaatggattcttggtgagcgtaacaagcgtattaaatttgataaaatgccttggaatgccgaaaaaattatcaaaactgcccttattcataccatttggggtgttttttctgcgattactgcggtaacttttattgcatttattgttggtacagactatttattttttaatggacaccctttattttttatgggttggggtaagatgacatggatattttttattctgattgtctttgttacccaaaccaacgcaggctatatgcgagagcatatgtgcgtgtacatttgcccctatggtcgcttccaatctgtcatgtttgacaaagacacattgattgtttcatatgattatgagcgtggtgagcctcgtggtgcgcgtaagaaagataccacacctgcaggctatggtgattgtgttgattgcaccatgtgtgttcaggtatgccccacaggcattgatatccgaaatgggcttcaggttgaatgtatccaatgcgccgcttgtattgatgcatgcaacgaaatcatggacaaagttggttacccacggggtttgattcgttatacaaccgaacgccaattggttgaaaaacaaaagaccaaaattatcggatggcgtatttttgcttatactggtgtacttttggcttgtatcattgctgcaacgatggtattggttagtcgtgcaccccttgagatggaaatccgccatgaccgtaaacaactctcaaccattaggcgtgatggcatggttgaaaatagctatgtcttaaaaattgtcaacaaaaccaatgaacgccaagtttatcaagttcgtttagatgcagagaatacagctggcatgactttacgctcacgctttaaagaattaccattgcaagccagtgagctgtacgatttgcctgtcagcatcatcggcgacccaaatatcatcaagcctggcagcacacctgtaaccatcactgtatatagtaaagatggtcaatacagtgcatcagctcaagatgtctttatttacgaaccaaaaaaatccaagcagcccaaataa

SEQ ID NO: 388 - DNA, 414 bp, M.catarrhalis
caggtgttacctaagacaccactgttattaatctcaaatcgagatgaattttatgcacgtccaaccttaccgctgcacgcctgtgatggtattattgcagggcgagacaagcaggcgggtggcacttggatgagtgtgaatctatcaggtcgctgggcagttttgaccaattttcgtgatggacaggataaaaaattgtacgccacctcgcatggcacattggtgcaaaattatcttgactcacaaatgacaccattacaatttttgacatgcttaaaaccatcacaaacagattatgcaggatttaatctcattgtcggtgatcgcactcaagctgcctacatgagcaacaaaggcgtagcaccaaccttactggcatggcgtgtataccttatcaaatggtcttatcagtga

SEQ ID NO: 389 - DNA, 507 bp, M.catarrhalis
ctgataccgtttggtattaagccaaataatgataaggatgctatgatgagccaacaagatattttccaagccctaaccgaatcacatgatagacagcgtaaattgtgtgataagattgaatcgctgatggattctgaccttgatgctgccaaaaaagtctaccctgagcttgagattgagctacaggcacatgctgccgccgaagagcgtcatctgtatgcacctgtcatggaatatgatgatgggctggatttatctcgtcatgccattgctgaacatcatgaaatggatgagatgatgcataaattaaatgatgggcgtatcagtgatgatacttggaaagaaacttgccatgccctaatccatgagctacgacatcatctaaaagaagaagaaaagaagttttttatccaagctaaaaaattattggatgaagaacagcaagaaagattaggtgcactttatgaagtggaacataaccattttgagcgtaataataatgagtaa

SEQ ID NO: 390 - DNA, 201 bp, M.catarrhalis
ttatgtaagcctatgaaacttttttctgttttagccatatttatgacttgcaccctactgagtgcttgtgttcataaagttgtcactgtacctgccaaaattgcctataaaacaaccaaagttgttgtaaaaggtactgttgccatcggtaaagcaatcattccaaatgatagtaacgataaaaaagataagaaaaaataa

SEQ ID NO: 391 - DNA, 1272 bp, M.catarrhalis
ctttgcgttacaatagacacacaagatcaaagcaagagtagttttttcactcgatttgataaaactgcgacgctaaataaatcgggctgcacaggaaaatatccaatgagtctatataaatcagcagtagcccccttatccgttgatcatgaatatgaaatcacgatcgtacgattttttacaatcatggcggtattttggggtatcgttggcatggctgtcggtgtattcattgcatcacagttggcatggccagtattgaattttgacacatcatggctgtcttttggacgactaagaccactgcataccaatgcggtaatttttgcgtttgggggttcagcactttttgcaacatcttactatatcgttcaacgcacttgtaagaccagattatttgcaccttatttggcatggtttactttttggggctggcaggctgttatcgtttctgcggtcatcacactgccattgggtgtcacctctgccaaagagtatgcagaattagaatggccaattgatatcgccattgcattggtatgggtcgcttatgccattgttttttttggaacgctcatcaaacgccaaacctctcacatttatgttgcaaactggttttttgcagcattcatcatcacgattgcgttgctgcatattgtcaatagcttggtcgtaccagttggcttatttaagtcatactcacttttcggcggcgcaaccgatgccatggttcaatggtggtatggacataatgctgttggtttttatttgacagcggcgtttcttggtatgatgtattactttattcctgtacaaattggtcgccccgtttattcatatcgcttatcaattgtgcatttttgggcattgattgcatcatatatgtgggcaggtggtcaccatctacattactcagccttgcctgactggacacaatctttgggtatggtgttctcattgattttatttgcaccatcttggggcggtatgattaatggcgtgctgacactttcaggtagctgggataaattgcgtacagacccaattatccgtttcttgattgtggcactatcattttatgccatgagtacttttgaaggtccaatgctctcaattaaagcggttaatgccattagccataatactgactggactgttggtcatgtacattcaggtgcattaggctgggtgggtatgattaccatcgggtcaatttatgtgctatttgcctcgatctttaataaggcaaaagaggtattcaaccaggcttaa

SEQ ID NO: 392 - DNA, 435 bp, M.catarrhalis
tgtctttttttaaccttaaccgacattatcaaacagtcaaggacaattattatggcaaaatttttaagccaagcatggtttgatcaagtcaatgaactcaatcaagctgcaggcaatttaaatctaccgccaaatttagccaatgtcttattaaatgccaaagttactggcgatgacggtgccaaactacacctcaaagaaggcaaaatttttcaaggtttgacagaaaatgccatcagcactgtcactgttgatagcgaaacattatcacagctcatcgcaacaggtgatgccaatcaagccattgaagcatttatgcttggcaaaattcgtattgatggtgatatgtctcaaatcatgacgctacaatctgccaaaccaagccaagaacaaaaagagctatttaaaaaaattctgcaaataaccgaattttaa

SEQ ID NO: 393 - DNA, 732 bp, M.catarrhalis
cttatgaaaacaacgatttatccgctcattgtcgctgctggcacaggatcaagatttggtgccaataaacccaagcaatatcttaaaattggtactaaaagtatcttgacacacagtatttctcgattaaatcaccccgatcttgatgctttgaccgtggtgattgctcatgatgatgcctatattcaaggcgaaatgttggacatgcaatcctcttttgatcaggcaatttactacacaactggcggcgatgagcgatggcagtcggtgatgaatggacttgacaaaatctgtgctgaagggggtttggatggtgattgggtgcttatccatgatgcagcaagaccatgtttgccttatactgatttggatcgattgattcataaaatcaaaagcaatcaatgcaatgcagcaatattggcgacagctgtcgtggatacattgaaatttgccaaagataaccatattagccatacggtcagccgagatgatttatggcaagcgttgacgcctcaggcatttaagataggggttttaaagtcggcttttgaatttgtcatcaccaaccgcctgcagattactgatgaggcatcagcgtgtgaagcgatgggggagtctgtcgccattgtgccagcatctcggatgaatattaagctgacttaccctgatgatttgccgcttatggagaagattttaagtggtttgtttgatgaattggtcaaattaagttaa

SEQ ID NO: 394 - DNA, 477 bp, M.catarrhalis
catttttatttgtattactctcaaactcaactaaataggttttatatgactactactatcagtgccaaacccgctgaagttgtacatgactggtatgtcgtggacgctgaaggcaaaactctgggtcgcctagcttctgagattgcttctcgtcttcgtggcaagcataagccatcgtacactccacatgttgatacaggcgattatatcgttgttatcaatgctgacaaaattgctgttactggcaaaaaagctcaggataaaaaatactatcgtcatactggctatccaggcggtattaaagaaactaacttcactaaacttcttgcacacaagcctgaagatgtgttgtttaaagctgttaaaggcatgcttccaaagggtcctttgggctatgcgatgattaaaaagctaaaactgtatgcaggcaccgaacatccacatacagctcagcaacctaaagcattagacatctaa

SEQ ID NO: 395 - DNA, 291 bp, M.catarrhalis
ccgttttgtgctgtcaatcaaagaaaatatgtaagcaataggaatgaaatagcgctgatagttgctgctgctggtaaggtaataacccaagccaaaccaataggtttcatcaaacgccaattggtatttttattcaccaaaccaataccaagcacagcacccaccaaaatgtgcgtacttgaaacaggaatgcccaagctagaagcacccatgacaactgcagctgctgcaagctctgctgaaaaacctgaagctggatgcatttcggtaaggttggtaccaactgtttga

SEQ ID NO: 396 - DNA, 651 bp, M.catarrhalis
caatcattggcaaatatcatgaaactgacacccaaacccaataaacaggcaaatatttggtacaaaaactatatggttttaatttttgtcattggattgcctgtgttggttgtagtgatttgtttattttttattttttattccataaaaattcaagactcaaccgtccgtgatgattggtatatggatggcaaaaccttataccaagactcatctcgtgatcaattagcacatgatttgggcgtttttggtgtcatgcgactatcttggcatgccaatacaaccgatatacgctttgaattaaattatcccacccaaaatctttcaacccaaaactttcataatgatacaccattaacctacccagatgagttatcggtgcatatctcgcatgccactgacgatacaaaagatcgtgattttaccattgtccatcaaaaagataatgtgtatgttggcaaagtgcaacttgatgacacccctgccaaatattacttgcaaatcagtagccccaagccacaaaactggcgattaattcagcacgaaaatttaccaaaaagcaatattatcttcttaccgctgtcaagttttgatgaggagcgtcgcatattgcccgaccaacgcaataaacgcccttctgccaaaccataa

SEQ ID NO: 397 - DNA, 702 bp, M.catarrhalis
tgggtggtggctattatgtcaaatttaatggcatttgatacggtatttgagcaatgttcgattgcacttttggcagatggtactgtaatttatgaacagactgtgccaggtggtcgtggtcaaaccgagattgtcttatctttggtggatgaagcgttgtctcagacgaatattaagttatcaaacatagactgtttggcgtttaatcgtggtcctggtgcatttagtggcattcgcattaataccgcagtggtacaagctttatcggtggcacatgaaactttgtgcgtaggtgtttcaagtttgactgcactggcagacacggcacatcagatacaccgatttgcagaatcatcgtacatcacggcggttatggatgcacgccaaaatcaagtctatgctggtaattttatgatcaaacatgataatattcagccaatcgtagatatcagcaatgtctatggcaacgaatttttggtagattatggcagtaccatgcctgctgatattatcgttggtgatggcgtatctttaattaacacaaatgccaatattaaactaaaaattcaaccaacagcaagcgatatcgctcgattggcttggggtgaatatcaacaaggtcatgcagtgcgtgcagaacacgctttacctgtttatcttagagataatgcttggaaaactttggctgagcaaggcaaataa

SEQ ID NO: 398 - DNA, 291 bp, M.catarrhalis
aaacctatttatttgggagaatttaaaatggatggctggatcatatgggcataccttgccttaaatgttttgatattaatacaaaatttcacacaaaaaactcgcatccaaaaacttgaagatgcgttgtttgtttataaaaaacaagaatggcttgagtacgcacaatcgcaagcaaatttaccacaagtcaaagccatcaaagccattcgtgccaaatttccagaaattagcttaaggcaagctgtgcagttgtacgtcatggtaagcccaccaaagaatcactcatga

SEQ ID NO: 399 - DNA, 405 bp, M.catarrhalis
caccaaccttactggcatggcgtgtataccttatcaaatggtcttatcagtgatgaatggtttaaatgcacacatttaagaatgcatttttatcaagaaattctacctttagtcaggcaacttgattttgatggtttgatcatcacgccaaagttaagccaagcggtgtggcaagtgcttgaagatacacaaaaagccaaggataatcaattgcccaatacaggtgttgatctatatttggagcggttattatccagtatttttattcaaagctcaaattatggtacacgggtttcaaatttactgtgtcttcaaaatcatcatctgacttggcaagaaaaacagcaacagggtaagcatatgggtcaaatattttcttggtctggtcatttacaatacaaataa

SEQ ID NO: 400 - DNA, 2256 bp, M.catarrhalis
  unsure (138),(144): Identity of nucleotide sequences at the above locations are unknown.
atggttgattttggccctattgagaataaatcactcaataaagcctttgtatcatcaggtgtgaccgcccaaaatttacaaacaattatgaaaaatattcgaggagatgaggctgtgaccaatcaaaatagtgaacanaatcgncaagcattagataaatataccatcaatcttactgagcgtgcgatggcaggtaagcttgaccctgtgattgggcgtgatgatgaaattcgccgtactgtacaggtgttatctcgccgtaccaaaaataatccagtgcttatcggtgaagcaggtgttggtaaaactgccatcgttgaagggcttgctcagcgtatcgttaatggtgaagtgcctgaaagcctaagaaataaaagcgtgctatcgctggatatgggttctttgattgctggtgcgaaatatcatggtgagtttgaggagcgactaaaagcggtgctaaatgagcttgccaaacaagacggcaatatcattttatttattgatgagctacataccatggtgggtgctggtaagaccagtggtgcaatggatgctggcaatatgcttaagcctgcacttgctcgtggtgagttacgctgtgtgggtgcaacaactttggatgagtatcgtcaatatattgaaaaagatccagcacttgagcgtcgtttccaaaaagtcttggtagatgagccgactgttgaagataccatcgccattttgcgtggtctaaaagagcgttatgagctacaccatggtgtcaaaattatggattcggccatcattgctgccgctaagatgagccaccgctatatcaccgatcgtcagctgccagataaggcaattgatttgattgatgaagctgccagccgtatcaaaatggagcttgatagtaagcctgaaagtttggataagctagatcgtcgtatcattcagctaaaaatgcagctagaagctgtaaaaaatgaagaagatgctggtgcaaaatcacaagtcaaatcacttgagcagcaaattgatgacgcacaaaaacagtatagtgagcttgaagaggtttggaaagctgaaaaagtaggtgttgaaaaaagtaaacagcttcaagccaagctagataccgcacgcatcaccttagaaaaagcattgcgtgaaggggattatgctcgtgcttcacagctacaatatggtgaaatcattgcacttgaaaagcaattggcagaagagcagacagatgagccagaacatgcacccaagctacttcgtaataaagtgactgataacgaaatcgctgaggttgtgtcgcatgccacaggcattcctgttgccaaaatgcttcaaggtgagcgtaataaactgttggcgatggaagatgtattacatgagcgtgtcatcggtcaaaatgaggcagtggcggcggtcgcaaatgcggtacgacgcagccgttcgggcttgtcagatcctaataagccaagcggttctttcttatttttgggaccgacgggcgtgggtaaaactgagctgactaaggcattggcaaatttcttatttgactctgaagatgcgatggttcgtatcgatatgagtgagtacatggaaaagcacagtgtttcacgcttggtgggtgcacctccaggttatgtcggttatgaagaaggaggtgtgctgaccgaagcggtacgccgtaagccgtacagcgttgtactctttgatgaagttgaaaaagcacatccagatgtctttaatatcttactgcaggtgcttgatgatggtcgattgactgacagtcaaggtcgtgtggtgaactttaaaaatactgtcatcattatgaccagtaacttaggcagtcatgcgatccatgagatgacagactcgccttatgaagacatcaagactgcggtaatggcgtcggtcactggacattttagaccagaatttatcaaccgtatcgatgagattgttgtctttcatggtttgggtgcagatcaaatgacgggcattgctgaaattcagcttgatcgtttgcgtacacgccttaaagagcgtgagcttggccttagtgtgagtgatgaggcgatgaatcatttggtatcggtgggttatgatcctgtctttggtgctcgcccattgaagcgtgcgattcagcaagagattgaaaatccattagcacaacttttattatctggtgagttcaccacgggagataccatctttgttgagtggttgaatgatcaattcacctttaataagctgcgttatagctga

SEQ ID NO: 401 - DNA, 636 bp, M.catarrhalis
ccacacacccagtatgggaatattcccattctttttctggaggaagttttaatgagccatgccgaaggcgtgaatattaaacgccgtagagtcctgattgcaaccaccgctgccattggagcagttggtgttggagcgattgccaccccgtttgtgcgatcttggtatccgagtgccccagcagaagctgcaggtgctgctgtcgttcaagacatttcaggcatcgagaacggtcaaatgatcaccgttaaatatcgtggcaaacccatctttgttgtcaaacgcaccgaagagatggtagcaaatcttagcaaagtaaccccaaaattaagcgatcccaattctgaggcttcagttcagcctgaagcgtgtaaaaatgagacgcgttcgctacaacctgagcttttggtggtcgaaggtgtgtgtacacatcttggctgtgcaccaacctaccgccctgaagttggtgcagcggatttaggcggtgctgattggtttggtggtttcttctgtccttgccatggatctttgtatgatttagccgggcgtgtttataatggcgtacctgcccctacaaacctacctgtgccaatttatagtatcgatggctcaatcttgaccgttggggaggcttaa

SEQ ID NO: 402 - DNA, 576 bp, M.catarrhalis
cacgccaaccaactctcatcagacgccatcactgacttgatggataaatttaaaaattacttaaaaccaattataaggagaattatcatgccatcttttgatgtggtttcagaattacaagtttttgaggttaagcacgcagttcaaaatactgaaaaagaggttgccaaccgctttgattttaaaggcagcgatatcagtattcaactgaatgaaaaagccaaaacagttaccattaccactgataatgaattacaatcagataatgtgtatgcgatttttgaaaaacaattgattaaacgaggcgttgatttacaatcacttgacccacaagataaaagccaatcagggaaacaaaccaagcaaatcatccatctaaaagatggcttagacagcgataccgccaaaaaaatctcaaaaacactcaaagaatctgatttaaaagtatctgccagtatccaaggcgataaaattagaatcagtgataagaaaaaagataatctgcaacttgctatggcttttttaaaagaaaagacatttggtgtgcctttacaatttaataattttaaagactag

SEQ ID NO: 403 - DNA, 642 bp, M.catarrhalis
acaatgtctaatatcactcatgaattagtagagaaaaatacaggtttactcgtcatctttatcgtcattgctgtcagctttgcaaccttggttgaaattgtacctttgatttatgatgaaaccgttgctgaagaaggcggtgtaaacaaacccatgccaaatatgcgtccttggacagcgcttgagcttgaaggtcgtgatatttatatccgtgaaggttgccatgtttgccatacacagatgattcgcccattgcgtgcagaagtggagcgttatggtccgtatagtcgtgctgcagaatcaacatgggatcacccattcttatggggttctaagcgtactggtccagaccttgcccgtgtgggcggtcgttattcagaccagtggcatgttgaccatctgaccgaccctcgttctgttgttccagaatctgtgatgccatcttatccttggcttgcgaccaatgaagttaatgggacaaaagtacaagaaaaaatgcgtctgtttaaagatcgttttgggttaccttatacagaagcagatattgaagctgcacctgaccaagttcaaggtgcaaccgagctggatgccctggttgcttatttgcaacagttgggtattgcgatgcaaggtcaacgctaa

SEQ ID NO: 404 - DNA, 186 bp, M.catarrhalis
atttatggtaaattctacaaaacaagccacgccgatagcagtcaatctattttttggtttgctattggctggaatgagtatctattttatccaatggggcttggtctacacaatgcatcagcaggtgctattgtttatgattgcaagtttctttggtatttttatggcattcaacattggcggtaa

SEQ ID NO: 405 - DNA, 1368 bp, M.catarrhalis
ccatatatcaaggatattcatatgagcaacgcaactattttgcagcatctgcctatcggtaaaaaagtcggcatcgctttttcgggtggtttggatacctcagctgccctgctttggatgaagcaaaaaggggcgctgccttatgcttacacggccaatttgggccagccagacgaagatgactacaatgccattcctaccaaagctaaacaatatggtgcggtcaaggcacggttggtagattgccgtttacagcttgttcaagaaggcattgctgccattcagtgtggggcatttcatgtaaccacaggtggcatgccttattttaacaccacgccattgggtcgtgcggtgacagggacgatgctggttactgccatgaaagaagatgatgttcatatttggggtgatggttcaacctataaaggcaatgacattgagcgattttatcgctatggtttgcttgccaatcctgaactaaaaatctataaaccttggcttgaccaaacattcattgatgagctaggtggtcggactgagatgagtcagtttttgattgataatggctttgattataaaatgtctgctgaaaaagcctattcaacggattctaacatgcttggtgcaacgcatgaagccaaagatttggagtttttagatgccagcatgcacatcgttgagccaatcatgggggtgcgtttttgggatgacagtgtcagagttgctaccgagacggttacagtcagttttaaagaaggtgtgccaacagcgttaaatggtgagcattttgatagccctgttgatttgatgttaaaggcaaatgagattggcggtcgtcatgggcttggcatgactgaccaaatcgaaaatcgcatcattgaagcaaaatctcgtggtatttatgaagctcccggtatggcattgttgcacatcgcttatgaacgactgctgacaggcattcacaatgaagacaccattgagcagtaccgtattaatggcttgcgtttgggccgtctgctttatcaagggcgttggtttgattcacaagcacttatgcttcgtgaaaccgctcaacgatgggttgccaaagccatcacaggtgaagtcacgcttgagctacgccgtggcaatgattatagcattttaaataccaaatcaccaaatctaacctatgaagctgatcgcttatctatggaaaaagttgaagatgctgccttcacatcgcttgatcgtatcggtcaactcaccatgcgtaatctagatattgcagatacacgccaaaaattggggctgtatgtccaatcaggattattaggcttcggtggtggcaatgctgtaccacagcttgaccatcaagataaacactaa

SEQ ID NO: 406 - DNA, 816 bp, M.catarrhalis
tcagacatcaacaaaggggtagccgtgcttgttatttttttactgtgtctgatactttatataggatcaggtctttatttggcatatgccttatttcaagatacaccgattcatcggttggtgcttggcatattgatttttgccatcttattacatggttgggtgttgacacctgaaatcatcacgctctacggactaaactttaacttatttaacacgctaagcttaactagcctattttttgtactattttatgtattatttggtctgtatcgcccaattttaagcttagggattttggcggtaccgatggcagcggctggggtgagtttgggctattttggtcaagtagcttataagccactcacggatttatcaaacactctacaaattcacattttgctatcatttgctgcatattgtgtgctactgatggcagccgttcaaggggtgctattacgcttacaaattcatgagcttaaacgcaaaaccattcatcgattttgggtcagtcgcctgccatctttacagagtatggagagtcttttgtttgatatggtgctgactggatttgtaattttgagtatcgcacttgggtttggtctggttgcaacttatgacatcttagatcaacatttggcacataagatggtatttagcttgctgagctggctattatatgggcttttgattgctggtcattatcgctacggctggcggggtaagcgtgccgcaaattttgcggtatatggatttttattgctggcgatcggttttgtcggctcaaaggcggtgatggaatttttaatcggctag

SEQ ID NO: 407 - DNA, 309 bp, M.catarrhalis
ctcatgaccaatacgccaaaaaccccaacacgcaccgaaattcaaacgcctgagctttggaattttcctatggattatcccatgagcatcatcggacacgaaggacatcatgaaacattgatcaatgaagtcaaactaattttagcagaaatttttcctgaatttgatgcagcgaccatgcaggttcgtccatctcgcacaggtcgctttcattctgtacgcgtgaatttgtatttaaccgatgccgatcaagtcaatcgcttgtataccgctttggataaagctgcaactgtgcgtaccgctgtttga

SEQ ID NO: 408 - DNA, 216 bp, M.catarrhalis
gcgtgccgcaaattttgcggtatatggatttttattgctggcgatcggttttgtcggctcaaaggcggtgatggaatttttaatcggctagcttttgatgatactactttaattttgacaaaattcccccatcttatctctacaccaaaatcatttaggataactcatgaccaatacgccaaaaaccccaacacgcaccgaaattcaaacgcctga

SEQ ID NO: 409 - DNA, 1677 bp, M.catarrhalis
tttttagtaaaattctattttaccagcaacagatatattactatgagtacgaaatttatctttgtaaccggcggtgtcgtgtcatcacttggcaagggcattgctgcagcttccattgcggctgttctagaagctcgtggtcttaaagttaccatgaccaagatggatccttatattaatgtggatcctggcacgatgagtccatttcaacatggtgaagtcttcgttaccgaagatggtgcggagacagatttggatttgggctattatgaacgctttttacgccgttcaaaaatgagtaaagccaacaattttaccagtggtcgcatttatcaaaccgtgcttgccaaagaacgccgtggcgattatttgggcggtactgttcaggtaatccctcatattactgatgaaatcaagcataaaatccgtaccagtggtgagggctatgacatcgccattattgaaattggcggtacagtgggtgatattgaaagtttgccttttatggaagcggttcgccaaatgcaagttgagcttggtcgcacacattctttactgatgcatttgactttggtgccttatattgcttcggcgggcgaatctaaaaccaagccaacccagcattcggttaaagaacttcgctccattggtctacagcccgatgtattaatttgtcgatcagaacaacccatttctgaagataaccgtcaaaaaattgcactatttacgaatgttgagccacgcggcgtcatcttatgcgaagatgccaagtccatttatcaaattccacgccgcttatatgagcaagatttggatgatttgatttgtgagcgttttggtatcacagcaccagaggcggatttgtcagattgggataaagttgttgatgatttgttcaactcccaaggcgagatcgtagttgctatggtgggtaaatatgtcgaactcccagatgcttataaatctgttaacgaagccctacttcatgcaggtattcacaataaaacaaaagttagcattcgatatatcagtgccgaggccctagaaacagattcagaggcaatgaatcagattaccgatgtggatgcgattttggttccaggtggctttggtgagcgtggtactttgggtaagatgaaagccattcaatttgcgcgtgaaaataacaagccatttttaggcatttgcttgggcatgcagcttgcagtcattgagtatgcgcgtaatgtattgggcatagaagcaaattctaccgaatttgatcgaaaaacagccaatccgattatcggcttgattaccgaatggtttgatgaaaaaggtgaacttcaaacccgctctgatgatagtgatttgggcggcaccatgcgcttgggtgctcaagaagcagaattggtttcaaactctaagcttgctgagatttatggctcacataatatcaccgaacgccatcgccatcgttatgagatgaataatcgctatattgagcctttggaaaatgctggtatgaaaatttcaggctattctgccaaacagcatttggttgagtcggttgaaattgacaatcatccttggtttgtggcggtgcaatatcacccagagtttaccagctctcctcgaggtggtcatccactatttaatagcttcatcaaagctgcgatagatgtgaaacaagcctaa

SEQ ID NO: 410 - DNA, 1068 bp, M.catarrhalis
atgatgacaaagacattaactctcattcagccagatgactggcatatccatctgcgtgatggtgaagctctggcaaccaccgttcggcatgcggcaaccagttttaaccgtgtgatttgtatgcctaatttggtgccacctgttaaaactaccaatcaagccatcgcttatcgtgaacgcatcttaaaggcattaaaagacagtgatttaccagccactcgcaaagatagtttcgatccacgcatggtgctttatttgaccgatcaaaccaccgccaaagatattgacgatgccgcacaaacaggtattgtatcggcagttaagctgtatcctgctggagcaaccaccaattcagctgatggtgtaactgatattttggcacgcagcttggtatttgaggccatgcaaaagcatggcataccgctactggtgcatggtgaaattaccgatagcaacattgatatctttgatcgtgaaaaacgatttttggatgatgtgctaaataaaattatcacacaatttccgaatttaaaaattgtcatggagcatatcactaccgccgatgcagcggatttttgtcttgctcaaggcaatcacatcgcagcgacaattaccccgcagcatcttttatttaatcgcaatcatctgctggttggcggtattaagccgcactattattgtttgcccattttaaagcgtgctgcacaccaaaagcgtttgcttgaagtggcaaccagtggcaatcctaagtttttcttagggacagattccgcccctcatgccacacacacgaaagaatcatcgtgtggctgtgcaggttgttatagtgccttgcacgctctaccactctacgccatggcatttgaaagtgtcaatgcacttgataaacttgaaaactttgccagccgatatggtgcacaattttatggcttagcaatcaacaccactcaaatcaccctaataaaacaaccacagaccatacctgagagttttcattatttaggcaataagacgctgacaccgttgttggcaggtgaagttttaccttggcaagtggttggtatatga

SEQ ID NO: 411 - DNA, 213 bp, M.catarrhalis
gatgttgcaaaaagtgctgaacccccaaacgcaaaaattaccgcattggtatgcagtggtcttagtcgtccaaaagacagccatgatgtgtcaaaattcaatactggccatgccaactgtgatgcaatgaatacaccgacagccatgccaacgataccccaaaataccgccatgattgtaaaaaatcgtacgatcgtgatttcatattcatga

SEQ ID NO: 412 - DNA, 426 bp, M.catarrhalis
tttgggaaaaacactgtggcaaatgtgaatcagatacttaagtatatggtgagtaatcagcttagactgattatcagcattattattgcaacagtggttttggtgctgatgcaaatacagtattggtatggtgattatggtcatgccaatttaattgctgtaaaaaatcagctgcatgaacaaaatcgcttgaatcaagagcagatcaataaaaacaatatcttattggctgatgtcaaagatctaaaatcgggtctttcggcaattgaggagcatgcacggctggaccttggtttaattaagcctggtgaaacatttattcagctgtcaaatgcaccaattacttattcacgccagcccttacttgaaattgatgagagtatcgaggctgttgattctgtaccagaacccatgcccaatcactga

SEQ ID NO: 413 - DNA, 1560 bp, M.catarrhalis
cacattggaaaaattatgtttgatactttaactgaacgactctctggtagtttgcgtcatatcgcaggtacaggacagctgaccgaagacaacatcaaagatactctaagagaagtacgcatggcactgcttgaagcagatgttgcattaccagttgcacgcaactttgtcgcacgcgtcaaggaacaagcacttggtcaagaagtactcaaagaactcgccccagggcaagcgtttgttaaaatcgtttatgatgaactcactgagatgatgggcagtgccaatcagacgcttgagatgacgggcaagccgcctttggtgtatctgctggcaggtttgcagggtgcaggtaagacgactactgcaggtaagcttgctaagtttttgcaagacaaacaaaacaaaaaggttatgctggtatcagctgatatatatcgtccagcagccatcaagcagcttgaacaggtggcagcacaagtcggtgcaagctttgtaccttcaacaaccgatgaaaacccaattgatatcgcacgccgagccatcgatgaggctaaacttcagtatcaagatattttgatcattgataccgcaggtcgtctgcatattgatgatgagatgatgagtgaaatcaaggagttaaccaaggcagtcaatcctgtggagacgctgtttgtggtggattcgatgacaggtcaggatgcggccaatactgccaaagcatttaatgatgcactgcctttgacgggtgtgattttaaccaaaaccgatggcgatgcgcgtggcggtgcagcactttcagtgcgtgcaattacaggtaagccgattaagtttttgggtcgtggcgaaaaactagaagcacttgagttgttccaccctgagcgtatcgctcagcgtattttaggtatgggtgatgtgctgtctttggtcgaggaagttgaacaaaaaattgaccgtgaaaaagccgaaaaaatggcaaaaaaaattcaaaaaggtggcgagtttgatttagaagacttactgacccagttccagcagatgaaaaacttaggtgggatggcaggctttttggataagatgccaggcttgggcggtgctgatatccaaaaagccatggaagaagctcgtcctgaagaaaaagtcaaagaaatggaagcgctcatccactcaatgacaccgtttgaacgccaaaatccagataaaatcacaccaagtcgcaaacgccgtatcgctgcaggctcaggtaggcagattcaagatgttaatcgcctgctcaagcagcacaaacaaatggcaaaaatgatgaaaatgatcagccgccctgatgggattggtaaaatgatgaaagcggtgcagggtctggctcgtggtatgtcaggtggtggccctttatttggtaataaagacgctaatcaagcaggtacgcccaatatgcaagacatgcaaaaatccatgcaagatttgggtctaaagccagaagatatgcccagcatggaagagatgcaaaaaaagatgcaagaaatgcaaagtcagcttccaccaaactttaaaaagcgtttttga

SEQ ID NO: 414 - DNA, 3897 bp, M.catarrhalis
atcaaaatgaaaatcttaaaactcagctttgaaaatatcaactccttaaaaggcaaatggcaaatagattttgaagatgccgctttttatcaccatgctctatttgccatcacaggtcccacaggtgctggcaaaacaacgattttagatgccatttgtttggcgttgtatggtgagacgccccgtctgagtatttctgccacacaaaatgagctgatgagtattggtactgcttttgcagccagtagcgtgatttttcgtgctaatgacaaaatttatcaggtcagttggtcacagcgtagagccaaacaaaaaaccgatggcaatttacaagccgtcagccgagaaatcagcttacttcagcatgccaacgacacgcatggaaaaattcttgaagaaaaagcaagcttagttaataaggaagttgagcgtattttgggcatgaataaagtccaattcactcggtcggtcatgcttgtgcaaggtgaatttgcagcgtttttacagtcagatgccactgagcgtggtcaaattcttgagcagattacaggcacacacatctatgccaaaattggtcaagcggcctttgaaaagcacaaagaacagcttaatttattaaaaaatctacaaattaaattaggagaagtcaatttattaaatacagaagaatatgatggattaattaagaaaattagcgaaatcacgcaacaaaaaaacttgcttgaaacacaaattaagctgatgagcgatcgccagaaaattgccaatgaataccaaaccttaaatcaggaaatggctcattatcaagcaaaactgatcgagcatcaagaagccttaacaaactttgagccaaatatacagcgcatgaaacacgctcatgatgccaaaaatttgcagccgctttatacagcgtttcatgagtaccatcttgagtataacaataaacaagatcaattgattatactaaatcatcgcttaaatgaaatccaattaagccatcaaaagcgtagccaaacacacagtgagcttaaagaaaaatttaacaaaataactgatgattatgaaaatttaaagccaactttgcaagcggttcgcaggcttgaccaacatattgcctctttgcgtaaagagcatcaaagcatgatccaaacccttgaaaaaacaaagcaggactatacatctacacaaaatttactcaaagaaactcagtcaaatcagtcagctttggtacaagatattgacaccattcaacaaaaaattaaaggcattgacagcgaaaatttaaagaaaaacttaaaattatgcgataatcatatctcacaatacgatacactcattcaagcaataacacacgcccatcaacagcagctttggcgtatcaatgtatttagcaatcatcttcatgaactcaaagataagcgagagcattttaagtctgttaatctaaatctacagtctatagataatcaaattggcactataaatataaaaattattgataatttaaacttaacaaaaaaagatgatattaatgtagatattttacaaaaaaatatagaagatcagtacgaaaaaatcaagcagcaaacacatcatttatatacgctagagcgaatcttgaaagattatgagcaatatgcacgcattcaatctgacatcagcgatacaaaccgtaagattatcaacctacaagaagaaaaaatcaaaattcaggatatcttagagacagtttctcaaaatatccatcaagcaagccaaacccacaaagccatcttggaaaattatgagctacacaagcaaattttatacatgaaaatgcactttgaccaactgcaagatggtagtccttgtccactttgtggcagtaccgagcatccttttaaattacagcccaatcatttggacgatgaacatgccaaacaagccaaagaaaaattagtattctgcgaaaatcagcttaacgaactcaatcacaccgctactcagcacacgaccacattacacaaactgcagatggctttggatgatcatcaagagcatctaaatactgcacaaaatacaagtaactctctttatcatgatcttaatgccctatggcaaacgatcgccagtgaatgcagcctagaacatgcaaatactctaccaagccgaaatactattggaaaatttattaaaaacagtcaagataaaattaaaaatctagaagagtcttatcagctgagcagtcggctattgcatgaacttaatcagctgattgctcaaaaagatagacaaatgatcgaaaaagaaaacttgaaaatcaatggtctaaagcttcgtgatgatgctttggtgctgatgcgtgagatatatgatggtaaagtacatttttgcgatcaactattatctgcattttatcagctcatccaagcacaaaataccatcagcctgccaaatgagcttaacgccattaaacagcatttgtctaaaatcaccacttggtacgataatatcacacatcacacccaaggcgatgttctaccagaagctgaagcattcaaccctagcccgttaacgctcaaggaagaagagtttggcaaagttcagtatgtgttatcacaaaccaagcaaatgcttgaaaatcaagccaatcaagccaccgcactcaatgaagattatatcaataagcaaaccaagctgattcacctagacgctcaaatcaacgcacataccaaaaaaatccaagaactcacacctgttattgctgagcttgagcatacgatggctaataaagtgcttgaaattaaaacacaaaccaacgaacgcatcactttattgggtgataaaaatcctgatcatactgaaaacaattatcaagataagctaacacagataagacagcagttagaaaatgccactaaaaatgtacatgatgatattgccgacttacatgcccaaaaagcaaccattgagagcctaaatctaaccataaaagaactggccaataaactcagccaaagcaaggtaagctttgagcaagcactgatggcatcggagtttgatactcaagcggagtttttggcggcattaatcttagaagatgagttaatcgagctaaaaaccgctcatgatactctcattaatcaactaagccaaacgacaatatcaatcaataactgtcaagaaaaacttgataatttaatcaaatcaaaccccaatgttcatcaattcaagcttgaagatttacacacagagctcatcaatctgcaacaacagctagagagtgtcaaccaatctattggcgaacttaacgccatcaaaaatagtgagcttcaaaaccgtcagcggcatacacagattcttaaagacatccaacgccaagaacaagaaaatgcaatttgggcaaaacttgatatgctgattggctcagcagatggtaaaaaataccgaaactttgtgcagggtttaacactggatttggtgctacatcatgccaatcaaattttagcaaaaatgaacgatcgctacttgttgacctttgatgcagacagctcaaggacacttgaaatcttagtgacagatcttcaccaaggcgatgcggtacgcagcagtaaaaatttatcaggtggtgaaagttttatcatctcactggctttagcgctcggtttgtcgcagatcaatagccaaaatatacaaattgaatcactatttttggatgaaggctttggtacactggatgaaaccgctttagatttggcacttaataccttatttgaactacagcaaagcggtaaaagcattggtattattagccatgtcgccagtctaaaagaacgcattgatacccaaattatcgttgaaaaacatgcaggcggatatagcaccttacatggtgctggtgtcaaaaacctttcttaa

SEQ ID NO: 415 - DNA, 1647 bp, M.catarrhalis
aaaccttggaaacttaggttgtttgaagtggttttttcgtttatctttggtgaatttatggtaaattctacaaaacaagccacgccgatagcagtcaatctattttttggtttgctattggctggaatgagtatctattttatccaatggggcttggtctacacaatgcatcagcaggtgctattgtttatgattgcaagtttctttggtatttttatggcattcaacattggcggtaacgatgttgccaactcatttggcacatccgtgggtgcaggtacgctatcagtcactcaggcgttggcagttgcggcaatttttgaggtatcaggtgccgttttggcgggtgcagcggtcacagatacgattcgtagcggcattgttgatatcggtcaattgggcgtttccccaaatcagtttatttacttgatgctttcagcactcgttgcagcggcattttggctattatttgcaacgaagcgtggtctaccagtatcaaccacacatgccattattggtggtattgtgggcagttcaatcgtgcttggcattagtatcggtggggttgattttgcattttcaacggtcaaatggtcaaagattcgtgatattgcactttcttgggtgatatcgcctgtattaggcggggcattatcatatttattatacagtattattaaaaaaaatatattggcatataatgataaagcggaattggtcgttaagaccattaaagccaaaaaaaaggcacttaagcgtgaacaaaaagagtattttgagacacttgatgataaagaaaagttgccatataccaatgcgttgctgcgtgaccaagaggcttttaaagacggtgattgtcagcgtgatgatttagaaacccaatattaccgtgccatttttgaccttgaacgccgccgtgacaatcttgatacactaaaggctttaaagacatgggtgccactcattgccgctttgggtgcggtgattatgacagcgatggttgtatttaagggtttggcaaatacaggtttacaattatccattctccaagctggtttggtgatgggtatgctgggtgctttggtatggttgaccgcttttatttataccaaaaccattcgtggtaaacataaagaagccttaggtaaagcgacttttgttatgttcagctggatgcaggtatttacagcatgtgcctttgcttttagccatggttccaacgatattgccaatgcagtcggtccttttgttgccattatggatgtgattaaaaataacgcagttgaggctcaggcaacggtgccagcacctgtcatgctaacctttggcgtttcactgattgtaggtttatggtttattggtaaagaggttattcaaacagttggtaccaaccttaccgaaatgcatccagcttcaggtttttcagcagagcttgcagcagctgcagttgtcatgggtgcttctagcttgggcattcctgtttcaagtacgcacattttggtgggtgctgtgcttggtattggtttggtgaataaaaataccaattggcgtttgatgaaacctattggtttggcttgggttattaccttaccagcagcagcaactatcagcgctatttcattcctattgcttacatattttctttga

SEQ ID NO: 416 - DNA, 1458 bp, M.catarrhalis
agctgcaactgtgcgtaccgctgtttgacccaagaccgctgtttgcggtctttttttgataatttggcaactgtcatgacgatatttaaaacacatctaacccatcaaagccccataacacctgccctacccaagcccaaggattcgctgcggctattacatacatctgattggcatttaggcaagcttttatacaatcagtcacgctatgatgaatttgctaaatttttagattggctgattgaggctttgatattacatcaggtggatattttaattgttgctggcgatatctttgataccatgacgccaagcaaccgtgcagaatacctttaccatcactttcttgcctccgcctttaaaaatcacattcagcacatcatcatcgtcgcaggcaatcatgactctcccaccagcctacaaaaaaccaaagaagtactcggcgtgctaaatacccatgtgattggcagtgtcagccaagacaaatctgatgagctcatcgttctaacagatgatgtaggcatcccaagtgccatcgtgatggcagtgccttatattcgtgatcgtgatgtcagaagtgggattgatgccaactcaatccaccaaaaaaatcagctcttactggagggtgtggccgaatattatcattctttaaccaatcttgccaaggataagcagcaagccgtttatcacactcaccaaaaaaccatccccatcattgccacagggcatctttatgctactggtgctgctgtctcatccaccgatgatggcatgcgtgatattcagattggaacacttggtcagatcagtagccagatttttgatgatgccattgattatgtggcacttggtcatattcacgctgcccaaaaagttggtcaaaaaaaccacatccgctacagcggctcgccaattgcgatgggatttggggaaattggacgccataaacaagtgctgattgttgatttaccactcaataaaagtgtaccgatatcaaagttgccaaagaatgatgatttgcatggcgaaaatcaagataacaatgccatatcaatccatagcctacctgtgccaatttttcatagccttgctaaaatctgtggcgatatggcgtttattaccaacgccatcgatacactaaaaacacatgatgagcctatttggcttgagattgaatatgttggcgacaccttagtcgctaatttaaaacagcacatttccaatctgctggaaggctcaaacatcgctgcaattagtatcaaaaataaagccatccatcaaggtagcctaaaattgcacacccctaccctaaatttagaaaaacttgatgaaatggatattttttatcagcggcttgataaggaaaacttaaatcaagatgaaaaaaatgatctcattggtgcttatcaagagttaatcaaagccatccaggaaactgatcataaagccgtctaa

SEQ ID NO: 417 - DNA, 204 bp, M.catarrhalis
ctcgtgatgctcgtgaagttgagcgtaaaaaattgggtctacgcaaagctcgtaaacgcccacaattttcaaaacgctagttcacacttatcgtttcaaaaaagctctcgatttatcgagagtttttttacacttatttttcatcagctcattaatcaaattatcgtggtaagtcaaaaatacctatcagtcttattggtttaa

SEQ ID NO: 418 - DNA, 1053 bp, M.catarrhalis
gcagattttagcattgaaaaatcattttggaacccaatcaaatcaacagttcatcaaaacagttcaaatgacctcttgggtagattaaggaatgtgatgttacaagccattggctttgccttttcaattgtcttgccaaatctttttttgatggctttgggttatgatatgaaaaggcgttcagcactcaatgctgaatttatcgaggtagcgtcaagcattgtgtttaattattgtctgccttgtttattattttttagtgtcctaaaaagtgatgtgcagattttggcacaatctaagcttttgctggcaggatttatcacaacttttacattgttttttttggcagagatttacgctaagttttttatcagcgagcttaaagataagggcgtgtttgtgcaaggggtgtttcgctcaaacatggcaattgttagtcttgcgaccgtttttaatgcatacggtagcgaaggcttgggtgtgggtgcaatttatatgggggttatcaccattttatataatgttttggcggtcatcaccttatcacgtaccacccaaaaagcggacagcgtatttatgcaagccaaaagtatcttggttaaaatcatcaaaaacccactgatcatcgctttggtgtctgccttcgtttataaagcacttgatttgcccatgttgccagaatttattaataaaacaggcggattattaggggcggtcgcattgccacttgcactgatttgtgctggtgctactttgaatatcaaatccatgataagcttatcaggattgtccatgcaggcaagcattgggcgtattgtcattgcaccactcttagcggtggtggtgggtgtggcatttgccttagaacctttgcaatttggcgtgttatttttgatggtagcaagcccagcagctgccgcaagttatgtcatggcaaaggcgatgggcggtaatgatatactggcagcaaacattttagggtttacgacagtctttgggatgattggcatggcggtgggcatggcattgttaagggtgcttggctgggcttaa

SEQ ID NO: 419 - DNA, 1266 bp, M.catarrhalis
tatcgatggctcaatcttgaccgttggggaggcttaatcatgagtattgctaagaagttcatgagctgggtagatgcacgctatcctgccacagaaacttatgaataccatatgtccaaatactatgcaccaaaaaatttcaacttttggtatttttttggtgtcttgtcaatggtcgtcttggtgaaccaattggtaacaggtatttggttaaccatgatgtttaacccaagtgctgaaggcgcatttgcatcgcttgaatatatcatgcgtgatgttaaaggtggttggctaattcgctatatgcattcaacaggtgcatctgcattctttatcgttgtttatttgcatatgttccgtggtttattgtacggctcatataaaaaaccgcgtgagctggtttggctgatcggtatgggcatctacctatgcttgatggctgaaggcttttttggttatttactcccttggggtaatatgtcttattggggtgctcaggttatcttgaatttacctgctgccattccgtttatcggtgatgctttggctgaatgggttcgtggtgactatctgatctctggtatcactctaaaccgcttctttgccttgcatgttatcgccattcctttagttttggttggtttagtattcatgcacttagtggcattgcaccatgttggatcaaacaacccagatggtattgatatcaaaaaactcaaagacaaaaatggtgtaccgcttgatggcgttccattccatccatactatactgtgcatgacatggtcggtattgttgtcttctttatctgtttctttgctgttgtattttttgtacctgaggggggcggctacttcctagaaaagccaaactttgaggttgcaaatgcactaaaaacaccgccacacattgcacctgtatggtactatatgccattttatgccatcttgcgtgcagtacctcataaacttggtggtgttatcgctatgggtgctgctattgccgtattgtttgttctaccatggttagatcgctcaccagtacgctctattcgttataaaggcatgttatcaaaaattgcattagcaatctttgttgtcagctttgttactctaggctatctgggtggtacagcttcaaccccaactgcaacaattattggtcgtatttgtaccatactctacttcctatatttcttattgatgccattttatacatcgattgagaagtgtaaacaaccaccagaacgcgttaccggaggccactga

SEQ ID NO: 420 - DNA, 759 bp, M.catarrhalis
acaaccaccagaacgcgttaccggaggccactgatgaaagtacttaattcactgatcaaatttggtgcaggtgcggtattggcaacggttggtgcttttgccagtaccaacgccctagcctctggtggtcatggttgtggtgaatataccgaagctgatggtacggttgttaccttagaatgtagcaaagctccaattgatttaaccaacaaaggctcgctgcaacgcggtgctgccatgtttatgaattattgtgcaggttgccactcagcccaatatgtgcgtcattcaagattggctcaagatttaaacatcccacctgaattggttgaaaaatatttgcttgtcacaggtgatgccattggtgaccatattaatgcagggattgacccagaactacaaagccaatggtttggtgctgcaccgcctgatttgtctttagagactcgcctgcgtggtgatgactgggtctatacttatttactgtcattctatgaagacccaagccgtccttggggggctaataacctagtacttgcaaatgcagccatgcctcatgttcttcataatctacaagaagaacttggcaaagaagaatatgaagcgcgtgttggcgatttggtcaacttcatggcatggatggctgaacctgttcgccatgaccgtaagatttatggtgcttttgttattttattcttattaattttattaattccagtttatctgctcaataaagaattctggaaagatatcaaataa

SEQ ID NO: 421 - DNA, 207 bp, M.catarrhalis
tatactggcagcaaacattttagggtttacgacagtctttgggatgattggcatggcggtgggcatggcattgttaagggtgcttggctgggcttaacctctattatttttttgtgtatacaaactgcagcacaaacacaacaaatgattagtagtaaattttggctaaattgttattataagaataatccaatgaaagatggttaa

SEQ ID NO: 422 - DNA, 264 bp, M.catarrhalis
ccaagttcaaggtgcaaccgagctggatgccctggttgcttatttgcaacagttgggtattgcgatgcaaggtcaacgctaatgaattggggcgttttgcatagtattgcgaccgttgcggcgtttatcacctttatcggtatcgcatggtgggcttattccccaaaaaataaaaaacgctttgaagaagatgcacaacttgcgctggatgatcaggacatacaacgcctatcatcagataagcgcactaaggatatacaatga

SEQ ID NO: 423 - DNA, 969 bp, M.catarrhalis
cttaaggcaagctgtgcagttgtacgtcatggtaagcccaccaaagaatcactcatgaaaaatcttaagacccacgcacccatgacggttaacgaaaagttcattgcatggttgcaactgacacgctttgataaacctgttggcactgagctgttattacatcccacgctttgggcattatttttggtctatgcaggtaaaaatgcattaccaaatttttggtatattgtaatttttgccttgggagcggttttgatgcgtgctgctggctgtgccatcaatgattttgctgaccgaaaggtggatggacaagtcaaacgcacccatgcaagacctttggcagacggccggttatcaccaaaaacggcagtactcacttttattggcttatcattattggcggcgtgcttgctgttttttttacccaaatcagttttttattggtctttgggtgcggtattattggcatttgtttacccctttatgaagcgatttaccaatatgccgcagttggtgttggcagtggcatttggctgggcaattccgatggcatttgtcgctgtacagggcgtgcctgatctatggacttgggtgctatttattgcctatatgtgctggacggttgcttatgatactgagtacgccatgtgtgaccgagatgacgatcttaaaattggtgtaaaatcaaccgccatactctttggtagatatgatgtcacaattatcataggtttgaaccttatctttacggtgctgatgagtgtttcattttggcattattttgatgatttgcccaaatggctgtgcattatgacatttatgcctgtgcttgcgatgttttttcggcaatatcagcttatcgccaatcgtgaacgcttagcgtgctttatcgcctttaaagaaaatgtttgggtggggcggtatattttgaccatgacggtgattttttgtttgatttattttagataa

SEQ ID NO: 424 - DNA, 183 bp, M.catarrhalis
tcaaacgtgggatcattcaggcccccgggacaagtgattttatcccccggaacaatcaaggtcttacaggcaccagaaaattatgcggccaaagcagcgattgagtttgtcccgattgaatggttgattttggccctattgagaataaatcactcaataaagcctttgtatcatcaggtgtga

SEQ ID NO: 425 - DNA, 1962 bp, M.catarrhalis
caagtttttataaaattaaaattactgatttggcctattaagcaagtctattggaaacaatccatgaatgcaatctcttatactcatcccaaaacatttgatgtcatcgtcatcggcggtggtcatgcaggcacagaagcatgccttgccgccgctcgcatgggtgctaataccctacttatcacgcataacattgagacgctcggacagatgagctgtaatcctgccattggcggtattggcaaatcgcatttggtgcgtgaggtggatgcacttggtggggcgatggcattggcaaccgataaggcaggcattcagtttcgggtgctaaacagccgtaaaggggcagcagtgcgagccacacgcgcccaagctgaccgtattttgtacaaggcagccattcgccacacgcttgaaaaccagccaaacctgacaatttttcagcaatctgtggatgacatcattgttgaaaatactcgtgcggtggcggtggtaacagccacaggcattcgtctaaatactcgtgcggtggtgctgacatcagggacatttttgggcggggtgattcatgtgggcttagaccatcaaagtggtggcagagcaggcgacatgcccgccattcgtcttgctgaccgtttgcgtgaattaaaactgcctgttggacgcctaaaaacaggcacgcctgctcgcattgatgctcgtacggtggatttctccgtgatgaccgtgcagtcaggcgatacacctttgcctgtcatgagttatatgggtgatgttgccatgcacccacgccaaatcaactgttatatcacccacaccaacgaacgcacgcatgagattatccgtgccaatcttgaccgctcccccatgtttagtggtaagattgagggggttgggccacgctattgcccgagtattgaagataagattcatcgttttgctgacaaagacagccatcagatttttattgaacctgaggggctaacaacccatgaattgtatcccaatggcatctcaacaagcctgccttttgatgttcagcttgaattcatccatagcatgaaagggcttgaaaacgcccacattacccgtccaggttatgccattgaatacgactattttgacccacaaaatctaaaaccgactttagagactaaatctattgatgccttgtattttgcagggcaaatcaatggcacaacaggctatgaagaggcagcagcacaggggttattggcaggtcttaatgccgcacgcatggcacttgatgagccatcatgggtaccacaaagacacgaggcttatctgggtgtgcttgttgatgacttgattacccatggcaccaaagagccataccgtatgttcacaagccgtgccgagcatcgcctgattttgcgtgaggataatgctgatgcacgcttgaccgccatcggacgagagcttgggttggtggacgatgaacgctgggcgagatttagtcaaaaaatggagtctattgccagcgaaaccgcccgcctaaaagacatttgggcgaccccaaacaatgccattggtcaagattttatggcaaacacaggtgagattttgaccaaagagaattcgttactggatttattaaaacgcccaaatatcacctttgacgacattgccaaagtgtcagacagtacagtgagtgctaaggtgggtgaacagattgagataagtgttaaatatcaaggttatattgagcgtcaaaatgatgagattgagcaaatgaaacgccttgaaaatacgctcttaccgcttgattttgactataaaagtgtgtctggtttatccaatgagattgtccaaaaattaagccaaatccgtccgacaacgcttgggcaggcaagtcgcatcagtggcgtcacccctgcggcggtcagtcttttggcgatgacgataaagaaacttaaaaaaacgcaagcagtgatgacatga

SEQ ID NO: 426 - DNA, 2304 bp, M.catarrhalis
gttaagcttatggcggtttggttatttgtttttgttgccttggctgtgcttgccatcttgggcagtattgagcaattttggcttgatgagacatggcttagtattttagcttcagatcaatgtatcttactgataactgcaggtttattgttgtgtttgcttggatggtcactgatacctacatctaaattagccaaaatcaatcgcttgctcaaagcgtgtctacttgttgcaagtattgttttgttatttgtggtgcgtacattggtcgcatatgttacttatgagatacatacgccaaacgctcgctacatggtcagtgctgacgctcatattcatactctgagtgatgggatttatgatgatatcttgggtacttcatttcgccaagtggcgactttacataatattaaacctattattccttctgctcatcacccctcaactttaaagattcataatccctttggggaatttaatcccaacccttcaataatgccaactcaagaggatttagacaaattaaaattaatggagggtatgacggtacttttgtcagccaatccaaatgccactcaagccgatttgagtaaacttgctaaggttcagcctgccatgcgtttgactgccgagattttgattacaccgattgataaaacgccatcggcaagtggttttgataccaatcaatggctacgcactcgccatattcatgctcaagcaaaaattttgtctgttggtgagattgcaccgcttgaggcagaatctttggctcagcggttttattttcgtcttgagcaatttcgtcatcggctcagaacgcatttttatcaagattggcataagcttagtgcatcgcaatcacaggcaccagcggtttctctgagcttgatgacaggtgatcgtgctttgattgataaacacaccaaagaactgtatcaattggcaggtatttcgcatttgcttgccatttcagggacgcatgtgctatttttagcggtgattttatcagcacttgtaacttttatgacggataaatttgcacaacacatttatgcacatttgccaagatggcaaattcgtatgatggtcatggtgttggcaagtttggtttatgcgttgtttacagggtttgatgtgcctgcggtgcgaactgtttatttattaattgcagcttggctggttcgctacttaatactgcccactggcatgatttctgtgctggcgtgggtagccttgttgatgatttggcttgacccttatgtgttatggcaagcaggattttggttgtcatttattgccgtgttgttattgatgcgttatgagtccaaaatcaatatgataaatgagaccaatcaaaatcaggggcaacttgtacggcgatggcttcaattcaaacaggcagtgcgtttgcaattttggctattttttagcatgctacctgtgtctatcttattatttggcaaggtatcaatctggggtttggtggtaaatttatttgccatcggattgtttggttttgttgttgtacccattaacttcctcgcagccgcagtttttgggattttgccagagctgtcgcagctactttggggcacatcttctgctgtactttattggctgcatgattttttatattttggactaagtagccaaattggtagtttgggtgcttggctatatgcaccttttgggatggcaggatttttactcagttttatggtagtgggcttatggatattgccaaatgtcttacctagggtactgattatactacctttggtggcgatgatatttttgggattgcccaagcaaataccgcattttaagctgattattttgccaagtgatacgcctaatatcagtcagatgttgcttagttatcacaatgccaatcaacaaaaacactggcttatcttaaatgatttgggtgccaagagcttaagagcaaatcatacccaaacgctgacagatcagctgtatcgactgggagcggcacaatatggcatagatggtatcattgtccaaagcccaagtgccatatttttgcctgtggtgggtcagcttgctaaagcattgcctgtgcatcgcttttggcaggcgggtaatcatgagcctttggcaaatattcatcacacaccatgtcgtgcaggtttatattggcaatctgaaggcattggtataaaagctttgacgggttggcatgagattggtgatgaacgtgtacagcactgcgaatatgaaggtttgccagatttgccactaaatacccaaaatttgattgaagataggtttacgccttaa

SEQ ID NO: 427 - DNA, 396 bp, M.catarrhalis
ggagacattatggaacgcaattacggcactggtcgccgcaaaacttctaccgctcgtgtcttcttgtcaaaaggcacaggtaacattgttgttaatggcaaatcattggacgaatattttggtcgtgaaacttcacgcatggttgttcgtcagcctctagagctacttgagcttactgacagcgtcgatctttatatcactgttgttggcggtggtatcaatggtcaagcaggtgcaatccgtcacggtattactcgtgcattgattgaatctgatgaaagccacaagcctgcacttaaagcagctggctttgtaactcgtgatgctcgtgaagttgagcgtaaaaaattgggtctacgcaaagctcgtaaacgcccacaattttcaaaacgctag

SEQ ID NO: 428 - DNA, 399 bp, M.catarrhalis
ggaatgattatgaccccaaaacgcccttatatcgtacgcgcttttcatgaatggatagaggataacgattttaccccctatctgatgattgatgcgacacatgacgatgttgttgcaccgcttgagtatgcccaagatggtcgcttggtgctagccgcttcttatcaagccacgcacaatctacaaattcataatgatgccattagttttactgccagatttggcggtgtctcttctgatatttggatacccatggcagccttgatggcaatatatgccaaagaagaccccaagcatggtgcattttttgatcctggcgaatatgccaatcatcaatcgcccaaaaccgatgaagatcgaccaactttaaaaggctcaacgctcagagtattggactag

SEQ ID NO: 429 - DNA, 846 bp, M.catarrhalis
ttgatggatattttgctgattatcaaagcgatcataatgggcgtggtggaaggcattgctgaatttttgcccatttcaagcacaggatatctgattttgtctgcagatatcatgaattttttaagtggtgaatttcgcaatttattcattgtatttattcaattgggtgcaatcttggcggtcatttatgattattggggcaggctttggggtgcgttcataggattgataacggggcattcaccagatcttaccaagccaagacagcttggcttttctttgatgattgcaagtttgcctgtggttgtggttggttttacgatggcggattttatcaccaatgcactgtttcatcctttggtggtggcaactatgctcattttaggtgcattgattatcatttatgctgaaaaaaaccctcgtccaatccacgcaccagaagctgaaaatatcagctttaaaacagcacttggtattggtctgtgtcagtgcttggccttaattccagggacgagtcgttcaggttcgacgattatcggagcgctgcttttggggacatctcgcaaggcggcgacggagttttcttttttcttaggcattcctgtaattattggtgctgcattgcttgatttaattaagcattttgatgcaatacagaccttaactgattggctgatcttgctgattgggacgggggtgtcttttgttatcgcacttttgtgcattcgattgatggtggcttgggtgagccaaaaagactttatgatttttgcttggttgcgaattgcgacaggtgttttggtgttgattgcattttttgggtttaattatcaaatccaagcttga

SEQ ID NO: 430 - DNA, 510 bp, M.catarrhalis
gagttaatcatgactatagatcggcgtatcgtgattgacacccaatcacagtgcttaactttgtatcaaggtaatattttgttgcgtcaatttgccgtttcaaccgcaaaaaacggcacaggtcagctagagggtacaggttgcacaccacttggtgaacatgtcatcggtcaaaagattggcggtggcttgcctcccaatgccgtgtttgttgcaaggcaatttactggcgagctttatgatgtacagttgggtcaaaatttccctaatcgagattggatacttgggcggatattgtggcttgaaggtcaaatcaatggctataatcatggcgtggataagacaggggcattggttgatactaagttacggtatatctatattcacggaacgcccgacacagagcctatgggtcggccgatgtcacacggctgtgtcagaatgcgtattgatgagattgtttggttatttgataaggttgaggttggagatttggtactgattcaatga

SEQ ID NO: 431 - DNA, 1077 bp, M.catarrhalis
ggatatacaatgagctttttttggagttcttggattaccatcttatcattgggctgctggctattcatctttggtgttctggtatggaccttacgatctagaccagttcttgaagaagatgagaccacaggtcactcatatgatggcattcgagaatatgataaaccgctgccaaaatggtggttggtgattttctttggtacgatgatttggggcttgggttattttatcctttttccatcaattcagccaaatacatggaaaggcgtgacaaccgttgaggtggatggtgagtctgtaccttggacttctgccaatgaactaaacagccagcttcaagctaacaaccgtgtatttactgaaaattttgagcaaaatattttggaaaatgcaggtgcaagtgaggcaactgttgtccttgctaaactaaatgaccttcaatcacagcgtaaagctggcgaagaaaatgccgaactacaaacacagattgatgaacaagtcaaactgctggcaccttatgttgataagctggcatcagatccagaagcacaaaaaatcggtaaccgtttatttttacaaaactgtgctttatgccatggatctaatgcaagaggtgcacttggttatcctgatttgacagataatgattggttgtatggtggcaacgctgaccaaatcctactgacaattcataatggtcgtgttggttcaatggcagcatggcaacaacaactgggtgaatctggtgtccgtgccgcagcggaatatgtgcttcagctttctggtaatcaaaatgactatgagcttgatgctgctaaagttgcacaaggtaaagtattgtttgaggcaaattgtgtggtctgccatggtccagatgccaaaggcagcgctgccattggtgcaccaaatctaacggatgatatttggctatttggtggtgatcgtgatgccgtccaaacttccattcgccatggtcgtgctggtgtgatgccagaatggcaaaccaaattgggcaatgaacgcattatgctgctggcagcttatgtacgctcactatcacaaactgccgctgaataa

SEQ ID NO: 432 - DNA, 726 bp, M.catarrhalis
agttttaccttggcaagtggttggtatatgagcaagatagtcaaaccaaccaaaactctcatcgctgaacgatttcgtggatttttgccagtcgtgattgatgtggagactgctggatttaatgctgccaccgatgcattgcttgaaattgcttgtgtgccgattttgatggataatgatgggaatctttatcaaggtgagccattaaatgcacacattgagccatttgatggtgccaatcttgagccagctgctctaaaattcactggcattaatcctgatagcccctttagaaaagccatcagcgaagatgaaaaaaccgccttgcgtcgtatttttaaagcattaaaagccctaaaaaaagaacatggttgccgtcagtgtattttggttgggcataatgcacattttgatttgggatttttaaatgctgccattgcacgaaccaatagcaaaaaccattcaccctttcatacttttagtgtattagatacggtgagttttgctgcattgacttatggtcataccgttttggcaaaaacttgtatgattgctgggcttgaatttgataatcaacatgcacattcagcactatacgatgcccaaaaaactgctgaactgttttgccatattgtcaatcaaaatacacttttatcaaccaatcatgccaatttaactcaaaatgacacgccaaccaactctcatcagacgccatcactgacttga

SEQ ID NO: 433 - DNA, 204 bp, M.catarrhalis
gtttacgccttaaatttggggaagactggtaccgccacttcaaatcaaaccacagttatcatcagtaccaatcgggagcccatgctttggcagctatgggaaatgctgtggctttctgacgaagaattaaagttggggacacctgtaggctaccattccggtgggcttacccccacacacgccggttgtgcccaccatggttaa

SEQ ID NO: 434 - DNA, 1338 bp, M.catarrhalis
gtgattgcgataggagctactatgtacgctgaagatacaaaaaatattgtagaaattaaagacattattgctcgagagattttggattctcgtggcaacccaaccattgaagcagatgttatccttgcaaatggtattcgtggtcgtgcagctgcacccagtggggcatcaacaggctctcgtgaagcgttagaattgcgtgatggtgacacttcccgttatttgggtaaaggcgtcaaaaaggcagtggcgaacgccaatagccaaatccgcaccgtactgcttgataaagatgttacacaacaaactcagattgataatatcttaattgagcttgacggtacagaaaataaaggtaatatgggtgcaaatgctatgttggcagtatcgttggcggtagccaaagcagcggccattgctcaatcattgcccctgcatcaatatattgccaatctgcgtggacaaaccagcttaaccatgcctgtgccgatgatgaatattttaaatggtggcgcacatgctgataataccgttgatatccaagaattcatgattgagcctgtgggatttgcttcattttcagaggcactgcgtgcaggtaccgaaattttccatgcattaaaatcagttctaaaagcacaaggtttaaatacggctgttggtgatgaaggcggttttgcgcccaacttacgctcaaacgaagaggcaattactgtcatcatgcaagcgattgataaagctggctataaggcaggtgaaaatatctttttagccttagattgtgcagcatctgaattttataaaaatggtcaatacatcttggcaggtgagggcaataaagcctttgatagccaaggttttagcgattatttaaccagcttatgcaaccaatatccgatcatctctatcgaagatggtttggatgaaagcgattgggaaggctgggcatatttaaccaaacagttgggtaaaaaggttcaattggtaggagatgatttgtttgtcaccaatccaaagatcttgcaagaaggtattgataaagacattgctaatgccattttgatcaaatttaaccaaattggcactttaagcgaaactttagatgcgatctatctggccaaacaaaatggctatgccactgtcatcagccatcgctcgggtgaaactgaagattcaaccattgctgatttggcagttggtacggcagcaggtcagattaagacaggttcactgtgccgttcagaccgtgttgccaagtacaatcagcttttacgcatcgagcagcaagtgcgtgccgcttatcgtggtcgtgaagaatttatcggtctgcgtggctga

SEQ ID NO: 435 - DNA, 873 bp, M.catarrhalis
ggatttgagatgacacagccaatgatagccgctcaatcaaacattaccgtatcagggattgagattggtaatgataagccttttgttctatttggcggtatgaatgtgcttgaaagccgtgaattggcttttgagattgctgagcaatatatcgatatttgccaaaggcttaatatcggttatgtgttcaaggcaagttttgacaaagcaaatcgctcaagcttgcactcttttcgtggtccaagccttgagaatggcttgacttggctaaatgacattaaagaagcttacaatgtccccattattaccgatgtgcatgaaccttatcaggctgcacctgttgccaaagttgccgatatcctacaattacctgcttttttgtcccgccagacggatttggtgagtgccattgcacgcactggcaagataattaatgtcaaaaaagcacagtttttggcaccacatgaaatgcgtcatatcattaataaatgtttggaagctggtaatgatcaagtgattctttgtgagcgtggttcggcatttggttataataatttggttgttgatatgcttggctttgataccatgaagtcaatgaatgtaccagtattttttgatgttacgcacgcacttcaagagccgggtgctcgtggtgacagtgcaggtggcagacgccatcagattaccactcttgctcgtgcgggtatggcgacaggcttggcgggtttatttttagaagctcatcctgatcctgataaggcgaaatgtgatggcccaagtgcattacgcctaaatcaacttgagccatttttgatacaaattaagcagcttgatgatttggtcaaaggctttgaaactttagatacacaataa

SEQ ID NO: 436 - DNA, 825 bp, M.catarrhalis
agagcgattgtgcgattatcattgatttatgacaagccaaataccgtagtagatgagcttttgtctatctgtcaggcgtatgatttgccacttgactgggcagtacaccggcacaataagctcaatgataagcaaattttacagttgaaacaaactggcgatacacccatcatcgccatcttaaaaaacacaccaacattaatcaaagtcgaagacaaaacaatcatcaaatctacactaaattggtcagcacttcagcatcgcattgtgacagcagggcgtaaatcagagctaattttgcaggcatgtaaacctcaagcaggtatgacggtactagatggcacagcaggttttggtcatgatgccctaattttggcaagtagtggcgctcatgtgactttgtgcgagagcaatcctgtgatggcattactactctattatgaatatcaggcaatggttcaagtggcaaattggcaaggacttttgggtcgtatggatattatttacaaagataccagtgagatgacaggggaatttgactgtgtgtatttagatccgatgtttcccaaagatagctataaagccaaggtaaataagcagatgcaagcgttgcatgaattggcagcaccaccaacacaatcagaagcacaccagattttttgtcggtcgatgaacatgattaaaccaaatggcagactgattatcaaaagaccaatcggcgcaccatattttgttcaacaaccaccaaatcacagcattcaaaacgacgcattaagatttgatcgctatgataaaaacggatactcagccttacatctggggtaa

SEQ ID NO: 437 - DNA, 189 bp, M.catarrhalis
ttcaaactggtgggtcttcacatggccggtatgttgtgcgtgcattggggggtgctttatatgtgggtggtatgtttgtcatggcttataattggctatcgcaccatcaaaatgccaagcgtgcctgaacatatcgcagagccaaaagaggtaaatactggcagtgaacaagcacgggcacaggcttaa

SEQ ID NO: 438 - DNA, 1008 bp, M.catarrhalis
tcgcaccaattgattaaagcaccacctaaaggtagttgtatgaatttacaaaaagttgacctaaatttattattttatttagatgtcttattacgagaaaaaaatgtcactcgtgcagctgaacagcttggcatcacgcagcctgcaatgagcaatattctacgccgactacgctcattatttaatgacccacttttggtgcgttcatctgagggcatgacaccaactgaacgagcttttgagttacagccacgcattcgtgaggtattgttagacatcacaacattacttgagccacgcaccgagtttcgtccatatagtacttctcgagtgtttcgcattatgaccagtgattatgcagaagcaacactggtacctcgtttggtgaaagcgctgcgtagcgaagcacctaatgttatcttggattttttgacgccatcagatgtctcttatcgagacatggagcaagggcgggtggatttggcgattaatcgctttaatgagataccacaaagctttcatcaagttttggtttggagagatacattcagctgccttttatcggcagacagttcctatgccaatcgttttaatttaaaaaattacctaaaagcacaccatatttgggtatcaaagacaggtatgggcgtgggatttggtgtcaatcctgaaaagtcaggtggtcttggctccattgaccaagcactccaaagacttggtcaaaagcggcaaatcagtgtatttactaggcattatcagatgcctgcaatgcttgttgcgaataaagatttaattgcaacactgcccacacgagtcgctcgcttacaagcagataatcatcctaatattatcatcaaagaaccgccattttttattcccgagtttgagctgaccatggcatggtcaccgcttcttcagcatcatcctgctcatcgctggttacgccagttaatcttgcatgtcgcacgacaagtcattgctgaagaaaatcaagtcatcaaagcatag

SEQ ID NO: 439 - DNA, 672 bp, M.catarrhalis
agcaaaaattctgatacactaagaggctcatttatatcatcgctacacatggcaaatttacctcatctttctttaacacaatttattctttatgccgatcatggaattaatagccatatcgtacggctattgcttgaagaaaaacacttaaattatgaaactgtgttcattggtgaggagcgccctgaagagctgattgagctaaatccttattataccctgcccatattggtcaatcgagacatttcactatatgaacataatgtcatctttgagtatcttgaagaacgccaccgagtcccacggctgatgcctgatgcaccaagtgagcgagccaaagtgcgtcaactggcgtggcgactacaaaaagactggctaaagcacggctatactctactgacccattctgacagctttgatattcaggctgcgacagccgccagaaagtcattaagcgattcactggtaacaatcgcaccgctgtttgggcataaaccgtattttatgtcggatacttttggatggtgtgatgtgttattactgccactactttggcgactaaataaaatgggcgttcatcttccgacacatctcatacgcccgttaatacactatcaagaacagcaatttgccagaccaagctttattaatagtatttcttttaaggaatga

SEQ ID NO: 440 - DNA, 1521 bp, M.catarrhalis
tggccatcatcacgatcaccaaaccaagcagggggaataatcatgaatccgatgatttttgaatctattttatcaatactgcctgctgtgatcgtggcactcactgcactcatcgtgatgattaccattgctgtcaagcgttctcatttttgggcagcaacactcagcgtcgtgggtctaaatatggcgttgctggcagttatttcccaagccttaggcttagtgcctgcaggcgtatcttttggtgaattgtttatctttgatggttttgcaattttcaatatgggcgtaattttgattgcagcattggcttgctgtacattagcatacggctattttgagaccttacaagatcataaagatgaactgtatttgattatgctaatctctacgctaggggcaatgctaatgacaggtgcagcgcatttggcagcattttttatgtcgcttgagctgttgtctgtaccgatgtatggtatgttagcatacaccttcttgcgttctcgatcacttgagtcgggtttaaaataccttatcatgtccgccaccgcctctgctaccttgctgatgggcatggcgttgatttttgctgatgcaggtactttattattcaaagatttggcaagaaatcttttgattggtaatttgtcaggcttaagtgtggctggggtggtcatgatgttggcagctgcagcatttaaattatcagcagcaccatttcattcatgggtgtcagatgtctatgaaggtgcaccagcaccaatcgctgcttttttagcaagtgtgagtaaagtggcaatgatggcacttgcacttagattctttgtgggtagtatgtttactgccatgccagcttttgagacgattttgattgttgtcattgttttgtctattttaatgggtaacttgcttgcaatccgccaaaataacattaagcgtatgcttgcttattcttcgattgcacatattggctatgcattgacagcacttttatcaatcggtgcaggtagcttgcctttggtgagtatgtatatggcagtttatgcactgacatctattggagcgtttggggtgatcacactgatgtcaagcccatatcgtgagcgtggacgcacttctatcagtggcgaagctgatgacctgcgtttttatcaagggttattttggcgtcgtcccgttctaacggcggtactgactgtgatgctactatcattggcaggtattcctctgacggcaggatttgttaccaaatttaccatattctttgcggctgtacaaggcatgcacttcttggcggctggtatgattattttgggtagtgccatcggtttgtattattatttgcgtattttggtcaatctgtaccaaaaacccaaagtcaatcttgagtttgatgcacatcaacattggggcgttaaggcaggcggagtcatggcgatgattatcaccgcacttatcgttatctttggcgtactaccagaagcaatgatgcaaatggctgcccgagcagtgatgttgtaa

SEQ ID NO: 441 - DNA, 228 bp, M.catarrhalis
tggtcaggattgtttcttttcttaacaccaaaaatcaggcaaatgattactgaacccatgaatacaaaattattagaaacaattgctgctatcataaaaattatggcaagcatggcaaacatccaatcaattttatacccttttattatcatgagcaccccttatcacttaaaaatcacccataccaacaaacactgtcaatcaattggcggtgctattatgagttaa

SEQ ID NO: 442 - DNA, 183 bp, M.catarrhalis
tcggttaaatccattcaaatctcctcattgtcatcacaaatcacccaaacttgccaaaatagttatttaccacacccgtatctcatagagcttatgggctatagtactgacaagttacatacttattgtatactaatgatatacttgacattttaccagttacttttatgtcaattcatttaa

SEQ ID NO: 443 - DNA, 651 bp, M.catarrhalis
tgtgcggagtttgttgccatgattgatgtgttaaaggcgtttttggcaaatggcagtgtggtgggtttttatgtcttatcgctggtggcaatttgggcaagcctaagggtggtaacgcacgccaatgctgtgcatgccattttatccatgattgtatcattattagctgtggcgggtattttctttatcttaggtgctccatttgcaggcattcttgaaatcattgtctatgctggggcgattttggtgttatttgtgtttgtcatcatgatgctaaatctaggcacagataccacagaagaaaaaacatggcttaccgccaatgcgtgggcgatgcctgtgtgtctgatgatgattgttggggcggtgctgattggttttattggctatggcacagaccaatccatacagctacaaagcgataccatctctgccaaagatgtgggtgtacgcttatttacagggtatgtgttgcttgtggaggtggcggcatttttgcttttgggggcattggttgcggcatatcatttgggtaaaaaagcacttgatgatgaaaacatcagccacagcctaacatgccctgatgtcacctctaatacatgggcaaatcaagacaaagagcaacaggagagagccgatgcaaaattataa

SEQ ID NO: 444 - DNA, 831 bp, M.catarrhalis
ttaaccaatacttatcaagggcaaatcatgtatacagacagtcatgcacatttgacttatctaaagcttgaccattatgataacagacctgaaaatctgctcaaagccatgtaccaagcaggcgtgaggcgtaccatggcaatcatgtgccagttgtctgaatatgacgatattcacgcttgggttgagatgtcagcagataccatgcctgatattggtatgagtgtcggtgttcacccttgccaagatgaacatacgctggctgccatcagtcctgacgaactgctaaagcgtgatcatgaaaaagtttgggcatttggtgagacggggctggattattattgggataaggataaatcatctgcccaaaaacacagttttgctgcacacattgacgcagcaaagaccgctaaaaagcccattattgtacatactcgcagcgcttatcaggatactttagaggtgctgacagctgagcggtgcgaacatggcattattcattgctttaccgaagattatgcctttgccaagcgtgcattggatatggggctgtatatttcattttcgggcattttaagctttaataaatcacaagacctaagagaggtcgctgccaaattgcctttagatagggtgcttattgagaccgatagcccatatttggcacctgttcctaagcgtggccgtgataatgaaccaacctttgtgccatatgtggcagaagctttggcaaagatttatcaaaaatctgccgaagagattggccacatcaccagtcacaattttatcactttggtcaatcaatataaacctattatctcacgcttatga

SEQ ID NO: 445 - DNA, 636 bp, M.catarrhalis
atggatttaaccgattatcgacaatcctatgaaaaatacagtttggctgatacaggattgccaagcaatccattgactttgtttcgtgcttggtttgatgaggcggtcgctgccaaattgcctgaaccgtatgcgatgagcttggcaacttgtggcggtgataatcgccccagcgttcgtattgtgttgatgcgtgagctcaccgagcaaggtgtggtattttataccaattatgacagtgccaaaggtcaggatattgctgacaatcctaatgctgaagtgttatttttttggcacagtcttgagcgtcaggttcgtttaagtgggcaaatggttaaagtttcggccgaaaaatcagcagcttattttgccaagcgtccacgagaaagccagctgggtgcttgggtgagccaaccacaaagcggcgttgttgataatcgccaaacgatggaagaaaaattcttggcactagagcggcagcatactcaaaatgtgccttatccaagtttttggggcggttatgagctaatcatcgaccatgccgaattttggcaaggtcgtcttgggcgtatgcatgatcgtatggcatacaccaaacaaggtgatgagtggcaaatcatgcgtcttttaccgtag

SEQ ID NO: 446 - DNA, 780 bp, M.catarrhalis
atgtcactaacgcccaaatccatcgccttattacccaaatacccagcaatcatcgcactgtttctgatgattgcgatgattgcaagtatgtttgttcttcaatatacttggttgttattgcttagcggtattaatgagctgctcaatccatcttttattgccaaaaatacgctgacaatcatgtcattgatattaaccgctgtcagcttggtatggattattgtgatttggcaatatctgcgtatcaaaactatgggtcatacgaccaaaacaaccatcttaatatggcaatgttattttggctttcatgccatgaattcaaaggcattttttaaagctttggcggttttattggttggtatcatcttatcaagtgggtttgttgccatactaagcgattggctaaaacccatgccatcaattgatgtcaaaagtttggttgatgacagcacgcccatgtggttatttgcactgttggttctgatttgtgccccaatctatgaagagctgatttgtcgtgggctattttggcgattgggtgaggatatttttagcccctttttcacccaagagcgacacacaaatatcgctgttagcttattatccagcggtattttttcttttttgcattttcaatacaactatattgaccttgtgatgatggcgacactgtcattaatactttgctatacacggctgtctacacaatcaatttttgcaccgatgctacttcacagtatcaacaatagcttagtgctgcttttgatgattttttcataa

SEQ ID NO: 447 - DNA, 549 bp, M.catarrhalis
atgtttgcaactttaaaaaatacggcggtgggcatgtttaccattgtacgctccatgtggatggtcaacagccacgccctaagacccagagacacgattttataccctgaacagcccgtgcctgtaccgccccgttttcgtggtcgcattgtgctgacccgagaccctgatggtgatgaacgctgtgtggcgtgtaacttgtgtgcggtggcttgccctgtgggttgtattagcctacaaaaggcagagcgagaagatgggcgttggtatcctgagttttttcgcatcaattttagtcgctgtgtgttttgtggcatgtgtgaagaggcatgcccaaccaccgccattcagctcacccctgattttgagcttggtgaatatgaccgccaaaatctggtgtatgaaaaagaacatttgctcatcagtggtgtgggtaaatacccagaatacaactattatagagtaacaggcatggcaacggacgataaacccaaagggtcgcacgagcgtgaagcagagcctgttaatgtgcggagtttgttgccatga

SEQ ID NO: 448 - DNA, 186 bp, M.catarrhalis
ggagtttttgcgaccccagttggcaaggttgtgcgtcaaatcggacaatctgcccaaaaaaacatttttatccacctcggcttgggtgatatcgtcaatgatttcacggctttgttgtgggtattgcttggtatgttggtttggtttggtgagcgtatatttcatcgtcttaatcttgctggttaa

SEQ ID NO: 449 - DNA, 648 bp, M.catarrhalis
tatccccattttataaaattgagatcacatggggtgattatgccagccgaatggtcagccattgtctatttacttgccagtttagggcttgtcgtctttatgcttgtcgtgccacgcctattgggtgggcgttcaagcggttctcaaaaacaagaaaactttgaagcaggcgtggtttcagcagggacggctcgcattcgtttgtctgccaaattttaccttgtggcgattttctttgtgatatttgacttagaggccttgtacttgtatgcctatgcggtgagtgtgcgtgaagtaggctgggcagggtttgccagtgcttttgtttttattgccattttatttgtggggcttgtctatgaaatgcgtcttggtgcgatgaactgggcgcctgccgataaacgcattaagaaaaaacgcattctaagccgtcctgctgactttgatttgactgccattaccgcttttcatggtattgatgaactgcacaccgaccccacaggaaaagtccctgcccagtcatcagggcggatttttgcagggcgtaaaggcttacaagcggtgcttgacaaggacagcgaacagatgacaaacattgaccacattaataccacaggccaggtaaccacccaagattttaactcataa

SEQ ID NO: 450 - DNA, 1359 bp, M.catarrhalis
atgatgagttattttggcaccgatggtattcgtggacaatttggagtttttccaatcacacctgattttttattacgcttaggttttggtgcaggtcaggttttaatgcgtcaatcgctcaataaacgcccaagcgtcttgattggcaaagatacccgattgtcaggctatgtcatcgaggcggcattgcaggcaggatttaacgcagcaggcgttgatgtgcatatgcttggaccactgccgacgcctgcaattgctcatttggtgaaaagctttcatgcggatatgggcgtggtcatttcagcatcgcataatccatatcaagataacggcgtaaaattttttaatcatgagggcaaaaaaatctctgatgagatgcaaaatgccatcaatgatcaattaaccgctttggttgatgatacaaatgccagtttggctcgcctagagggcattaaagctgacgctattggtaaaaatcaccgtatcgccgatgccaatggtagatatattgagtattgcaagggaagttttccgtatcatctaaatttatccaatcttaaaattgtgattgattgtgccaatggtgcaggctatagtgttgctcccagagtacttcaagaattaggtgcacaagtcattgcaattcataacacaccaaatggcattaatatcaatgacaactgtggttcaactcatcctaatattattcaggcggcagtgcgtgagtatggtgcagatgttggcattgccctagatggtgatggcgatcgcattattatggcagacaatcaaggaaacattattgatggtgatgggattttatacattcttgccaaacaccttaagcctgtaggcgtggtaggaacgctgatgagtaatgtcgcacttgagctggcgttggctaatcaagggattggattttaccgagctcaggttggcgatcgttatgttatgcaagcactccaagagcgaggctggagtatcggcggcgagccatcgggtcatattttatgcttggataaaagccgtactggagatgcgattgtggcaggtttgcaggtgctaagctgcatagcagaaacaggcaaatctttaagagagttggttttggattatacgccttttccccaaacgctcattaatgtgcgcttaactcaaatgagcaacccttatgataacgatgagctaaatactatctttaaaaacgcagaagaacagctgtctgaccagggtcggttgctgattcgtcaatcaggtaccgaacctgtcatccgtgtgatggttgagcatcaaaatcaggcggtatgccaagaggttgcccaaaaattagcggcagaagttcggcgtgttttggcttaa

SEQ ID NO: 451 - DNA, 987 bp, M.catarrhalis
acctattatctcacgcttatgatgacaaataaacgcatcagccttgccccaatgattgattataccaccatggattttcgggcatttgcaaggctttttaacccaaatatccatctttatactgaaatgattagcaccagtgccatcttaaaaggtgatgccaagcatcatcttcggtgtcatccgaccgagtcgcctgttgtgttgcagttgggtggctcaaatccagacgagatggctaaagcggttcgtgtaaccgaagcacttggttttggatattgtgaatataatatcaatgtcggttgcccctcagatagggtgcagcacaataaaatcggtgcatgtttaatggcagaaccgcaagtcgtggctgatatggtgcgtgccatgaaaaatgaaaccgacaaaccgattaccgttaagcatcgcattggtattgatgactgtgatagctatgaatttatgcgtgattttgtgcagacggtggcagaggcaggttgcacgcattttattacccatgctcgcattgcttggcttcaaggattatcacccaaacaaaaccgagaaattccgccattaagatatgaagaggtttatcggctgaaacaagatttccccgatttgaccatcgagattaacggtggcattagccatttggatgatattaagacgcagttggcaaaggtcgatggcgtgatgattgggcgagcattttatcacaatccgtatttgatggcagagtgtcatcttttatggggcagtcagccacccagtcatcgccaaatttttgaaaatttaatcagctatctaaaaaagcgtgctgatgaaggtgtgaatcttgcggtattgacacgccattatttggggttatttcaaggcatggcaggcgcgagacgctggcgtcaagatctaagcggtaagtctgttttgacggtcgatgagatttatcagtcaggcgatcgagttttatcccaaaatggtcaatag

SEQ ID NO: 452 - DNA, 192 bp, M.catarrhalis
attggggcacaaatcagaaccaacagtgcaaataaccacatgggcgtgctgtcatcaaccaaacttttgacatcaattgatggcatgggttttagccaatcgcttagtatggcaacaaacccacttgataagatgataccaaccaataaaaccgccaaagctttaaaaaatgcctttgaattcatggcatga

SEQ ID NO: 453 - DNA, 1740 bp, M.catarrhalis
tggtggtgtaacatggcattagaacaaaattggatactaccagcattgatcgcaattccattgattgcaggctttttatgctggttaattgaaaaaatcagcgatcgcctgccacgctggattgcactgattggcatggtcattacttttattttgaccttagtgctttggcaacaagggaattttaatacgctactggtaacagatacagcggtcagcggtgagacattgccttgggcggcacagtttatcctgccatggattccaagttttggcattaaatttcatttagcgatggatggcttgtctttactgatgattgcgttgacggcatttttgggtattatggcggtgggctgctcatggggcgaaattcagcgccgtgtgggattttttcatcttaatctgctgtggtcactaggcggcgtgatcggcgtatttttagccattgatttgtttttgtttttctttttttgggaattgatgctgttgccgatttattttttgattgcactttggggacataatgccacagggggtaagagcaaagaatacgcagcaaccaagttctttatttatacacaagcctcaggcttgatcatgttaattggcattttattattagtcattattcagtttagccaaacaggtgttttaagttttgattatcatgatctcttaggggtaaatcttggtgattgggaatatgccatcatgctttgcttttttattggttttgcagttaagctgccaatatttcccttgcatggttggctgcctgatgcccacgcccaagcaccaacggcaggttcggtagatttggcggggattttgattaagacggcggcatttggcttgttgcgttttgtcattccattatttccaaatgcctcggcacaatttgccccagtggcgataactttgggcatgattggcgtattttatggggcatttttggcatttgcccaaaccgatatcaagcgactgctcgcttataccagtgtgtcgcatatgggttttgtcgtgcttgccatttatgctggcacacttgtatcgttacaaggtttgatggtgcaaatgctcgctcatggtctatcaagtgcagcactgtttattatggcaggtcaaatttatgagcgtttgcacactcgtgatatgacggtaatgggtggcatgtggggacagtttcgccgccttgctccatttatgatgttcttttgtgcggcattgttgggcatacctggtacgggtaactttattggtgagattttgattttgattggtgcttttgccatacatccgatctttgtcacacttgccacagtaagccttgtgatggcaggactgtattctttgatgataatttatcatgcgttatttggtcaaaataccacgcttgaattggtgaagcaaaatcacggtacgctaaaagatttgggtaaacgagaattggtattgctactttctttggcaatcggtttggtatggcttggcttgtaccctcagcctgttatggataagtctgaagggtcaatgcagtggattgccagtgcttatgcacatgatgtcatcatggcagatgagccaatgcatggcattcgattgattgaagggaatatgggtgactatatgcatgcccatcaccatcagctgcatggtcaaggatatgacgctggtatacatcatcacaaaggctctgatggccatcatcacgatcaccaaaccaagcagggggaataa

SEQ ID NO: 454 - DNA, 801 bp, M.catarrhalis
gagctattaaataggcatttatacaggacggtcatgcaagaaataatacaatccattgtttttattgctgccgccatactgcacggaattacaggcatgggatttccgatgcttggtacaaccgcattggcttttatcatgccattgtctaaggttgttgccttggtggcattaccaagcctgttaatgagcttgttggttctatgtagcaataacaaaaaagggttttaccaagagattgtttattatttaaaaacctataaattgcttgctatcggtagcgtcgttggcagcattttgggggtcaagctgcttttgatacttccagtgtcttggctgtttttactgatggcagtcattacattgtattactctgtcaatggtattttaaatgtatgtgcaaaagcaaaaaatattcaagtggttgccaataataaaaatatggttctgtttgggtttttggcaggcattattggcggttcaaccaatgccatgtcccccatattgttaatatttttgctgagtgaaacagaggataaaaatcgcatcgcaaaagcaagcaacctatgctatcttttggcgaaaattgttcaaatatatatgctaaaagaccagtatttgttattaagtaagagtgaatacggtttaatatttttactgtccgtattgtctattattggattgtatgttggcatttggttgagagctaagattagcccaaatttttttaaaatgttaatttttattgttttattggtattggctctaaaaattgggcattcaggtttaattaaactttaa

SEQ ID NO: 455 - DNA, 813 bp, M.catarrhalis
attaaattaaatactatcaatttttttcatacaagttttatcacaaccaaaaggaaaattattatggcttttaaagacatgacaggacaaaaagtcccaaatgctgtatttcatacacgccaaggtgatcagtgggttgatgtgaacactgatgagctttttagtggtaaaaaagtcgtggttttttcattgccgggtgcctttacgccgacttgttcatcaacacatttgcctcgttataatgaattggcagatgaatttaaaaaactgggcattgatgatattttgtgtgtatcggtgaatgatacctttgtgatgaatgcttgggcagacgaccaagaaagtgacaagatcactttaatcccagatggtaatggtgagtttaccgaaggtatgaatcgtttggttagcaaagaagatttgggctttggtaagcgttcatggcgttattcgatgcttgttgatgatggcatgattgtcaaaatctttgatgagcctgaaaaagatggcgatccgtttgaggtttctgatgctgataccatgatcaaatttttaaatccagattgggaagataagccgtctgtaaccattattaccaagcccggttgtgctttttgtgccaaggctaaagaggctttaaaatctcatggtgttgcatatgaagaagttgtacttggtcgagatgccagcatgacaagtgttcgtgccatcactggccatgatacagtaccacaagtctttgttggtggcaaacgcatcggcggttcagaagaacttgaaacttatttggcaagtgatgcttgtgccgtttaa

SEQ ID NO: 456 - DNA, 3141 bp, M.catarrhalis
acaactcaaaaccacaacaaaacaaggtgggggtgtaacatggcagtcattcatatagatggcaaaacttatgatgtggacggctcggataatctgctctcagcctgcctgtcgcttggcattgatgtgccttatttttgttatcaccctgccttaggttcggtcggttcttgtcgtcagtgtgccgtcaaacagtataataacgccgaggattatcaagcaggcaaagggcggttggtgatgagctgtatggttgcccccagcgatgacatgtacatctctgttgatgatgatgaagccaaggcatttcgcaaaagcattgtggaatacttgatgaccaatcacccccatgactgccccacttgtgaagagggtggtcattgccatttgcaagacatgacttatatgtcaggtcatcatcgtcgccgttaccgctttaccaaacgcactcaccacaatcaagagcttgggccttttatcgctcatgagatgaaccgctgtatcgcctgctatcgctgtgtgcgattttatcaagattatgcaggtggtgatgatttgggcgtgtatgcgtctaataaccgtgtttattttggtcgcccagaagatgggcagtttgacagtgagtttagcggtaatttaaccgaagtgtgtcccacaggggtgtttacggataaaacccattctgagcgttacaatcgtaaatgggacatgcaatatgccccaagcatttgccatggctgttcggcaggctgtaacatttcagcaggtgagcgttatggcgagcttcggcgtattgaaaaccgctataatcacgatgtcaatggctactttttatgcgaccgtgggcgttttggttatggctatgttaaccgagcggatagacctacccatccccttaaaaaggtgaatggacaatttgtcaaaaccagtgcagaccttgctgtggatggtgtggcggacttgctaaaaggtaaaaatgtgattggcatagggtcagccagagccagtttggagagtaattttgccctaaaaagactggttggagcaaacaattttagcacaggcgagcgagcggccgtcaaagatgtggtggaattgggtgtggtattattacgccatgaagcggtgcatcaggcatcattggcacagattgagacggcagatagtgtgtttattttaggggaggacattacccaaacggcaagccgtgttgccttgtcagtacgccaagcggctaagaataaatcccgccaaatggcaagtgccctaaaaaccgagcattggcttgctgaacctgtcaagcgtatcggacaaagtgcgtacagtccgatttatgtggcgtgtgtggcagatactaagctatccgacattgccaaagtgtccgctgttgccacaccagatgacattgccaaattgggctttatggtgggcgatgtcatcaaggcatatgctgatacgctagatgagattggcaaaagtgagaacgccatttttgccaaagaaaaacagacggatttggtgattgatgatgacatggcgatgcaatttttggcgcatcatatcgcttatgatttgattatggcaaatcgtccgcttgttgttacaggcacaagtttgacatcaaaagcaatcgttcaggccgcaggctatattgcccaaaccttgaccgccaagcgtgccaaaatcgcccatgtggagcgtgaatttatagaagtacaaaacgccaaaatccgtgatgaggtcgcccgtcagttcattgaccctgataaagatgccaaaacggacggtacgcacaccacagagcgagaccccaatgactttgaaaaagagctgtcatctcgcctattaaagacaaatactctgtatgctgataaaacaggcgtgtatgttgccatgccagaggccaatagcgtgggtgtgaatttattgggtgggcaggcgatggaggaggttttggcacaagcatttgaggcggtggtcgtgttagaacatgatttgtcaaatctgaccccaagccaatttgacaaattaacacaaaagacactcatcgtactagaccatcagtcttatgaatggcatgataaagctgattttgtgttatcaagtgcatcatttgctgaaagtgatggcacgcttgtctctgctgaggggcgagcagggcggttttttgcaagctatgataaaaaatattatgaaccaaccagcgagctaaaagacagttggcgttggctacatgcacttgacaatgccatgacaaacaagatgggtgaacccatctggcgccatcttgatgatgtcattgatgagctggttgtagagtatccacaccttgctcaaatcaaagatgctgccccagagtcagattatcgcattacagggctaaaagttgcccgtgagccacgccgttattcggggcggacggtgttacgctcacctatttctattcacgaacccatgcaacctaaggacttagacagtggtttgactttttcaatggagggttatgtgggcgataaaaccaatccaagccttatcccttttgcgtggtcagcaggctggaactccccacaagcatggaacaaataccaaaataaagtcggtgggcgattaaaaggtggcgatgtgggcattcgtctgtttgaaacactgccaaagacgcaaatggtgtttgggcgtgttgatattgataatgcaaatgttgctacaagcattttttatggtcgtgcggtgattgtgcctgtacataacctatttacaagctcacgcatgataagccgtagccctgtggtagcaagccaaatcaaacctgccatgtggatgataaaccatgatgatgcagagcgttggatggttaaggtgggcgataaattaaccctaagccagcatggggcagagattaccttgcctgtggaggtggtggattatttggcagacggctgtattggttatcctgatggtgctgtaccgcttatggtcggtataccaacgactgtcaaaaaagcagataaggacacgcctgtctatgtgcctgaccatcaaaagagcatgcagagattggcaagtatcaagcgtgagaatatctttacaccaaaggcagggtttaataacgcaccgtttgcgatgaataaagtgggggcataa

SEQ ID NO: 457 - DNA, 1860 bp, M.catarrhalis
ggtggtatgaatttgttagcattgacctttattttccctttaattggatttttgatattgaccatggggcaaggcagaattggcgaaaaacctgctaccatcattggggtgggggcgatggggctgtcggctgtgtgtgcctttgtcagtatttttgggtttttgacaaaagggcaacaggcgatgtctgtgccactttggacatggctgtcggtgggcgattttactcccaaatttgggctgtatcttgatggattgtctgttaccatgatgggcgtgattacaggcgtgggctttttgattcatctgtttgccagttggtatatgaaaggtgaggcaggatttgcccgtttttttagttatctgaatttatttgtggcaagcatgctcatgcttgtgcttgctgataaccttttgctcatgtatttgggctgggagggtgtgggcatttgctcatatttgttaattggcttttattatcaaaaccgagccaacgggcgggcggcgataaaggcatttaccgtaacccgtgtgggtgatgtgtttttggcgattgggctgtttttactgtttgttgtatttggtacgcttgatatggccgccatcaatgccaaagcagatgccatgtttgctgttaatgaccccatgctactactcatcgtggcaatgcttatcggcggcgcgtttggtaaatcagcacaaattccactgcatacctggcttgcagatgcgatggcaggccctacgcctgtttccgctcttatccatgcagccaccatggtaaccgcaggggtgtatttgattgcccgcatgcaccctttatttgtgctgaccccccagatgctcctgtattgggtgggcggtgttggtgcattgtccatgctggtggcaagtttttgtgcgttggcacaaaccgacattaagcgtattttggcgtattctaccatgagtcaattgggatatatgttcattgccttaggggttggagcatggcaggtggcgatttttcatttgatgacgcacgcattttttaaagccttgctattcctagccagtggggcggtgattgtctcaacacaccacgagcaaaacatttttaaaatgggtggtctgcgtcataaaattccccttgtgttttggtcatttgtggtaggtggtggggcgttggttgccttgccttttgtaacggttggcttttattccaaagaagccattttatgggagacttatgccacaggacacatgggtttgttttgggcaggcgtgtttggggcatttttgacctctgtttatactttccgtttgatttatcttgtgttctttggagagcaaaaaacgcatggcgagtctttaaagggcataagttacgctttgcctttggtggtgttactgctattgtcaacaggaattggagcattaatccatccccccttggcaaatgttttaccgatgagtgtgggcagtactctaacagatgctaagcataccgctgaaattatcgctgttggctttactgtctgtggcttggtgtttgcctactttttgtatgtcataaataaaggcaaaattttgacaaaatggacaaattctacctttggcacagcatgtgtttattggtgttaccatggattgggctttgatgcgttgtatgacattatttttgttaaaccctttttgggcatcacaaaggcattaaaatctgacccaatagaccgcctaataaatatcttagccataggtgcttcatggggtaataaattaacaacaaaaacccaaactgggcttttgcatactcatgccatcagttttggtgtaggtctggcggttattttaatcttagcattgatgatggtggtgtaa

SEQ ID NO: 458 - DNA, 642 bp, M.catarrhalis
cacgcataccttcgatccccgctgttaagaaatatcaagatgtgcggactgaagaaaaatgaaaaagataaagtttcatccattcaagaacctgccatgggttatgcaatggaattaaaacttcgtaatgctcaccctcagaacccaaataaagcgaccgaaaaacgcatcgccttagaccaaaaagatttggtggctgtagagggcgacctaaccaatgttccttttgataaaaatcttattgaataccttaaaaaatcacccgaggttgtaagtaaattcaatgaacaaaaaggcggtattgaaaataacacaagattgacacacaaagattcatcattatcatcagagcaaaaagaagcaaaagtcaaagaagcgttggacaatgctttaactcaatttgcccaagaaaaatacaaggagctaattgagaacgcccatgataaaaaatctgacgcacgcaaccgtgatctaaaatatgtcaagtctggttttaactatctttctggatataccgccaccgaccacgacaaaaaaccaattatcgtggctattatggtgcgttgtattataaaggcagcgaaaccgccaaagagctaccacaaacaagtgcaaaatataaaggttactgggaacttatga

SEQ ID NO: 459 - DNA, 186 bp, M.catarrhalis
tataattttgaaaactgcgttcatcaaatgatgcaaacaaagccttatgccttagggcttgatatgcgtcatcacggctatcaaagacatctttgcggtatttggatttttgggcgggcgttaattgatcaatcaaatggtattgaaattttggaatacgccctatgtatttatccatcgtcttag

SEQ ID NO: 460 - DNA, 846 bp, M.catarrhalis
gatgataatgacaaagagaacatcatgagtgatgacaaagcagtgacattgacggtgctatcaaagacagtttggtcgcccaatttatttagttttacgacaaccagacctaagggttttcggtttgaggcggggcaatttgttcggctgggattatgtgcagatgagctgatttattatcaagataagcatcaagatacgcctaaatctgagagtgtaagtccaatttttcgtgcgtattctgtagtatcgtctccgtatgatgaaacacttgagtttttttcggtggtggtggctgatggggagtttacatcacagcttcaatacttacaagcaggtgatcagttgtatcttaatacaataccgtttgggtttttgacgctatcacgctaccaagaaccaacgccaaaaacattatggttattagcaactggcacagggcttgcaccatttttatccattctacaggatttatatgcttgggagcactatgataacattgtgcttgtatacagtgcacgaactcaaagtgaattggcgtatcaagacaaaattcattcattggcaacaagctttggggggttggtggataatcctgctcgtttttattatgtgccaatcgtaacgcgtgaaaaagtcgctggctgcttatctgagcgtattccaagcttaattaataatggtgagcttgccaagacagcaggggtagcactcgacactcaatcgcatgtcatgctgtgcggcaatccacaaatggttgaggacaccaaagaagcactcaaagcacaggggcttagcatgaatcgtcgtggcgttggtcacattgccgtagaaaattattggtaa

SEQ ID NO: 461 - DNA, 471 bp, M.catarrhalis
ctcatggtagaatacgccaaaatacgcttaatgtcggtttgtgccaacgcacaaaaacttgccaccagcatggacaatgcaccaacaccgcccacccaatacaggagcatctggggggtcagcacaaataaagggtgcatgcgggcaatcaaatacacccctgcggttaccatggtggctgcatggataagagcggaaacaggcgtagggcctgccatcgcatctgcaagccaggtatgcagtggaatttgtgctgatttaccaaacgcgccgccgataagcattgccacgatgagtagtagcatggggtcattaacagcaaacatggcatctgctttggcattgatggcggccatatcaagcgtaccaaatacaacaaacagtaaaaacagcccaatcgccaaaaacacatcacccacacgggttacggtaaatgcctttatcgccgcccgcccgttggctcggttttga

SEQ ID NO: 462 - DNA, 213 bp, M.catarrhalis
ctatctttctggatataccgccaccgaccacgacaaaaaaccaattatcgtggctattatggtgcgttgtattataaaggcagcgaaaccgccaaagagctaccacaaacaagtgcaaaatataaaggttactgggaacttatgacagatgccacatttgataacaaatacacagatttgccaggtatcgccagacaaacccaatgggggtag

SEQ ID NO: 463 - DNA, 1476 bp, M.catarrhalis
ggacacttatggccctgtgctgccgtccgaggtcggtctattattggagcaatatgtatgaataagccaaatgtcagcgaacagattgacgctcgtaaaaatggacttgccccaagccagcttaaccgccaaaaaacgccaatttggggcgtgggactggcggacgggcaagcaccaacgtcacttacgcaccctttgacatggcgactgtatcatcatgatgcactgctgacactggcagattatgaagccttggacggctttgttggcttaaaaaacgccttgaccaaatcacccaaagaggtcggcgagatgataaaaaccgccaatgtgcgtgggcgtggtggggcagggtttaacgcagggctaaaatggacattcatgaccccgcctgatgggggcgtgcgttatttgatttgtaatgccgatgagatggaacctggcacattcaaagaccgcttattgatggagcgtctgccttttcagctcattgagggcatgctcatcagtgcctatgccattggggcgagcgtgggttatgtctttatccgtggtgaatatgtcctagctgccaagcgcttacaaaacgccattaatgagtgtgttgccaatcacttgctgggtgatgggattttggggacggagtttaactttactttgcatattcacacaggggcggggcgatatatttgtggtgaagagacggcactcattaattgcttagagggcaggcgtgccaacccacgcaccaaaccgccatttccccaagtctcaggggcgtggggtcgcccaacggtggtgaataatgttgagacactaaacaacatgcctgccattttgttaaatggggtggattggtatttgaatttgccaaaagccaagggcaaatccaccacccctggcaccaaaatcatgggcgtgtcagggcgtgtcaaagatgcagggctttgggagttgccatttggtcataccgcaagagagttaatagagctggcagggggtatgcaagaggggcttagcttaaaggcgtggctaccaggtggggcgagtaccgactttttgaccgcaagtgatgagcatttggatttggtgatggactttgaccccatcatgaaagcgggcagtcgtttgggtacttgcttgatgatggtggtggatgaaagccaagacatggtgagtttgtcaaaaaatctacaacagttttttcagcgtgaaagttgtggctggtgtaccccttgccgtgatggcttaccgtggggcgttaaaatccttgatgccatggataatggacaagcccaagcggacgacattgacaaactctccgagctgacacgagatttgtggcttggcaaaaccttttgcgctcatgccccaggggcgatggagccactcatgagtgcgttaaaatatttccgtcatgaatttgagcaaaaagtgaacaactcaaaaccacaacaaaacaaggtgggggtgtaa

SEQ ID NO: 464 - DNA, 192 bp, M.catarrhalis
caccgtcaatgtcactgctttgtcatcactcatgatgttctctttgtcattatcatcttaatcaccaatgtcatcttaacagacattggacttttattgtgtattttgactgataatttggctttagtcaaatcatcagtcacgcatcaaattcaaaaaattgccttgattgcctttaaaattatcacttga

SEQ ID NO: 465 - DNA, 1029 bp, M.catarrhalis
atgagtattcgtgtgattcctgatgtgccatcatggcttggtgcttggtcgtttgagtggtggtcgtttgtttttatgactgtccaaacgctgattatttttttggggcttgtcatgacagcggccttgatgattgtgtatgaacggcgtatgttggcgttgtggcaagaccgttatggcccaaatcgtgttggctggcaaggctcgctacaactggtggcggacatgctcaaaatcttttttaaagaagattggacacccaactttgccgacaaacgcctatttaccctagctcctgccattgccatgtttggtgctttggcatcttttgccatcattcccttatcgcccacattgggggcagcggattggaacattggcattttatttttctttgccatggcaggtttggcggtgtatgcggtgatgtttggcggatgggcttctgccaataaatttgctttgcttggcggtctgcgttcagcggctcagacgataagctatgaggtctttttgggcttatcgctcatgggcgtggtggcgatgacagggtcatttaacctgcgtgagattgtcttagctcaggcagatgtttggaatgtcattccacaatttttggggtttttaaccttttgtgtggcaggggtggcagttacccaccgccatccttttgaccagccagaagcggaacaagagctggcagagggctatcatgtggaatactctggcatgaaatttggcatgttttttatcggtgaatacgtcaatgtggttgtcatctcagcactcatgacctgtttattttttgggggttggcttgccccatttaatctggatttgccctttgtgccacctgttttttggtttttgattaagactttgttttttatgactttatttgtgctaattcgtggttcgcttatgcgtcccagatacgatcaggtgatgaattttggctggaaagtgtgcttgcccataacactgctaaaccttttggcgactgcttttgtgattttgatggtgaattaa

SEQ ID NO: 466 - DNA, 1551 bp, M.catarrhalis
agaccggtgcttgatcatttaagcattgatgatatcgccgaaaaacttgagattgcaggccctggatttattaatatcttcttaaaaaatgagtggatatctaaacatgccaatcaagccaatatcagtcgcactttgggcgtaaatgccgcccaaaatgataccgtggtggttgactactcctccccaaatgtcgccaaagaaatgcatgtcggtcacctgcgttcaaccatcatcggtgatagcgtcgtacgcacgcttgaatttttaggtaataccgttatccgtgctaaccatgtgggtgattggggtacgcagtttggcatgctcatcgcttatcttgaaaaggtacaaaatgacgatgtcaaggatttggatttatctgatttagaagcattttatcgtgcagcaaaacacgcctatgacagcgatgaagcgtttgccaaaaagtctcgtaattatgtggtaaaactccaaagcggtgatgagtattgcttaacaatgtggcgaaaacttgtagatatcaccatggcacaatgtcagcacacttatgaccgcctaaatgttaccttaacgcgtgatgataccatgggtgaaagcctatataatccaatgctgcccagcattgttcaaacactcaaagacaaaggtttggcggtcgaagatgatggtgctgtggtagtttttttagatgaatttacaaataaagcaggcgacccaatgggcgtcatcatccaaaaaaaggatggcggctatctttacacaaccaccgacatcgctgcagcagcttaccgctatcatacacttcatgctgaccgtgtcattttgtttaccgatgcacgccaaaccctacatgcacagcaagcatggctcatcacacgcaaggcaggatttgtacctgatgaatttgtcatggagcattttacctttggtatgatgcttggtaaggatggtaaaccttttaaaacacgcacaggtggcacggttaagcttgccgatttgcttgatgaagcaatcgagcgtgcaaccaccctaatcgagcaaaaaaatcccgatcttagtgctgaagaaaagcttgctgtcgttgaagcggttgccattggtgcggttaaatattccgacctttccaaaaatcgtaatactgattatgtgtttgattgggataatatgctgtcatttgagggcaatactgcaccctatatgcaatatgcctatacacgcattcgctcgatttttgcgcgtgcagggcttgatatggcagatattggcggtgagattgtgattcatgaagataaagagcgagccttggcggtcaaattgcttcaatttgaagaagtgctattattggttgccaaagacggtatgccacatctattgtgtcaatacctatttgaattggcgggtattttctcaagtttttatgaagcctgcccaatcctaagctctgatgataagacaaagacctctcgcctacgacttgcagcactgaccgccaaaactctaaaacaaggcctgcaattacttggtattaagaccgtagaaaaaatgtaa

SEQ ID NO: 467 - DNA, 708 bp, M.catarrhalis
aataacgccagtttattaaccagcaagattaagacgatgaaatatacgctcaccaaaccaaaccaacataccaagcaatacccacaacaaagccgtgaaatcattgacgatatcacccaagccgaggtggataaaaatgtttttttgggcagattgtccgatttgacgcacaaccttgccaactggggtcgcaaaaactccttatggccctttaactttggcacaagctgttgttatgtggagtatgccacgaccttgacaggcgtgcatgatttgtctcgttttggggcggaggtcattcgtgcctcccctcgccaagctgatgtgatgatagtggcggggacgtgttttgtcaaaatggcacctgtgattctcaggctgtatgaacaaatgctagaacccaagtgggtcatctccatgggggcgtgtgccaactctggtggcatgtatgacatttattcggtggtgcagggggtggataaaatcttgcctgtggatgtgtatgttccggggtgtccgccacgccccgaggctttgattcaggcattaatgctcctacaaaactcaatccaagaggaacgccgtccgctgggcattcatctgaatgaacaaggcgttatccaacctatcatgacacccgaacgagaccacaagatggctgaccgcattgctacggtcaacttgcgtagccaagatgatgcgttttaa

SEQ ID NO: 468 - DNA, 1251 bp, M.catarrhalis
caaatacacagatttgccaggtatcgccagacaaacccaatgggggtagtctggtttctactgatgagtatgcaacactcttgccagccaaaaataccaagccccagtaattataatggtgcatatggtcatagcagtgaatttgatgttaattttgctaacaaaaaagtcacaggtaaacttatcagtaatcagttatcaggcaaaactgtaaccgctaaagagcgttataaaatagaagctgatatccacggcaaccgcttccgtggcagtgccatcgcaagcgaaaaaacagatgaaagcaaaagcaaacacccctttaccagtgatgctaaagataagctagaaggtggtttttatgggccaaaaggcgaggagctggcaggtaaattcttaaccgatgacaacaaactctttggtgtctttggtgctaaacaagagggtgaagccaaaccaaccgaagccatcttagatgcctatgcacttgggacatttaacacaaatgacgcaaccacattcaccccatttaccaaaaaacaactggataactttggtaatgccaaaaagttggtcttaggttctaccgtcattgatttggtgcctaccgatgccaccaaagatgtcaatgaattcaccaaaaacaagccagagtctgccacaaacaaagcgggcgagactttgatggtgaatgataaagttagtgtcaaaacctatggcaaaaactttgaatacctaaaatttggtgagctcagtgtcggtacaagcaacagtgtctttttacaaggcgaacgcaccgttaccacaggcgagaaagccgtaccaaccacaggcacagccaaatatttggggaactgggtaggatacatcgcaggaaaggacacaggagcgggctcatcaaaaggctttactgatgccaaagatgttgctgattttgacattgactttgagaaaaaaacagttaatggcaaactgaccacccaaggccgccaagaccctgtatttaacatcacaggtcaaatcgcaggcaatggctggacaggcacagccagcaccgccaaagcgaacgcagggggctacaatatagattctagcagtagtacaaacaaatccatcgtcatcaaagatgccgaagttactgggggcttttatggtccaaatgcaaacgagatgggtgggtcatttacacacaacgctgatgacagcaaagtttctgtggtctttggcacaaaaaaacaagaagttaagcagtaa

SEQ ID NO: 469 - DNA, 1647 bp, M.catarrhalis
ttgtgcaaaagatggtgcaaaaaaatcggtatggtgctgtcaggcgtggtgatggttctgttaatgataataacaacgccaagccatgctactgccaagttgttgccgacctctcaagaaaatccaaccaaaaccatggtagatagctttggtcgtgaaacgccacgaggggcagttcaggggctattgcgtgcaattgcagcagaagattatgaactggctgccaactatttggacggccgttatttggcaaaaacccaaacgcccaatcgtgagattgttgagcatttggtggttgcactagatgcaggtggcaagctgtatcctgatttacaaatcagtcatgccagcgaaggtgatttgtcggataatttgccaagtgatattgataaagttggcgagcttcatctgatgaatgagcatattgacattttgctcaatcgccgtgtgactgatgatgacatggtattttggcaagtgtcatcacagaccttgtcatcattgcccaagatgaccacacacgcccaaacgctttcagaacggcttgggctgtctgatgataccacacacgctcaaaccaaatattggcttgagctttcagcattggtgctgcttgtgacggttttatatttggcgattaatttggcggtatggattttgtattgggtgagtaaggggctttataccacactcaccaaaaagccttttcgcattatgcccagtgtgattatgccgttgtctttggtggttttatcattaatcttaccgataattatgattagtgttggcgtgcctttgacattgcgaagttcatttggtcggattaaggatattgtcgcttggggtgcgaccgcttggctgatgcttcgtctgcttgatggtatttttcgccgtgctgaggcaaattcattaaaacgaggtcgccctgaacaggtttctattttaaatctacttagaaaagttgccaaagccttgatgattattttggcggttattttaatttttggtaatcttgggtttgatttaaccacaggcatcgccgcactgggggtgggtggtttggcactggcttttggtgcccaaaaaacgcttgaaaatctcatcggttcggttgtggtggttgccgaccgccctgtgtatgtgggggattattgtaaatttggtacttatgaaggtacggtgattgatattggcattcgctcaactcgtatccgcaccttaaaccgcacaattgtgactgtgccaaatggcgaattttcatcgctacagattgaaaactttactgcaagggatatgttttattttttgcatgatttattcatcaagcgtaccgctgatttggcggaaattgagcgaatgataaccaatttacaagaatttttggcaacgcatcggctgaccaaccatgaatggaatcaagtttggattaagcagttgcgtcaagagtgttatgtcattgagatgcgtgcttatattgatgctgatggtgctcaagatttttatgccaaacaatcggtactgattttggagatattaaaatttttagaaagttatcatattgaacatgctttaccatcacaatccattacagtgcatcaaaatcatgaccaaacaaccccaaagcatgaaaaaaaccccaagacatga

SEQ ID NO: 470 - DNA, 1755 bp, M.catarrhalis
atacgaatgagcataaatcacactcatgattttggcgtgttggaagaattgaccgcaaacaaccatacttatatcacacaatctacggcagacggcataccaaccatttgggtggcttgtgatgagctgcttgatgttttgctgtttttacgcacattgcccaagccctttgtcatgcttgtggatttgtccgccattgatgagcgtttgcgtcagtaccgccatggtttgcctgacagtgattttacggtgttttatcatctgatgagcttggagcgaaattcagacattcgcattaaggttgctttaaaagaaggtgagcatgtcccatctgcgaccaagatttatcccaatgccaactggtatgagcgtgaggtgtgggacatgtttggggtggtgtttgatgggcatccgcacctgacacgcattttattgcccaaatattgggaaggacacccattacgcaaagaatatcacgcacgagccaccgaatttacgccctattttttaaacaccgccaaacaagagtttgagcaagagaacttacgctttgtgccagaagagtggggcatgaaacgctctgggcgtgatgaggattttatgtttttaaacatcgggccaaaccacccatctgctcatggggcgtttcgtttggtgttgcagcttgatggtgaggagattgtggattgtatccctgacattggctatcatcaccgtggggcggagaagatggcggagcgtcagacttggcattcattcattccttataccgaccgcattgactatctgggcggggtgatgaatgagttgccttatatcatggcggtggagaaactggcaggcattagcacccctgagcgtgccaatgtcattcgcatcatgatgagtgagttttttaggattaccaataacctgctttattggggcacatttatccaagatgctgggggcatgacccctgtgttttatatgtttgctgaccgtcaaaaggcgtatgatgtcatagaagcggtaacaggctatcgcatgcaccctgcgtggtttcggataggcggtacggctcacgatttgccaaatggctggcagcggttggtgcgtgagtttttggactggatgccaaaacggatagatgaatatgtcaaggcaaccatgaccaatagtgtgctaaaaggacgcacgcaaaatgtcgcccaatatgatgccaaacatgctctggcgtggggcgtaacaggggcaggactaagggcgacgggcattgagtttgatttgcgtaaagcaagaccgtatttgggttatgaaaactttgagtttgatgttcccgtgttttataacggtgatgcctatgaccgctgtttggttaaaattgaagagattcgccaaagtctacgcatcattgagcaatgcctaaataacatgccatctggggcatataaggctgagcatccactggctgtgccaccgccaaaagagcgtaccttacaagacattgaaacgctgattaaccactttgtatcagtatcatgggggcctgtcatgccagcaggagagtcggcgtgcatggtagagggggttaaggggcttaacagctattatgtcatatccgataaatccaccatgagctatcgcacacgtattcgcacgccaacctttgcccatttgcagcagatgcccagcgtgattaacggctctttggtgtctgatgcgattatttatttggcaagcattgatattgtgatggcagattgtgataggtga

SEQ ID NO: 471 - DNA, 885 bp, M.catarrhalis
ttggtgtttggtattttatccatacctaaaaccgaatcagccaatgacgcattttggcaacctttacaaccttatcaaaattgctacatatcgcaaccatttaatcagtttatttgcattttttatgtagattgtcatacagtgatttggcaaaataaaaatagatgctatcaaatatatcacatagcattatatcaagaatatcaagggaaatttatgttaacttcaaccctaaaaaccgccgtagtaaacgccgttatcagtggtgctattatggcatctgttatgatgcctgtcgctttgacaacagttgcccatgctgccgctgcttctcaatcacaggctaccaaaaatttaaacagccaactatcaggcattcgctcgatgacggcaaactttagccaaactacacaagcaggcaataaaaaaaccaattttacaggcatgatgggcgttcagcgtcaaaatcagttccgttgggaaaccaaatcgcctgccgaacagttgattgtcgctaatggtaataccatgtggatttatgataaagatttgcaacaagcaactcggcaatcggttggcagtcaaatcggagaagtacccgcattattattgtcaggcgatccaagccaaattgatcgccattttaatgtcagccaacctgatgcgaataaaaactactttattttaacacccaaatccagtaatgctaattttggtagcctatcattaagctttaatggcggccgtcccgtgatgatggtacttcaagattctattggtcagaccacaaccattcaatttagtaatattgctttaaataaaaaattgccagcaacgcagtttaatttcacgccgccaaatggtgtagatgtgattaatcagtaa

SEQ ID NO: 472 - DNA, 189 bp, M.catarrhalis
aaaaccgaagggcttaacagctattatgtcatatccgataaatccaccatgagctatcgcacacgtattcgcacgccaacctttgcccatttgcagcagatgcccagcgtgattaacggctctttggtgtctgatgcgattatttatttggcaagcattgatattgtgatggcagattgtgataggtaa

SEQ ID NO: 473 - DNA, 1251 bp, M.catarrhalis
ggattgtttatgtcagcaatcattgccataccaaaaacattaaaaaccatcattttttatggtgttgcctttggtagctttcgtatgctcattggtggcatatccaccctatatcttttgagcaaaaatattgatttaattgacttaggcttattaaaatcatttcaatttgggttaatgatgataattgatttacccttatcttacattgccgatagatatagccgaaaactatctaccatacttggaattttatttgggtcattttggttgttgactaccgcttttgcctcagaaatttggcaattttatgttgcagaagcatttaatgccatctccttatcattatttggtggtgcttatatatcttatttaatagatataaaaaacaaacaatacccagatctagataataaaactttactctcttatgacaataaatacaacagcctaggtatggcaatttgtgcttttgtaggcgccagttttttagaaccagcatcaaatatcatatggattattgcaggcacattattatttatagtcagtatgggtgcttttttacaactacccagtgatatctaccaaagtacgcataataatataagtgatttaaagattaatacacccaacttctcagaaaatttgggtcgtttaatctcaatactcaaaacaaaacaagagatatgttatgggctaatagtgctatctatcttgctaatatattttcaaactatattacaactatggcaaccagttattaaaaactttaatacaggcaatttgggatggatttatggcatgtttttttccatcgtctctcttgctcagcttttgtcaagttatgccattaatagtaacattaaaaacaaatacacatatattctgatttgtctatttttatcactactgctcatgctatctgcaatcacactgtttcagcactcgacaaaaggggttgtattaatagtcatctctttatttattatgttttttggcattaagtttttaatgattgaagcttcagctaaatttcatgacattatacccaacaactatcgttcactgcttgatggcatggcattttttatcagtcgtaccatattactgattatttttcctgcaattacctatcttatacaaaaaatgggctttattgctttaccactaatttttagcatattaatcactttatatatgttcattggtcatcaatttaagacaaatattaataataataccagtgtttaa

SEQ ID NO: 474 - DNA, 942 bp, M.catarrhalis
atcatagtaataaaaacactcaatcaggatgatcttatgacactcactcaaattcatcagctaaataagctgcccaaatccataaaaactggcaagccactgttacattttgtacatgccaatggtattcctacaccaacatatcaagtcatgctagataggcttgccagatattttaccatcgtgtcaatcaatgaattaggcacacaccccaactatcctgttgatcatcactggcaaagtatgacccatcaagtcggtgatagcattgatgatgcctgccgtgagcatggcgtgtcaacactggtggcagttggacattctttgggtgccatgacgaccttacagacattgattgctaacccaaaacccatcagccaagcagttttattagacccttctttgctgacagctcgttctgcttttttatatcatgtagctaagacgatggataaatacatagggcgtattccaaaatttcaataccatttgattgatcaattaacgcccgcccaaaaatccaaataccgcaaagatgtctttgatagccgtgatgacgcatatcaagccctaaggcataaggctttgtttgcatcatttgatgaacgcagttttcaaaattatatcaaatacggttttaagccaacggcggatggcaaatatacgctaagcattcccaaatctgtagagagtgcaatttttcgcaccatgccatcactatattggctaaaatccatctcacctgccaagccagtcgctttaattgcaggtcaagacagcgattttaccaaaattggctcttatgacgatgcccacaaaaaatttgatatacctgtttattatgtcctagggtcgcatatgtttccgcttgagtatcctgaacaaaccgctgatgatatcctaaatacactcattgaacaactacagcttgaatgtcactaa

SEQ ID NO: 475 - DNA, 237 bp, M.catarrhalis
ttttttacaataaaaggatacgctatgaaacaaattaagattaagattgaaggtatgacttgtggtggctgtgtcagtagcgtccaaaaagccttacaagcggtggttggcgttgaggcaatctctgtcagtctagaagatggcttggcggtggtggcatatgatgagtcagactgcgatgttccagcaatcgttgaagcaattgaagaggcaggctttgatacgcaattggtttag

SEQ ID NO: 476 - DNA, 438 bp, M.catarrhalis
catgccctgatgtcacctctaatacatgggcaaatcaagacaaagagcaacaggagagagccgatgcaaaattataatgtagatactctaaataccccctttgcccatgaagtcgccaaattggcatctgatatgggcgtgcctgctcatcatgggctgattttggcggccattttgtttgttattggactggctggcgtcatggcaagacgcaatgtgttgttcatgctcatgagtttggagattatgatgaactcagctgcccttgcctttgtagtggggggtaacatgtggggcaaggcagatgggcaggttatgtttgtgtttattttgacgctggcagcagcagaggcggcgattgggcttgccatgcttttgcaattttatcatcgttttagaagtcttgatgtcaatcacgccagtgaattaaaggggtag

SEQ ID NO: 477 - DNA, 525 bp, M.catarrhalis
atgcaaaaggttaccatgaaaattgttaccgacaaaacccccaaagtggacattcacgccattttaacgccccaagaaattgacggcattcatcatcacattcatcactacccacagccccgtgccgcggtgcttgatgctttgaaacttgtgcaaaagcgtaacggctgggtcaatgatgcccaagtggtcgccattgccaacatgcttggcatcagtgtggcagatgttgagggggtggcaacattttttaatcgcatttatcgcttgcctgttgggcgacatgtgattttggtttgtgatagcattgcttgctatttgacaggttatgagacgcttttggctgagtttaaggcacagctgggcattgagtttgggcaaaccacagctgatggcaggtttaccctgttgccaatttgttgtttgggaaattgtgataaaggggcaagtgtgctgattgatgaggacacttatggccctgtgctgccgtccgaggtcggtctattattggagcaatatgtatga

SEQ ID NO: 478 - DNA, 306 bp, M.catarrhalis
ctgatgctctccaagctaattcctgatatcatcacgccaaaagatatccctaaaggcttgattttattgcttattgtggcgtgtttgctggtgggtttatcagggcttagatatggcggtgtggaaggatggcttcatgtccttgaaaattggcttgtcgctttggtggtgattcctgccttaactgcattgatctcattgcctttaaagtggcgtgatagcacctttgatgtgcgtatggtctattattcgggtatgtttgttgcacttttatttatgttggcaaagctacgctactggcgatga

SEQ ID NO: 479 - DNA, 2820 bp, M.catarrhalis
aaatatgaatcgcctaagaacatgggcggttcatattttttaaattgctatcatggtttatgctataatactctgttatttcaaaccaaaatttggacttttatgactcagcacagaccttcttattttgccgatcttaaaaactttgatgtcaatgagtttacagtcattgtgacttgtgccgatggtcttgaggctgccttgcaaatcgaactgaacagttttggcttatcaagcgatgtgctgcgtgcagggcgtgtggcagtcattgtggatttggcaaaattttatcacatttgcctatatagccgagtggccagccgtgttttattgccgcttggcgaatatcattttaaacagaaattatcgcaagctacaaccaaccaacctgttgaagtattggatgaggatgtgcctgaggcattatatcaatttgccagtcgtattgattggataaatttatttgggcttgaacatcgttttgcgattcgtctttcgactgacaaacgcctatcggtcaatcaacaatttgccactttacgcattaaagatgccattgcagatacctttaatcgtgcttttggtgcacggcctgatgttgatgccaagcagcctgattttcagatttttgcgacagccaaccataaatttgccgaaatttttttggatttatcgggtgtcagtttacatcgcagaggctaccgtgttgctaataccgcagcgccactcaaagaaaatttggcagcggcactgttgtatgaatgcggttggcatcaaggcattcatgatgccatcatcgatccgatgtgtggctcaggcacattcatcaccgaagcattactgatgcgtgcggattatcctgttgggcttgaaaaggcagctgatgaatttggattttattgctggcagcatcatgatgataaactgtgggatgagatggtgtccgatgccacacagcgatttcatgcgtgtttatcacatctgcaaaacaatcctttgacagtgattgcctgcgatgccgatgcttatgtggtacaggcttgccataaaaatctgatagcggcagggcttagccccatattagatcaagtcaccttggcccagcgtgctttatatcggctgcctaagcttttatccactttgacttgctcaaagcctttaatcatcaccaatccaccctatggagagcgattgggggataccgactttattaaacctttatatcatgggcttggattgcatattgccgctgccatgcggtcagtttctgccaatacaggacaagcgattgatgccacgatagcggttttggcaagtcatgttgagtatgcagatactttgccaattataaatcctcagactttgcgttgccataatggtgctttgacggtgtattttcgtcatggtgagctaaatttgtctgagccatctgatctaatttttgagtggcaaaaacaagagattatccatccagatgctcaagattttattaatcgcttacaaaaaaatttatctaatcttaaaagacaagcgaccaaaataggcgtgaccaacctgcgtgtctatgacgctgacctaccaaattttaatgttgcgattgatgtctatggcgataaaattcatgtacaagaatacgcaccacccaaacaaattcccgctgatgtcgccaaaactcgctttaatcttgttctgcaagctgttcgagaagtttttggtgtacctcgtgaagccatttttatcaagacgcgtgccaagcagtcgggtaatgagcaatataccaaaaatgataacgccaccaaacgcaaaaaaatgtgggtggtgcgtgagcttggtgcttatttttatgttaatttcactgattatttggacacaggactatttattgaccaccgccatatgcgtgccaaaatcggtgatgccagccgtgccaagcgagtgttaaatttattttcatacacctgtacggcttctgttcatgcagctttggcaggtgcaaaatcggtaaccagtgtggatctgtctgccaattatttggattggggaaaacaaaattttgccttaaatggtctggtgcttgatgctttttatgatgatggtgagaggtatcaattcatcgcacacgatgtttttgaatggattaaacaccataccgagcaatatgaagttatctttattgatccgccaactttttctaattccaaaaaatttaaagggacatttgatgtccaaagagatcatgtggcattaatcaatcgtgcgatgaatcgcttaacttcagacggtgttttatactttagcaataattacacccgttttgaatttgacgaaagtttgatggcacgatatgatgtcaaagatatcacgcatgaaaccattggttttgattttgatctaaaaaaacccatccatcgcagttatgagattcgccataaaaatgcagtcaaatctatgaccgttatcaccaataagaccatggatcaaaatgcacagcatcacatgcccaaaaaccatgatcagcccaagcgttttactaaaacacgcaatcaaagcaccgataaaaaacctcatcaaaagtttgctaaagatggcaaaaaatcgcacactgaccgctttggtcattttgataaatccgcaaaacgagcgacgcctaacgctcgccgttcaaatcatagcgaacatacgccaaatcaaccaagcataaaacgagtttatgtcaatccaaaatcggcagatgaaaatttagccaagcgtttgactgataaacttgccgaagccaatctgcaaggcgaaaaacgatatacaattaagaaaaaaagctaa

SEQ ID NO: 480 - DNA, 882 bp, M.catarrhalis
ataataatgtctattgaaaatattttaataaaacaattaaaaaaatacagttggattttactgatttttgttttatcagagatgacagcttttggtcatcaaaaagagatatcgaatatcataaataacgataccgccaatgtatcaacacaaccatcgaaaaatcactcaaatcaagcttggttagatgaccaacaagaagttcatggagtctttgatcaaagttcaaccaaactgaagtccattccaaaaaaatacaccccaaagcccgaaaaaatccatcctgaagtttataactctttgatcgatatgattgataaggcacaaaaggataatattaaacttagcgtcgtatcagcatttcgttcttatcaaagacaaaagcaaatttgggagaataaatggggaaatcgcccaaatgatgatattaatcatgccaaaaatatcctaaaatggtctgcttttccaggcaccagtcgccatcattgggggactgatgtggattttaatagtgtggaaacggcctattggaaatcaaaagaaggtgtaaaggtttataattggctgcaaaataatgcacccaaatatggattttgtcaaacttatgacgatggtagacaacatggatataattctgaaccttggcattggtcatatatgccagtcgctgataggtatcttgctcaaatcagtaatcctgcggttttagaggttgtattaaaccaaggcgtcaagggttctgaagcagttcgacaatcaggggatttaatgaattatgtgaccagtattaacgcttgccaagtcacatatccacacaatcaacagcaaaatatacaaactcctcaagatctcccgccaaatgataccaatcagtcagagtaa

SEQ ID NO: 481 - DNA, 270 bp, M.catarrhalis
aatatggtttattttaccgcatctgcttttatttttcagagaaaatttgacgctaataagcttgggttgttaaattcaacatttatcccaaataaaccccaaaggttctacctgcttggggtttatttcaacgataaacatctgccaactgataagtcagcaattagcagcgataatataaatcaaattcaagcggatgcaccgcttcatttaatttatgaacttcttgcatttttagatcaatataagcatcaatcatatctttgctaa

SEQ ID NO: 482 - DNA, 192 bp, M.catarrhalis
attaatgattatacattgaaacaatcatgtcaatgggtaaaattgaccaagctgatggctaatttttacccattaaaatctaccaaatattggttaaatttattgaccgttttaactttgctttttatgatcggtacgatattgattgggggtattttatcacaagtggatatttttaggtatgagagctaa

SEQ ID NO: 483 - DNA, 1554 bp, M.catarrhalis
ttggtatttcatgagaagattatcatgccagccaaccaattacccagccagcactattttagtgccattctcattacaagtctcatcgccagcgtggctttttttgactttgctatttttatatatctgtctgatttattacgacagatcttttttggtggtacggagtatacttggctttctcgcctgcagttgtttggactgttttcagcaggttatattgccagacccttgggcggtttgatgattggctactatggtgataccaaaggtcgcaggcctgcactattcatcagtttactgggcataacaatattcactttattcatcgggttattaccacagtatagtcaaattggcttcatcgcccccattatctttatcgttgctcgagttatccaaagtcttgccattggtggcatcatgccaagcgtttgggtgtatgtcaccgaacatctaccaacacgccatattggcgtaggttgtggtgcaatcttatctggctgtgtgctgtctttgatttttttaattttattaatgaactggctagacgatacgctaacttgggcacagatgatgagttttggttggcgtattccgtttatttgtggcggtttattaagcgttattttaatcttaatatcatacaaacacttgcaagaaacgcccatttttttagaagcacactctgagcggtcatttcgccccaaacatgagtcaatgcttagtaacatgagtttatccactttgaccaactcacaaatcaagcagcttgatcatctgccagcaattgagtttcagctttctgaagatacaaaaatgcccgatcacagcataagcccaagctcaatgacaccaccacccaaaatcaatgagatagatcaacgcacagtcacaacagccatgcgactgacctcaaaactaaccagctttgctaggtcgtcaatctcgttttttcaaatcatttgcaataaaaatatgctcatcagtattattcctgccataatgttaatcagtattatggtcagtttattgatatttacgccaattttattggtagatttgattgatggtagctttcgaatctctgaaacggttttatggtttggcaatgtgcttgcaattttatttatggcaattggttgcttgatatttggcattttggtggataggcttaatcctggtattgtgctaacttttggtagcctattcttggcgatgcaagtggctttgttttttaatcatttgcgtaatggtggtgaatatgggttgatattttttgccctatttggatttgcttcaggtatcattggtgcaattccttcggttgtcgtgcgactattccctgccaagattcgattaacaagcgtcagtatcatttataatatcatcatcgcacttatcggcggtttgttgccgtttgttctacattcagcctcagctcatatcgcttttgcacctatgattttcatcgtttcattatcgcttttaacaatgtttataagcttttatatttactacattcctcgtaccgaccttgatatgaatcgctaa

SEQ ID NO: 484 - DNA, 828 bp, M.catarrhalis
ctcaacattcagtacaaaaacaggtatattattatgtcttatcccaaccaaaatttaccgataattcatgcattatggattggtgatacactcggaaaactctccgctgcttgtttgtcttcttttgttcaacaagggcatcgggtatgtttacatgcctacacacccatcagtgatgtgccatctggtattgatatatgcgatgctaacttaattattcccaaagaaaaaatcatcaagcataaagccacaggcagttatgcgttattttctgatatttttcgttatgagctattaaataagacagatcatggcatctatgttgattgtgatgtgtattgcttaaaacccataaccatgcccaatcatggttatcttttaggatatgaagatgatactaaaatcaacggagcaatattggccctgcccaaagaaagtgagttattacatgccttattaaaatcagcttacgacccctattttgtaccaccatggtataaatctagaaaacaaaaaatacttaaaatacgcaaacaatttggattttcaagacatgttgcaaacatgccatggggtgtgattgggcctgatgccatcacatactatgcccagcactatcagatagctcattttgcccaaagtattgatgttttttatcccatccatcatcactgtattgggcatctattaaattctcgtttatctatcaaagatattatcacgcctgacacattgtgtattcatctatatcaagaaagactaaggcaccttgacttatcttgcctgccccaaaattgcattttagataagatcatcaattcacactaa

SEQ ID NO: 485 - DNA, 1632 bp, M.catarrhalis
gtcatgactcatcattttcgctctttgtttgtcatcagtatacatactgtcatgctggtattacttgttggctgcaaaaatttgcccgatacgcctcacttaccaaagagtctggcattgaccaaacaggttcaagagcgtcaccaaatggtcaaacatggtggcagttcagatggtctcatctcagccatcaacgcccaaagccatcatcaccccaatcaatctggatattatccgattacaacaggtgccaatgcgtttgctgcacgcagtacgctgactgatgtggcaaaccaatccattgatattcaatactacatttggcataacgatgaagctggtcaactgatgcttaaagacctgtgggaagcggctgatcgtggtgtgattgttcgattgctgcttgatgattttaatagctcacctgaacttgatcagctcctactacgtatctcaaagcataaaaatattgctgtcagattaatcaatcccatgccttatcgtggcttccgtagtctaaactatatgttacatcccatacgcaccaatcggcgtatgcataataaaagcatgacatttgataataaaatcagtgtcataggtggtcgtaatatcggtaatgaatatttaaataatgcacctgttaatcattttgctgatttggatgtcatgttagttggtcatgtcgttggcaaaattacccaaagctttgagatttattgggcttcacccctatcctttgatattgaaacacttgtcaaacatgacaacaaagatgacatcagtggcatcaaacctgtggtatttgatgaacttgaaaaagtcaaagacagctcagatgctgatcgtgagctacgcacttatcgccaagccatgcaaaattcaaccattgggcaagatttactcgcccagcaagtaccatttttttggacagagattgatttgatagcagataatgttatcaaattaaacggtcactcagatcctaatgaatttttggtttcacagctacaaacacaattgggtcaaccaagcaaaaaactcagcatcatctcttcttattttgttcctaccaaagaaggtatcgacacactgatcacgcttgctaaaatgggtgttgaggtgcgtattttgaccaattcatttgatgccaccgatgttggtattgtacatgcaggttacgcacactggcgaaagcaactactggcggcaggcgtgcatctttttgagattaaatctagtgctcagagtatccaagataacgaaaatcgtttttggcgtacacgccagcacagcaccacaagtctacacgccaaagcctttgcggtagatgatgatcaaatatttattggttcatataatgtcgacccacgctcagccaatatcaataccgagcttggtgttcttatcaaagatagtaaattggcaggacagctacacaaagctttgagtaatagccaagccatcacccatcaagcctatgaactaaaacttgacgccaaaggtaatattaattggcataccatcgaaaatggtcaaccagtcattttgcatcacgaaccacacatgaatcataaagatcgtattatcatttggctggctggactgatgcctatcgattggctactttga

SEQ ID NO: 486 - DNA, 1431 bp, M.catarrhalis
ataaaaaatcaggagtgtacgatgtcaaacaaattatttgacctgattgaatcatcaggggcgaaatgggtggattttcgctttacagatacgcacggcaaagagctacatttaacttttccagcatcgaccgtggacgaagatacgctagaagatggtaaaatgtttgatggctcgtcagtggcaggctggaagggaattgaatcttcggatatgattttactccctgatgccaaaacagcatatttggatcccttttatgaatcaccgactgtcgtggttagctgtgatgtgattgagcctgcgacaatgcaaggttatgaaaaagacccccgctcaattgcacgccgtgccgaaacttatctgaaatcaacagggattggcgatacggcttattttggccctgagcctgaattttttgtttttgatgatgtgaagtggcaaattgatgaatcaggggcacagcacagcataagctccgaagcggcatcttggtcgtcaaataaagagtatgcttggggtaataatggtcaacgcccagctttaaaaggtggctatgcggtgactgcacccatggattattatcacgacatgcgtgcagttatgtgtgatcgtattgaagatatcatgggcgagggtcgtgtcgaggtgcatcatcatgaggtggcatcgggtcaacttgagattggtgtgtcttttaatactttggttaaaaaggccgatgaggttcagcaatttaagtatgtggtgcaaaatgtcgctaatcaatttggtaaaacagcaacctttatgccaaaaccgattgttggtgataatggttctggcatgcatgtacatatttccatctcaaaagagggtgtgaatactttttctggagatgagtacgctggcttgtcaatgacggcattgtattttattggtggtattattaaacacgctcgtgcgttaaatgccatcaccaacccaaccgtcaatagctataagcgtttggtaccacattttgaggcaccgattaaattggcgtattcagcatcaaaccgctcggcgtccattcgcattccacatgtctctagcccaaaagcggtgcgtattgaggcccgtttcccagatcctgcagcaaatccttatttgtgttttgcggcattgttgatggcaggcattgatggtattgaaaataagattgacccaggcgaggcagctgataaaaacttgtatgatttgccaccagaagaagaagcattgattccgactgtggcagaaaatctagaaactgccttaaaagctttaaaacaagatcatgcttttttattaaaaggtgatgtgtttagcaaagatatgattgatgcttatattgatctaaaaatgcaagaagttcataaattaaatgaagcggtgcatccgcttgaatttgatttatattatcgctgctaa

SEQ ID NO: 487 - DNA, 768 bp, M.catarrhalis
accatgatacaaaattttgtcatcagtgtaaaaactgccacaaaaagaagagaacatattatgtgtgaatttggcaaacaaggcattgcctttgagttttttgatgcagtaacacccactgatattagcaagtacgcccaaaagctttcaatcccaatcatcaacaaccaaagactcaccgatggcgaaaaagcctgctttttaagccatgtagcactatggcaacagatgattgatgaaaacttggattatatggcaatttttgaggacgatgtctatttggggaatgactctcaacaattcttacaagaactgacaatttggctacaacaaaatgccgttgatgtcattaaacttgaaacttgggtggaaaaaatacacataaaaaaagccgttactgttcttaatcatcgacagctttgcccattaaaaacttttcatacaggcactgcaggttatgtcatttctcaacaaggtgcaaaaataatacttgattatttatcaacactagatgcttttgaattttttccaattgaccatgtgatttttgatgccatcattagtaagatgagcgtcttacaagtcaatcctgccatggtcattcaagcccatttagtatcagaagatgacacatttaaaagtttgatagaaactcaaagaaagcaaaatgttaatcagcatcgaagacgcactttagctgattatggcaaaaaatactatcgaagcattggtaagcgtactttttttcaaagaatcgcttttcagtaa

SEQ ID NO: 488 - DNA, 1065 bp, M.catarrhalis
tatcaccaacagttgagaaaatttatgagcgatgtacgccacactcagatgatggaatttttaaatgcaaatttggcgaccgactttcgtgtagaaagcttatcgggagatgccagttttcgtcgttaccaccgcatttatttacccatgcgtggcgaggtgggcggtcatgagatgacatatcttttgatggatgcaccacctgataaagaaagtattcaagattttatccatgtggcaggtatcatgagcgaaacggtaaatgtacctgatattatggcgtgtgatgaagcgatgggatttttgcttttacaggattttggtacggtggagtttgcccatgccattgccaaagacactgataacaaagatggctattacaccaaggcgttacagacattggctcagctacagacgattaagggagctgatttgcctaagtatagtaatgaaaaattagcccaagaaatggacttatttagcgagtggtttttaccttatttgggaattgggctaactcagaaagatgctcaaaaatgggaaagtttaaaacaaacactcatcatgcagattaataagcagcctcaagtgattgtacatcgtgattaccacagtcgtaatttgatgatggataagggcagtgatcatcttggtgtgattgattttcaagatgcggtgattggtgcgtatacttatgatttggtcagtctggtgcgagatgcatatattgattataatgaggtgtgggcccaaaagcgtatgcatgaattttatcaattgattaaacccagcgttgatttgggaacttttatttcacaaaccaatataatgggcatacagcgtcatttgaaagttttggggatttttattcgcttgtcagagcgtgatggcaagcaccgctatcttaaaaacatccccaaggtaatgagcgacttggtggctgagctgtcttggctgtctgagcgtagtcatgatgcgatttatggtgaatttatggcatggcttaaaaatagcgtactacctgcttatagcaccaaatttgggtacttatcggagcggttatga

SEQ ID NO: 489 - DNA, 183 bp, M.catarrhalis
aagattatccttagtatttggtgcaatcttatgacccttatgagagatatagagcagatcctaaggatggcttggttagtgctggcggatttggatctgagagttactctgactgattggtatcatttggcgggagatcttgaggagtttgtatattttgctgttgattgtgtggatatgtga

SEQ ID NO: 490 - DNA, 243 bp, M.catarrhalis
ccatcaaccaaaacttcggttgcattgcctgaaccaacaatcgcaggcacgcccaattctcgtgcgataatggcagcatggcaagtgcgtccgccacggttggtgataatcgcactggcacgcttcatcacaggttcccagtcagggtctgtcatatcagagaccaacacatcgccatcttgcactttgctcatttcagttaagttggtcacgatgcgtactttaccactgccgacacgctga

SEQ ID NO: 491 - DNA, 1041 bp, M.catarrhalis
ccaagaaccaagcgtaacacagaatctacccacccaatttcatttggtggcttgaccatgaaaattttacatgtattattaacttcattgccgataccaccgaatgattatggcggtacagaaagagtattatgggcattgtatcaagggcaaactgccttggggcatcaggtgcgttttttactcaaagccaatgccaatcatgcaccttatgtgcaggtttttgatgagtcaaagccattacatgagcaaattgatgactgggcggatatggtgcattttcactttccttatgaaggtgagttacataaaccttttgtttgcacagaacacagtaacagtgaagttgaaaaagagtttccaatcaacaccatttatctgtcttctaaacatgccgaaaataatcacgcaacttgttatgtgcataatggattatactggcctgattatggcgagccaaattttaagccaaaagattactgccattttttagccaaagcatcttggcgtattaagaacttacaaggtgctgtacgcattgcaaaaaaagcaaacaaaccattgcatattttggggggcaatcgctttaatatccgtcgcaatccctattgttatttatcttcacggttgcattttcatggaatggttggcggagtaaagaaaaatgagctaattgccaactcacaagcattaatctttcctgtgttgtggcatgagccttttgggcttgcagtcattgaaagcctatatttgggctgtcctgtgtttgccacaccttttggggcaatgtccgatattgttacccaagaagtggggcttttgtcagatagttatgcggttttaagtgaagcccttaaagatgtggcacaatttgaccgccttgcgtgccatgaacatgctaagagacattttagtcatttgtctatgtcaaacgcttatttagactgttatgaaaaagttttggcaggtgagactttaaatgcagtcaaaccaaaagcaaagcctgatattaaagcaagacagatgatgcaagatggttga

SEQ ID NO: 492 - DNA, 2436 bp, M.catarrhalis
catcatgccaaagtttttgttcaccaatcggagctaactatgaacaagcaagtccaagtcattacctttaatcaacttggtaaaaatgatgttgacattgtcggcggtaaaaatgcctcattgggcgagatgattagccatttgggcggcttgggcgttaatgtgcctaatggttttgcaaccacggcagatgcgtttaaccgctttttgaatgaaacaggcttgcttgataaaatcaataccgaacttaagggtttggatgtcgatgatgtggatttattaacccaaataggtgccaaaatccgtagctggattatcgaacaagagctaccaaaagatttagaaaatgaaattcgtaccgcttttgcagaattatccaaaggtgaagatatcgccgttgctgtacgctcgtcagccacggctgaggatttgcccgacgcctcttttgcaggtcaacaagaaacctttttgaacattcgtggtattgataatgtgcttatcgccatcaaagaggtctttgccagtctttataatgatcgtgcgattgcctatcgtgtgcataaaggttttgagcatgcaggcgtggcgttgtccgcaggcattcagcgtatggtgcgttcagaaacgggtacttctggcgtcatgtttacgcttgacaccgagtcaggctttaatgaagtggtgtttatcacagcaagctatggcttaggcgagatggtcgtccaaggggcggtcaatccggatgaattttatttatcaaaagtattgcttgaacaaaatcgccctgcagttatacgccgtaatttgggttctaaacaaaagaaaatgatttatggcgatgaaggcagtaccaccaaatcgaccaaaattgtcgatgttgataaagctgagcgtcatcaatttgctttaagcagtgaagagctaacccgccttgccaaacaagccatgattattgaaaaacattacggttgtccgatggatattgaatgggcaaaagatggcgatagtggtgaaatctttatcgtacaagctcgtcctgagacagttaaatctcgtcaagacaaaaaccacatggaacgctatgtcatcaactcaaaaggtgctaaagtcttgacagaagggcgttcaattggtcagcgtgtcggcagtggtaaagtacgcatcgtgaccaacttaactgaaatgagcaaagtgcaagatggcgatgtgttggtctctgatatgacagaccctgactgggaacctgtgatgaagcgtgccagtgcgattatcaccaaccgtggcggacgcacttgccatgctgccattatcgcacgagaattgggcgtgcctgcgattgttggttcaggcaatgcaaccgaagttttggttgatggtcatgaggtgacagtttcttgtgcagagggcgatactggctttatttatgaaggcattttggattatgaagttcagcgtaattcaatcagcaccatgcccgaacttgcctttaagattatgatgaatgtgggtaaccccgaccgtgcctttggctttgcacagattcccaaccaaggcgtgggtttggctcgacttgaattcatcatcaatcgcatgattggcgtacatccaaaagctttattaaaccttgatacgctaccacaagaaaccgtgcaagccgttcaagaacggatggcaggctataattctcctgtggaattttatatcaataaattgattgaaggcatctcaactttggcggtagcattccgtgataagcctgtgattgtgcgtatgagtgactttaagtcaaatgagtatgccaatttaattggtggtaagctgtatgaaccttcagaagaaaacccaatgcttggttttcgtggggcaagccgttatgtgtcagacaatttccgtgactgctttgaacttgaatgccgtgcgttaaaatatgtgcgtgatgacatgggcttgaccaatgttaaaattatgattccatttgtacgcacgacaggcgaagccaagcaagtgattgaactacttgaaaaaaatggcttaaagcgtggcgataatgagcttgaaattatcatgatgtgtgagttgccaaccaatgcagtgcttgccgatgaatttttaaaatattttgatggcttttcaattggatcaaatgatttaactcagctgacattaggtcttgatcgtgattctggtattgtgtcgcatttatttgatgagcgtgatcctgctgtcaaaaaaatgctaagcctagcgattgatgcctgcaataaggctggtaaatatgtgggtatctgcggtcaaggcccctcagaccatgccgatttggcctattggctgatggagcaaggtattgactcggtttctttaaatccagattcagtgcttgatacttggttctttttggcagataaaaataaccaaccagcagacgattacgcataa

SEQ ID NO: 493 - DNA, 501 bp, M.catarrhalis
attggctacaataattttttggcaaatgcagttaactttatgaccattcaaaccaccaaaaaagtcgctttgattaatgggcctaatttacatcttttgggtatccgagaacctgaaatttatggctcagttactctgacagatatcaccaatcgcttaacatctcaagcgatatcacatggaattgagctaatcgcttatcaatcaaatcacgaaggtgcgattgtcgatttcatcggtgagtgtgggcttttatcatccgatcctgttgacggtgttattattaaccctggggcttatacacatacttctgtggcgattcgtgacgctttatcagccatggataagccatttatcgaggtgcatttatcaaatattcactcgcgtgaaccttttcgtagtcactcttatttgtctgataaagcagttggtgttatctgcggtttaggtgacatgggttatacgatggcaatggactggtttatcaagcatcttaactag

SEQ ID NO: 494 - DNA, 609 bp, M.catarrhalis
aatatgtcaaattctgataccgtaaactttatccacgattacgaaatcctgtctaagcattatgccgaaatcatctcctcagcaggagaagatttgacccgtgatggattaattgacacaccaatgcgggctgccaaggcgtttggttatcttactcgtggctaccatcaggatttggcaaccgtggctaataatgccgtctttgattctgataatcctgagttagttttggtacaaaatattgaattttattcgctatgtgagcatcatctactacctttttatggggttgcccatgttggctatctgccagatggcaaagtattaggattatctaaagtggcacgcatcattgatatgtatgcacgccgtctacaaatccaagaaaacttaaccaagcaagtggccagtgctatcgaagagctgacgggttgccgtggtgttgcggttattatggatgcctgtcatatgtgcatgatgatgcgtggtgttggcaaacaacaatccaccacacgcaccaccagcatgttgggtgagtttaccaccaatcatgacgcacgccgtgaatttttggatgctgtacctcgccgaatgcccgcttttggttaa

SEQ ID NO: 495 - DNA, 1137 bp, M.catarrhalis
attatgacaaattcacacattgagcattctcaagcaaaaaccaccgacgagcaacatattgccgatgttcttttgggtaagtccgttcatataacagaagatggcgatgatggattaccgccagatgatgagcctcatgagcttgatgatggtatcacatctggtcgatttaaaaaattacaaaaaaagctaagaaaagaggtttcttgggcaattcgcgattttaagatgattgaagatggcgatgttgtcatggtgtgcatttctggcggtaaagacagcttcactttgctggatattttgttattcttaaaacgcattgcaccgattcattttgaggtagtggcggtcaatcttgaccaaaaacaacccggattccccgaagaagtattaccacgctacttgtcagagcaaggcattccttattatattctagaaaaagatacttacagtatcgtcaaatctgttgtaccagagggcaaaacttattgttcagcttgctcacgcctacgccgtggttcactttatgggtttgccaagcaaattggtgcaaccaaagtggcacttggtcatcatcgtgatgacattttggcaacttttttcttaaacttatttcatgggggtagtttaaaagccatgccgcccaaactgctatcagatgataagcaaaatatactcattcgcccactggcgtatgttgccgaaaaagatattattagatatgccaattataaaaaattccccattattccttgtaatttgtgtggctcacaagaaaatctacagcgtgccatgattaatgatatgttgcgtgagtgggataatgcccaccccaagcgtttggcaagcatgtttaaagccttgcaaaatgttgcaccaagccagcttgctgaccgaaatttatttgattttgagcatttaacgcttgatcgtaatgatgatgagcgtttatttgagggcgataatatccaatcaggtgtgactgatgagcttgataaaatgggcctgccaatcaatcctttggttcaaagctttaatccaaaatttcagcaagaaggcgataattctgatgagcgtcagaagacagatcaaaaagataagccgtataaaatccctataatcaacccattggtataa

SEQ ID NO: 496 - DNA, 510 bp, M.catarrhalis
aatttaatgaaactcatcttttttgcaaatgttgtatttatcatggtcatgttggtggcttgtggtgatgaacctgctgtatcaacatcagccaagacagcaacaacagatcccaaacaagacttttatatcggctgctataccattgacaaaaatacgcctgccagtattaagatcagtcaagcacaaggcggctacaagatgcaaatgaaagaaccaaacgatgccgccaaagcttgggatacaccagagccactgcttgtactcaccaaacaagatggctggaagtatttttctaccaatgccatcaatttatcagtcaatgatatcaccgatcaggttatcgtaagacctgacgggctattggttatcgctaagctgcatgatgccagtacgaacaccaatcccatgcttgatagtcgctatgctgttgccttaatgggtgcggtaaataccatctaccaagtcgcttgtgatgataaacgcattaatttaatacaagcgttttaa

SEQ ID NO: 497 - DNA, 324 bp, M.catarrhalis
agggtaaggaaaaatggtatgggatttttaggttatttgttgatgggtggcattgtttataccattggtttttttattaatcttaaacgattacaccccaagcgtcaggcgggtgcggtcatttgtgtcacacacccaatcatgattggttatttgctgggatgttttatgattatgcttggtgtgtcggtattgcttgggcgatttgtattacatcatgatgggccagattgggcgtttattggcgtgaatagtttggtggcaacagtcgtattttattttggtctaaatcctgacacgaccaagatgaatctgcctgattga

SEQ ID NO: 498 - DNA, 507 bp, M.catarrhalis
aataatgatgagatggcaatcataatgacaaatcaaatttcacaaaccatggaaaattgccaaacgatgaatattgcagaatgcctatcatttgttgatgattgggtatatcaggcgtctgattccgatgaaaaggccaccctatcaattttacatgacctgttttttcagaaaaataatggccctggtgataaaaccctaaatgaaccacttgcttcaagccttttttcagttaaatggattctgcaacatttaagagactttgcccagcaggtaaaacgggccatttgggcggcgattttaaccccaattttcaaaaaggggcccgtctttcagggattaacccgccacggtccaaccctttgtgaagggagacttatgcccccaaagccacaggttttttccggtataacccccccaaaaaacaaggagattgggggccccaaaaagacgctgtttaccggttgggacccttcccccgcccatttcaaaaagacccacaaataa

SEQ ID NO: 499 - DNA, 183 bp, M.catarrhalis
tttgagcaagatacctatcagcgactggcatatatgaccaatgccaaggttcagaattatatccatgttgtctaccatcgtcataagtttgacaaaatccatatttgggtgcattattttgcagccaattataaacctttacaccttcttttgatttccaataggccgtttccacactattaa

SEQ ID NO: 500 - DNA, 906 bp, M.catarrhalis
gtttacatttgtactaattatatcccacattttaaaattctatgctataatggcaaaaatttctatcaaaaggataaagtcatgttactaaaaggtcagcgttttgtggtgactggaattgccagtaaattatcaattgcttgggcgatcgctgaaagcttgcatcgtgagggggcgcagctgattttaacctatccgaatgataaaattaaaaagcgtgtggatatggctgccgaagcatttgatgcggtggcggtgattgagtgtgatgttggctcagatgagtcgattcaagtgtgttttgatgaaatcgccaaacattggggcgtaggtgacgataaaggcattgatggcattgtgcatgccatcggttttgcccctgccgatcagcttgatggcgattttacccaagcaaccactcgtgaaggcagtcaaattgcccatgatatctcaagctacagttttgtcgcacttgccaaagcagggcgtgaattacttgctgcacgccaaggctcactgttgactttaacttatgaaggcagtatttctgtattgccaaactataatgtcatgggcatggcaaaagcaagcctagaagcttcggtacgctatttggcatcatcattgggtggtgagggcattcgtgtcaatgccatcagtgcaggccctatccgcacgctggccgccagtggtattaaatcatttcgccgtatgcttgatgttagcgaaaaaatcgcaccacttgggcgtaatgtcagccaagaagaagtgggtaatgctgcgctgtttttgttatcaccttgggcaagcggtattactggcgagattttatttgtggatgcaggctttaataccgttgccatcagtgaaaaaatcatgatgatggcaggcgacggcgaacaataa

SEQ ID NO: 501 - DNA, 750 bp, M.catarrhalis
caccaaatttgggtacttatcggagcggttatgattcagcaagcgatgattttggcagcaggtaaaggcacccgtatgcgtccattgacgctcacaaagcctaaacctctgattccaattgctggtaagccgctgattgtatggcatatcgagcgtttggcgacggcaggtgtacaccgcattgtcatcaataccagctatctatctgaggtgttactcacagaacttaagacactcaatttatctaaaaaatttggcattgagattttactttctattgaacaaggtgagccacttgagactgcaggcggtattagatttgctttggatcaaggtttgttgtgtgatttgccatttattttgattaatggtgatatttggacggaatttgagtttgatcggctggttcatcatcagcttaataagcatttggcacatctaatcttggtggataatcccaagcatcatcctgagggtgattttgggctaatcaaagaaaaagtatgcttaaaaagtgatgatcataccgcattaacctttgcagggatgagcgtcatgtcgcctaaaatcgtggcatcactgaaccaagggcaaattgcaccactggcaccctatttaaaatctgccatcaatcagcagttggtgagtggcgagcatatgacagatcactggatggatgttggcacgcttgataggcttgccaagaccgaagcctatgtccaaaataaatatgccaatgctaaaaaataa

SEQ ID NO: 502 - DNA, 939 bp, M.catarrhalis
ttgccatcttgtactttggggtattttatgattgtccgagataaatcaaacagtttcaaactactatttgcatggcgtggcacagtgctacccaaagtgttgccaacgatattaggtatcatggtactgtctttcatcgctggttttgtggcacagtttcagtggtattatattgccaccgtgcctgcggttggctttacgatgtttggtgtcatcatctctatttttttgggatttcgtaataatgcttgctatgatcgatggtgggagggtcgtaagctttggggtgctttggttgctaatacgcgtcatctaagccgtgatagccattttttagcaccaaatgagcgagaatcactactgtatcagatgctactatttgtggcgatacttcgtgatcggttgcgtggacaaaatatccagcgatcacagtttggctacacgaagattgatgatcattatttggattggcttgatcaacagatcaatgcaccgcaacgagttttggaggcgatgcagcaacaattaataaaattagttcagcaaggtcaaatgagtgatgtcatttatatgacaatccaaaaacatgtgattgaaatggggggcattcaagcgggctgcgatcgtattcatagcacgccattgccatttccttactcagcactactgaatcggccggtatattgtttttgttgggctctgccgtttggtttgcaagccgtcatgggtttttggacaccggtattggttgggtttatttcttatttattgcttgggctagacgagctggcacggcaactagaagagccttttggctttgaccatcatgatttggcacttgatatgatggtgagaatgattgagcgtgaaaccttgatgctgatggataagccactgcctaagccgtgggagattgataagaattttaatatgagctaa

SEQ ID NO: 503 - DNA, 663 bp, M.catarrhalis
ttgccccatcgattttgtctgctgattttgccgggccttggagcggatattaagagcgttcttgaagctggtgcagatgttgtgcattttgatgtgatggataaccactatgtaccaaatctaacttttggttcgatgatttgtcaagcattaaaagactatggcatcactgcacccattgatgtacatttgatggttaagccagttgatggtatgattgagcagtttttaaaggtgggggctgacatcatcacttttcatcccgaagccagtgagcatatagacagaagccttcagctgattaaagatggtggtgccaaatgtggtttggtctttaatcctgcaacacctttatattatttggatcatacattggataaggttgatcaaattttgctgatgagtgtcaatccaggttttggtggtcaaaagtttattgatgcaacattagataaattagcagctgtgcgtcaaatgattgtcgatagtggtcgagacattcgcttggaagttgatggcggtgtcaatgtggcaaatattcgcaccattggtgaagcgggtgctgatatgtttgtggcagggtcggcgatttttaatcagcctaattataaggctgtaattgatgccatgcgtgatgagttatcaaaggtaaatcgatcatga

SEQ ID NO: 504 - DNA, 195 bp, M.catarrhalis
ataactatttttattatttttttagtaataataatatatgatgatatcattagtttttattatgatatattagtacgcagcatcactgtgattgtcataaaaaaaatcgcactcacaagtgcgatcagcgtcaaaaagtatcaaaattttacgcagtcaatcaggcagattcatcttggtcgtgtcaggatttag

SEQ ID NO: 505 - DNA, 1389 bp, M.catarrhalis
caacccaagcttattagcgtcaaattttctctgaaaaataaaagcagatgcggtaaaataaaccatattttaccgcatctgactattatgaccattcaaaatcatccagcagacaatccaccaagctcatgggcttatccaaaatcccaaataaaacaatatgatattgccattatcggtgctggtgttgtcggtatggtctgtgccattttacttgccaaaagaggcaagcaggttatcattttggataataagcccgctcccagcaaggcatcgtttgatcagcgattgactcagcgagatgccagagtctatgcactcaatcttagcagtatcgatttattaaaaagtgccgatgtatgggacggtatcaccagacgcgccgattatgaccaaatgcatgtatgggcgagagatgattttggtgaattgatttttcaagatgaacacgcctttgaaaatatcatgcttgggtctatggttgagccatcagtattggatgaagcactttggcatcgtgcaaaagcttatgaaaatttaactttaaaatatgagatcagcttggcggctcatggcatggcttttgatgagatgcctgacggtgtgtgcatacgctatcaagctgacaatcaagccaagatggtgaaggctaagctattgattggtgccgatggccgtgcgtctttggtacgccgtgagatgggggtgggggtagataccttaaattatcaccaaaaagccatctgctgtgccatacgaaccgatcagccacatggtaacacagcacgccaagtgatgttgccaacaggcactttggcactattacccattgccaatctcaatcaagatgatcaatgccgatggcagtcgattgtttggacattgcccaagcagattgcagagacatatttgagcgactaccaccaaaatcctgatagcctaatcaataggctggctttggcaagcggctatgtacttggggatattcataagatacagtcggtcgcaagttttccactgtctgcacaagccgccaatcgctatcataagggtttaatcgcactgatgggtgatgctgcacatgaggtacatccgttggcaggacaggggcttaacttgggcttatctgatgtgaaggcattgctggcattggtagatgtgtatcatgccaaaaatatgcccttaagcacacgcttattaagcgattatgaacgcacggtcaaagggcataattcgctgatgatgcatagcttttctatgattaattttgcttatacatcagcactgagtaatatttctgtgatacgccatgcacgcagtgagattgtcaaggcgatttctaagtcaccatccgtcatgcgtctgctgattgggcgggccaatcgctaa

SEQ ID NO: 506 - DNA, 750 bp, M.catarrhalis
gtgaaaatcagcaaattgataaaaaatggtttagtttttggtaactttggcgtaaaattagataaatttttattggaaatagtcatgaccgcaaccgatccaaaacttactcaaaaaaaatctgctgccaaagctgctttaagccatattgaagatggcatgattttaggtgttggtacaggcagtacagtcaattgcctgattgagcttttaccaaaagtgcgtcttaagggtgcagttgccagctcacaggttaccgaggataaattaaaggccttgggtattgagatttatgatttaaatcaattgggtgtgctggatttatatatagatggtgctgacgagattgacgctaaaggcaatatgattaaaggtggtggtggtgcattgacacgagaaaaaatcgttgccgccgcctcaaatcggtttatttgtatggtagatgactcaaaaatcgtcaatacactgggcaaattccctgttgcaattgaagttttgcctcaagcgcgttcttatgtggcgcgtgaattggtggcaatgggtggcgatcctgtatatcgtgaagggtttgtgacagattatggcaatgtcattttggatacctatgaccttgatattaccgatgctgccaagatggagttcaccttaaataatatcgtgggtgtggtttgccatggtatatttgcatcgcagtcagcggatctaatgctaaaagctggcagcacaggcgtggacactgttgtattttaa

SEQ ID NO: 507 - DNA, 1293 bp, M.catarrhalis
ccaaccagcagacgattacgcataaattcatctaatttcacacccttgaggtatgttaccttaagggttttgtgcttatttttcctgcttgattgtattttattgtatttaactttattcataagccgtacgatattcgtcatgacgacaccaaaaatcgctgaattttttgaaagaattttaaaagagctataccaaaatatctaccaactgtttggcggatcgttggatgatcaaaagctaaccttagcacacatcggcttatcgatattaagtagcggcattaaaatcatcattttacttctgctggtgggatttatctattggtttttggtttataccgttaaaactgtacgaaaattatttggtctgccttatcgctatacgcgtatcgctcgtgcgactttgcgatacttatggtttatgaccagcttgcttgcggtcatgtcacaaattggcatcactgataaaactgtcacagccacagccaaagcagcaacatgggcgggtttttattatgtgctttgggcgttgagtggtcaaatggtcagcagtgtactaaagcattatgatttgaatgcttccattgaacagcttttaaaaaatctactactggtcatgatactggcacttgcttttgccacagtcatggcaaaatttggctttgatatattttccattgtcgcaggtttgggtattgctggtcttgcggttggctgggcgtctcaaagcacccttgctaattttatcgctggtgtcgtgattttggttgaacagtcgtttcaagttggtgattggattcgcttgggtgaaaaagaaggtcgtgtggttaaaatctccttgcgagctacccaaattcttgaccgtgataatatcattattatcattccaaattcaacggttgcctcatccgaggtcgttaatttaacttccaaaaaaatgattcgctttgatgttaaaactcgcatcggattacacgcagacatcacagcagccagaagtgtgattatgaaaacactacaaaaagatgaagtggtcttaaaacatcctgcaccacttgcgacagtatcagagattggtgagtctggtatttatttgattgtgcgtttttgggtagcaccactttcggtcgctagaattccaatcattaaagaaaatatcaatgaaaaaatcaagcgagcgcttgatgaatcaggtattgaggtgccatttccttatatgaagctgatcatgactgcagacggtgatcaagcacagcggttcaaatttgaagatgatgaacaaaaaatttaa

SEQ ID NO: 508 - DNA, 1884 bp, M.catarrhalis
atccaatttggaaagtcaatgctacacaaccttacctttggtctgttttctaaaaaagacaccgcaagttttatgcaactgatggtttatgttaaaccttataaaatgcgtatcatgtttgctttacttgctattattggagtggcattcacagaaagctatttagcggcattcattgcaccacttgtcaaccaaggttttgttttacctgacggtacagatatgcccatgctgattggcgatggtatattagaaaatcttaagtattatatagatagttttcagcatgccatttggggtaccaagcataaagtttgggttgttccgctattttttatgagtttggtcatttttcgtggtatttgtcgttttatcagtgcttatctgatggcatgggtagccacgactgcgattggtcatctgcgacaagatatgtttgataaaatgttgttattgccatcagagcagtaccaaagtatgtcatcgggcgaaatgttgatgaacatggtacaaatggtagaaaattccatcaatcatgccagtggcatttttattgttttaacacgagataccttgattgtcattgggctggtttgtgtactgttttatttaaactggcaacttgccttactgatcatggtcatgtttccaattttatcggggttatcacgctattaccgtaatcgtctaaaaggtgtcattaataacgcccaaaaaagtatcggttctttaaataccgtgattaatgaaacccatcaaggtcatcgggtcattaagctgtttggtgggcaacaacactcagccaataaatttaatcaagtcaatacgctcatcgttcaacttggcaaaaaaatcagtcaagcagatgctgcacgctctcccatcagtgaagttgttggctcaaccgctttggcagtggtgatattttttgccttatggcaaagtcagcaaggtatgacgaccattggcgaattcatggcatttattgtggcaatgatgcaaatgtttggtcctattaaaaatcttgctaatatcagcataccgatgcagacaatgtttctggcagccgattcggtgtgtgcttttttggataccaaatccgagaccgaccaaggtacaaccaagcttagcaatgtccaaggttatattcattttaatcatatcagcgtacagtatggtaatgaaacaaccaaagctttggatgattttaatcttaatatccgccctggcgaaaaaatcgcttttgttgggcgatcaggctctggtaagacaactgccatcaatctactaccacgctttatcaatcctgttgctggtgagattttgttggataatattaatattcaagaagtcaaccttgctaatctaagaagccagtttgccttagtctctcaagagatttttttgtttgatgataccttatttgaaaatgtgcgttattcacgcccagctgcgaccgaaatggaggtgatggcagctttgcaggccgccaatctcagcgaactggttcataaacaccccaaaggcatacatcaaccgatcggtactaatggcagtcttttatcaggaggtcagcgtcagcgggtatccattgcacgcgccatcttaaaggatgcgccaattttgctactagatgaggcaaccagcgcgcttgataatgagtctgagcgtcttgtacagcaagcacttgagcgtctcatgacaggacgcaccagcatcattgtggcacaccgcttaagcaccatcgaacaagctgaccgtatcatcgtcatggacggtggaaaaatcatcgaagaaggctcacatacggagcttttggcaaaaggtggatattatgccatgttgcacaatacctcaaatgcgatttgtggtcaatcgatttga

SEQ ID NO: 509 - DNA, 195 bp, M.catarrhalis
caattaaatggtatgggggatcataccaaaaattggatatttggaccaatgtttgatgtcattggcacaattttgctcactaccaacttaactttttatgaaagttttaaatcgttgttattgttcgccgtcgcctgccatcatcatgattttttcactgatggcaacggtattaaagcctgcatccacaaataa

SEQ ID NO: 510 - DNA, 375 bp, M.catarrhalis
gttatcaaaggtaaatcgatcatgaccataccgcaccatcaagcccaaaccacgcatcacaaccccccaaaacccaacaaacccgccagcgtcgtaccgatgggttttaccatagggctatgtttggcaagtttgctattaagcttggcaggctatggatttcgattgatgtttggtgatgagatgtctgaggtattgcgtcatgctgctgtcgttgtgcctgtatttgtgattggcattccgctgatgacttggcttggtgcaactggactaaataaactgggtaaaaccaatatccaccctagaaatgcttggacttttggttggttattatcgactgttgcgatgttatccattatgggagtgtatagctga

SEQ ID NO: 511 - DNA, 1578 bp, M.catarrhalis
ggattatttatgtcaaaaaaacccaaaaccacccaagataccgacccagtcgccttgattgaaaccgctccacaaacaaaaaaatctcaaacttttgagcatgtagagaacgatcaaacccatcctagtctcatcagtcctttagatggtcagcgtgtgggtttggatcgctccaataaaaacaaaataaagcacaattatgaatatgatgccatcgtcattggtgcaggccctgctggtgaagcggctgcaatgaaacttgctaagtctgggcatcgtgttgccgtcatcgatccgcgtgaccaagtcggtggtaattgtgcacatgttggtactattccaagtaaggcactgcgtcagtctgtttttaatattattaactttcgccgagatcctttgtttaaacaaaataaagatagctatcaagttccactaagtaaagtcttaagtcgtgcgcgtgaagttatccgtcatcaggtcaatacgcataagcttttttatgagcgtaaccaaattcaagtcattcatggttggggcagttttattgatgcacatacgctagaggtgtacatcaatgatcaggagcctaccaaaaccattacctttaatcaggcaatcattgcggttggttctcgtccttatcgccctgagattttagatttcgatcatccacgcgtctttgactctgataaaatcctacaaatggattatattgcccgcaaaatcatcatctatggtgctggtgtcattggctgtgagtatgcctctatttttacaggtttaggctatgtggttgatttaattaataataaagatcagcttttgagctacttagataaagaaatttctgatgcactaagccatgacttccgtcaatttggcgtacgcattcgtaaccacgaagaaatcgatcaccttgaaacgcatgatgactgcgtggtattacatctaaaaagcggtaaaaaaatcaaagccgacgctatcttatggtgtaatggccgctcgggtaataccgatagcctaaacctagaagcggttgggcttaccgcaaatagccgtggtcagcttgaagtggacaaaacctaccgtaccagcataccacatatttatgctgtgggcgatgtcatcggctggccatcattggcttcggcagcctacgaccaagggcgtaatgcagcagggtttatggtaggtgatgaagatgctgagtttgtcaatagcgtcccaactggcatttataccattcctgaaatctcaagcattggtaaaactgaagctgagctgaccgccgaaaaaacaccttatgaagttgggcaggctttttttaagcacttggcacgctcacagattattggcgagcgttcaggtgtcttaaaaatcctatttcaccgtgaaacacttgagcttcttggtatccattgctatggtaaccatgcttctgaaattattcatattgggcaggcagtcatgaaatgtggtcatacgcttgaatattttatcaataccacatttaattatccaaccatggcagaggcctatcgtgttgctgccttaaatgggatgaaccgaattttttag

SEQ ID NO: 512 - DNA, 285 bp, M.catarrhalis
gctgatgatatgatgaaaccatcagcctcttttggtaatgaagtagctcagtttgttgagcatttaaggaaaattgttatgtctaaagaacaaggtgttgtaaagtggtttaatgacgccaaagggtttgggtttattcagcgtgagactggcgaagatgtttttgtgcattttcgtgcaattcaaggggaaggctatcgctcactaaaagaaggtcaagcggtagaatttgtcgtaacaactggcgataaaggtctacaggctgaagaagttaccaaattgtaa

SEQ ID NO: 513 - DNA, 876 bp, M.catarrhalis
agtactgacatgtatgtccacacgcccacacctgctcaacaagaaaaacagtcaaatatccgaagtgctttttttatttctgatgggacagcgatcaccgctgaaaccttgggaaaatcattgctaagtcagtttagcgatgtggaatttgacattcaggtcattccttatgttgatacgccacttttagcgcgtgaagccgttcaacgcattaataacgcttatcaatccagcaatctacgccctttggtatttgataccattgtctcggatgatattcgtgaaattatcaatgctgccgatgcacacaatttagacatctatgaaggtttaatcaatcgtatcgccaccgaaatcaaccacaaacccaaccctcatactggcatggcacatagcagagttgattcagatgattataaggcacgcattgatgcggtgcattttgcgcttgataatgatgacggtgctcgtaccaaccattatgacggtgctgatattattttgattggtttatcacgctcaggcaaaacaccaacttctttatacttagcactacaatatggcatccgtgccgccaactaccctttaactgaagaagacttagacaccagtcaattgccaagagtgctaaaaccatatcaccataaactttttggtttgaccattgatacagaacgcctagtacgcatccgccaagaacgcaaagctggtagtcgctatgcaagtttggcacaatgtcaagaagaacaaagggccattcaagccatttatagtcaccaaaaaatccccagtttgaatgtctctgaaatgtctgttgaggagattgccacccgtattttacaaattacaggcctaaagcggcggattggtgtttaa

SEQ ID NO: 514 - DNA, 1107 bp, M.catarrhalis
agccaagtgatgatggtttgcaagatgattgaattgttttttaaaaaatttctgttaatatatgatgtaaattatcatttgtcaattttaggcttattgcactgctcatttatgaaaatattacatgttttactcactcgcatgcccattccaccgaccaaatatggcggcacagaaagagtattatgggcattgtatcaagggcaaactgccttggggcatgaagttaaatttttaaccaagcatgacaataagcaccctgatgctttggtgtttaatcctaatatcagccttgaaaaacaggtggaaggttgggcggacatcattcattttcattttttatatcgtggtgagattacgacaccttttgtctgcaccacacacaatcaacaaatcacacctgccagctttcccaaaaataccatttttttgggaaaattacacgcccagagaagcggtggtcaagcgtatgttcataatgggctgtattgggcagattatggccagccgaatttaaatacgccaaaaaattatgtacattttttggcaaatgcgaagtataaagataaaaatctcaaagatagtgttaccatcgcccgtcaagcaggcagaccgttacatgttatcggcagtaaacgctactctttaaaatataaagcaggcaagtatcaaccttattattaccaaggggctgatttgacattttatggtatgcttggtggggataaaaaaaatgaggtcattaaaaattcaagtgcattgctttttccagtacttaattatgaagcgtttgggcttgcgatgattgaaagcttatatttgggctgtcctgtcattggcagtcggtgtggttcattgccagagctgattatcccagaggtgggcattagcacccaaagcaaatcagagatggtagaggcaatcaaaaacatcgccatatttaatcgtaagcattgccatgaatacgctcaagataactttaatcatttggtcatgagtcaaaattatcttcactattatgataaagtactcaatggtgagtcgctacatgaccaagaaccaagcgtaacacagaatctacccacccaatttcatttggtggcttga

SEQ ID NO: 515 - DNA, 348 bp, M.catarrhalis
aatgtttttgttgataacagtaattttatcaaagtgactgtatcaaacaaagtagatatggtgtcaatatatcttcattttaagttcttgaacaaatgtttgttcgttcgttgtggtgcgtattatatagaaatttatcacagtgtcaaatactttttggataaattatttgatattttggataaattttataagttattgatatttaattggttattttttagcattggcatatttattttggacataggcttcggtcttggcaagcctatcaagcgtgccaacatccatccagtgatctgtcatatgctcgccactcaccaactgctgattgatggcagattttaa

SEQ ID NO: 516 - DNA, 1656 bp, M.catarrhalis
cttcccattgttcaatgtttcatcttcaacccattttctaagcttattatcatgaatacagccaagcggtaccgattatctgtcgtgatgattgtcaaaaacgaagctgacaatcttaaggtttctttgcctgccattgccgattgggtagatgaaatcatcattttagacagtggcagcaccgatgatggtcaaaaaattgcccaaagtcatggggcaaaatggcatgtcaataccgattggcaaggctttggcaggcagcgacagcttgcccaagcttatgccacaggcgactggattttggcattggacgctgatgaagtggtgacaccacagctcaaaaacagcattttaaaggtcatcaaaaacccccctaccgatacggtttatggcatcaaacggcttgattttgtctttgggcatcaaattgataatgccttatggggggttaaggcccattggcgactgtatcccaaaaagtttcaatatgacaacaacctagtgcatgaatctgtgatattaaatgacgcaacaaccaaaaaattaagtggttttttacaccaccacaccgcccccacgccactgttttggctaaataaacgcttagattatgccaaagcatgggcagatgacaggcacgctcaaggcaaaaagggcaagttttataaagttgtggttaatcctttatgggcatttattaaacaatacctacttgacggtcgattcttacaaggtcgttatgggctgatttattcattattttttacccaatatacatttaataaatatgcctgtctgtatgatttaacccacaaccaagccgaacacgcttttttacattcggtggcgatggcacaaaacttaaaacccattaatgtctcacaaaaaaaatccacgctgtcattggtgatgatttgtaaaaatgaaagtaaacatctaaaagcatgtctagagacggtgcatgatattgttgatgaaatcattgtgttagacagtggcagtactgataacactcgccaaatcgccgaaagttatggggcaaaatggcatgtcaataccgattggcaaggctttggcaaacagcgacagcttgcccaagcttatgccacaggcgattatgtgcttgtgcttgatgcggatgaacgccttgaccaacccttgcgacaagccattaccgatgtactcaaaaatcctgtgcaaaccgataaagtatttagtgtggcacgagttaataccttttgtggcattgaggtacaaccacgctggtggtatgccgacaaactatcacgactttatgcacgccaacattttcaatattctgatttaaaagtccacgaatcactcaatcaatatggcaagccaagcatggtattagatggttatcttaaacatttaaccaacgacaatttgcatcattttttattaaaaaatatccgatatagttacgattgggcaaaagataaattcacccacaacaaaaacacatcactcatcgctggtttttttcgggcggtattttcttttatccgagagtatgtcattcgtggcgacttattgggtggtgcttatggctatattcttgccatggcatcgatgggctataccctagataaatatatcatgctatggtggttaaacaataaggataaaccatga

SEQ ID NO: 517 - DNA, 1542 bp, M.catarrhalis
ggtttggctgtgattcgctctcgtattctttgtgcaagtttaatgcacaccgctcatcaccatcgctcaaagacatatttgactaccgctattcgttacgcactatttggtatcgccagtttgccatttgtcataccaacttatgcagaactcaataccagccgttcactgacagtcgttggtgctgacagctcaaaaaatttgcctgatacaccaaataccaaacccaatactgtcttagccttagacgcccatctacaaagtcatgatgatactgccaatgcctttgatggctttgattttgaagttatcacacagcaggcagccgagcagacaagcagtcaagcaaatcaaggcaatcatcagatgagtcagcttgacgcctttgctagtaagtcagacaatccaagtttaaacactgccaggctgacggataagcatgatacaccctctgccagtaaaagcttagccaaattagccgaaaactaccatattaagtccgatccagacgctcatcgttgtcagggtatgtggatgcagccaatccaccaagcaacacacacaaaccgccctaccaccccaaaactggatgaaaatggtaatccgattacagaagatggtatttttgctcaagctgattatggatattatgacgctcaaacttatgccgaactgtctggcaatgtcattatggaacaaaacggtcggcgtgtaaccgctgataagcttactttagacacccaaacagggcaagccactgcgtcaggtcaagtacaatttagtgatggcggtgcaagtgatcacagtgctggcattattggcatggctgaaaacttagtataccatacagatggtcagacagcgaccgcacaagatgttgcttttgcaagcactaccatcaatgctcacggttatgccagtcaaatggataaaataagcagtagcgaatatcggcttcaacatgtcatgttcaccacctgtccacccacagaacgcaaatggtacttagatactgatagcattgatatcaataccgatacaggtcgtgctatcgccaaaaataccaccttgcgtatcaaaaaagtacctgtcttttacctgccctattttaactttccgatcgatgctcgtcgctcttctggatttttattaccatcaatgggatttggtgcatcggacagttttgaaattagtacgccttattatctgaatttggcaccaaattatgatgcaaccattacgccaactgtatttactaaccgcaatcctatgctgactggcgaatttcgttatctgacccaagattatggatcaggggtgttgactgcttcgtaccttccaaaagatcagcaatatcatgataaagaccgtagccgaatacaatttgatcatacatggcaacccaagcagtttgatacaattaccacttacgcacaatatcaatctgtttctgatgccaattatttatcagactttaatgccttgggtgttgagagggctaagctgtcttcaccacgggggtggaaggacgacggtggtcta

SEQ ID NO: 518 - DNA, 213 bp, M.catarrhalis
ctattgacggttgggttggtgatggcatttaacgcacgagcgtgtttaataataccaccaataaaatacaatgccgtcattgacaagccagcgtactcatctccagaaaaagtattcacaccctcttttgagatggaaatatgtacatgcatgccagaaccattatcaccaacaatcggttttggcataaaggttgctgttttaccaaattga

SEQ ID NO: 519 - DNA, 984 bp, M.catarrhalis
tcacgaaaattttttgtaaaaatgttacaatgccgatttatttttactttgatgaatttggggaattggatgcagggaatcatcacattattacttattttaagtccaatgtttgttggttttgcactaccaacatcacaaaagttggccgcatttggtggacaagctctgacttatctgatttatcttattttgattgtcattggtattgagcttggtttggtggatgatttggtacaaaaggttggggatattatcaaatatttggttgtgttaatcacactgaccattggctttggagcgattagcttggttttttttgataaattcactcaaaaaaatcagttatctaaacacacactacccaaccaaaaacccaaaatcagcctaaggggcagtttggctcagctcatttgtttggcaattggatttatggctgctaaatttttgccagctggatttataccacctgaaaagacgaccaccatcctgctaatggcactattatttttggtgggtgtcagcctaaaaggatcagggattggattaaagcaagccttggtcaataaaacaggtctacaggtcagtgtcatatttattttttgtaccaccttatcaggcatcatttttgcaagcatttttcatgaagtcacgctgatgcagggtttggctttggcatcaggttatggctggtattcgctatcaggtacgattatgacagatgcttatggtgcggtttggggcagcgtcgccctgcttaatgacttggctcgtgaggtgattgccttaatctttatcccatgggtcatgcgttattcgacatctgtcgctgtgagtttaggcggtgtaaccagtcttgactttaccctaccaaccatcttacaggcgggtggtacacagattatgcccatcgccatcagctttggatttatcgttaatattgtatcacctgtgctaatggtgctgtttagctcatttggatga

SEQ ID NO: 520 - DNA, 198 bp, M.catarrhalis
ggcaaaacttcaattgcaacagggaatttgcccagtgtattgacgatttttgagtcatctaccatacaaataaaccgatttgaggcggcggcaacgattttttctcgtgtcaatgcaccaccaccacctttaatcatattgcctttagcgtcaatctcgtcagcaccatctatatataaatccagcacacccaattga

SEQ ID NO: 521 - DNA, 378 bp, M.catarrhalis
ctgatacataaggaaaatatcatgaaaaaacttgcctttagtcttattgtggctactgctggcatgatggctatttctgccaatgccatgagtccaaaaaccgtacaatatacctgccaaggtggtaaaagtgtcaatgttaaatacatctttaacgatgcagatttaccatctaaagccgttgctagcttctctggcaaaactgtcggtatgcccatcaatcttaacgcatcagatatgacaagctcaatttttggctttggtggttataccatgactgcagactatatcgatgccaagaactacaatcaagtcggtattgcagtcatcaccgacccaaagaacaaaactttgttcaaaaactgcaacccaagataa

SEQ ID NO: 522 - DNA, 498 bp, M.catarrhalis
ttattgataaaagtggaagctgagccaaatttatacacaaaaccgtttaaatttgagcttttaaataacaacatttggaggtattctatgaaaatcttagctttagcccctgcgactgccttggcacttgttggattcattggtgcagctcatgctcaagttgaccatgctcaagaagctcatgattctaccgtattaaagcgtcaagttacttatgcctgccaatcaggtgggcaagccaccgtaacttatggctttaaccaacaaagattgccaacttatgccagtgcttatgttgatggcaaaaaccgttttatgccatttaatttaaatcgttctgacaatgttgatagcgtttttggtgatgaaaataactacagcttgatgactgatgccatgacattgtataactatcacaaactaggcattaacatcacaagcccttctggtgattttgctcataaaggctgtaatgtcagatatgttacaaaactttaa

SEQ ID NO: 523 - DNA, 2100 bp, M.catarrhalis
gggtgtttaagttttattcttaaaaacgccatttcacataacaaacaaaggacccatgttatgaaaaaaacgaagttatttgccacagtaggggcagcagtattatcggcatctattttagctgcatgcagcaataataccacgacagcatcacaaggtggcggtgatttgaccacctataaatatgtgttttcaggtgacccaaaatctttagactatatcttagccaaccaagttgttactgccgatgttaccactcagatggttgatggtttgctagaaaatgatgaatatggcaaccttgtcccttctttggcgactgattggagcgtttcagaagatggattaacttatacctacaccttgcgtgatggggtattttggtacacttcagatggcgaagaatatgcgcccgttactgcccatgactttgtgacaggtctaaaacatgccgttgacggtaaatctgatgcactttatgtggttgaagattctgcgaaaaacctaaaagcctatacagaaggtaaagtgaattggaaagaggttgtcgttaaggctttagatgataaaactgtacaatacacgctaaaccaaccagaatcatattggaattctaaagggacctatggcgacctattccctgtgaatgctaagtttttacaatctaaaggtaaagattttggtgctttagatccttcatctattttggtcaatggtgcttactttttaagtgcctatgcatcaaaatctttgatggaatttactaaaaatgataattattgggatgctgacaatgttcatgtacagtctgtcaagctaacctataccgatggctcagatcctggttcgtattatcgtaactttgataaaggcgagtttagcgttgcacgcttatatccaaatgacccaacttaccaagctgccagtgaaaaatatcaagataacatcgtttatggcttgatagatggtacaacttattatttcacctttaacctaaatcgttctgcttttgccaatagcacaaaaacgccagagcaacaagaatctgccaaaaaggcaatgctgaacaaagatttccgtcaagcggttatgtttgcacttgatcgtgcagcttatcaagcacaaactgtcggtgaggaagccaaaaccaaggccttgcgtaatatgctggtaccgccaacttttgtgtctgccgatggtgaagactttgggcaaatggtgaaaaaagacttggtaggctatggtacggaatggcaagatgtcgatttgtcagatagccaagatggtctatacaatccacaaaaagccaaagaagagtttgctaaagccagacaaactttagaagctcaaggcgtgactttccctatctatttggattttccaattgaccaagcagattcgaacagagttcagcaagctcaatcattcaagcaatcggttgaggcctcattgggtcaagaaaatatcattatcaatgtcattgaaaccgagacctcaacttatgagtctcaaggctactatgctgaatcgccagagcagcaagattatgatattatgatggcaggttggggcccggattatcaagatccacgcacctatttggatatcatgagtcctattgatggtgccatgctacaaaaaacaggtatccacagaggtggcgataaagctttagttaaacaagttggtttggatacttatcaaacactgcttaatcaggcatcggtcatctctaatgataacagtgcgcgttataatgcctatgccaaagcacaggcattactgattgacagtgctttacaaatcccaatggttgctattggtggtgtaccaagagtttctaaaggcgtaccatttagcggatcattttcttgggcgggcaataaaggcggtagctggtataagagattaaaactacaagcacagcctatcacgactgagcaatatgagaaagcctatcaagcatggcaaagtgaaaaatcggcttctaatgccaaatatgctgacagccttgttaatcgtgtcaaaaaatcagatacagcagcaagcgatgctgcaccaactgatgctgcaacccggattcggacaacagcgaattga

SEQ ID NO: 524 - DNA, 978 bp, M.catarrhalis
gagggaataatgtcacagacagtaaataccaccacacaacaaaccgcaccaaaaaaattggtggaagtgaaagatttggaaatctcttttggtgaaggtaaaaaacgcttcgttgctgttaaaaatgcaaacttcttcatcaataaaggtgaaactttttctttggttggtgaatcaggcagtggtaaaactaccattgggcgtgccattatcggacttaataacattacaggtggtcagattatctatgatggtaaagtcattagtaatcaacctaaagatgcagagctgatttgtaagattcagatgattttccaagaccctgccgccagcttaaatgagcgtgcgacggttaattatatcatctcagaagggttatataattttaaattatataaagataatgctgaccgcttagcaaaaattaaacaaatgatggcggaagttggtttgttacctgaacgtctgacacgctatcctcacgaattttcaggtggtcaacgccagcgtattggtattgccagagcattggttatggatcctgaatttgttatcgctgatgaaccaatttctgcattggatgtctctgtgcgtgcccaagtgttgaacttgctaaaaaaaatgcagcgagaaaagcacttgacttatttgtttatcgcacatgatttgtctgtggtgcgttttatttctgataggattgctgttatttataaaggcgtgattgttgaaatcgctgaaactgaagagctgtttaaaaatcctattcatccgtataccaaatcattgttgtctgctgttcccattccagacccgatacttgagcgtaaaaaacaactgattgtatatgatcccacgcagcatgactattctagcgatgagccaagcatggtggaaattaagcctaatcattttgtttgggcgaataaacaagagcttgaacgctatcaacaacacatttcaaaccaaacagtcgtataa

SEQ ID NO: 525 - DNA, 192 bp, M.catarrhalis
gctgcaccaatgaatccaacaagtgccaaggcagtcgcaggggctaaagctaagattttcatagaatacctccaaatgttgttatttaaaagctcaaatttaaacggttttgtgtataaatttggctcagcttccacttttatcaataatcaattttctaaagcgatcggcataataactttaggcttttga

SEQ ID NO: 526 - DNA, 1023 bp, M.catarrhalis
aagttaaatgtttggttggtgaggtttacagtgcgtaaacgctttttaactggcattcgcaatatttctttgaagttccatgaaggtgaaatcttggctttagtgggtgagtcaggatctggcaaatccgtcttaaccaagacttttacaggcatgttggaaaataatggtcgcattgcctcaggtgatattttataccgtggacaagatttacccaaacttaccaataatgaagattggcttaaaattcgtggttcaaaaattgcgaccatctttcaagaccccatgaccagtttaagcccaattaaaacgattggtgcacagattgtagaggtaattaccaaacaccaaaaagttagtcgtaaagaagccaaaattcaagcgattgactatatgcgtaaggttggtatttccaatcctgaaaaacgctttaatgattatccgtttgaatattcaggcggtatgcgccaacgcatcgttattgcgattgctttggcgtgtcgtcctgatattttggtatgtgatgagccaaccactgctcttgatgttaccattcaagcacaaatcattgatctgctaaaaagcctacagcaggaatatcgctttaccatcatctttattacgcatgatttgggtgtggtggctagtattgctgataaggttgcggttatgtatgcaggtgagattgttgaatttgcatcagtcaatgagatattttacaatccacaacatccttatacatggagcctattatcaagtctgccacagcttgttaatgattcaggagagctgtatgccattcctggtacgccgccatccttgtactcgcctattgtgggcgatgcctttgctttgcgttcagaatatgccatggaaattgactttgaacaacgaccggccatcatcaatgtctctgatacccattgggcaaaaacatggcttttgcatcccgatgcacccaaggccaataagcctgaagcgatctgtgatttgcatgaaaaaatattgcaaaaactatcttaa

SEQ ID NO: 527 - DNA, 666 bp, M.catarrhalis
gccttttaccctatggataagcaatatcaggtcttagcccgaaaatatcgacccaaaaacttttctgaacttttgggtcaatcacatgtcgcccaagcactgtcaaatgccattgatacaggcagattgcaccatgcatatctgttcactggaactcgtggcgtgggtaaaacgaccatcgcacgcattcttgctaagtgcttaaactgtgaaacaggcatgacaagtcagccttgcggtgtatgcgatacttgtattagcattgatcaagggcgatttttggatctgattgagattgatgcagcttctcgtaccaaagttgaagataccagagagctgcttgaaaatgtcccttatccacctgtacaaggtcgttataaagtctatttgattgatgaagtgcatatgctatctacgcattcttttaatgcactactgaagactttagaagagccaccagactatgtcaaatttgtatttgcaactaccgacccccaaaaacttcccattacgatcatttcacgctgcctgcaatttgttctgcgtccactaccgcaggcttgtttgtctgatcacttagccaaagtattagatgcagaaaaaatcccttttacagaaaatgccttatggcaattgggcaagcactgcaaaaggttcggtgcgtga

SEQ ID NO: 528 - DNA, 645 bp, M.catarrhalis
aaaaatttaccgctgttgaactcttggcaatcaaaaaatggttttaatcgccatgagtttttggcacttgccaatcaaggggaaagcttggggcagatgagcgagatggaaactcgtattatcaaaaactctttggcattgggcatgattaatgtagaagacattttgacgcctcgttcggtcgttagtgcgtttgatgaaaatatgacggtaggcgatgtctttgccagctatcccaaactacctttttctcgttttccaatctttgatgaagatttggataatgccacagggtttatattaaaatccgatttactgatcgctaaggcaaatcaagaaattcatacacccatcaagcaatttcggcgtgatatcaactttgtatttgccaaaatgaaactatttgatttgttggatttgatgttaaaagagcaagttcacatcgctttagcggtaggagaatttggtgaggttaaaggattggtgagcttagaagatgtgctagaaaccttgcttggtcttgagattgttgatgaatttgaccgtgttgatgatatgcagattttagcacgccaactcatggataaacgcatggcacgcttgggggcaaaactagaagaagatgcaccgtttgatgaaaagtag

SEQ ID NO: 529 - DNA, 2904 bp, M.catarrhalis
gttaggccaccaaaggacataacaatgaaaaaacacaccaaatcttcgatctcaacacaaattttaaagccgctcagtcttgccatttcatcttgtattttggttgcttgtagtagcacaggcacacctgctaaacctgttagccaaaccccaaaacccatacctcaagctaagcccagtcagcagattaatatctcgtcaggtaatactaatttgggtaatactaagactggtgcagatgtagatgttttggatgttcagatgcttgatgcattagaagcgttattacaagcgactgatatgagcatggtggagggtgatgaactggcgattcaacgctatggtaatttatgggatcgggttcgccgtggttatcgcattaatgagatgaccaatgcacgcattgaagctcaaaaatcatggttttatactcgccaaacctatttagatcgcttgactgcgcgtgcttctcgctacctacatcatacggtcgccgaagctgaacgccgtggcattccctctgaattggcacttttgccaatcattgaaagctcatatgacccaacagcgaccagtaatgccgccgccgctggtctttggcaatttattcctagcacaggtcgaatttatggcttgaaccaaagtgccacatatgatggtcgccgtgatgtcattgaatcaacgcgtgccgcttatgactttttaacaagtttgtataaccaatttggttcttgggagctggctttggcggcttataatgcagggcctgggcgagtttcgcgcgccatcaaagccaaccaagatcaaggattgccaacagattattggtcgcttaagctaccgactgaaaccatgaactatgtaccaagattcttagcagtcgctcaaattgtgaggtcgccaaatacttatggcatcaatttacccgccatcgctaaccacagtcattttagaacagtgccagtgaattatggtgtcagcctatctgaggttgccacagtgacaggtttgtcagtcagcgagcttcgtttattaaatcctgcactgttaaattttaccgtggatgagattggtccaaatcgtatcgtcattcctgacagtttgccgaaccaaatcgataatcagctggcttctttaaaaggctatggatttggtggcgattatatcgcaacagcacctgcccagagcatcacctatgtggtacctaagtctggtgctacagccaacaccagctctcaacaagaattaatcgcagccaatacactaccaaccaccatcgcacaagttacaccaaataataccattgtgcaagaaccagctttatcaaaatctgagataaatttgattgcagcagaaattcaaaaaaccagtcctgaagtgcctgcaattagccctcaagatggcaatattcagctaaatgcggtacaaactggtcagtcggttttggatgctcgtggtgagactaaaatgttgagttttgcagatgggccaaaaactcaagctgtagcacagcagcccactcagcctgtgcaagtagctgtaacaccgcctgctcagcctgtacaaataacagtggtcagtcctactcctgaaccaatctctcagcccaagcctcagcttccacctgtcacagcttcgataccagtcgtctcatcgccacctgtcttagtcccaccgccaccaagtcggcctcgtcctgaacctgcatcaagacccaagccaaaacctgaaagctacaccgtgcgtgctggtgatagcctaacatcggttgcggctactcatggattaacggtcggtcagcttgccagttataataatttggcgaatgatgcacatatcttgattggtcaaaggctatggcttgtcgctggtaaagtcaaacgccaaccagtatcagcacaaacaccatctcgccaaagcacatcaaccgccaataccaattcagcaacccataaagtatctgctggcgaaagcttaaccgccatcgctcgcaaatacaacatcagtttacacgccttagccaaagaaaatggcttaagtgtcacagatggtgtcttaattggtcaaacactcaaattgcccagcgatgccaaaacagccaataccacaatggctaatacatccagctcgccatcagtgaataaacccgaaagctacaccgtgcgtgctggtgatagcctaacatcggttgcggctactcatggattaacggtcggtcagcttgccagttataataatttggcgaatgatgcacatatcttgattggtcaaaggctatggcttgtcgctggtaaagtcaaacgccaaccagtatcagcccaacagacatcacaagccacccagtctactaaaaataatcaaagcactcaaagcaccgccacacatcgcgttcaatcaggtgaaagcttaactgccatcgcccgcagatataacatcagtttacacgccttagccaaagaaaatggcttaagtgtcacagatggtgtcttaattggtcaaacactcaaattgcccagcgatgccaaggctgaaagtagcacaccatctcgtttgggaaataccaaaaataattcgacacgcacgcctgctaatacaaatattggtatcactgaaaattataccgtcagatctggtgacagcctaaccatgctctccaatcgttttggcgtagcaatcggtgatttggcgacagcaaatggtttggcttccaatgccaatttgcgtattggtcaaactttaaaagtccccaagctaacgacgacatacaccgtcaaagcaggcgatgggcttatcgctttggcacgacgctatggtattagtacccaagagcttgccaaaatgaataacttagaacctactgccgatttgcgtattgggcaggttttgactgttccaaataaataa

SEQ ID NO: 530 - DNA, 714 bp, M.catarrhalis
acggttttgccccatgccaataaggtgcttaacgatatgcaacttatgcgtcatgagatcaatgatttacaagactttcatcaaggtaaagtgcgtattgcaacaccccagcaactgtcagcattctcgataccaaggttgattcgcttgtttaaagaagcatatcctgatattcaagttactttaattgattgctcaattgaagaggtggcaagtcatgtgcaaatgctagatgcggatattgggcttggacctgatcttttgcatagtaatgatctgatacaaaccaaactgtttcggtcgtcttttgggttggtggtgcgtgcagatcaccccctggcagattcagaggttttgacatggcaagatttgagcgaaggtgatttgattaccgtgcaagcaccgtttgccgatcatattcgtgaaaagttgactttggatatctgcacacgcctatttcgtagtgattaccaagttaactttttatcaacggctttgggcatggttaaagaaggcttggggattaccatgacacttggctatgccaaaacttgggtagacgagcaaggtttggtcatgattccgattcatgagccacagattgggtatgaatttttactgtacaagcaccgccagcgtagccaaacgccagcgatgaaaagctttgaaaactttttggtcaaagccgccaaagattggctgctgcatatttaa

SEQ ID NO: 531 - DNA, 408 bp, M.catarrhalis
tatgctgatacttatcataaaataagtcaatacagcgtacaaatggaatttttattatacttattggatactcctatgaatattacttttcgccagcttagagcatttgccagcatcgcacgacatcacagttttagtaaagctgcaaccgaattgcatttgacacaatcatcgctgagcggcttgattaaagagatggaaaaacagctggatactcgattgtttgaccgtacaacacggcaaattcatttgactgaatctggtgaacggttttgccccatgccaataaggtgcttaacgatatgcaacttatgcgtcatgagatcaatgatttacaagactttcatcaaggtaaagtgcgtattgcaacaccccagcaactgtcagcattctcgataccaaggttga

SEQ ID NO: 532 - DNA, 1035 bp, M.catarrhalis
ccgtggtgtgcggtgatagtcatactgccacgcatggggcattgggctgtttggctcatggcattggtacatcagaggttgaacatgtgcttgcgacccaatgtttgggttgccaaaaaaatgaaaaacatgctggtgcgtgtggatggcaaattgggcaaaggcgttaccccaaaagatgtcgtgcttgccatcatcgctaaaattggcacggcaggggggacaggctatgccatagaatttggcggacaggtgttttgtgatatgtccattgaggggcgtatgactgtgtgtaatatggcaatagagggcggtgctagggttggtcttgtggcggtggatgataagaccattgactatgtcaaagaccgaccttatgccccaacaggcgatgattgggagcgtgcggtaacctattggaacacactacattctgatgatgatgcccattttgatgcggtagttgtgctaaacggtgatgagattgagccacaagtgtcttggggaacctcgcctgagatggtgattgcagtttcgcaaaatgtgccaacgctggatatggcacgagacgatgtgcagcgtaatgactggatgcgagcttatcaatacatgggcttgacagcaggacagcccttgtccgatattgtgcttgaccgtgtgtttatcggctcttgcaccaactcacgcatcgaggacattcgtgcagcagcagaagttgttaagggtcacaaagtcgctccaagcatcaagcaagcgatggttgtggcaggctcaggactggtcaaagcacaagccgaacaagaagggctggataaaatctttatggatgcaggctttgaatggcgtgaaccaggctgttctatgtgccttgccatgaatgctgataaactacaagctggcgagcattgtgccagtacctccaaccgcaactttgaaggtcgtcaaggcaatggtggacgcacgcatttggtatctcctagcatggcagcagcagcggcaattgcagggcattttgtggatgtgcggacattttag

SEQ ID NO: 533 - DNA, 660 bp, M.catarrhalis
aaattccatttgtacgctgtattgacttattttatgataagtatcagcatattagcaagcatcatttatcaaaaatatcaccagccaaacacggagtattttatggcagatttatttgaaaacccaatgggattgtgcggttttgaatttgtggaatttgcaagtccaaccccaaatttacttgagccattatttgaaaaaatgggttttagcctggttgccaaacatcgctcaaaagatgtcttattatatcgccaagggggaattaattttatggtcaatcgtgagccaaattcagaagcaatgtattttgctcaagaacatggaccatctgcgtgcggtatggcgtttcgtgtgcgtgatgcacagtatgcttatcatcgagccattgagctgggtgctaagcctgttgagataccaacttcggtgatggagcttcgcttgcctgccattcgtggtattggtggtgcaccactgtatttaattgaccgatttgatgaaggcaaatcaatttatgacattgattttgagttcattgatggggttgatattaatcctgtgggttatggttttaaggtcattgaccatttaacgcataatgtttatcttggacgcatggattattgggcagggttttatgaaaaactgtttaacttctaa

SEQ ID NO: 534 - DNA, 396 bp, M.catarrhalis
ataatctgttacaatacttggtatatttttattgaatttttatcaaattcacacattaaaaaattgcatattgggtatattatgagttcgcaaaatcaaccacagcgtagcgaagccgccatttcggaaaatgagctaatcgcacagcgtcgtacaaaactggacgccttacaacaaaaagccaagcaagcaggcaaaagtgcttatcctaatacctttaagcccaagaactattgtggtgatttgcaagcacagtttgatggcgttgataaagctaccattgaaagtggggataaggtgtatgttaaggttgcaggtcgtgtgatactcaatcgtggctcgttcattgtgatccaagacatgcaccgaccgcattcagttatatgtggatcgtaa

SEQ ID NO: 535 - DNA, 522 bp, M.catarrhalis
gaaatacgctattttgatattaaaggtgaatatacagggctgacaagtcgtgctatgatagcacccgatgggctgattcgcattcctttaaatgaagaatctaaacaaggtggcggtcagattgaagaatatttgatggcatttggcggtgagggcattcagcatattgcactgttaaccgataatttgaccgatgcgattgatcagttaaaagcagcaggcgtacctttgatgacagcacccaatgatacttattatgagatgctagatgaacgcttacccaattatggtgagcatgtcgattctctgaaaactcaaggtatcttacttgatgggacaacacaaaacagccacccaggattattgttacaaattttttcagaaacagcacttgggcccgtattttttgagtttattcagcataaaggggattatcgagaaggatttggtgaaggtaattttaaagcattatttgaatcacttgaacgagaccaaattcgccgtggtgctttaaaaatttaa

SEQ ID NO: 536 - DNA, 186 bp, M.catarrhalis
gatcagtgtcacaagtcaccgttgattaaggcaagtttatcaaccaatttgaatgaaccaccgtttttaggtcaattcggtggtttttattgcccattggccatccaaatggttgccaaatttgtcaaaataaggcattattatcgttcaaaaatcaagttgggttattttgccaatcctccatga

SEQ ID NO: 537 - DNA, 303 bp, M.catarrhalis
ccaccccgtcaggtgcttgatttatcactgacagaaaccttaagacgaaccattatgactgtcggtacggtgtttgttgtggttgttgccatgctgttcttaggtggtgatggtctgtattggttctctgtggcgttatttatcggtctgattgctggtacatattcttccatttatgttgcaagctctattccgctgatgatgggtctatcaagagaggactttgtggttaaagtcaaacctgaatttgaagaagaagtggtcgtttttgctgaccccaatcttcaaaatagcaaagattaa

SEQ ID NO: 538 - DNA, 606 bp, M.catarrhalis
tttttacaacattacagtgttatgccccgaccgagaacccaaaatctggcaaatttgtcttttgtttctatcgctatttttactgtatcagtagcggctatatttatcccctcaacggcatttgctgcgtttgagcttggtggcacaccgaccaatcttgcgttattgattttttttatttgtttatctttagtcgtgtcatttttatgctctatttctgaagcgacattgttaaccatgacaccttcttatattgacacgcttgaagaagataatcccaaaggagcggcactgcttaagagtgtgaaagttgaccacatcgaaaaatcaatttcaacaattttaacactcaatactgttgcccatacattaggttcgcttggtgcaggcccgcacgcagtgatcggttttggtaatgcatggtttggggtttttagcggggtgatgacctttattattttgattggcacagaaattttccccaaatacattcgaaccggtttattgccaaccaatttgttatgcctgggccgtattatgtgccttccaatcattgtggcatttttccccattattgggtggactgaaaaaatttaccgctgttga

SEQ ID NO: 539 - DNA, 312 bp, M.catarrhalis
gttatggctaaagctaaatcaagctacatttgccaaaattgtggggcgatttatggaaaatgggcagggcaatgtacagactgcggtgagtggaatactcttgttgaggcacctaacaccagtttgccacatcatcataaatcaaaaactaccacagcacccagaaaaaccgctaactatgctggagcggggaatgctttgatgacattggaccatgttggcgttacgctagaaacacgcatgccaacgggaattggtgaatttgaccgagtgcttgggcgggggacttggggcaggcttcggggggtttaa

SEQ ID NO: 540 - DNA, 939 bp, M.catarrhalis
ctttgccataattatccaaacaatacgattgggtcaagtaaccaatcccccaatcattgtacactgtttaataaacgcttaccagtttgtgtctggtatttcgttttaggatgtataaagttcacaaaatctcatcaaaaattgttacaataccaaatcatcaaaaaatacacatttaaagagaaaataatgacgacatttgtcagttttaatattaatgggctgcgtgcaagaccgcatcaacttgaggcaatcagagatattttgggtgcagatattattggcttacaagaaaccaaagtacatgatgcactttttccagtaaacatggtgcaagatttgggctatcatgtcgaattttttggtcaaaagtcgcattacggtgtagcattggcgtctaagattgtaccaacatttgtccaaaagggctttccttttgggcatgatgacgcacaacgccgcttgattcacgcacgctatgattttgatgggcggagtatcgatgtgttaaacggatattttccccaaggtgaaaaccgcagtcatgaaatcaaattccctatgaagcgtgaattttatgccgatctcaatcgctatattgatgaacttcaggctgatggtcgtgagctgattatcatgggggatatgaatatctcaccagaggatattgatgtgggcatcggtgcagccaatgccaagcgatggcttgccaaagggacttgctcatttttacccgaagagcgtgcgtggtatcagatgctgatgtctacaggtttgacggatacttatcgcttgttttatccaaaaagtcatgatgagtttagctggtttgattatcgctcacgaggatttgaggatacgcctaagcgtgggctacgcattgaccatattttatgtacagatactctaaaaaatgactgtgtgggcagcaggcattag

SEQ ID NO: 541 - DNA, 516 bp, M.catarrhalis
acagtgtacaatgattgggggattggttacttgacccaatcgtattgtttggataattatggcaaagttatggtaaattttcaaaaaacttataaggtgtatatcaatcatacggatgctggcggtatcgtctatcatgccaatcatttggtattttttgaaaattgtcggcgtgattggctgacgacacttggctatgatggctattttttaagcttggatgacgacgctaataaagaatcacgcaaagcggtgcattttgtggtaagtcatgcagacattacatatcacacgcctttgctggttgatgatgagctggcagtaacggttgatgaggtgcgtattagaccagccagcttgatgatacatcaaagtatttatcgccccaatcaaaacaagcctgccacaacagcgacaatcactttagcttgtgtcatcaatgacaaaaaaacgattcgcccccaccgtttgcccaaaaaatttgtccagacactgatcagtgcaactgccgtatga

SEQ ID NO: 542 - DNA, 882 bp, M.catarrhalis
tttgaggtaaatatgttggataatttacgaggtatggcggttttttcaagcgtcgttcgtcacggttcatttagtggtgcagccaaagagcttggcattacaacgagtgctgtaagtcagcaaattcgctctttggaaaatgatttgggcgtctctttgctacatcgctcaacccgtaagctaagtctaaccgaagctggcgaaagtctgtattcatcagccactcaaatggtaaaagcagccgaacaagggcgtgacagtgttattcagctaaaagatgagctttcaggcagtctgcgtattgcgaccaccccagagcttgctaaggcttatttactgcctgccttatctgattggttggttgagcatgataatttatcattgaatatcatctcacgagacaatttggatatgattgaagatcgtgttgatgtggctttattattgagtgaacaagctcaaggcatcgccctaaagactgtcgagcaaatgttgattgcttcaccagaatatatcaaaaatcacggcgatgtagaaaatgttaaggcattggcaacgcatacgatgattatttgtggcgaaaaaccaagcgaaagcatcgagtttaaagatgcaaacggtaagcagtctgtacgagtaagctcaagaatcatcaccaacaatcatgccatcgcattaaacttggctgccgagggctatggtattgccaagaccaatgctgttgatgctaaggcgttgcttgagtcaggtaaagttgttaagatcctaccaaatcacagtttgcccatactgactttgagcgctgtcaccatctcaaaagaacaaacaacggtcaaggcacaaaagtgcattgaagtacttgaagcgcactttaagaattaa

SEQ ID NO: 543 - DNA, 684 bp, M.catarrhalis
ttgattaaaaataaccattttttggagacaatcatggaaaaatacaccaccgaacagggcatcgttgccccacttgaccgctcaaatgtggataccgatttgattatccccaagcagtttttaaaatccatcaaacgcacaggctttggcgataatttatttgatgaactgcgttatttggacgaaggatttttggggcaagacattaataagcgtcccaaaaaccctgattttgtgttaaaccaagcccgctatgctggggcaaccattttacttgctcgcaaaaactttggctgtgggtctagccgtgaacacgctccgtgggcattggaagaatatggctttcgcaccgtgattgccccaagttttgctgatattttttataataactgctttaaaaatggcatgttacctgttgtgctaagcgatggcgatgttgatgacttatttaacgaatgttttgccaatgtcggttatcagctgacggtagatttacaaaatcaaacggtgatttcaccaaatggcggacaatatcattttgagattgatgcgtttcgtaagcattgtttgttaaatggtttggacgatattggcttgactttgcaacacgccgatgacattaaagcttttgaagaaaaagccaaagcggacagaccgtgggtgtttgcagagttgtcagtatag

SEQ ID NO: 544 - DNA, 294 bp, M.catarrhalis
cacatgaaaaaaatcctacctgccgctgtttttgctattttattggctgcctgcagtcaacaaactcaagattcagccagtcaagctgcatcatcggtcgctgaggataccaaagcaaatgctactgttgtcgcccaggaagcagaagcggcagcacaggcgacaggtaacgctgttgagaatgctgcagaaacagcttctaatgctgccaaaaaccttggtgccgccgttaacgaagtgactgccaatgagcaatctgccgaagccaaagcacctgaagaccaacagtattaa

SEQ ID NO: 545 - DNA, 1668 bp, M.catarrhalis
atgcagaaaaaatcccttttacagaaaatgccttatggcaattgggcaagcactgcaaaaggttcggtgcgtgacgcactgtcgctgaccgatcaagcgattgcctttggtggtggtcggattcaaacagatacggtcttatcgatgcttggattggtaaatcgtactgatgtgcttgagattattgagacaatttaccacgatgatcgaatggcaatcagccaacttatcaccaatatgcgtgataaaatggtcgatgctactgcaatctttgacgaactcattgactgcattcatcaaatggcactcatgcaggtgttgcctgatatccctttggatatgaatgatgaacaagcacatcaaattaaacgcttatcatctgccatcagctcggatatcttgcaactgtattatgaaattttaatcaaaagccgagacggcattcgcttggcaagtacgccaatgcaggctttagagatgggtatcttaaggttgttggcatttcgaccgctggcagaaggacaggtgactgttttaaatgatacgccagcaaagcagccagaggatgctgacaaccacaataacatgcctgatgatatcgttgacggtctaaaagatcaagcctgtgctgctggtgaaattaatgcgttatctactgatagtcattttgatagcgacaagcaagatgatttgaatgatttggcatcacagataggcactgagttaatcttagatcaattagacaatgacgatgtaaatacaaaagatggtcaagatactaaccaatttgctcatatcgatcaagcacaatctaccaatatagccgtcaatttgaccgtatctgaggaaaatttttgggtaaaacagccccagtctgatccacctgaactgttgcaaactgatgaagattcgccaagtgatcatgatacactcacccaaatggccaccgaaccatcacttgcggttatgtcggatagtagtgataccgatgagcttacagctgattttactgaagatttgcagtcagtcccagcagttacagtagcggcattggtcaaggttgatagtaagaaaaaagcatcacatcaagcagatctgacagctcatcagccagcttcacacaatttggatcaacagcccatcagtcattttgaccatattaatccgttaaaacctttggcacatctgtccagtcaaccgatgaccaaaccccaaatgcttgagcagctaaagccaactccaattgagcttgaggggggctggacaagtgaaaaatgggactattgggtacatttggcgcgtgaagaagggcattttgcacctgatgagcttgccttgatgagtacgagtgtgatggcaggcgatatcgctggcgaaagccgtttattggttgccgagattaactctcaagttcaatccagttttgagaatttgcacgccaaatttttagagcattacccacaaattaaactgtctttagagcctgtactggtggattgtgcgttagaagtgccaaaatctcgcttatctgatcgtcatcgtcaagtgcagatgcaggctcaacatcagctggttgatagcccagtttttcaaacactttggcaaggtggttttatcatcgatgatggcacttcagtgctcaatcaatctaagttacttattgactaa

SEQ ID NO: 546 - DNA, 693 bp, M.catarrhalis
cttctaaatgaaacaaaatataacaatttgccatcatactttaagcttactgtgttattttggcttaagattactccgtcatacatcatggcgtattcattcattgataagtatattgagtataagggttggtttatgaaatacagcacccgttctgttttaagaaaagccgttgccgcaagtatgctgacggcagtgattcggtcggccattcaattgacaggcaggtcttttggtaaaggtgctagtattggcttatttattggtatgattggcgtacaaagcttaatcactaccaatgcttatgcaatcagtgaacaagatgtcagccgatacgcttcaagtatgagtagcgccgccaacgctcaaaatattgcccaaatttcaagattgattgatgatgatgccatcatttcattgtctcggggtggcaaaacgaccagcttggataaagaaggctacttgcaactgcttcaaaaaagctgggccatatccagcgattatcgctatcgtattaatgtggcagatgtggtagtaacaggcaatcaggctagagctcagattgtaactaccgagacttggactcaagatggtaagcctgtgacaattaagaccgcttctcgagccactttttcgcaggttggtaataatgccgtattattaagatcagtgtcacaagtcaccgttgattaa

SEQ ID NO: 547 - DNA, 1254 bp, M.catarrhalis
tccaagacatgcaccgaccgcattcagttatatgtggatcgtaaaggcttaccaagtgagacgcttgagctgattaagtcattggatttgggtgatatcgtggcggcaagtggctatattgggcgttcaggcaagggagacttgtatgtgcatcttgaagcatttgagttattgaccaaatctttacgcccattgcctgataaatttcatggcttgactgatacagaagtcaaatatcgcaagcgttatttggatttgatggtcaatgaagagacacgaaacacatttgccatccgtgccaaagtagtggcgggtatccgtgcatttttgacccaagaacgctttatggaagtagaaacaccgatgatgcatgtgattccaggcggtgcgtctgcacgcccttttgtgacgcatcataatgcattggatatgcagctttatttgcgtattgcacctgaactgtatcttaagcgattggttgttggtggctttgatcgtgtgtttgaaattaaccgtaacttccgtaatgaaggggtttcaacacgccacaaccctgaatttacgatgattgagttttatcaggcttatgctgattataaggatttgatggccttgactgagcgtatgcttgagacattggcgatggatattttgggatcgactgatgtatcgtatcaaggtgaagtgtttagctttaaaggtccttttaagaaaattacgatgtttgatgccatcttagaatacaattctgattttagtgccgatgatatcaatgaccgtgaatttttggcaaaatttgtcaaagatgaattaaaacaggaggttaaaccaagttttggtctggggaaattacaaaccatcgtttttgaagaaacggtagagaccaagttgcgtcagccgacttttatcactgaatatcctgccgaaacttctcccttggcacgccgaaatgacaccaatccacatgtaactgatcgctttgagatgtttattggtggtcgtgagcttgccaatggttttagcgagcttaacgatccaattgatcaagctgagcgattccgtgcccaagtggctgaaaaagatgctggtgatgatgaagccatgcattatgatgccgattttattgaggcacttgaatatggcttaccgccaacagcaggcgagggcattggtattgaccgtcttgtgatgctgtttgctgacgctgccagtatccgtgatgtgattttattcccacacatgcgtcacaaataa

SEQ ID NO: 548 - DNA, 510 bp, M.catarrhalis
ggttttatgagtattcaatattggcgcatgcaattacacccagaccacagtacattttcaagtttttatgctcacactagtattgccaaaggttttattggtttggattttaaacaagaaagtaatgctggcgatttattaacattgcaagatgacgataaattaggttatcaaaagagctatttaccttttgcaagagatatgaaaattggtgatattgttttaattgtatcccatcataatccaattgccattgttaaaataacaagtgattataattacattcgtcaagttatccccgaacttggaatttggtttcgtcattttagacaaattgataaagataatattatttattattcagattttgagaccaataaaaataattatcagtcaatcacaatgactaatacaatttcaccgctaaaaaatgatgattcacaatcgatgcaattgattcaagaaatgataaaatgggaaaaatcacataatccagattcggtttattga

SEQ ID NO: 549 - DNA, 1404 bp, M.catarrhalis
ggattatttatgaattcagatacattattaaccatgcgacccatcaaagcggttgctattgcaggtgttctggttgcactacttggtctgacgatgattgcttggagctgggtaccgcatttgtctttattggttgtgattgcagcactgttattttttggtttattaaataaactcaaatttgagcaaatgcaagcatgcatgattggcagtgtgggatcggcaatgggtgcgatttatttattttctttcatcggtcttttggtttctgctttgatgatgtcaggggcaatcccaacattgatttattatggatttgagatattatcagccaaggtattttatctgtcggcatttattttatcatcggttgtgggcatcgccttaggcagtggatttaccacttgtgcaaccgtgggcgttgcatttttgggtatggcaaccgcttttggagcaaatcctgccattgtggctggtgctgtcatctctggtgcgttatttggtgataagatgtcacctttatcagatacaacgagtatcgccgcctcacttgttggcgttgatttattcgaccatattaaaaatatgatgtatactaccgtgcctgcttgggtcatcacggccataattttttggtatttatcagccaccaataccatcagcgaccttgcaggcattgccatactcaaagagcaactttttagcagtggcttagtgcatggtttttcattaataccttttgctgttcttgtcattttggccattttacgagtcaatgctatctataccattattgcaaccatcataacagcactgatgattacctacacacattcaagcccaagtttgaccgatttgggtggatggttttttgctggatatacgccagcagaagagctggcattgggtgatgtggcaaaaatggtatcacggggcggcttacaaagtatgttttttagtcaactgttggttattttggcattgtctttgggtgggcttttgcaaggattgggtatcttgccagcattattagatggcatgcgtcatttattaacccatgccagtcgtggcgtggcagccgcagcatttacctcacttggcattaatgttttggtgggtgaacaatatctgagtttattattatcaggcaatgcctttttaccagaatatcagcgattgggtttgcatccaattaatctatcacgcaccattgaagatgcaggcacggtgattaatcctttagtgccatggggtgtctatggtgggtttttggctgggacttttgggatgccagtgattgagtatgtgccgtatgcgtttttttgttattggtgctttttattgacactgttttttgggataacaggattgaccattacacgcttatcacccaagttgacatag

SEQ ID NO: 550 - DNA, 657 bp, M.catarrhalis
attattgttattctaaaagtatgctataatggcaaaattacccagtccatgacagtgttggagaataaaatggcaggcaaaaccttatacgacaaactttgggatgaccatttggtcagacagcgtgatgatggttcatcgctcatctacattgaccgtcagcttttacatgaagtgacctcgcctcaggcctttgaaggtttggcactaaacggtcgcacgccttggcggttgtctgccaatatcgcaacccctgaccataatgtacccacctcacttatggagcgtaagcagggcatggcaggaatagccgatgacacatctcgcattcaagtcaaaacccttgatgataattgtaaatcttttaatgtcatgcagtttggcatcaatgacattcgccaaggcatcgtgcatgtggtcgggccagagcagggtttgactttgcctggtatgaccgtggtgtgcggtgatagtcatactgccacgcatggggcattgggctgtttggctcatggcattggtacatcagaggttgaacatgtgcttgcgacccaatgtttgggttgccaaaaaaatgaaaaacatgctggtgcgtgtggatggcaaattgggcaaaggcgttaccccaaaagatgtcgtgcttgccatcatcgctaa

SEQ ID NO: 551 - DNA, 1887 bp, M.catarrhalis
gaatactctatgcactaccctgcttggaaatatatattaattgttgtggtgctatttatctctggcatctacgcattacccaacctataccctgatgagcctgctgtgcaaattacaggcgcgagtgcaggcacacaattaactcaagatgtgctaacacaagctgaaggtctgctgacacaggcaggattaaatcaccataatggtcgctttgaaaataacagcgcattacttcgtttatcaaatgctgaagatcagcttaaggcacaagaagtgctgcgccgagacttgggcgaacagtatgtagtcgcactcaatttggcacaaaccacccctgaatggctgcgtaatttgggtgcagctcccatgaaattgggcttagatttgcgtggtggtgtgagatttgtgttagaagttgatatggcaaaagcacttgaacagcgtcttgcaactgccagtcaagatgtacgccgtacactgcgtggtgagcaaatccctgttcaaagcctgcgtatcactgataatggcatggtgcttacctttataaatacagatgatcgtggacgtgctcaatctatcctacaaaatcaagtgggtgcagactttgcattacgcccctttgctgatactgaaggtgcggcacttgagctgacttatactgatgccaaaattcaagagattaatgaatatgctgttggtcaaaacttaaccacactaagaaatcgtatcaatgagcttggcgtggctgaagcattggtacaatctcaaggcaccaaccgcatcgtcgttgaactgcctggtgtacaagacaccgcagaagccaaacgggttttgggtcgtaccgccaatcttgagtttcgcatggtgagcgaacacgatatgaattatgcaggcggtattccacctgcaggtaccgaagcttttgcatttggttctttggacggtcagcccatgttgcttgaacgccaaaccatcatcacaggcgagcgtgttcaaggggcacagtcgggtttggatgagaatggacgcccacaggtaaatattaccctagatacagcaggcggcagactcatgcaaaatgccacacgcactgctgtgggcaagcagatggccgtgctatttattgaaaataagcaaaaggtcagcttccaagaagattcatcaactggcgagcttgttgaggtgcgtacaccttataccgagtcacgcattattaaccgtgctaccattcaggcggtacttggttcttcatttgtgatcacaggcttagattcagatgcagaagcaggcgagcttgcgttactgttacgctcaggcgcgttagcggcaccgatgtactttgttgaagagcgaaccattggcccatctttgggtcaagataatatcgataaaggattattctctacacaggttggctatctgttggtatttttatggatgattgtgttttatcgtgcatttggtgtgattgcaaatattgctttagcctttaatgtcattatcatggttgccattatgtccattttaggatcatcgctcaccctacctggtattgctgggattgtgttgaccattggtatggcggttgatgccaatgtgctaatttttgagcgtattcgtgaagagcttgccaatggtactcgtgcaaaatccgccattgtggcaggttttgatcgtgcatttagctcaatttttgatgccaatatcaccacgctattaattgcatttatcttatttgccatcggaacaggaccaatcaaaggttttgcaatcacgcttgcaattggtattatcagttctttgtttactgcgattttagtcactcgtgccatgattcaaatttggtatggtcatcgcaaaaacttaaccaaacttagcatcggttag

SEQ ID NO: 552 - DNA, 1080 bp, M.catarrhalis
ggaaatctcatgaccaaaaaaatcgcaattctaaacggcgatggtattgggcctgaaattgttgcccaagctgtcaaagtgttagataaactcattgagcaagggcttgatgtgtcctataaatacgccaaactgggcggtgaagcctatgacacttatggcttgccatatccaagccaaacccaagaaatcgtacaaaaagctgatgccgtgttattgggggcggttggttcgcctaagtacgatgaccttgaccgcccattgcgtcctgagcgtggactgcttgccattcgcaaggatttaaatttatttgccaatttacgccctgcaattttgtataaagaactggcggatgcttctacattaaaacctgaggttgtggcagggcttgatatcttaattgtcagagaattgacaggggacatttattttggtgaaccacggggcattgtaacccttgacaatggcgagcgtgagggctttaataccatgcgttatggcgaaagtgagattcgccgcattgccaaagtgtcctttgaggctgcccaaaaacgccgtggcaaactgtgcagtgtggataaagccaatgtgttagaaaccaccgaactttggcggcagatttttaccgaagttggcaaagactatccagaggttgagcttagtcatatgtatgtggataatgctgccatgcaattggtcaaaaatcccaagcagtttgatgtgattgctacaggcaatatctttggcgatattttgtccgaccaagcgtctatgctcacaggctctattggcatgttgccatcagcaagcctaaacgagacaggcaaaggtttgtacgagccgtctcatggctctgcccctgacattgcagggcaagataaggcaaatccactggcgaccatattatcgcttgccatgttggtcagatatagcctaaatgatgaacagcgagcggtacagattgagcgggcggtacaaaaagtgttagagcaaggctatcgtacagcggatatttatgaagatggcacgacgcttgtgtcttgtgatgagatgggtgaggcggttcttaatgcactgtga

SEQ ID NO: 553 - DNA, 189 bp, M.catarrhalis
gtgacaatcatgccttacattatactggcgacttattttaagttgccaatggtagcggctgatcatacggcagttgcactgatcagtgtctggacaaattttttgggcaaacggtgggggcgaatcgtttttttgtcattgatgacacaagctaaagtgattgtcgctgttgtggcaggcttgttttga

SEQ ID NO: 554 - DNA, 1842 bp, M.catarrhalis
gatctcaacatgactgcaaagataactgctccagattttgttcgtcaccaagccttgattcattgggtggctgaaattgccgctttgaccaaacctgctgccatcgaatggtgcgacggctctgaagaagaaaaccagcgcctaatcgatctgatgatcaaaaacggcaccatgatcaaattagatgaagacaagcacccaaattcgtatctggcattctcagatccgacagatgttgcacgtgtcgaagatcgtacttatatttgctcaaaagaagaaatcgatgcaggtgcgaccaataattgggtcgagccaagccaaatgcgtaccaaacttaacgatttgtttgatggttgcatggcaggccgtaccatgtatgtcgtaccttttagtatgggtcctttaggtagtcatattgcccatattggcatcgaaattacagacagtccctatgttgtcgtcagtatgcgaaagatggcacgcatgggcaaagaggtttatgatgtgcttggggctgatggcgagtatgtgccatgtgtacatactgtaggctcgccattgactgaagggcaaaaagatgtggcatggccatgcaatgatgataaatatatcgtacatttccccgaaactcgtgaaatttggtcgtatggatcaggctatggcggtaacgctttgcttggtaaaaaatgtctagcattacgcatcgcttctgccatggggcgtgaacaaggttggttggctgaacatatgctcatcttaggtgtaaccaacccacaaggcaaaaaacattatatcgcagcggcattcccatcggcatgcggcaaaacaaactttgccatgcttattccaccagcaggctatgaaggctggaaagtagaaacggttggcgatgatattgcatggattaagccatctgaagatggtaagctttatgccatcaacccagaagcgggcttttttggtgtcgcaccaggtaccaacaccaaaaccaactcaaactgcatgagtactttgggttctgatgttatctacaccaatgtcgctgtcaccgatgatggtgaagtttggtgggaaggtaaaaccaaagaaacgccagcaaatttgaccaactggaagcgtgagccacacacaggtgcagagcgtgccgctcatgccaatgcacgctttaccgtttctgcaaaacaatgtccgtccatcgatccacaatgggaaaaccccgaaggtgtaccaatttctgcctttatctttggcggtcgtcgtgcagatactgtgcctttggtatcagaagcatttgattgggtagatggtgtttataaagcggcaaccatgggttctgaaaccaccgccgccgctacaggtcaacaaggtgttgtacgccgtgatccatttgcaatgttaccatttactggctataacatggcagactacttcaaccattggctacaaatgggtgaaaatcttggcaaaaaagccaaggcggcaggcaaccagttgccaaaaatgttcaaagtcaactggttccgccgtgatacaaatggtgactttgtatggcctggttttggtcagaacatgcgtgttctgcaatggatcatcgaacgctgtgaaggtactgctaacgctgtccgcactccgattggcttagtgccaacctatgatgatatcaattgggatcagtctgattttaccaaagcacaatttgagcttgtcaccagtcaagacaaagatgcttggatcaaagagcttgagagccatgctgaactttttgacaagctgggtgagcgtatgccaacagcactcaaagcacataatgccaaacttaaagctgacattgagcaggcataa

SEQ ID NO: 555 - DNA, 624 bp, M.catarrhalis
ttattatcaatgatcggtatgatctcaggacaggtgcagtatcttaatgcacctattgcttgtattttgacctcaaatggcgtgggttatgaaattgagttgcccatacctagcttttgtcagctgaccattggcgctcagaccgctgtctatgtacatcatcatgtccgagaagatgccataaatttgtttggttttatggatcgtcatgatcgtgatatttttagaaagctgatcaaaattaacggcgtaggtgctaaaatggcgttagcaatgctttcaaccctaagcgttgccgagattaaacacgctattgaaacagattatgatgcagctttggtgcgtgtaccgggcattggcaaaaaaactgctcagcgtattttgcttgatttaaagggtaagctcaatgagtttggcgaaatgcacccaatgacagcagagggtttatttaatcaacctgccgataattccatgttaatcattgctgaggttgaaagtgctttgatgaatttgggttataaggaaaaagaagcacaagtggccataaaaaacgcccaatctgatgctaaaaataatacttctgatcttctaaaagcagcactgcgtcagctttcggggttctaa

SEQ ID NO: 556 - DNA, 870 bp, M.catarrhalis
ataccacaaatcttgccacttttgttgcagttatgcagacaggcagcatctctagtgctgccgaaaaagctttatattacgcaacctgctgtaagtaagcgtattaagaatcttgaagatgaatttgggacggcgttgtttgatacggttggtcgtagcattatcccaacggctgctgcatatgatttactaccctttgtacggcggtggctggatgactatgaagcctgcaaagcaagcttgcaacacgccaaagaagttgcttctggtcgattagtcattggcaccagccatcatattggactgcatcatcttgcgcacgtactcaaacgattcattcagacttatccagcggttcagcttgaagttcggtttgtggattctgaagaagctcataaggcagtacttgaaggtgaaatttctttggcttttttgactctgccaccgacttttgacagacgccttaattatcataccttatggagcgacccattatattttgtaacaggtacactcagtccattggctcaaaaatccaaggtcagcttacttcagttggcacactatccagcaattttaccagctgccaatacattcaccagccaaattaccttagctgagtttgccaagcataatttgcgtccttatgcaacgatgagcaccaatccgctcgagtccattcgtatgctcgtctcggtcggcttgggctggtcagtattgcctgaaacgctgattaaccaagatttgattaaaattgatatggcagaaaatatcgaacttcaaagacatttaggcttagtcaccaatcccaatttgactcgatccgccagtatgcaagcgttattatccatgctatccattaatgattaa

SEQ ID NO: 557 - DNA, 864 bp, M.catarrhalis
gagttaaaaatgaataatgaaaataaccctatcgacccaaatgcagcacagccaccacgccgtcgccgtgtgccgcgtcgtgatggtaaaggtgccaatgctgccacaaatcaagatgctcttgccgatcaatcattgattgccgacgctggtgatgaagctgccgaaaaagccggtggtgtcaaactcatcgctaatcagcgtatcattccttttatgaagcttgaaaagcccatgatagtattttcggtattgtctatactcatagggctgatagcaatcattgtcaagggtttaaactttggtttggattttacaggtggtgtgtcagccaatgtcgcttatgaacagcctgttgagcaagcacaagtcattaaagcattggctgacaatggctttaatgatgcggttgtccaatacctaggaactcgccaagagcttttggtacgcttaccgccccaagatggctcagctgaaaatctaagtgcttctttggatcagattcttaattttccaaataatccatcaaccattgatagcattagcattatcggcagccaactgggcaatgaaatttacctaaattcactgcttgcgatgtctgttgcacttggtatgatgctcatttatgttgcaacacgattccagttcaagctggctttgggtgccgtacttgctttatttcatgatgtgattatcgttgttggtatttttgccatcatgggctggccatttgacttgacggttttggcagctgtattggctttgattggctattcggtgaatgatacaatcgttgtttatgatcgtattcgtgagaattttcgccgagtgcgtggtttaaccaccccgtcaggtgcttga

SEQ ID NO: 558 - DNA, 345 bp, M.catarrhalis
gagttattgatgttagacttggccattaccgccgcacatgcgtctacaggtgcgcctgcaggtcagcagtcattattgatgaatttgctcattcctgttgctttttttgcaattttttattttttaatcattcgtccacaatctaaacgcaacaagcaacacaaagccatggttgatggcttgactgttggtaatgaagttgtctttgctggtggtttgattggccgtattaaaaaggttgagggtgattatgctgtcatcacattgaatcattcaacagaggttaagattcagcgtgcaagcgtagtcatggtactgcctacaggcaccattgacaatatctaa

SEQ ID NO: 559 - DNA, 1047 bp, M.catarrhalis
gagagtatgatggcattggtttcattacgccaattattagaccacgcaggcgagcatagctatggtttgccagcgtttaatgtcaataacctagagcaaatgcgtgccatcatgatggctgccgataagacagactctcctgtcattgtacaagcttcggcaggtgcacgcaaatatgctggtgcaccatttttgcgtcatttgattttatcggcgattgaagagtggccccatattcctgtggttatgcatcaggaccatggtactagccccgcagtctgtcagcgttccattcagttgggatttagttccgtcatgatggatggatcattgcgtgaagatggcaagactccagctgattatgagtacaatgttgccgtcacaagagaagttgttaagatggcacatgcttgtggtgtgtctgttgaaggtgagattggtgtgcttggcagtcttgaaactggtatggcaggcgaggaagatggtgtgggcgctgaaggcgtcttggatcacagtcaattactaacttctgtagaagaagcacgccaatttgttgccgataccaatgtggatgcacttgccattgcggtcggtacttctcatggtgcttacaaattcactcgcccaccaacaggcgatattttggcgattgaccgtatcaaagaaattcacgaagctttgccaaacactcatatcgttatgcatggttcaagctcagtacctcaagagtggctaaaaattatcaacgaaaacggtggtaatattggcgaaacttatggcgttcctgttgagcaattggttgaggcgatcaagcacggtgtgcgtaaaattaatatcgataccgacttacgcttggcaagtacaggtgcggttcgtaaatttttgaacgaccatccagcagagtttgatccacgcaaatatttgacagcttcaatgaaggcaatggaggagatttgtgttgctcgctacgaagcttttggtgctgcaggtaacgcaagcaagattcgtccaatcagcttagaaaaaatggttgattattatcaatga

SEQ ID NO: 560 - DNA, 1164 bp, M.catarrhalis
ttcatgaaattcatcaagcaaaatagccatcatttggcaatgttacttgcgatgaccactggtgctcatcaagcacacgcattttcggttgataacagtcagcagcgtataacagtacagcccacttatgtgcaacctgctcaggtaatcacctctcaatctgtgtatgttgaaccgacagcccaagtaaccacaacgacaaatgtgagcgtgcaggcagtaccacaagcaccccaagagcatgtggtgtcacaagaaggctatgcacaaacccaactgaatattcaaccacaagtcatctcaagcaccaaaacccaaacaaccgcttacaccaccacctcaaacgcccaaacagccatcttaaatgaccaaaacagctatacaaatagtttttatgcgttgcccatcagtacacgatcggcagcggttttggtctatgatttacaagatggcaagctcatttatggtaagaatgcagatgttcaacgctcaatagcttctatcagtaaagtcatgaccgccatggtcattttggatgctgagcttgatatgcgtgaagaaattactttgattgcctctgacttgattggtgcaaaacaagcaagcacacgcctaaaagctggtgaccgcatgacacgatctgagtttactttgatgatgctcatgcgttctgaaaaccctgctgccaaagcattggcacgcacttaccccggtggatatgatgcttttattgctgcaatgaaccaaaaggcgtatgatttgggcatgtatcaaacgaaatttagtgattcttcaggtttagatccacacaatatgtcatcagccaatgatttattaatcatgatgaaagcggtcaatagtagtccacgctatcacagtatccgtaatttttccacagcaccacattatgatttttatatcgccaattatggcagtggcgaccgtatctataaaggcaataataccaatcgcctagtacgagaaggtgcttacccaattggtgtccaaaaaacaggctatattcgtgaagctggttatagtgttgtgatggaaactaacattaacaatcgcccagccattgttgttttattgggtgcatcaaacagtgcaaaccgatggagcgatgctgaaaccattttaactgaattggcttatcgccagtaa

SEQ ID NO: 561 - DNA, 1767 bp, M.catarrhalis
gtttcaagattaactttaagacaccgcaccatgtcccttaaacacaaccaaacccacaacaccacttttaccaaatttttaaagtccaacagcttttggtctaagggcttttggtctaaccgccatcaccgcaccaaagatttaaaagggttagatgcttatctgtttatggcaattgtggcgatatttttgaccacaactgccaatgtgacattttttcaacaagtcatgtcagtatacccattggcaaattacgcactttttatcgcttcattggcggtggtcttaacaggcgttttgttgctcttattggtgttgcttggctatcggcataccttaaagacggtggcaatttgttttattttaatcgctgcttttgctggtcattttaccgacacctatggcactgtctacgacaccaccatgctacaaaatgccttacaaactgacacggcagaaaccaaagatttattaagcatgaagcttttaatccgtgttgtgttgttggctggtttgcccatctgttggattattgggcagccattgtcatttggcacactcaaagcaagtttaatgaagcggctggttacctatcttgtggctttggcattggttggcttgcccattttggcatttagcagtcaatacgccagtttttttagggaacataaaccgttgcgattttttaccaatcctgtaacggtgatgtattcagcaggcaaacttgccaatatgagttataaaaacgccaccaaacccaccgaaaccatcatgcacgccaatgatgccatacaaaaaaccaccgcttccactcgcaagcccagattggtggtgatggtggtgggtgagacggcccgtgctgaccatgcgtcttttaatggttatcagcgagccacttttccccacatggacaaactcattggcttagggcaagtgcataattttggtaatgtcacttcttgtggcacatcaacggcatattctgtcccatgtatgttcagttatttgggagcagaaaaatacgatgttgataccgccgattaccatgaaaatgtcattgacaccttagaccgcttgggtgtggcgatattgtggcgagataataactctgattcaaaaggcgtgatgaatcgcctgcctgccaaacagtatcaagactacaaaaacagccctcttcaaggtggcaataacaccatttgccacaccaacccttatgatgaatgccgtgatgtgggcatgttggtggatttagatgaccatgtcaaggctcatgccaatcaagacatattaatagtgttgcatcaaatgggcaaccatggccctgcttattataaacgctatgacgatgaatttgctcagtttttgcctgtttgtacaagtagcgagttggcagaatgtgagcgacaaacggtcattaatgcttatgacaatgcgttattggcgactgatgactttttaaaacaaaccatcgattggttggcagcacaaacacacgctgacaccgccatgttatatttaagcgaccatggtgaaagcttaggagaaaaaggcgtttatttacatggcatgcctaaggcgtttgccccaaaagaacaactgagcattcctgcgttactttggttgggagcagacactccatttgcagtggcaaattcgccaacggctggctttagccacgatgccatcaccccgacactgctcaacttatttgatgtcagcacacaagccacggcagataaaacagcatttgttaatcctttggattga

SEQ ID NO: 562 - DNA, 243 bp, M.catarrhalis
ttaaggagattactcatggctcgtttctatcgtcgtcgtaaattctgccgtttcaccgcagaaggcattacccacattgattataaagatgttgaacttttaaaacaatacatcagcgaaaatggtaaaatcactccaagccgtatcacgggtacttctactaagtatcaacgccagcttgcagttgccattaaacaagctcgttatttggctctattgccatataccgacaaccacaagtaa

SEQ ID NO: 563 - DNA, 1593 bp, M.catarrhalis
ttgattatgttatggttctttttttgtgtaaccattttattggttggctactttatttatggcaaagtcatcgaaaaaattttcgtcatcaatcctaataaaaacacaccagcctatacgatggcagatggtgtggattatgtacctatgtctaagggtaagatttggctcattcagcttttaaatatcgctggcacaggcccaatttttggtcctattttgggggcattgtatggacctgtcgccatgctctggattgtcattggttgtatatttgctggggcggtacatgattatatgtgcggtatgctatcggtgcgtaatagtggcgcaagtatgccctacttaactggcaaatatttaggtatcattcctaagcattttatcaacctgcttgctgttgtattgcttattttggttggtgtggtatttgttgcaagcccagcacaactgcttagctctatcacgatagatatatttggcactgccgccacaggtacaatttctgtggataatgctgaaagtatggctgccgttactggcacatcaagcaataccgtctttggtatgaccaaagaaaccattatcgttgtttggacagccattatttttatttattatattatcgccaccttattacccattgataaaatcatcggacgcgtctatcctatttttggtgggcttttattattcatgtcgcttggcatgacttatggcttggttatgaatgagcttggtagtactcaaagctatttttatagcagtatgggcggtttgtcatttgatgctttttttcaaaacttacaacctaagggtgatttacccatttggccgctgctatttttgaccatcacctgtggtgcattatcaggatttcatgccacacaaacgccattgatggctcgctgtgcgatgaatgaatctgaaggtcgatttattttttatggtgcgatgattgctgaaggtattatcgcattgatttggtgtacggttggtttatctttttatcctgatttggtcagtttacaagaagccattagtgtcggttcgccatcaaaagttgtttacgacagctcaattgcttatcttggtgctatcggtggcgtgttcgctgtgcttggtgtggtgattttacccatcacctcaggcgacacttcttttcgtgctgctcgcttaatcattgctgaatttttaaatgttgagcaacgcacactcttaaaacgacttgggattgccataccgctatttgtgattggttttattatctcaaaagttgatttccaaattttatggcgttattttagttgggcaaatcagtctgttgctgtggtcatgttgtggacagcggcaggttatttataccgctatcgcaaactgcactgggtttgtaccattcctgccatctttatgagtgctgcatgttatactttcttggcttataataagatcggttttgggctagattaccagctatcggtatatatcggttttggcttaaccatcttaacaacagccgcatttttcttatttgttaagcgtgagcgtgtggctggtgacccagatgctttggtgtttgaacccaaagtttag

SEQ ID NO: 564 - DNA, 432 bp, M.catarrhalis
ctattatacccaaatttactgatactttgctatactttgatcactttaaataaaaaacttcatcaaggagataaaccgatgacaatcaccatttatggcatcaaaaattgtaatacaatgaaaaaggcttttgataaactaaacgagcttggcaaaacatatgaattttttgattataaaaatgagcaactgactttggataagtttggcaaatttgtggcaatctttggcgataaggttattaataaacaaggtatgacctatcgaaagcttgatgatgatgctaaagccatattaaatggcgatgatgtgtcggcgatgtatgaaattgtcaaaacaaatcaaagtatgattaagcgtccgattattttgggcggtatgaagtcggtgattgggtttgatgacgcagaatatgagcaaatatttgggtag

SEQ ID NO: 565 - DNA, 1122 bp, M.catarrhalis
tcaaagtttgctaaaatacgcaatttattattgacaatctcatcagccatgacacaacaaacccaacctgtcttacttagcgactatgactaccatttgcctgacgacctaatcgctcggtatcctttaaatgagcgtaccagctcacgcctattgcatgtctcaaaaaacagctgtcaagatttacgatttaccgatttaccaaacttattaaaaagtggggatttattggtactcaatgacaccaaagtcatcaaagctcgcctgcatggtcaaaaacaaacagggggagcggttgaggttttgattgaacgcatattgcccgatgaaatcaacaacaatctttataaagccttgtgccatgtacgctcaagccgctcaccaaaagtcgggcaaactctaaatttagccaataatcagatgcaagctaccgttatcggtcgccaagacaatttatttattctaggctttaggtcgcccattttggctgatttggataactatggtcaaatgcccattccgccctattttgagcgaaaggctgatgaaacagatgatgagcgttatcaaactgtctttcataatcccaccaaatccgccagtgttgctgcaccaacagccagcctacactttgatgacgcattattgacacagcttagaaaaaaaggcgttcaaattgcttttgttactctgcatgttggttctggtacatttacgccagtcaaagtcgacaatctagccgatcatgtcatgcatgctgaatacgctcatcttcctgcgtctactgccactcttatcaataacaccaaatctgcaggtggccgcatcattgccgttggcacaaccgttactcgtacgcttgaaacggcacaccgtcatcgtattcatggtgaattggttgaatttttgggagatacccaaatttttatttatccaccttatgaatttggtgtggtagattgcttgattacgaattttcacttaccaaaatcaacgcttttaatgttagtctcagcatttgctggcactcaaaccattcaagaagcttacaatcatgccatcaaaaacaaataccgtttctttagctatggcgatgcgatgtttttggaaaaagcccagtaa

SEQ ID NO: 566 - DNA, 1104 bp, M.catarrhalis
accatgaccgctccacaacgcacccctttatttgatgctcacaccgaacacaatggcaaacttgttgattttggcggttgggagttgcctgtcaattatggctcacaaattgatgaacaccatgccgtgcggacagatgcaggcatgtttgatgtctcgcacatgctggttaccgacatcagcggtgataatgccaaagcctttttacaaaagctacttgctaacgatgttgccaaattaggctttgtcggtaaggctttatattctgccatgctaaacgatgatggcggcgtcatcgatgaccttatcgtctatcgcatgaacgaagatgagagtgcttatcgcatcatctcaaacggcgcaacccgtgaaaaagactctgcacactttgccaaagttggcggggcatttggtgtcactttgaccccacgccatgatgttgccatgcttgccatacaagggccaaatgccatcaccaaactccttgccgtcaagcctgaatggacagacaaagtcaatgccctaaaaccctttgttggtgtggatttgggtgatgattggtttgtcgcttatacaggctacacaggtgaagatggcgttgaggtggtcatgccagcagatgaagcgactgggtttttcgatgaactcatcaaagcaggtgtcgccccatgtggacttggtgccagagacaccttgcgtatggaagctggcatgaatctatacggtaacgacatgacagatgatgtcagccccctagaagcaggcatggcgtggacggttgatttaaaaaatgaaaaccgtgattttgttggtaaatccgcccttatcgccctaaaaaatgacggtgtcaaaatgcgtcaagttgggttactacttgccaaaggcggtgtacttcgtgccagcatggaagtgattaccgaagatgggtctggcatcaccaccagcggggtattctcccaaactccaaacccccccatcgccatcgcccgtgtccctgccagctttacaggtgagcatgccaaagttatcatgcgtggcaaagagatggatgtgcgtgtactcaaattaccatttgtcagacatggcaaaaagcaatttgattga

SEQ ID NO: 567 - DNA, 723 bp, M.catarrhalis
cagatgaatttttcaacattttggcaaactgcacctttatctttgttattgatactcagctttattggcttggcgatcgtacagttattgatgggtgttgatatagatgccccaagcacgcacgacttactacgatttggtgctaactttatgccgctgtcgatggttggcgagccttggcgactgcttagcagtggatttttacatattggtatattacatctgttattcaacagctttgcgatgtattattttggacaagttaccgagattatcatcagctccgttcatgttggtttgttatttattttggctgtggtaggcggcaacttgcttggaaattatttggcatggcaggctgtgtttttgggtacacctttagctatcagtgctggagcgtctggcggtatcatgggattgggtgcatttttattttcattggcattgctacaggcacccattgcacttaagctaaataccaaaactttgggttttgtgatggcgattaatttactgatgggttttgctgtcaaggaaattgatcatgcagggcatattggcggcacacttgttggatttactcttggtgtggtttatcgttatgctttgtcttatcgtcagtataccaatttaatattgactggtgcaatgatgggcatggcgatgctatttggggtaatttggtattggttacattggcaaatcatggcggtgattggctga

SEQ ID NO: 568 - DNA, 366 bp, M.catarrhalis
tactttaagtaccaaaaaatccgctcagcaaagtttcaacaaagttgggcggattttatttatccaatctttttttatcttcttatcaatcaagctgatgatgaatattcgcttaatttaaaacttagtaataaatatgattttatcaagatagaatcatacaattttctttacattctggtaatttttcgttattttatacctaattgttgcaaacaccgcctgcccaaaatttttctgggtggctcaaactccatttgttggataattgattatgttatggttctttttttgtgtaaccattttattggttggctactttatttatggcaaagtcatcgaaaaaattttcgtcatcaatcctaa

SEQ ID NO: 569 - DNA, 429 bp, M.catarrhalis
acattggagtatacttggaaccgttggtttgattttatcggtaatcatccagtcttagttggattgctgattgtattaatcattgcattttttgccatcgaaggcaaacgcagtggtcgtaaagttccgccaagcgaattgggcttattggtcaataatcaaaatgctcgcattattgacattcgcccagctaacaagtttgccaatggtcatatcactggtagccaaaatataccgtttaacgaccttaaaaatcacctagctgaattacaagccattgaagtgcctgtgattttggtttgtgatattggcatgcaagcaggtgctgctgtacagctgatcaatcgacccaattttatgcgtcttgaaggcggtattcaaggctatcaatcagcgggcttgcctttggttggtactaataaaaagtag

SEQ ID NO: 570 - DNA, 1776 bp, M.catarrhalis
cccatgagtcaattttggattaatatcatttttgttagtttgtcatttgctctttattttggtattgcgatttgggctcgtgctggctctaccaaagaattttatgtggcaggcggtggtgtacaccctgttgttaatggtatggcaacggctgctgactggatgagtgcagcatcattcatctcaatggcgggtatgcttgccatgggtggttatgctgcctctgcctatctgatgggctggactggtggctttgttctgttggctttattgcttgcaccatatttgcgtaagtttggtaaatttaccgttcctgactttattggcgatcgtttttatagtaaaacagctcgcttagttgcagttgtctgcttgattttggcatgtacgacatatgttattggtcaaatgacaggtgcaggcgttgctttttctcgcttcctagaagttgatagcaacacaggtcttatcattgctgcgattgttgttttgttttatgcagttcttgggggcatgaaaggcatcacttatacccaagttgctcagtactgtgtactgatggttgcttatatcattcctgccatcttcatttctttgaacttaactggtaacccaattccccagctgggtatgtttggcaatgatgtcagtacaggtatgccaattctacaaaagcttgatatgctggttgctgaccttggctttgctcagtataccgctgatgtgccaaataagcttaatatgttcttattgaccatgtctttgatgattggtactgctggtttgccacatgttatcatccgcttttttaccgtgcctaaagtatcagatgcacgcatctcggcaggctggacattgatctttattgcactgttatacaccacagcacctgcagtaggttctatggcacgtctaaatattatcaatactgtttacccacaagggcttaatcagccagcattggcatacgaagcacgcccagagtggatgaaaaactgggaaacgactggtcttttgaaatatgaggacaaaaataatgacggcctaattcaatactataatgacaaaaatgaagaatatgcaacaaccgttactgccgagaaaggttggcaaggtaatgagctgactgccaataatgatatcttagtacttgctaatcctgaaattgcaaatctaccaagctgggtcattggtttgattgcagcaggtggtttggcagcggcattatccacagcagcaggtcttttattagcaatctcatcagccatctcacatgaccttattaagaaaaccatcaaacctgatatcaacgacaaaggtgaacttatggcggcacgcatctcaatgacgattgcgatcgtggttgcaacctatttaggcatgaatccaccaggatttactgcacaggttgttgctgtcgcctttggtattgctgcatcaagcttattcccagcactgatgatgggtattttctcaaaacgcatcaactcaacaggtgcaactgctggcatgattgcaggcttgagtgcaacatgtatctatgtatttttatacatgggctggttcttcattccaggcaccaatagttttaaaaatgtggaagccaactggatcttaggcgtctcgccactgtcatttggagccattggtgctgtaattaacttcattgttgcgatcgctgtatctgccatgggcaatccaccgccaaaagaagttcaagatttggttgaaagtattcgttatccaaaaggtgcaggcggtgcaatcaaccactaa

SEQ ID NO: 571 - DNA, 270 bp, M.catarrhalis
tctatgtcacaacatgaacatcatcataccagtggatattgggcagccaatgtccgaatcattactatttgtttaattatttgggcacttgtttcccatggctttgccatttggcttagaccaatgctgtcaggcatccaattcggtggtgctgacttgggtttttggttcggtcagcaaggttcaattttgtgttttattcttttaatctttttttattcatggcgaatgaacaagcttgaagaacgctttgggatcaaggaggactaa

SEQ ID NO: 572 - DNA, 2886 bp, M.catarrhalis
ctaacttttaaagcccagcacaaggaaaactttatgtcatttaatgatttttcagaattattctatgaaaatgcttttgttcatcgtcatcttggtaaagatgccaatgaacaacaagccttattacaaaccgttggttttgatgatttggacagttttgttgatgctgtcgttcccaaagccgttcgtctgaataaagatttggatttaccagaggccatgagtgagcataacgccttggcaaaactgcgtgccatggcagataatattactgttgccaaaagctatatcggtcaaggttactcacccactcgcctgcctgcggtcatccaacgaaatgtgctagaaaaccccggttggtataccgcctatacgccctatcaagctgagattgcccaaggtcggcttgaagctttacttaatttccaacaagtttgtattgacctaactggcatggatttggcaggggcaagcctgctggatgaagcaaccgccgccgctgaggcgatggcgatggctaggcgtgtgagtaaatcaaaatccaacgccttttttgtggatgagcgtacctacccacagacccttgatgtcattcatactcgtgccaaatattttggctttgaaattgtgataggtgattttgatgttgccaaaaatggtgagttttttggggcatttttccagtatgtcggtaaagatggcgatgtggtggatttgaccgatgtcatcaccgctgtcaaagacaacggagcttatgccatcgttgccagcgatatcatgagccttgtgcttttaaaatcccctgctgatatgggtgctgatattgctttgggaagcacacagcgttttggcattccgatgggttttggtgggccacatgctgcctattttgcctttaaagacaaagacaaacgctcggcacctggtcgtatcattggcgtatcaaaagacgcccaaggtaataccgccctacgcatggcactacaaacccgtgaacaacatatccgccgtgaaaaggccaattcaaacatttgcacaagtcaagtacttcttgccaatctggcaggcatgtacgccgtctatcacggggcggcagggctaaaacgcattgccacacgcattcacgccctagcggtcgcctttgccaaagcggtcaaatcatcagagctggcagtgcgtcatgatgtgttttttgataccgtactggttgaatgtaaagagcaagcacaagcgatttttaagaccgccaaagacaaaggctacaacttatggcagcatgacaatggcggtatttctgtatcatttcatgaactcaccgatgaagcagaatttgatgaactgtgtcaaatctttggggtcaaaggcagtcttgatgccctccagatccaattgggcgatttattaagacaagatgacattttaacccatcctgtgtttaacagtcatcacaccgaacaccaaatgctacgctacctaaaatccttagaggataaggatttggcgatgaaccgttcaatgatttcattgggttcttgcaccatgaaattaaacgccaccagtgagatgttgcccatcacctgggatgagtttgcaaatgtgcacccatttgcacccagcgaagacaccaaaggctacattcagatgattgagagcctacaagcccagctaaaagccatcacaggctttgatgaaatcagcatgcagcccaattcaggggcatctggtgaatatgcaggcttgctcgccattcgtcgctatcatgaaagtatgggtcaagatgagcgtaatgtctgcctaatcccccgctcagcacacggcaccaatccagcaactgctcagatgatgggcatgaaagttgtggtcgttgcaaccgatgataatggcaatgtggacattgatgacctaaaagccaaatgtgatgaacacagcgataagcttggtgctttgatgattacttatccatcaacgcatggggtttttgaagagggcattcgtgatatttgtgatatgattcacactcacggcggacaagtgtatatggacggtgctaatatgaatgcacaagttggcatcatgcagccagctgatgtcggggcagatgtactacacatgaatttacacaaaactttttgcatcccacatggtggtggtgggcctggtatggggccaattggtctaaaatcacacttagcaccttttatctcaaaccatcgtgttgcgcctgtgtttaatgcccagtccgactgttcggcggtttcagccgctccttatggctcggcaaatatcctgccaatttcatggatgtatatcaccatgatgggtcgtgatggtcttttatcagccaccaaacaagcactgcttaacgccaattatatcgcaactaagctaagcgaagattatcctgttttatatactggtaaaaatgggcgtgtggctcatgaatgtatcattgacattcgcccattaaaagcacaaacaggcatctctgaaactgacattgccaagcgtttgatggattatggctttcatgcaccaaccatgtcatttcctgtggcaggcacgctcatgattgaaccaacagaatctgaaagcaaagcagagattgaccgcctcatcagtgccttaaagcaaatcaaacaagaggccttaaaggtgcaaacaggcgaagatggttggacaccagatgacaatccacttgtcaatgccccacacaccgcctttgttataacaggcgaatggacgcatccgtatagccgtgaagaagctgccttcccattgccttatatcaaggcacataagttctggccttcggtgggtcgggtggatgatgtttatggtgataaaaatctgatttgtgcttgcccgagcattgaaaattacgaatga

SEQ ID NO: 573 - DNA, 417 bp, M.catarrhalis
cccccatttaattcaccaaactcacaggagagacccatgagtaatatccccgctgatttaaaatatgttgccagccacgaatggctaaaacttgaagatgacggtatcatcaccgttggtatcacagaccacgcccaagatttgctgggtgatgtggtatttgttgagttgccagaagttgggcgtgaagtatctgctgatgaagagattgccgttgttgagtcagtcaaagcggcaagcgatgtctatgcaccgattgcaggtgagattgttgagattaatgatgagttggtagacagtccagagcttgccaacgaagacccttatggcaaagcatggttctttaaaatcaagcctgccaatgtggccgattatgatgacctacttagtgccgaagagtaccagagtgctttgtaa

SEQ ID NO: 574 - DNA, 249 bp, M.catarrhalis
tggtctcaaaataccaccgaaggcgtaaacggcattgctcttagcactgcattccccataatcgctcaggtaaatggactgaaaattctcggtagggaaacttaccaacacaatctggagaatggtaaattacctaccgaagggaagaaaatgatgataaaatcaaacctagcatcatcattgaaaatctcaggtcaaaggacagatggggtgctaattttggtattattttttaatgttattttttaa

SEQ ID NO: 575 - DNA, 1233 bp, M.catarrhalis
ttgatacaaaaatcatgcctgattgatggcttattaaacatttactatttaaatatttactatttaaaaaccttagagaaatttatgaaatttaccttacatcataccgatggcggcaacaatcatgctcgccgtggcactgtcagcttagcacatggcaatgtccaaacacctgcatttatgcctgtcggcacttatggtacagtcaaaggcatgttgccccgtgatatccatggtatcggtgcagatattatccttggaaatacctttcatctttggctacgccctggcatggaagtgattcgtcattttggtggtctgcatcattttattggctgggataagcccatcttaactgattcaggcggttttcaggtgtttagccttggtgcaatgcgtaaaatcagcgaagaaggtgtggcatttcgctcacctgttgatggtgctaaagtctttttatcacctgaaacctccatgcaaattcaaaatgacctaaactctgatattatcatgcaatttgatgaatgcacaccttaccccgccacacacgatgacgccaaaaaatcacttgagctgtctttacgctgggggcagcgttgccttgatgagcatcatcgcctgggaaataaaaatgcattatttggtatcattcaaggcagtatgtataaagatttgcgtatgcaatctttacaaggtttgctaaagatgccttttgatggttatgccattggtggtctgtctgttggtgaacccaaagaagagatgataaaagtacttgattatctaccatgtgccatgccaaatgataagcctcgctatctgatgggcgtgggcaagcctgctgatattgttgaagcggtacgccgtggtgttgatatgtttgattgtgttatgccaacacgcaatgccagaaatggccattattttgtgacaggtaatcatgacaataaaggtgtgattcgcattaaaaatagccaataccgtaccgatgacacaccacttgatgagcattgcgactgttatacttgccaaaacttcagccgtgcctatctttatcatctgcataaatgtaaagaaatgttatcagctcagttggcaaccattcataatttacgctattatcaacgcttgatggttgatatccgtcaagcgatcgaacaccatgcctttgatgaatttgtagtgcaattttacgctcgctggggtatggtagtaccaccatttaactcataa

SEQ ID NO: 576 - DNA, 1200 bp, M.catarrhalis
gatatgtttgaattatttaaaaagaaaaagccaacaactgaccccatgcaagcagtcattgatgagatgatgctctatggacagccgtttaggcaatatattgagaaaatggatattgttgatgataaaatattgcaattacaaatgcgaatttttgagtctgatgataccgctgagcttgaaaaacagtatcataaattacaacaaaagctgtatcctattggtattaaagaggttaatatcaatgttacggtcagctcaaaggataatggttcggacaatactcacgaccacaccacacagcccaatcttgtcaaaacccatcatcccaccaaaaaaaccgatgccatctccgctcagcatgatgataagccacccactaaggcagcaactaagcagtcacaactgaacgcccatccacgcatcacccatatcatcgctgtggcttcaggtaaaggtggcgttggtaaatccacaacaacggtaaatctggcgttggcacttcaaaagatgggtaagcgtgtcggtattttggatgcagatatttatggaccttccattccaaccatgttgggcgtggcaaccaaaaagccgatcgtagaaaatgaccagtttatcccaattgatgcaaatgggatggcagtgctttcaattggtaatttgattgacgctgaaaatacaccaattgcatggcgtggcatcaaagcaacaggcgcattaatgcagctttataatcaaaccaactggccacagctggattatttgctgattgatatgccaccaggtacaggggatattcagctaactttggcacagcgtattcctttaacaggggcgattatcgtgacaacaccacagcatatcgcactgcttgatgccaaaaaaggcgtagagatgtttcataaaactgatattagggtgcttggtattattgaaaatatggcactacatacctgtacgcattgtggtcataccgaagcgatttttgggacaggtggcggtgatgaaatggcaaaagcttatgatgtccctttacttggtcaattaccactggatgccagcattcgtgtagcaatggataatggcaaggcggatgagttaattgatgccaacttagcttggcattatgagcatattgctaagcttgtcaatgagtgtgctatacagtttaccaaaaaatccagtgagcggtttttttaa

SEQ ID NO: 577 - DNA, 330 bp, M.catarrhalis
aatattcatgaaaagccttatataagatgtggacctaatttaatggaaatggcaatgcaaaaagtaaccatctataccacaccgacctgcccttattgcttggctgccaagcagcttttgaataataaatctgttgcttatgatgagattagcatgtatgatatcaatgctgaggatcgtgaagcactctcagccaaaaccaatggctatcgtactgtcccacaaatctttattggtgataatttcattggcggttttgatcagcttaataaattaaatgccgatggcaaacttgatgagcttttggcgcaatcatttagccatttttaa

SEQ ID NO: 578 - DNA, 321 bp, M.catarrhalis
atgcattgtgatgtttataaatttccaaaaaatgaaggttggtatgtatacatcggccgacctgactatccaaatgacacagaaaaccttaaggatttgcttgggtgtttgcctgcaacaatgcgtaacaaaactggtttttggcagtttattatgcatttagatttgtcatcaaggcaaaaattagctcaggcggacattcatcaagttaaagccaaacttaacgaacaaggctattatgtgcaagcaccgccatcggagatgctggcagctcaagcggctatcaaagcccaagatgctcaggataaacaatttgattaa

SEQ ID NO: 579 - DNA, 951 bp, M.catarrhalis
  unsure (215): Identity of nucleotide sequences at the above locations are unknown.
ttatatggtttacgctctcttgggcattgcgccaatcataaaaaacccaaccacaaagccaccaatgtcagttcatcaccaacagcccgcccccatctgtatagcaggggatcacgcattggccttagagggtctgaaaagttaaaatatgattatgaggttttgtacaagttggagtaccgtctagaaaatgatggtgatttccgcaatgaaanaatcaagcagccagatggtactgaaaagactgttgctaaaacacgcaattttgaggctcgtgattcatggattggcgtgaagcataaaaagtatggtaccatcaaggcgggtcgtatgttgtctttggatccatatgtgcgttatactgcctatttggcgtcaggcgtagatggggtgcgtaccaataataccattgcatacgaatcaccaaaaatcaaagatgttagttttcaggcgatgtacatcttagatgaaaataaagagacagataccattgatcgtgatggttattcattgcttgtcaagaaaaacacagatacatataatgttggtgcagcttatgcctattttggtaaagcaaaaacctcttatggcaagattaactatactgcgcgtgtgacaggtaattataaaattaatgaggattataaagtaggtggtatctatcagcatgtcggctatgccaatgacgacagtgccaaaaataatacagaacaagctgttggcgtggctttgcagcattttaaagacaaatggactcataccgcacacatgaatcttgtgaataatcctagtgggaaaaagggcgatgggtttgagctgatcggagcaattgaccgtgatatttctaaaaatgtctctgcaggcatggatatcacctatggtaactttaactacgcaacagaaaaagaatcttacatcaacccaactatctatgcgactgtatatttttaa

SEQ ID NO: 580 - DNA, 870 bp, M.catarrhalis
acaaatctttgtatcatggctttgtgtatgccagaaaaaaatttattaaaaagttcaatcaatcacagcttaataaaaaataagatctatatcattatcgaagggacggacacgcctgccggtaagttatttgatgtgctaatcttagtggcaattattaccagtgttttggtggttatgctcgatagcgtattatttttacgcttgcaatatgggcgtttatttttcgttgctgaatggttttttacgattttatttaccatagaatatgcattgcgtctttattctgcaccaaatcttcgtcgatatgtgaccagtttttatggggcagttgatttattggcactattgccaacatatttgagcttattttttgcaggtacgcattatttgctggttgttcgaattcttagaattcttagaatctttcgtgtctttcgactcaaatcttatatgcagcaagctggatttttggcggctgcttttaaaaccagccagcataaaattacggtattttttctatcgctacttctgcttgtaaccatttttggctcagttttgtatgttgttgaaggccctgaaaatggctttacaagtattcctttatcaatctactgggcggttgtgacattgacaacggtaggttatggcgatatttccccaaaaacaccactagggcaggcgatcgcaagtatggtgatgattacaggttatgccatcatcgccgtaccgacagggatttttactgctgagctaactcggactatgcggccgcaacttcagccaatttcttgcccaaattgtggtaaatttgggcatgcaactaatgctaaattttgtgaccgctgtggtcatgacttacatgtataa

SEQ ID NO: 581 - DNA, 432 bp, M.catarrhalis
gcgagcatttggcgcttaatacgcccgtctctagtctcatggaggctttgtaatgaaattgcaagctttaaaccaactgataataatgacattgctgcacaccatgaagctatcgttgcgttattgacattgctatctttatatgctccacatgttggcgaatatttgttagaagcactaaaaatcgatgcacgcacccaagctttcccagtcttggataaatcagccttaatcaacgataccatcaccatggtggtgcaggttaatggtaaagtgcgtggtaagatggaggttgcctctggtacagatcaggccgagcttatccgtgaagccaagaatattgaaggtgtgtcgaagtatctcattggtgacattaaaaaagagattgtcgtacccaataaactcatcagctttgttgtggcgggtgcttga

SEQ ID NO: 582 - DNA, 1086 bp, M.catarrhalis
acagtactatgcgcttggcagtcagatacatacgccttagccatgcaaaaacgatttttggcagttaccgaatccctcaaaaatcccacaatgacgctgagcggtttatggcttttgcattctgatgagccactgatgattcaatggctcattgatgcatgccatccaatttggcaagccaatcatcaagtgatgaaacgcattgatcttacctcccccaaaagctggcacgaggttacccaagaacttatatcactatcgctgtttgaagaatctaccgccatcattctaagcggtaagcataagcctgatgatgccaccttaagtcaattgatagattttgctcatgatgccaaagcaggtactagcacacatcatctgatttggctgctgcccaaacaagataaaaaatctcaaaataccaaagcatttaagctgtttgatcagcatgggctgattatccatggcactatccaaaatgaatctgagcggcgtgcccttttagtggccaaggctcaagattttaagctttcgctcaccgctaatgcgtggcagatgctgatgggccatacccagcatgatttattaaccgcttatcagacgctatggcgtctgtcctatgctcacactctgcctagtcagtcacagctttcggtaattgatgtgcctgatcttagcacacttttatccgaaggtggcgtgttcagcgtttttgatttatccgatgcactcatccaaagacagcccaatcaatgcctaaaaatcattaattatctttatcagacagataccgcacccagcattattttatgggcaatctcaaaagacattcatctgattgccgccctaaaacatggtcaagatccccaaaaacttggcatttggcgtaataaagttttgaattatcaaaatcttgcaaataacatctctgatggcatgatatcgcattggcttactcaggtttatgaaattgacaaagccatcaagggcttaagccaagataatgcttggcgattaatcagacaattggttttatctatttgtgggattgatatacagggtttacactcacatcatgagcggtaa

SEQ ID NO: 583 - DNA, 537 bp, M.catarrhalis
actcatcagctttgttgtggcgggtgcttgatgcaaataaaatctatgattcaagcaggtgcaatggtattaactttactatcattgaccgcctgcggatttggtctacgaggtatcagtgagacaggcattcagttagtgccgacttatagtcatgtaaatatcatcaccgaaaataatgctgtgagctatgcactcaaacacaaacttgaaacacagatggctcagcttggtgtggtgagcgacaccaatgccgcccatcagatccaagtcagtaatttacgctatcgtgaatataaactgctcggtgtgttatccgaaattcgcttggtgctaactgctgatattatctatcagatgaacggtcagaccattcgtagagtggtgcaagctgagcgtagctatcagtacaatgaagctggtgtatcaaccaaagatcagcaaggcgaaattgttaaagtatggctacaagacagcctagcacatcgcatcgctgaacagtactatgcgcttggcagtcagatacatacgccttag

SEQ ID NO: 584 - DNA, 498 bp, M.catarrhalis
aattacattttttatacacatataaaggataaaccaatcatgatgttttgggaaatcttggcaaccatctttagcggttttttattggcaggtcttgttatgccaatccgattattttataagcgtgcaccaaaatggatcgtacctattgcagcaggattgggaatgattggctttcaggtatataccgaatatgcttgggcaaatgatgccattgccaagcttcctgaccaaagcatcgtcgttgccaaagtagaaaaaagcacttggtttcgcccttggtcgtatgtcaaaccacaggtttttcaatttgtggtattagataagggcaacactcggatagattttaataatccagccattaaacacagtacgctgtatttttttgaacgccgtgcagcagtgcatccacttggcatttctgttgattgcactcatcctaatttggcatttaatgacaccaccaatcaaaatattatcgacgccctttgtctatag

SEQ ID NO: 585 - DNA, 513 bp, M.catarrhalis
cccaattttatttttggtcaaaaatcaatgaattggttaaaaaatttaccgcttgagaaaatcggtgaagcactggcaggcttttttggcttttgggggcgattgacggagggtgtgcctgcaagtcagttgccgttcatcgtttatgtcgtctgctgtggattggtgttactgttgtggcttgttgtcatgcgtctgataccccaaccttttaaggggattagtttagcagtgcttgcagctgttatgtttacacctggtcaagcggcagggaatagcggtgagattgcccctgcgatgattggcgtattttatgccattttgatgaaagattttagtgctgcacttggggcagcagtaccgatttttgcgatacttgctgcgttgcttgtggtgggtgcagcttggcagatggttcgaggtgtgcttgtggctaatgctgaaaagcaggcttgggtaagacaagttcaaaagcaaaaacaacaattgccacaatctgaggacaaaaactaa

SEQ ID NO: 586 - DNA, 411 bp, M.catarrhalis
ggagtccttatgagacattatgaagtggtgctactggtacatccagaccaaagcaaccaggttgccgacatggtaactaagtaccgttctatcgtagaagataatggcggtaataaccatcgcctagaagattggggtcgccgtcaattggcttatccaatcagtaaaatccacaaagcacactatgttttgctaaacattgagtgtaacgatgagacattggcacagttagaagagctgttcaaatacaacgatgccatcattcgcagtcttatcattcgccgtgatgaagccattaccgaacaatctcctttggcaaaagaagccgaagacaaacgcactcgtaaagccaaccgccgtaacgatgttcgcactcaggaagctgagagtgataacaccgcaagcgaataa

SEQ ID NO: 587 - DNA, 474 bp, M.catarrhalis
gcagtccctatgaaaagcgtacaagtcaaaatccttaatcctaaaattggctctcatccagactttcccctaccaacgcatgctaccgcaggctcagcagggattgacttgcgagcctgtattgatgagccaatgattattgccgcaggagaaaccaaacttgttggcactggattatccatttatatcagcgaccctaattttgctgggctaattctccctaggtctggacttggtcataagcacggcattgtacttggtaatttggttggcttgattgattctgactatcaaggtgagctgatggtctcgatatggaatcgcagcgataccaactttgagcttaagcctgccgaaagaatggcacaatatgtcattgttcccataatgcgtcctgactttgagattgttgatacttttagtgatatcagcactcgtggatcaggtggttttgggtcttctggccgccattaa

SEQ ID NO: 588 - DNA, 456 bp, M.catarrhalis
ggaattatcatgtctgaagaacttcagccacagctcggtttagagcgtatctacacaaaagacatttcatttgaagtgccaaataccgaagtatttaccaaacaatggcaacctgaaactgatgtcagcatcagcacaagcgataacgatttagatgaagactacaaagaagtggtactcactgtcagcgtaactgccaagcttggtgagtcagttgcgttcatcgctgaagttcagcaagcaggtatttttttgatgcgtaatatccctgaagcagatatgccacatttgctacaagcgtattgcccaaatattttattcccttatgctcgagaagccatcagcgatatcgtgacgcgtggtagcttcccgcagttactacttgcacctgtgaattttgaacaagctttcttacaaagtcagctagaaacccaaaatgacgaaggcaatgcctaa

SEQ ID NO: 589 - DNA, 807 bp, M.catarrhalis
aatcatcaaatgtcaattttacgccctgtgtctcccatcagccccatcaaccaagccctgcttgcattggcagtcatcgtgatgaccgctgtgtttattgagcatggttcggtcgatgttaccatcagttcatggttttatgtggagcaaggccgctggttattaagcaaagaccaatttgtcttttccatgctgttttataaattacccaaatggttgttgattgtgtttggggcgtatctgctgactactttagtatggcgtcaattcattaccgatacaaaattcattgctgataccaataccatggctgataaaacagacaactcagcaaaatcgctgtttgggcggagagatgcccccatttatgcgcctttggctaactttgggcaatctgatattttatatgtgtttgctgttttggcattaacaccgctgttggtggcaacattaaaatcgctgacgcatgtgccttgcccccatgaactgctcatttttgctggtgataagccttatttgtctttatggcaagacatactaagccaacagcgtgcaaaatgcttccctgcggctcatgccagctctggctttggtttatatggtttggcgtttgtgcctgcgttacaacacaaacgctggcgttatgtgattttggtcagtgccatcggctggacaatggggctttataaaatgatgataggcgatcatttttttagccatactttggcatcgatggcattggcttggtttgtggcaagcggtttatcagcggtgttttttaccaaaaagcatgacattgatttttag

SEQ ID NO: 590 - DNA, 558 bp, M.catarrhalis
ggaaatcaaattatggcaaagcaagttgcagtattaatcggtagtgcaagccaaacttctgttaatcggttggcgtttaactatcgtgaatctgttgcaccatcatcactacaatttaaagtcgttgaaatcgcagatttgccactgtatgatcgtgatttagacgagcaagatgtacccgcttacaaccgatttcgtgaagaaatcaaagcagccgatgcagtactatggattagcccagagcataatggtggttgttcggctatgattaaaaatgccattgatattgcatcacgcccaattggtcaaagcgtttggactaataagccattgggtttaatcagtgtcaatgccaatggtagctcacgggtcactgatcagctgcgtaccattgcgacaaatccagcgctcaatatgccaacactgccctttggtgcatacttcggcggtatctttactggggcgttcaatgaacaaggtgagctggtatctgagcacggtcaagcaactttaaagaactttatcaaggcgtatgctgaatttattgaaaagttttag

SEQ ID NO: 591 - DNA, 462 bp, M.catarrhalis
ttactagaaatctgttatgtctttgaagttgattcggtaaatgaagaagtggttgatatactgattgccagtaattttatcccagtgattgcatcgcttggggtggatgtcaatagcgatacctataatatcaatgcagatttggttgccagccgtgtcgccaaatttcttggggctgaacgcttacttttactgaccaatattaaaggcgtgctggataaacaaggtcgtgtactcacccatttatcagccaaagatattgatcacttaattgctgatggaaccatttcaggtggtatgattcccaagattgaaggtgcacttgaagccatcagatcaggattgcacagcgttactatcgttgatggtcgtgtgccacacgcatgtttgcttgagatatttaccgaagaaggtgttggcacgcagattttatgcaacaaatcgtcaaatcctatgcaataa

SEQ ID NO: 592 - DNA, 384 bp, M.catarrhalis
tacctcgtttttggtattggttatgatgctaaacatgaaaaatttggtggaaatttatacattacccgtgtcagtgccaaaaatgctgaagatacctacaatctattttggaaagaggagcaagcaaacgatagtacgcttagatggagaagtggcggctatacgacggttgatttaacaggttattataaacctaccaaaaacctgacgctgcaactgggtgcgtataatcttaccaataaaaaatatatgacttgggattcggcacgctcaattcgaccatttggtaccagtaacatgattgataagaaaaatgacaaggggattaatcgtttcttagcacctggtcgtaactttaaggtaagtttagagtatgtcttttaa

SEQ ID NO: 593 - DNA, 249 bp, M.catarrhalis
gggtcgttagttcagttggtagagcagttgactttttattcaattggtcgcaggttcgaatcctgcacgacccccatttattccccaatagctcagtcggtagagcatcggactgttaatccgtgtgtccctggttcgagcccaggttggggagccaaatttaaaaattccttagccatcttaatagctaaggaatttttttatatcataaaaaattttatctattaccaatatcctaaaaatcaataa

SEQ ID NO: 594 - DNA, 483 bp, M.catarrhalis
atcatgcaagttattctattacagcgtgtcgttaatcttggtaagcttggcgagactgttgatgtaaaagcaggttacggtcgtaactatctcatcccacaaggcaaagcactgcctgcaactgaagccaatttggctaagtttgaagctcgccgtgctgaacttgaagctttggaagccgaagagttattagctgctaatgcacgtgccgaagccttagctgatgtgaatgtcatcatgcgtgccaagtctggtgatgaaggtaaactatttggctctatcggtgctcgtgatatcgctgatgcattaactaaatctggcttagaagttgaccgttctgaggttaaaatgccagaaggcgctttccgtcaaattggtgaatataaagttacgatccagctgcaccatgatattagcaccgatattttagtgaccattttgtcggaagatgcaccaactgccgatgaagatgatagcgaataa

SEQ ID NO: 595 - DNA, 2301 bp, M.catarrhalis
ctaagtttatttcttaactttccactttttttggatagcaatatgagccaaatttctttagaagattataatttttctgccatcgaaaaacaactacaaacccaatgggaaagcgacaaacgctaccacaccaataacgaaacaacggataaacccactcgctacatgctctcgatgttcccttacccaagcggcaagctacacatgggacatgtacgcaactatgccatcaccgatgtgcttagtcgctattatcgccaaaaaggctacgaagtcatgcagccaatggggtgggatgcttttggtctacctgccgaaaatgccgccatcgctaatgcggttgcacctgccaaatggacctttgacaatattgctaatatgcgtgaacagctcaaggcattaggactttcgattgattggtctcgtgaatttgcaacatgcacacctgaatattaccgctgggaacagtggctatttctacaattgtataaaaaaggcttggtatataaaaaacttgccaccgtcaattgggaccctgtggataataccgttcttgccaatgagcaagtggtcgatggtcgtggctggcgttcaggtgcgattgttgaaaagcgtgatatcccgatgtactactttaagatcactgattatgccgatgagctgttagatgacctaaaaaccttggaggggcattggccaaagcaagtactctctatgcagcaaaattggatcggtcgcagccaaggcatggagttggattttacttattcaatcgatgaccatgatgctgttttgcgtgtctttaccacacgccctgataccatcatgggggtcagttacttagcggtcgcagccgaacatccgcttgctcagcatgccgccaaacaaaacccagctatcgctgaattctgtgcagaatgtaaacaaggctcggtcgctgaagctgacattgccaaagctgaaaaagtcggtatcaatacaggcttgaccgcaaagcatcccatcacaggtaccgatgtgccagtatgggtagcaaactatgtactgatgagctatggctctggtgctgtcatggcagtacctgcacatgatgagcgtgattttgaatttgccaataagtacaatctgccaattccacaagtcattgattttaagaacaaaccaagtaactatagcaccaatcaatggcaagactggtacagtgataagacagggttttgtatcaattcaggcattttggacggcttgtcttatcatgacgcagtcaccaaagtcaatgaaatcatcaccgaaaaaggcttaggtcaaaccaccactcagtatcgcctgcgtgactggggcgtgagtcgtcagcgttattggggctgcccaattccgatggtaaactgcgaatactgtggtacagtgcctgtcgatgaagctgatttgcctgtggtgctgcccaccgatgttatccctgatgggcgtggcaacccactcaaaaatatgcccgaatttctacagaccacttgcccaaagtgcggtcagccagccgagcgtgaaaccgatacttttgatacatttgtagaatcaagctggtacgctcaacgttttgtatcaccacacgatgacagccaaatgattgagcgtactgctgccgataaatggctgcctgtcgaccaatatgtcggtggtgttgaacatgcggtactacatttactttatgcaagattttttcataaagtgatgcgtgatgaaggcttggtaagtaaagatgagccttttgccaatctgttggctcaagggatggttttggcaggtacttattatcgctcaaacagtgatggtagtacaacttactatttcccacatgaaattgattttgtcatgaatggtaccgaaatcgaaggcgctaccttaaaagccgatggcaagcctgtcaccattggcaaaattgaaaaaatgagtaagtccaaaaataatggtgtcgaccctcaagagattattgagcaatatggtgcagatactgtgcgtctttatacactatttaccgcaccagccgaccaaacacttgaatggtcagacagtgccttaaaaggtccacataattttatcaaaaaagtatggcgtaccgttggtgagcatttgtcagccattcaaaatcaccaatcaaatgatctaacaattaataaagacacgctttcaaaagatgccaaaaatctacgccgaaaaactcatgaaaccatcgctaaaatagatgtcagcttaggcgagcatttggcgcttaatacgcccgtctctagtctcatggaggctttgtaa

SEQ ID NO: 596 - DNA, 258 bp, M.catarrhalis
ttaacttcattgttgcgatcgctgtatctgccatgggcaatccaccgccaaaagaagttcaagatttggttgaaagtattcgttatccaaaaggtgcaggcggtgcaatcaaccactaacctaccctcttataaaaaatcgctcagaattctgggcgattttttaataagtttaaatagtttttttggtgacacccataagattgtgataatttttatggcattttatgctgtagttatctataatatttattcataa

SEQ ID NO: 597 - DNA, 966 bp, M.catarrhalis
attttaatttcagtaatccaaggtcgcccatacgccaaacccaatatgattatgatgaaagtgccaaaccccaaacttttaacaacttcattgcttgttttaacttcagccatagcagtcttttctttttctgcttgctatcagattggggatgtggtgaatgaggcggcagctgaggcaacacagcaacccccaattagaactcccaagcagactgctaaattaaacgccttcgaaaattcaacctatcaaacagcaactgatgagctacttaaagcttataactggacattgatatctgccgaagtgcaaggagcaccaattcacagctacgaaaatattattaaaaatcgtgcagggagcttaagtttttcaaatcgtggactttactttaatgtgggctgtaaccatcactctcaacattatcaattatctgaaggcgttttatcaattcatcacagaacatcaactttaatggcttgtcatcattctgacagccactcacctgatttagctcaagttgaatcaaaatttgcacaggatttaaacggctcaaacctacaaattaaaactggtcctgacgaatacacagccaccttattactccaaaaaggtgctcaggtactcacttggcaaggtgatatgaaacctgaagttcgttttggggagtcagtattgctattttgggaaattgaaccaaataaaattaactgtattgatgaaattggtcaagagcaacgatgtttaaaagtgcgtaatgtcacttataatgaacaaggcattaagactggctctggtgcatggcgtaccttttatggtcaaattcatgggtatgagcatcagcctaatttgcgtcaaattattcgactaaatgcctacaataatcctgatagtaaagaaaacccatattatatctatgatagacctgttgaaatttactatttggatgttcccgtgtctcaataa

SEQ ID NO: 598 - DNA, 1584 bp, M.catarrhalis
gatgaagcttctataaaactaaccaaacaagatattaacacaaaagcacgcacagatgattattgtgatggtgagcattgtcaagcactgagcaacccattaggattacagcttaaagatggtaaagttgtggataaaaatggcaatccttttacggttgctgcagatgaaaacggtaaagctgtgtttcatgcgaatggtaaagtgtattcagattttgatagcaggcgtgttgatcagtattggtttgattgcgatgcctttgactgtgatagcccagttgatgtttatgaagcgaactatggcagatttgttcgtaccacccaggtaaacttggatcgtagaaaaactgatcctaataccaataaaacttacgcaacgacttctcagtattctcataagatactgatgtcatttccatcaagccaagggtatttagaaaatttatattctgatcgtgatttaaataccaataccaagcagattaatattgactttaaaaagcggctggataaaggtagtgtatctcatcacatgacttatggtgcaagctatgaaacaaccgaaaaatccatggtcaataaatctggatacaatgcttggtcatcgacttggtggagtgataaaaccttaggctgggattttagtgaaaaacttcgcacctgtgataattcatcaacatttaatggtctgttgtgtccaagacacactactttttcatttttaattcctgtaaaaactaaagatggctcggtttacttaaatgactctgtcttaattggtgatcgggttcgtttggaattgggatatcgctataaccgtatcaaatatcagccaaattatatacctggacaaactgccaaaattccagatgatttggtcaaaggtctatttattccactaccaagcaatgatgttggcgaagaaccaaaatggtggagctcaaaatacagtggtagaaacgacccaaaatttagaaccgatttggcggattatcatgccaaaaaagaggcttatgagaccaaacttgcccaaaaccctgcaaaaaatattgcctatattggacaacccaaaacccattcgcagcattcatacagtctctcgcctgcgtttgatgtgaccaaaaatatcaatttacaggtcaagtattctaaaggcttttataccgattttattgattttgttttccgtggtttggaggatattgaaagaaaaagttctagaaaatggccagtttatcaaagcatgaatcggcaaaatgccaaagcagaaggcattgagattaattttgtactaaaattgggcgagctggtgcctgccatagatgggacacaggtcagctataagatgacacgccaaaaaggccgtgccgatggtaatattccgatgaatgccattcagcctgatacctcgtttttggtattggttatgatgctaaacatgaaaaatttggtggaaatttatacattacccgtgtcagtgccaaaaatgctgaagatacctacaatctattttggaaagaggagcaagcaaacgatagtacgcttagatggagaagtggcggctatacgacggttgatttaa

SEQ ID NO: 599 - DNA, 906 bp, M.catarrhalis
aatatgcgatttagtcatttgatgatgcagattagcttggttgtaatttctatgaaaaaacttgaagaattgtttagtaaagccgatagatttggacgcattgtcgccaaccgttttaataaaattaaagacttaaatgacattcgtggcattggggcggggaagacagtgctgattacaggggcaagctcgggtctgggtgcgatgatggcgcgtaagtttgcttttttgggctatgatttggcgatttgtgcacgccgcctagaaaggcttgaggcaatcaaggctgagcttgagggtgattatggcattacggtacatatcaaacgcttggatgtgacggattacgagcagatttttgaagtctttggcgaatttaccaagcaaattggtcaaattgataaaatcatcgtcaatgcaggcgtaggcgacagtcgtgtgattgggcatggtcgatttaatattaaccgtgcgaccgccgaaataaactttattgccgccattgcccagtgtgaagcggcaatgcagatttttcgccgtcaaaatagcggtcaattggtggttatctcaagtatgtctgcggtgcgagggttaccgcgtcatttgacaacttacgccgccgctaaggctggtctcgctagacttgctgagggcattcgcgccgatatgatcaaagaaaagttaccgattacggtatcgaccatttacccaggttatgtacgcacagatttaaatattggggcgaaatatctgccttttgaagttgaagaagatgaaggtgctgatgtcattatcaaggccattgaagccaaagttgatgaagcttatgtgccactatggccatggttacctattggacttggtatgaaatatttgccattaagactaattactaagtttatgtaa

SEQ ID NO: 600 - DNA, 1188 bp, M.catarrhalis
atcaaaccatctataggcataatgtgggttctgatctgtgcttatcttgataagcttattggcacatctaaaataaaacagggagcaattatgagccacccaatgacgcacaatcccattacgcaacataaagaaattgatgacgtgaatatcgaaaaattcattccgctaattaccccaaattgcctaaaaagcgagctgccactgtcggagttggcttatcataccgttctaaatggacgaaaaaccattcaaaatattttagatggtattgataagcgaatcttgattgttgttggaccatgctctatccatgatcctgtggcagcacatgaatacgccgacaaacttaaagtactgtcagaagagcttaaaaatgagctttttattgtgatgcgtgtttactttgaaaaaccccgtaccacaacaggctggaaaggcttaatcaatgaccctgatatgaatgacagctttgatatcgaaaaaggcctacatatcgcaagaaagcttttgcttgaattaaacgaaaagggtctgccttgcgccaccgaagcacttgatcccaatacacctcaatacatgcaagatttaatcagctggtctgccattggtgcacgcacaaccgaaagccaaacacatcgtgaaatgagttctggcttatcttgccccgttggctttaaaaacggtaccgatggcagtatgactgttgccgtcaatgccatgcaagcagtacagtcaggtcatagctttttgggattgtctggcgatggtcaagtatctatcatcaaatccaaaggcaaccgctacgctcatgttgtcctacggggtggtaatgataagccaaactacgatgaaaccgctgttgctgccgctgaaaatgagcttgctaaaggtaaaacaaacggtaaaatcatgattgatgccagtcatgccaacagtggcaaagacccctatcttcagcccatggttatccaaaatgttgcaagccaaatccaaaatggcaattcatctattatgggactcatgattgaaagccatctgaaaggtggtcgccaaaatattcctgtcaatttagatgatttagaatatggtaaatccgttactgatggctgtttggactgggaggcaaccgttgaaaccttacgcaccttcgctaaaacagtgaaagcacatctacaaaatcgctga

SEQ ID NO: 601 - DNA, 222 bp, M.catarrhalis
ggcgaccaatcaaggcgaccacaggttttatactcatgttttactcttaatatcgttaaaattgaatctatagcaatgaggatttgggtgatcatgcatcaatcatcattaaaccaaaacagcaaagcctttgccactgatatcatgacaaaggatattgattttattgattatttaaaattgccaaacagtcacaacgccatctgcggattgggcatataa

SEQ ID NO: 602 - DNA, 3729 bp, M.catarrhalis
aagattatgtcctttgtacatttaggtattcgtagcgaatacgccattatagactcaattgtccgtatcaaagatttggtcaaagccgccgtcgctgatggtcaagatacgcttgctttggctgactggaataacatgtttgcagcagtcaagttttataaagcgtgtattgacgctagtattaagccaatcattggggctgaggtggtggttggtgagcatagtgataaagatgctgctgatgcacgccacagcgtcatcctttatgcgatgagccatcatggctaccaaaacctgatgcgtttgatttcagatgcttataccaaccgcccaatgaataatcatggttcggtagagtttgaaacacccgtcatcaccaaagcggctctggctgaatattccgatgaattaatcgccatcttaacacatcgctcagagattgctcagcctttacttagccataaccctgacaatgccctgcctattttacaaacatggcaagatatttttggcgataggctctacattggcattcgccgagtcaaagccagcgatgataagtttaatgaaagtgccatcattcaagctgccaagcttggcattgctatcattgcacataatgatgtacgctttattcacgcaagcccaactgagacaaatgacaaaaataataccgtcagtacagactttgatgcacatgaagctcgtgtgtgtatcgcaaatggctataccttagcagatgacagacgcccaagagaatacaccgaacttcaatatttcaaaagccaaaagcagatggccgagctgtttgctgatttgccccaagccattgaaaatacacgcctactcgccagccgatgcaatgtaaccatcacacttgggattaatgttctgcccgattttcctatcccaaaaggtgagaccattgagactttttttaaaaaagtatccgccgatggcttaaacagacgccttgagaagctctatcccgttgaggaaagaggtgacgattgggatcaggtacgaaaaccttatgatgaacggcttgactatgagcttgatatcattcttaagatgggttttcctggctattttttaattgtcatggactttatccgctgggcaaaagccaatggtgtacctgtcggtcctggtcgtggctcaggtgcaggctctttggttgcttattcgcttaatattactgatcttgaccctttgagctatgatttgttatttgagcgattcttaaaccctgagcgtgtctcaatgcctgactttgatatcgatttttgtatcgaagggcgtgaccgtgtgattgactatgtggcacaaacatatggtcgccaagcagtcagccaaatcatcacctttggtacgatggcggcgcgtgcggtggttcgtgatgtcacccgtgttcagggtaagccttttggtctaggtgatcgcatctcaaagatgattccaaaaacacctggtattaagcttgaagatgcctttgatcaagagccgcagctcaaagagctactgaccaatccagatgcaccagatcatgagctggctcttgagatatgggagatggccaaaaaacttgaaggtctcacccgtaatgtcggtaagcacgcaggcggcgtactcatcgcacccaatcgtatcagtgacttttcggccatctattgtgatggtgaaggtcatcctgtcagtcaatatgataaggacgatgttgaagctgtcggcttggtaaaatttgacttcttaggacttcgaaatttgaccgtacttcaagccgctgttgataacattaaccaaactcgtcaagctcaaggtcaatcctcaattgatttagaaaccttaccactcgatgacgccgatgtatacacttcagtacttcaagaggccaaaaccagtgcggtatttcagctagaaagtagcggcatgaaaaaatacttagcacagcttaagccctcaaatatcgaagatgtcattgcgatgtgtgctttgtatcgacccggcccgcttgagtctggcatggtgtctgattttatcgatagaaagcatggtattcaagaagtggcttatccccatcctcagtttcagcatgaactgctgcaaccaccccttgaatcaacctatggggtcatcgtctatcaagagcaggtcatgcagattgcacaggtcttagcaggttataccttaggtggtgcagatatgctaaggcgtgccatgggcaagaaaaaacccgaagagatggccaagcagcgtagcacttttgtggatggtgcgattgagcaaaatatcgatggcggtttggcggcacaaatttttgatttggttgaaaaatttgcaggctacggttttaataaatcacattcggcagcctatggtgtgcttgcttatcagactgcttacctaaaacattattatccagctgaatttatggcagcggtcttaacatctgaaatggatgataccgaccaggtggtttttttactgtctgattgccgtgataattttgggttaactatcatcccacccagtgtcaatcatagccaatggaaatttgtggtcagagatgccaagacaattgtttatgggcttggtgctgtcaagggcgtcggtgaagaggcggttaatagcattgtcgctgcacgcaaggacggtgcttttaaggatttatacgatttttgtaatcgtgttgacatcaaaaaagtgggtaaacgctcactagaagcactcattaaagcaggctgttttgatattttagccgaaaccttaaaaccacactatatcaccgatcactcagattgcagttaccaaattcgccgtggcttgtggcggcagctccccgaagcaatggcagctgccgaccaaaaccgccaaaaccaattaattgggacgatggatttatttacagatgtcgatgattcactatttgtcgcaccgccacttgaagatgtctactggcagccacaagatcgcttacgctatgaacaagcgacacttgggctgtatttaactggtcatcctttggatgaatatcgcagtgagctacccttatatactactgttaaaagtgtcgttgatttaaaagataccgccaaaggctttgcatggattgcaggcttgatttatgatgtggcattttttggggagcgtattgtcgtcaagcttgacgatggcaaaggtcgcattgaaatgagctgctatggtgagacttttaatcaatttaaagaagttttgaccgcaggtaagcgtgtgcttggtattgatgaagaatacaaaccgttatacaccaaaggtgagcgtgcaaatatgaccattgcaaatatcgtcatcgccaaaatcagcgtccgagaaaatgatgatggtcggatttttactcgcctacatcacattgagtctatcgaaaatgctcggattcgccgactaaaggaaattcatctaaagcttgcttgtgatgacactcaagcacttgaggggattttaagtgtgataaaagaaaatagcccaccgcctgagctaatcaaacgaggctctcacccaacttcagagcatgatgatatagacatcagtcaagtgggcgatttatgtgtacctttatcattatacttatatgatgaatgcagtgttgcacgcatccaaaccaatgaccgattacggctataccccagcgaccacaatattgctcaattaaaaaatcatatcactgatgatcatttggtgtttcgataa

SEQ ID NO: 603 - DNA, 336 bp, M.catarrhalis
attggcctttatgtggatgcaccggtaatggcaaaacttgcccctgagttttggcatgagcctgaacatgcacttgcagcagttcagatgggcttagatttggtacatcaaattttataccacgcacctgattatttgacaaaagatggcttgttggtttgtgaagttggtaatagcgagtgggcattacgccaagcttatcctgaaattcggtctgattggctgacctttgaaaaaggcggtagtggtgtttttgccatcacatgcgaagagcttttggaataccgagaagattttgccaaacaagttgagcgtgtgcaaggtttgacccactga

SEQ ID NO: 604 - DNA, 627 bp, M.catarrhalis
aatggacgctacatgaaaatccgagtaaagtggcctatggtaatggcgatggggctggttttaagtgcctgtcaaagtacaccaataccgcctaaaaataatccgcaattggcacaaatccgaacccaaattgcaatctcgctactggacatgggtaagcttgatcaagccaaacagcagttggatgctgctttatcggctgatcggcagtttgcacctgcctatcgcaccttggcaaaggtttatcaagcttcggaggatgccactcaccaaaccaaagctcaacgcttgtttgaaaaggcgattgaactaaatcctaaagatatgcaaagttatatggattatggattttatttggtgcagatgggggacttgtcaggtgcgttgatttattttgataaacctagccgagccatcggttatgaagggcgtgtggtagccatcgaaaatatggcatatatttattatcatcaatatgaagctgccaaatcaccaacaaaagatgactataataacgccaaatcagcacttgagcgtgcgttaatttcaggcactcaacatgatgaaatcaaaaagtcttatgacaaattattaagtgattataaattattaagtgattataaatag

SEQ ID NO: 605 - DNA, 522 bp, M.catarrhalis
gtttggatatatgatggcacaaaaccaacaagtgttaacccccaagcatcaaagacagcaatcacagataacaacatatataagagcaatactgttatgagtaatccaagttttaaagatttgttatcaaaatctctacaagaagatttaaagcaaatgaccaaggcttctaccaaacctgaaatggcaagtgataaacctaacgagacggtcaatttgcccagctcaaaggcaattttacatgaagtgaagcgttttaatcatgatgccatcaatgatgataccgtgctatttatgcaggcgatgagtggcgtcataccgttaaaaaccgatgctgtcgtcagccataccaaacccacccaaaccgatgaaaatatgttgcgtcgccgtgcgtcagctgaaggcgatgagccaattcaaggtgttttgtctgatatgcaagcgttattaaatcctgtggcgagtgaggcttttttatcttacaaaaacccaccttacaaaacaaagtctttgagcagttaa

SEQ ID NO: 606 - DNA, 465 bp, M.catarrhalis
cttagtcaatacccgtattcgtaccgccataatcacgagattattatcccaaatggtgatattatgacctctgctagtatcaactattcctccttgccaaatcgccgtgtagatgttgaggtgggtatcggttataatgcagatattcgagaggcacgcaaggtaatgattggtcttgccgaagcccatccaaatgttttggatgacccaaaaccaactgtcattgtcacagcattggccgatagctctgtggatttggtgctgagagtatggaccaataatgacgattggtttatgacgcaagcagatttgcttgagcaggtgaaatatgcgtttgatgaagcgggcattgatattccctttccgaatcgtacggtacagattgaagggctgcagatggataaatttaaaacaatttttgaatcaaatgccaagcatcctgagcctaattcatccaatctataa

SEQ ID NO: 607 - DNA, 603 bp, M.catarrhalis
gataagtatctggacttggcaaatagacttaaaggttataaaaatagaattgatggaaaagtcatgagtcaaagtaataaagtagccaacagcgagtctaataccgttgttcgtacagtcgctgataccgctgaaacagccaaagaggttgtgacagatgcagcaaggctgacgaaagatacccttgagcatggtgccaatgatactttacaatttttgggcgtaccaattgatatcaatacactaacccagctggcaattgacttttcggggcgtttggtattggcattgctgattttctttgtaggtcaatggattggtaaacgcatcgttggcgttgccaaacacattatggtaaaaagccgactggatcgcacggctgccaactttttgggtaatttgttatatggtttgatgttggtcacggtcattttggcatccttgaataaattgggcgtcaataccaattcatttgttgctgtcttgggtgcggcaggtgttgcaattggtgtatcgctcaaagaccagttatcaaacttggcagcaggtgttttgattgtgattttaaccatttggcgtggtgattggttgagattgcggtaa

SEQ ID NO: 608 - DNA, 1164 bp, M.catarrhalis
ttatcacgccatgtatttggtcaattgaacaagaataacggtaacaccatgtcaatacacaatccgattaaacgccgccctaccaaaaaaatctatgttggcaatgtcgccatcggcggcgatgcacccatcagcgtgcaaagtatgacaaatacaaacacctgtgatattgatgcaacagttgcacaaattcagcgatgcgtggacgcaggtgcggacttgatgcgtgtatcgacaccaacgatggagagcgtcgctgcctttgctgagataaaaaaacgcgtatccattccactcattgccgatattcattttgatcacaaaatcgccattgcagtggcggatgtgggtgcagactgcctgcgtatcaatccaggtaatattggcaatgatcaaaaagtcaaagaagtggttgcagcggcacgccatcataatgtgccgattcgtatcggtgtgaatgcaggctcacttgaaaaggatttacaaaaaaaatatcgagaaccgacaggtgaggcgatgctagaatcggcgttacgccacattgatattttagaaaatcttaattttcagaattataaaatctcagtcaaagcctccaatgtatttttaacccttgatgcgtatcgattgatttcagcacaaattgataatccattgcatcttggcgttaccgaagcgggcgtatatcgcactggcacggtcaaatctgccattgctttgggcggtttgctacttgatggcattggcgataccatgcgtatctctttggcggcagcaccagaagaagagattaaaattggctttgacattctaaaatcactgggtattcgtagtaatggcgtcaattttattgcttgtccaagttgtagccgtcaagagtttgatgtgatcaaagtgatgaatgagcttgaagctcgcttagaggatattcgtgagccactagatctgtcagttattggctgtaaagtcaatgggccaggtgaagccaaagaagcgacgatcggtgtcgtgggagccagccccaatagtttggtttataaacatggtgcaaaaagccatctgattgataccaaaaaattggtagatgagattgaggcgatggtgcgtgctcaagtcaaagacattcaagataaacgggcaaatgagattatccgtataggctaa

SEQ ID NO: 609 - DNA, 1242 bp, M.catarrhalis
ttggttttaaaccaaaaaattgttaaactaaaggtttatattaagcataaagtatgccaaattttatcgcattttttgattaattttgagaccatcatgaccgataatataagattttgcctacccaaaggcatgagccataagacttttttggcagaatattggcaaaaaaagccgctgctaattaaggggggtttgcctgacttgatagggatgtttgagcctgaagatatacttggtttggcacttgaagaaggcgtgtctgctcgattgatcagccaaagtgataaaaatatcaatcaatggtcgctaaaatctgcaccgcttgatgaagacgatatctatcaaacccccaagctttggacaatcttggtacaaaatcttgagcaatggtcgcctgagcttggtgagctttggtcgcattttgattttattcccaaatggcaacaagatgatatcatggtatctgttgctccaaaaggcggttcggtgggtgcacattatgatgaatatgatgtatttcttgcccaaggttatggtgcgcgtcgatggcagttgggcaagatgtgtacttctgataccccttttgtgcctaatcaaccaatacgccttttagatgacatgggtaagattatttttgatgaagtcttgcaagcaggtgatgtgctttatgtaccgccaaggcttagccatcatgggattgcgatgaatgattgcttgacattttcatttggttttcgcagacccaatcttgtgcaaattatggacgagctggcagatgtcgccaccaatcacgccaatctgtttcatgtcctaaccttaccgcaagctgaccaaccagatgcctatgagcttagccaagatagcattcaagcactcaaagatcagctaattaccctgctaaattccaaagaaggcgatgcgttattgacagatgccatcggcgagctggtcagtcaacgccagtacgaattgcttgcgtttgaagatgagcttgacgctgatacactcaaaactcgccttgaagatggtgaatgcttagtattaaatcctgcctgccgctttgtccatgtgcgtgatgtgtggtatatcaatggcgaaaaagttgacttgtcagatgatgaacgagcatatcttaagcatttgattcacggtgatgccattactgccgaagacgccaatttacaaaatctgccttggcttagccagtggcttaatgataattggctgattttggtttaa

SEQ ID NO: 610 - DNA, 762 bp, M.catarrhalis
gtactaaaaaatcatatgacacacaccatatcaccaaagcttatgaatgattgtaccatcttcactaaacccaatgcggttttatcaagtcatgccccaatcgtcggtatcgatgaggttggacggggcgctttatttggcaatatgactgtcggtgcggttatcttgcccaatgaactcagcggccgctttgatgagatagatttaacaaatactaaaatttctttattaaatgacagtaaaaagctgagcgaaaaacggcgagaacaactgtttgacatcatcacagatttggcacttgattatgcgattgttgatgtaccaagcactattattgatcagattaatatttatcaagcaacgatgcttgggatgaaaattgccattgagacaattattattaagaataatttaaatgaaaaaaacacaactattttgatagatggcaatcagctaccttcaatggatggcagtttgggcgaacactttcatcagatttatgccatgatcaaaggagatgctactcatagcagtattgcttgtgccagcatattggctaaagtgcatcgtgatcgtttgatgattcagcatgccaaatcttatcctgaatatctgcttgataaacataaaggctatctgaccgccaagcataaagctgccatcttagaatatggtattttacctgagcatcggcgtagcttctcaccgattcgtgaattatacaatcaaggatttattaattctaactattggcattcatag

SEQ ID NO: 611 - DNA, 204 bp, M.catarrhalis
tttcatgaaaaatggtttttgaataagcttgaaaatatttatcaaatttcaaaaaataagtcaagacagggtgcaactctcgctcatgatattttgctaagcgatgagtggtttgatcaagattttttatcacctctaactttgtttgctgagattttaaaatatattgttttggcttggtatttgtatttggaacttccttga

SEQ ID NO: 612 - DNA, 1341 bp, M.catarrhalis
atatggcatgacaatacagccaatcttttaataaatttactgattagtattgagaaaattatgacaaatacatcgtcacttacgatcggcatcgtggcaggtgaagtctcaggagatgcgcttggcggtgattttatgcagaaaatgaacgccctgcacccaaatattcgatgggtcggcgtcggtgggcggtcaatggcaacacaggggctaagctcagtgattgatatggggcgcttatcggtaatgggtttggcagaggtgatgatgcatttacctgatttgttaaaagccaaaaagcaaatcatcacagcgtttaaaactcatcagattgatctgtttgttggtattgatgcacccgattttaaccttcgaatcggtaaaatattaaagccccaaggtgttttttgtgtccaatatgtcagcccctcgatttgggcatggcgagaaggtcgcattcatcacatcaaagcagcgacagacttggtgctgtgcttgtttccgtttgagctgggtgtttatcaaaaatatgcccatcctgccatctgcgttggacatccacttttaaataaacttcacgcccatcaggatagcccaaaggtgcgtttggaaaattttattcaccaatatcataatcaccatcatggcgtaacaacactcataaaagcaagtcatattatttgtctaatggcaggttcacgcacctctgaaatccgagccatgttaccgctattattaacaagtgcacaaaacattcatcagcaaataccaaccgtgcagtttgtgctgccagtcgtgagtgctgagcatgcacgattagtgcatgaaattttgcacactcatcatgccaatttggtcaactgtgtccatattttggatgatcacaatcggtctcaaaaacaaaaccaacctgcgatcagtcatgcgtgtatgaccatcagtgatgtggtacttttggcatcaggtacagcaacgctggaatgcttactacttgagcgtcctatggttgtcgtctatcaagtcaatccgcttacttttatgattgccaagcgtttggttaaaattccttatgtgtcattgcccaatatcttggccaagcagtatcttggtcatccaatcgtacctgaactactacaatctgacgccaccgccgaaaaagtcagcaccaaagcattagggattattcaccacccaaacaaacaaaccaaacagcttagcaatatttcagcgtggctacgcagccaaagtcaccaaaactccgccaaagccgtgctggatcattattttatgagtactaaaaaatcatatgacacacaccatatcaccaaagcttatgaatga

SEQ ID NO: 613 - DNA, 1212 bp, M.catarrhalis
ttaaatacttgtatagagtgtaccgtgaataaaattcctgtcatcacctccgctgagcagtccgaccaagcagccaagaaagttaatcttttaggtatgtcaaaagatgaattatcggcattttttgtgtctttgggcgaaaagtcgtttcgtgcaacgcaggtgatgaagtggatttatcaatttggtgtgacagatttttttgagatgacaaatatttcaaaaaaacttcagcataagctacatgaggtagcttgcgtcgtgccgccgactgtgaaatataaagaatttagccaagatggtacacgcaaatgggtctttgaggtggcgggtggttcgttggttgagacagtcttgattcctgccgatgatggtaagcaatttgggcgtaagactttatgcatttcatcgcaagtgggctgtgcgttggattgttcgttttgtagtacaggtaagcagggttttgagcgagatttaacgccaagcgaaatcattgggcagctttgggtcgccaatcagtcttatatggaaaatgtgccgccaaccgagcgagaaaaccgtgtgaccaatgtcgtcatgatgggcatgggtgaaccgttattaaactatgatcctgtggtggcgtccatgtcacttatgcttgatgatcatgcatttggcttatccaaacgccgtgtcacactttcaacctcaggcgttgttccaaaaatgtatgatttggccaaagatattgatgtggcacttgccattagcttacatgcacccaatgatgagcttcgtaatgaacttgtgccgattaataaaaaatatcctttaaaagatcttattaaggctgccaaatcttatgtgtacgatgaaaatcctcgccacaaaaaacacattaccatcgaatatgttatgctggcaggtgttaacgattctgatgaacacgcacatcagctggttgatttgctaaaagatttgccgagcaaaattaatttaattccgttcaatccatttccgcacgcaccttatgggcgttcaagcaataatcggatacatgcttttagtcatattttaaaccaagcaggatttgtttgtacaattcgccagactcgtggtgatgatattgatgctgcttgtgggcagctggtcggtcaggtcgctgatcgtacacgccgtgccaaaaaatggcaagaaagtatccaaaaacgccaaagccatcatgaatga

SEQ ID NO: 614 - DNA, 1458 bp, M.catarrhalis
gaagacctgctaagaaatggtggtgtcaagctaaacgaccgtgtacaagccacacttgagattgagtcaggtgcaaacgacccattggcaattttattggttacggtgatgattaccttgaatcttgatccgacaagccaagggattggtgacattatttttatgctcatcagccaaatcggtattggtttggtacttgggttattgtcaggttgggcattatctaagatgttgccaaaagtttacttggcagatggtatgtatgccattttaattttatctgctggcttgattgtttttggtatcacaaaccttttgggcggttctggatttttggcggtatatttggcaggcgtcgtgattggcaataccaaagtgcgtgccacagagcatgtactgcgtgtgatggatagttttgcttggttatctcaagcggtgttatttgtggtgcttgggttattggtacagccatcaggcatcttagaggtgattcattactcattactgatttttatctttttattattcgtcgcccgcccaattgcggtatttagttcattgttgccgtttcgttttggcattcgtgagatcggttttatttcttgggttggtttgcgaggggcggtgccgatcacgcttgccattatcccagtgacgatggcggtacctggtgctgacttggcatttaacattacttttggcatggtaattttatccttattggtacaaggtgcaaccattccactgatgtctcgtttatttcgggtgtgggtaccaaccaataatgaaccaaaagctgagcatgaaatttgggtggcagatcaggcgaatattactttatatgaatttgaagtcaagcagggtgcatttgccatcggtcgccatcctcaatccatctcgagtaaatttgacgcccaagccttatccttatttgcattggtgcgtcataataagcttgttaatgtgaatgaagataccatcttaaagatgggcgatgtggtttggtatgctatgcgtggcgatgatgcaccaagtattgccaaaatttttaataactctgccacccaataccaaaaaaatagtgagttttatggcgattggctgttgtctcctcatgcacgcattgcagatttgccattttataatttggcggcacgctcacttgcgaccaactcatctagtcgcctgccaaagcctgttgccagtgcacttgatatcttcaccgttccgccacaggttggggcaatgactggtattgatgaagatttggtgaataaattgaccgaagctaaaaatcaaactgtcgaagaatttatgatgcagtattttaagacagaacctgtcaaaggagatgaggtatatctgaatgaaacttggtcgctcatcgtgcgtgatgtggacggacgaggtcgcttgcgtggcgtgggtctaaaaaataaaattaaaaaagaggtttaa

SEQ ID NO: 615 - DNA, 822 bp, M.catarrhalis
cgaaaaggcagcttgatgacaattgatacccactttgacgctgacgatttggcggaatatgactttgattatacgatgaatgaaaatggtcagctcacccaagcggagattgctacattatataccgagcttggtgaagctgagcaggcattggtaaccattcgtgattttatccgctttgtggtgaccaagcttcgccagtatgatgtcgttgtggcacaagggacgacagatgagtttgctgaagcggcggcaattgttttgcattctttatcgcttgaatggtcggcagatgagcagattttggcgtgtaagctgactcccagcgaaaagcaagaagtcttgactttattatctgagcgtatcattcagcgtaagcctttgtcttatttgattaatttggcgtatttttgtgggctgcctttttatgttgatgagcgtgttttgattccacgctctccgattgccgagctgattaatcagcagttttatccatattttgatgtcgatgatgtacgcaaaaactcattttttagccacggtttagaagagtcgcagttggcagcacctgagcgtattttggatttatgcacaggttctggttgtattgccattgcacttgctaaggcatttcctgatgccaatattgatgccacagatattgataaagatgccctagaagtggcatggacaaatgttgagcatcatgagcttgctcatcaagtcaatctacttgaatcaaatttatttgccaaactgcccgctgaaaatcagtacgagcttattgtgactaaattggcctttatgtggatgcaccggtaa

SEQ ID NO: 616 - DNA, 333 bp, M.catarrhalis
ggcttttttatcttacaaaaacccaccttacaaaacaaagtctttgagcagttaaaacaaggcaaactacggtggtatgatgcggtagatttacatggctcaagcattgatgacgcacgcaatgctgtcttattactcatcagccaagccatcaatcacggtgaaactgtggtcaaaattgtacatggcaaaggtaaagatgccattcttaaaacctgcgttaatggctggttacgccaaatgccagaggttatggcttttgtttctgcacctgcaaaagacgggggcaatggttcggtattggtattactcaaaaaagtcgcccaatcgtga

SEQ ID NO: 617 - DNA, 1188 bp, M.catarrhalis
ggatattttatgtatcagcgctttatcaataccgcattggttgcagctttggcggtaactatggcaggttgtggcaccaaagccatcaagccaaccgaacgcaaacctgccaaattggttaatattcaggcgccagtcgctgtattaacacaggtatcgagcgtccgcttggatcaaggtcgatctggctttagtcgccgtaatgccaacttaagaaaggatgttattgatttacaaatcgcaccgttggcagatggtatgattgcagcaagtcgcagcggtatcgtcagtggctacatgggtgaatcgattgcttggcaatataatgctgaagatgtgattactggtggtgtcggtattgatgatcaaggcagcgtggcggtcattggcacccgctcagggaaattaattgcattagatgcccgcacaggtgcaccacgctgggcggtagaattggcttcttctagtttgacaccagcattgattagtggtgataaagtgattgtcatcacgaacagtggcacgatttttggattggatattaatagtggtgcgacagtttggcagtatgccactcaggtaccaaataccagtgtgcgtggtatggcaaagcctttggcacttgatgctcgcacggtattgattggcggtgctgatgggcgtattcatgcactagatactatgacgggcgcaccagtgtggactcgccgtgtgggattggcgatgggttctggagaaattgatcagctgcgtgatgttgatggtacaccgaccgtcgtagatcattatctgtatgctgccagctacagtgggcaattaactgggtttgatatgacaacagggcgtaccatgtttgtcagtgagctatctagtaccaaaaagctgaccactttggctgatgctgtcatcggtagcagcactgatggtgatgtggttgcctttaaccgactgactggcgagaagctttgggaaaatcatgatctaaaatatcgtggattgaccaatcctgtaaccatcggcacttatattgctgttggggatgcagatggtgtggtacatattttaaatcatcaaggtcaaattatcagccgagtcaataccaaaggtgctttgaccaacttaactgtgatcaatcatcgcttatatgcccaatccgcagatggcgttgtgactgtttggcaattttaa

SEQ ID NO: 618 - DNA, 1278 bp, M.catarrhalis
ggaatatttatgaataaaattaccgctatccgtggctttaatgatgtgttgcccgagcaaacaccagcatggcgtgcaatggaacgaacattaattgaggtgatggatagctatggctatagccaaatccgtttgcctttggttgaagaaactcagctatttgcacgaggtgtcggtgaagcgacagatattgttgaaaaagaaatgtttggcgttgtacatggcggaaataagggcgatgaaggatcttcttttactttacgccccgaaggtactgcaggatgtgtacgggcaattgttgagcataacttaactcgtggcgatacaccaaaattatggtacttaggcccgatgtttcgttatgaacgcccccaaaaaggtcgctatcgccaatttcatcaattgggcgtagagtattttggcgctgagttgcctgatgctgatgctgagttgatcgctatgacttatcatatgtggcaaaaactgggtatcggtgagcatgtgacactccagctaaatactttgggcgagaccgatgagcgtgttgcatacaaatcagcactggttgaatatttgacaacacaccaagaggctttggatgatgattcaaaacgccgtttaaataccaatccactgcgtattttggattccaaagatgaaaacactcaacaaattttacaaaacgcccctaagcttggtgagtttttgggtgaggcatcgttggctcattttgaaaaagtacaaaattatttgtccgcattgggtatttcgtttgaaataaacgataaattggtgcgtggcttggattattataataaaaccgtttttgaatgggtaactgacaaattaggttcacaagcgaccgtctgcggcggcggtcgttatgatggcttggtgggtatcatcaaaggtaaagctgagcagtcagagcctgcggttgggtttgctatgggtcttgaacgcttaatgctattgattgatgccgttaatccttatcaggtcacatcttggtgtgatgtttttgtgattgcccaccctgattattatattgatggcttaaagtacgccgaatcacttcgcttgcgtcaggataatttacgcgtcaaaatggcaagtgcgacaggcttaaaatcacaaatgaaaaaagccgataaatcaggtgcagcttatacggtcatcatcgcagaagatgaggtaaatgctaaccaaatcaccattaagacaatggcaacgggtgaacaacgccgtgcacccattgattatcaatttatacgataa

SEQ ID NO: 619 - DNA, 987 bp, M.catarrhalis
ggcaaaattatgttacacacttcaaaaaaacccattgagctacacattacccatctaaataacgctcaaaaagataccaaaaacaaaatcaaaaccatccaatctgagcatcatggtgcatcacacaaattcaaagataaattgtgtcaattattcaaagatattaaaaaattagacaaaaaatgccagcagtctaccgacgatcacacacaaaaagcagcaatttatgtccttgattttgatggagatattaaggcaagtgcggtcgctcatttgcgtgaagagatcagtgccatcatcagtgtggcaaatcgtggtgatgaagtggtgcttcgcctcgaaagtggcggcggtcaagtgcatgcctatgggctggctgccgcacagcttgtgcgtatcaaagaagcagggttaaagctgaccatctgtgttgataagattgctgccagtggtggctatatgatggcatgtactgccgataaaattattgccagtgattttgcggtcattggttcgattggtgttgtcagtcagctgcctaactttcacgagtttttgaaaaagcatgatgtgcaatttgagcagtttacagcaggcgagtataagcgtactgtcacgatttttggagaaaatgacgatgaagatcgtgccaagcaccaagctgatattgagcgtattcacgagttatttaaaggttttattcataaatatcgcccccaactggatcttgagcgtgtcgctacaggtgaagtgtggtttggtgaagatgctctagagcttgggttgattgatgagattggtacttcagatgcgtatttgctcgatcagctaaaagcttgtgaagcgtatttgttacattctcgtagcaagccaactttggcagagaaaattggcttggctgagcaacttggtagcagcgtcacagatgtgattggaaaaacaggcaatttacttgggcaagctttggctaaatttagcagaccttaa

SEQ ID NO: 620 - DNA, 843 bp, M.catarrhalis
agtttgattatgattgacactccgaagaatgacaataattttactgatcaaaaatctttaaatgccttaaaattgcatggcgaaaagattatttatgccgtacttttggtattggctgtcttttttggttggcagtattatcaaaaaaattatgccaagatagatacggtcgctgcagatgcttatacttcaatttcggtgcgtgatgagcgactggcgcaagcgtatttaaacccacaattggatgaagtggctaagcaggcattggcggaagaagaaaagcagttatttggcgatattgatgcacttgtcgcagcaaatgataacactgtttacgcttggcaagcgctgatgatcaaggcgcgccaccagaccaataataacgatcttgacggtgcggtcgcaacgctcagccaagccacttcaatcaatcttgacgatgacggtttgacagcaatagccaaaatacgccatgcacgagccatgttggcaaatggtgatacaaacggtgcgttatcgattgccaatgaagccatgccgacagcttttgaagcatcacgccaagagcttttgggtgatatttatcatgccaaaaatgaaattgataatgccaaatctgcttatactaatgcatgggaggcgctgcgtgagcgtcaagaaaaccgtgcggtattggctttaaaattacagtcacttggggtgaatgttgaaccaatcgaacctacgccatcagtggtatcgataccaaatactcagccagtcattgaaggcggcgaggtgtttgagatgattgagcatgattcaccagtggcagacacacaaaacccacacactggcaattag

SEQ ID NO: 621 - DNA, 618 bp, M.catarrhalis
agcttgattatcacatttgatatgaacaatccaatcgcaaaaacagtcaatcgctgcagttggtgcttgtccgatccactttacattcactaccacgatcatgagtggggcaagcccatttatgatgaccagaggctatttgctcaattttgccgagagacaatgcaatcaggaaaaagttggattacgattttaaaaaagcgtgataattattatcatgcttttgatgagttcgatgccataaaaattactcagtatgatcaagctaagattgaagcattaatgcaaaatacgggtattatccgtcaccttggtaaaatcaacgccatcatcaataacgccaaagcctaccttgccatcacagagcaccaaagttttagtgactatctgtgggggattacaacaccagatggcaaacccgtcatcaactaccccaaaacacttgccgacatacccacccaaaatgaagtctcggcaagattggcaaaagccctaaaacagcaaggatttaagttcatcggttcaacgacctgctatgcctttatgcaagcagttggcatggtaaatgatcatttgattgattgtgattttcgcaaaaaagcccttgtatcatcatag

SEQ ID NO: 622 - DNA, 966 bp, M.catarrhalis
gctaaatgtatgagcgatcaggataaattgggctttttagatttggcggtgcatgcgatgaaaatggtcaatcgaccaatgacaacgatgcagctgtgggagtttgttcttaaaaataaattgcatcgtcggttaagatcttatgatgtttccaccgaatctttcattggcaaatcaccagaaagaacatttggtagttcaattactcgcaataaacatatcttcaaggaagttccaaatacaaataccaagccaaaacaatatattttaaaatctcagcaaacaaagttagaggtgataaaaaatcttgatcaaaccactcatcgcttagcaaaatatcatgagcgagagttgcaccctgtcttgacttattttttgaaatttgataaatattttcaagcttattcaaaaaccatttttcatgaaatcagtccaaaaggagcaaaaggcgaggataaatggctgtatccagatatggtggcggtgcattttgaatacgccaactatcaaaaaaaccatgtacttggttttattacgaaatttaataagccaccaataaaaatctattcatttgagattaaaaaagagctgaattttagtaattataaagaaagcttttttcaggcagtcagtaactcaagttgggcaaatgaaggttatttggtggcggcacaaatcctgcctgacggtcaatttattgagtcgctcaaaaaacttagccaaagctttgggattggtatcattgagcttaatagacacaatgtgaaacaaagtaagattttatcacctgccaaatttaaagagatgatggattattcggtggttgatgaattggcgaataaaaatgacaatttctcacaatttttaaaaaccattatcgattttgatgttaatcatcctcatcgatatgacagcgagtttgacaaaatcttaaacctatatgaaccgaatgacagcaatcattga

SEQ ID NO: 623 - DNA, 1422 bp, M.catarrhalis
aacatgagtataaaacctgtggtcgccttgattggtcgccctaatgtcggtaaatcgactttatttaatcagttaactaagagtcgtcaagcattggtggcggatttggcgggtctaacccgtgatcgtcagtatggtgatgcacattttgaaaacaagtcattcattgtcgttgacactggaggtatcggtgagatggatgatggttcgggcaatattgatgattacatggcgactcagtcatatacggcgattcatgaagcagatatcgttgtttttgtcgtagatgctcgtgcaggattgattggtgcagatagtgagattgcacattttttacataccttgggtaagcctgtatttttagtggcaaataagatggatggcgttcatgaagcggcatatgcagagttttttgctttaggttttggtgaaccgtacgctactgcagccagtcatggtagaggcgttaccaatttgcttgagtctttgacggcagatatgcccgaagatgtgcccgaagatgagcttgacggcaaagccttaaagcttgccatcattggtcgccccaatgtcggtaaatcaaccttagtcaatcgcttgctgggcgaagatcgtgtggtggtctttgatatgccaggcacaacccgtgatagtatttatattccttttgagcgagaagggcgtagctatgttctgattgatacagcaggtgtgcgtcgccgtggtcgcattgatgagaaagtagaaaaattttctgtcgtcaagacgctacaagccatcaaagatgccaatgtcgtggtggtggtcattgatgccaaagaaggtattgttgatcaagatttgcatatgcttggatatgcactagacgcagggcgtgccattgtcgtggcaatcaataaatgggatggcttaagccaagaccaaaaagactctgtcaaaattgaaattgaccgccgttttaattttgtgccttgggtaaaaattcatttaatttctgctttatatggtaatggtgtgggtaaactttatccttctattcataaagcctatgaagcatcaatgtttaaggtttcaaccaatcagctgacacgaattttagaagatgctgttgccagccatccaccaccaatggtgggtggtcgcagaattaagctaagatatgcacatttgggtgggcataatcctcctgtcatcgtcattcatggcaatcaaacgagcagtctgccaaaaagctatcagcgttatcttgaaaatgtttttcgcaatgtctataaactcgaagggacaccactacaggtagaatttaagcaaaatgccaacccatatgaaggcaagaaaaatcctgtcgttaaaaacaaagccaagttgatgcgtgagaaaaaacgcattcagcggtttaagcgtgccgagaaaaaacgataa

SEQ ID NO: 624 - DNA, 816 bp, M.catarrhalis
gaaaaatacatgctaaaaaaactgttgaaattaaaaaacaccatcacagatgatgtgaaagctgtgcttgcacgagaccctgctgcacgcagccaaatggaagtactgttaacctatcctggcattcatgcgcgtatcatgcaccgaggggcacactacttgtggaatttggaccataagtttatggccagagcgctttctcattttagtcgctgcacaacaggcattgaaattcaccctgccgctaagatcggtaagcgtttttttattgatcacggcatgggcgtcgttattggcgagactgccgaaattggtgatgatgttactttgtatcatggtgtcactttaggtggtgtctcttgggaaaaaggtgccaaacgccatccgacccttggcaacaatgtggttgttggtgcaggtgctaagattttgggtggctttcgtgttggtgatgatgccaagattggctcaaatgctgttgtcgtaaaggcagtgccagctggtgccacgatggtcggtagtgccgcccgcatggtcgtcaagcacaaacaagaacaaatatccaccaaacatcacgcacaatctaaggagctgtttaacgcttatggcttaaaacctgattccaaagaccctgttgcatcaagtattgcagctttattggcacatatccaagagcgtgataagcaaatctgtgaactcaccgccgcagtcaaaaaactagatccaaattttaatccccaaggcataaaatcactgtgcaaagatgatttggatgtttttgatggcgaaggcttagagcttgattatcacatttga

SEQ ID NO: 625 - DNA, 234 bp, M.catarrhalis
ttgagcatgattcaccagtggcagacacacaaaacccacacactggcaattagtgcttacaaaagacccgttaattatggtcaaataaacttaattaaaaatagcaaagtaaggatattttatgtatcagcgctttatcaataccgcattggttgcagctttggcggtaactatggcaggttgtggcaccaaagccatcaagccaaccgaacgcaaacctgccaaattggttaa

SEQ ID NO: 626 - DNA, 330 bp, M.catarrhalis
gatagcgtttttgattttaaaacagatctatcaatcatgaataacgctcagctgacttatgccaatatccaagccatggtttctgaagatgtggctattatggataagcaggttttggccagtttaaattccaaagtgcaggtggcgatgagtgtgtctaaacatgtcattgactctggtggaaaaaaactgcgttctttaatcacgctactgaccgcgctcgtggtacatgaagaacaaaggcatcattctctgcagctggcagccattacagagatgcttcataccgcaactttggcgcaagatgatgtgtatgccgcctttttttaa

SEQ ID NO: 627 - DNA, 903 bp, M.catarrhalis
tcatttggtgtttcgataatgatgaacgatttactcaaatcttggctatcacgcattcgcatcgtgatggttggtactaccctacctgccaatatcggctcggcggcgcgtgcactgcataccatgggcttagatgatttggtggtcgtcaatccacgcttaccgattgatgacagcagttatgccaatgcagcaggtgcaggcatattactggacaaagcttgcatcacaaaagatatcaaacatgccattggtgattgtacactcatttttgcagccagcgcccgatcacgccaaatgcctaggcctgtgctgacgccaagcatggctgcacaagttgcacttaagcaattatcacagactgtctcaaaaaatactttggcgacatctttggatcatatgaatcaatcagctgatgattcggtcaatgccttacctaaaattgccattttatttgggcgtgaagaccgaggcttgaccaatgaagagctgtcattggctgattatcatatccagattcctgccaatttgaattatcctgtactcaatgttgccagtgccatacaagtcatcacagctaccttttttgatcaatttgccagtacgcttacaccatcttctcttgttagtaccaagcagatacaaggtatgccaaaagaggaatactcgctgcccatacacatacgcagcgactgggatgagcctgcgatcactcaagcacagtcagccaatcttgaaagtgccatcatcacattgatgcaacggctcaatcttgcacacgacgatgatcttaagcacctaccaaatcgcttatctcgcttgaatcgtcgcttgcagctagaccaaaaagaatacgccttagtccgtgctttgattgctaagattaataaaaatttgccttag

SEQ ID NO: 628 - DNA, 264 bp, M.catarrhalis
ttaaaacgcttcacttcatgtaaaattgcctttgagctgggcaaattgaccgtctcgttaggtttatcacttgccatttcaggtttggtagaagccttggtcatttgctttaaatcttcttgtagagattttgataacaaatctttaaaacttggattactcataacagtattgctcttatatatgttgttatctgtgattgctgtctttgatgcttgggggttaacacttgttggttttgtgccatcatatatccaaacttaa

SEQ ID NO: 629 - DNA, 258 bp, M.catarrhalis
gttgcgtttttacgcttttcattcatccaaattaggaaaattgttatgtcacaaaaagttcttggcactgtaaaatggttcaacgaatcaaaaggttttggttttatcgctcaagataatggtggtcaagatgtatttgcacattatagtgccattacaggctcaggatttaaaactttggcagaaggtcaaaaagttgctttcatcttaggcgaaggcaaaaaaggcccacaagctgaagaaatcgaaaaagtttaa

SEQ ID NO: 630 - DNA, 528 bp, M.catarrhalis
tatgctggatttatcatgccaaattctaccgcccaaaattttaaacacttagccaaaacctgccatctaactattgcgttgccgccaaccattcaagatacattcataagcagcgagccgattcaagcctatcttaagaaattaaatcaagccattgatgatcaagtcgtcgcttatggcatgcatgcggttcatcatattgccaatctgctcaaagtgcgtacacttgccattgatattatcttaaggcagttgtttgatttttatcaatttcccaaagattttgcgttatttgcggtgggcggctatggtcgcagcgagcttttgccagcttcagatgtggatattttattgattggtgatgagattggcaaagccaccaagccgattgagtcttttgtggcgatgctttgggatattggtatcacacctgctttttcggtgcgaagtgtcgatgagctgcgtgctgccgtccgtgaccaaaccattgcttctgccatgcttgaggcaagacgttttggcaggtaa

SEQ ID NO: 631 - DNA, 1236 bp, M.catarrhalis
aatttcttgttcacagtcaacacaatagacgcaatacatcaaggagcgtacatgagcttagcaaatcccactttggttctaaattgtggttcttcatccatcaaatatgcccttatcagtgaagatggtgggagtcgcattgagggcttggcagaaggcttgggtaatcctgaagctcgcattaagcataaaaatttagagggtgaagcgacgattattgacattccaaatggtgttcatgctgacgcactgaaagttatcttagaagatttgattaaagcgcataagcctgtggttgtgggtcatcgtgtggtgcatggtggcgataaatttaaatctgctaccgtgattgatgaagaggtgttatcaaccattgaagcattgacaagtctagcaccgctacataatcctgccaatgctgcaggtatccaagcgattaatgccatttatcctgatttaccacaggtagcaatttttgatacggcatttcaccaaaccatgcctgagtatgcctatcgttatgcagtaccaaaaaatctgtacactgagcatcaaatccgccgttatgggtttcatggcacttcgcatgcgtttgtttcaaatcgtgccagccagcttactgatgccaaaggcgtacatggttgggtggttgcccacttgggtaatggctgctctgctaccgcagtttatgatggtaaaagcttagatacctcaatgggtatcacaccgctagaagggctgatgatgggtacacgctcaggggatgttgatccaagtttgcatattcatctaaatcgtacattgggcttatcattagacgaagttgacaccttactcaataaaaaatcaggtttgcttggcgtatcaggtatctcaaatgacatgagaaatcttgaagctgctgataaagagggcagtgcagatgctcgtttggcactggacatgttcgcttatcgtaccgccaaatatctcctaagcctaactgcagcattgcctgagtttacaggcatcgcctttacaggtggtgtgggtgaaaatgctgttgaaatgcgtgccgatattatcaagcacctaaaacatttgggtgcaaaaattgacaccactaagaatgataagttgatgcgtggtgctgaaggcagtttccatgccgaagattcatcgattgagctttgggtgattcctaccgatgaagaataccaaatcgccagcgaaagccgtgcggtcttgggattataa

SEQ ID NO: 632 - DNA, 486 bp, M.catarrhalis
aaatacagtccaacgattaaaaatttaaaaaggtttcagatggctaatttttcacccagtatcaactttgccaaacgctggcttgccacgccttttaaggctcgcacagtgatttatcaggaattagatgatattatcaatttactggataatgagcttttggttaaggatttttgttttcggcacgcagattttaatgctgctattacccaagaaatgcacaaaaatagcaacacacagaccaatcgcttgattcataccatcgagacaatatcactgaaagatgacgatgaagttaaagttatccaatcgccaaactttgatgagcttgaagctcggctgacccataatttatcagttcagattgatgagtttttgggtgagcatatggctcagctttctgaagatttgcgtgcctgggttaaaatggcagtacggcatgagctggcaaattatcagtccgaagaaaaactatctcaaaactaa

SEQ ID NO: 633 - DNA, 900 bp, M.catarrhalis
aaatatataccaactattgataatttgataatttttatgccaaaataccacttagcaatttgcgtcaatattgagattatcgtcatgaatatcaaacccatcataaccacattatcgatgattactttgatgatcacgatgcctacactagcaaataccatcagtacacacggctttgatgacgatgatttgccagcttgtgctgccacgccgctgccagaggatgctaaatttgctatcatcggttctgattgcggttatgctgaagggctggcaccaatcatcaaagacgatcactatggttatgtcaataccgtaggcgagcttgttattcctgcagtttatcaggcggcttatccgtttagtgatggcttggcgttgtatcgtgaaaatgatcactatggctatcttgatacatctggtcagagtgttatcgctccacaatataccaaagcttgggaattttcggaagggcgtgccaaaattgagcaaaatggtaaatatggatttattgatacgactggtaaaattgtcatacacccaaactatgaagtgattggcgattggtttgaagaaggtttggttctttttaagcaaaaagataaatatggctttttggataaatcgggtaatattgccatccgcccacagtttgattctgccaaaggattttcagaaggcttagcggcagtaacgatgaaaacagacaaggtggatgaacatggtagatcaccacataaatacggttttattgatagaacaggtaaagtggtgattgatattaaatacgatttggcgtatgattttttatcaggtgcaacttatgtcgtagatggtgataacgcttattatattgataaatcaggcaatcctaccgccatgccaaattattttgaatga

SEQ ID NO: 634 - DNA, 279 bp, M.catarrhalis
tctcagatacccacacagcataaatatctgctgacggctgatgatggtattgccaaggcagtccatggcgaccatgtaactcaaaccatgtcagtaaccgcttggcaaaactgtgccgctgctcatcagacggataaacgccctgctcactcatctgagctatcgtacaaacatctgtcgttttggttgttgtcatctcaaaaaactgctaaaattcaaagggacattataaaaaccttatcaatgaattacaatgacaatatccgctcacagttatga

SEQ ID NO: 635 - DNA, 189 bp, M.catarrhalis
atagctacgccgacttcagatgacgccaatcaaaattaccgaccgatgagcgtcatcaaaataatgccacttatcttacctgaaaactttcatcttgccaacctgtttttagtactttttaaaaatttatcaaataaatcggttatatctttgccatgtttaccaatccctccactttactcgccctaa

SEQ ID NO: 636 - DNA, 1056 bp, M.catarrhalis
aagggacataccatgcaaaacgctcctattgttattatgacggccgccatgctgacggcttgtagccagcaatcgacctatcaaaccgttagtggcgaaaccatgggtacaagctatcatatccgttttgaatatgcagatcatttaagtgatgcagcaagtatccaagctgctattgatgagcgtttgcaagcgatcaatgacagtatgtctacttaccaagaaaacagcaccatcagccgctttaatcgcctgcctgcaaagacagatcttgttattgatgatgattttattcaggtattgactgatagccaaaccgtctatcaattatcccatcgggcgtttgacccaacagtatatcctttggttcagctttgggggtttggtggtcagatgagcattgagcgtttacaatcaccaccaacagaagatgacattgccaaggctaagcaatgggttgggcttgataaagtcacactcaacgagcagaagcttagtaaatccattgacggcgtagggcttgatttttctgccattgctaaaggctatgcggtagatgtgattgctaatacattacatcacgattatggcgtggtcaattatatgatagaaattggtggcgaggtagcaactttgggcgttaatgataaaggcgatccttggacgcttggtatcgatgcacccattattgatagcggcgtcaaaaatcgaaccgtactcaccaccttaacccaaccaatcggtgagccgatgcatttggcaacttcaggcggttaccgcaattcaatagaatatgatggggtgcgttttagtcataccatcaacccagtaacaggatggcctgtggcaaataatgcacccagtgtcaccgtgctacatgatacagttgcattggcagatgcttgggcgacggcattaacagcactgccttataccgaagcgttggcacttgctaatgctcaaggtctgatggcgatgtttgtgatagaaaatccaaccaaaacaggctttgatattgtgcaaacagatgccatgcaacaaaaatttgccaaatag

SEQ ID NO: 637 - DNA, 372 bp, M.catarrhalis
ttaatatacactgccaaccgccaaggaatatttatgaaactgatttctgcaattatcaagccgtttaaactcgatgatgtgcgagaagcactctcagaaattggcgtcaatggtatcaccgtcactgaagtcaaaggctttggtcgccaaaaaggccataccgagatgtatcgtggggcggaatatgtggttgattttttaccaaaaattaaaattgagatagcatgtcgtgatgagatggttgattcaattattgagtcaatcattaaagttgcaaatacaggtaaaattggtgatggtaagatttttgttagtccgcttgagcgtgtcattcgcattcgaactggcgaatttgatgaaagtgccttataa

SEQ ID NO: 638 - DNA, 219 bp, M.catarrhalis
attttctttgcgattttcaccacgagccagattggcaaagttggtggtcaaacgagtgctggtcgctggctcatagttttcatcaaaacgctgagtatgcactcggcattgaaattgtgtggtcatgttgttacctcttggctaaaatttaaagatgagatattaaaccgcatttttaatctaaataaaagcgaaatattttttaaagaagatgaataa

SEQ ID NO: 639 - DNA, 489 bp, M.catarrhalis
agacgctttgcaaaagatattggtgacaaattatttcatcgtaataaaaaacaagacgcagcccaaccaaccgctgctccagctgcaacacctgcagaagagccaaccgctcaagagattgccaatttacttcttgctcgtattcaagctcaaaatgtcaatatcagtggcttaaaagtcaattataatggcgatacagacacagtcacattatcgggtgttgccaaaacgcaagccgaccgtgaaagagcacgccttgcggtgggtaatgtccagtatgttgagacggtggttgatgatattgaggtggaatctgctgaacctgaatcacgattttataccgttaaatcaggtgatagcttatcaaaaattgccaaggaaatgtacggcaatgcgaatgattatatgaaaatctttgatgctaacaagcccatgctgtcagatcctaataagatttatccaggtcaagtattgcgtatcccacaataa

SEQ ID NO: 640 - DNA, 1062 bp, M.catarrhalis
tgcaccaaagccatgatctattttaaacacccaaagcaaatatcagcctggttgctcgttattatgatgagtgcaaccagtactgcccatgccaacgacagtgccatcaattcagcagaacagctgacaactcacatcaccacagccatcaagcaaacaatcgtcaaaagcacagacaatgaccgtttatatcaagaccccaaccaacaagctgatggtgagattgttggtgtgcgttcatttgatgatagctttagcgactgtcaaaatcagtttgccaatcggcaagcaccaacactgatcggcaagcaaggtgaacggctgtctaccatggcgcgtgctttatgctttgaaggatttgccactttacattcaggcatcgctcgcacaccgctatggtcagcatctcatctgacccaagcacgcatcagccaagcccgaaccttggcgcgtgttgacagctttcacgcagagtccagactacctgctgatgagcgtgctgagctgtctgactatcgacgctcaggctatgatcgtggtcatatcgccccaaatggtgatatggccaccacaggatcccaatatgatagctttagcctagccaatatcgcacctcaaaacggtgaacataaccgtcatctgtggcgtcatatcgaaacacagactcgtcaactggcaatcgagtatggggaggtttatgtcgtgacgggcgttgcttttttgggtaagacttctgagcgtattggcggacgagtgcttgtacccagtcatttttttaaggcggtatatattccaaaattatcgactgctggtgtctatttttcctcaaatgacagtagtgaaaattatcaaatcatcagcctagatgagctggctcgcctgacgggtattaatgccatgccatcactacctactcagattcgccaaactgcctacgatttgcccagacctagcagcaataaaaacccagaacaaaaggtgcttgatcatcagccaagcagctggtttgatttggtcatcagtgccatgcgttatgtctttgaaacactaaaccgtacttga

SEQ ID NO: 641 - DNA, 960 bp, M.catarrhalis
cacatgaaagctgtttttttggatgcgggtacattctctaagcaagcgtgcctacccacgcccaaaggtgtgacagaatatcaaacctattcacaaaccccacaagatgacgagattatcattcagcgttgctgcgatgctcagattgtgattactaataaagtggtcatcacacgcaatattttaaaagccctgccaaagcttaggctgattcagctgactgccactggtatggataatgtggataaacaagcctgccaagacttgggcataacacttaaaaatgtcgcaggctattcggtcaatagcgtacctgaacacaccttgatgatgatgcttgcgattatgcgtggtgccaaatactatcatcagcgtgcaaccgatggcacttggcaggcagatgggcgattttgtttattaaatgagccgctgtttgatttgtatgggcaaaccttaggcatcatcggtgcaggcaatattgggcggcgtgtgggcgaattggcaaaagcttttggcatgcatgttttatacgccgaacatcaaggcaaaaccccgcgtagttcagaatataccgagtttgaaactgtgctaaacagtagcaatgtcatcagtttacattgcccattaactgacgctaccaagcacctaatcaataccgacacgctcaccaaaatgcaccaaaaaccactaattatcaatgtcgctcgtggtggcgtagtatgtggagcggacattgttgatgcactcatcaatgatcacatcttaggttatgcctctgatgtatttgagtctgagccatttgccaaaaatgacccgctgcttggtatcgctgatcatccacgcgtactgtttacaccgcataacgcttggggcagtcttgccgctcaagaaaaactttgggaaattttagccaatcaaatcactgattttatcaatagccactcaacccacaatccctaa

SEQ ID NO: 642 - DNA, 189 bp, M.catarrhalis
gtacgctgggcaaccgtactggtaacaaaaaaaagggtcgctggcggttggacgaagaatcactgcttaggctcaaaaatcgttaatttgaaggcatctaaacaaatccatcttacacctccaaaatcaataatgcagatgatgatagcaaaaactgatcagcataaaaataccaccttaactatataa

SEQ ID NO: 643 - DNA, 639 bp, M.catarrhalis
gcgtgtatttatcaatcaatgcaaacacatatcatgaatcacacaactgtcattattatcattactgtcatcatcagtatcgccgcatggcaatctagacctttgcttgagcgattgattttttatccacctgccgtcaataaaggtcaatatgaccgcttgcttactcatggatttatccacgccaatggcatgcatttactgtttaatatgtttacgctgtacttttttggtcgtgtgattgaacggttttatattgataaatttggcaatttgggctttgtgggtttttatatttcggcgattattattgcgatgctacctacttatgcacgcaataaaaacaatacttactattcaagcttaggtgcatcaggtgcggtcagtgctgttttatttgcttatattttattcgccccttggaatacgctgtatttatttgccgtcctacccattcctgcgattgtatttgcgattgcttatgtggcttatagtatttgggctgaccgccgagatggcggaaatatcaaccactcagcacatctttttggtgcagtctttggcgtagtagcgacaattgccattgaaccaaatctgattgttcactttcttcatcgtctgctaaatccatcattataa

SEQ ID NO: 644 - DNA, 1833 bp, M.catarrhalis
tcatatggtcaaatccacagtaattctaatccatcaatgagttttaaaaagacaatgagcctaaattaccacatcagttttgagcggtttaatgaacatttagccgatatacgcattcatcacacagcgttaagcgatactcctgctttttctatggtaacatggattgcaggcagttacttaatccgtgaatttagtaaaaatatcaccacagtgtattatcaaatcggtgatagcccaatacgccatcgtgccgaaaaaattgacaaaaaaacattcgtactgccaaatgccaagcaaggtgatgatattaccatacactatgaagtgtactgccgagatctatcagtgcgtacagcattcgttgatgctacgcgtatttttggaaattttacctcattattattacttccagaggcaaataaacagactcaagctaatatcacactgtttgtaccaaagacatttttggcaaaccatctgaaatgcacaattgcttgtggcttaaaatttgagcaaacaagtacgagtgatgggcttgaatatcgttttaatggcttggcagcttttgagtattttgactttccctttgaaattggcaaccaagatgaaatcagctttgagattatcaaagataaaaaaacttgcctgccacaccgattttttttggcaggtcaccatcatggcaacttgcatcgcctaaaggctgatttaaccaaaatttgccaaagctatgtcaattggctgggcgatgctccctttgcagattacacttttatgaccatggtaacagataaagactatggtggacttgagcacatcaattcaacagctttaatcagtcctcgtggcgatatgcctgcttttgacgaaccccaaatcccaaatgagcattatcaacgctttcttgggctatgtagccatgaatattttcacgcatggtgggtaaaaacagtcaagcctgatgtgatgatgaacaatacactcaccgaagaggcttatacgccacttttatgggtatttgagggcttcacttcctacattgatgatttaatgcttttagtctcaggtgtgattgataaatccagctatttaaaactcattacggcacaaattaatcgctatcaacaaacagaaggcttgttacatcaaagcgtagcagaatccagttttgatgcttggattaagctatatcgtaccgatgaaaataccaacaatcaaggcatcagttactataataaaggtgcattggttgccttattgcttgatatgatgctgatggataaaacagacggcaaatatcgtctgtttgatgtcatcaaagcctgttatataaaaacaaataaccaaccctttgggctgaccacccagattctaggcgagatcatcgctcaaatgatggggcaagaagcttggcaagatttttatcatcgctatgtcattggtgtcgatccattaccattgactgattattttacaaaatttgccattcaagctaagtttcaggataaacataaaacatggggcataagctttaatgaacatgcccatggactgaccatcactcatgtcagccgtcaatctgctgcaagccatgcgggactatcttatgatgataccatcattgcaattgatgggctaaaagcaacatcagcattgctcaatcggctggttaagcatcaaaataccacaggctcgccattaaccgtacacgcgtttcggcgagatgaactgttgtcatttaccattaacaaccaaaaaaccatacaccaaacagttaaacttgaaggtgatggcggtttatggctgaattttgctgatttaacaagttga

SEQ ID NO: 645 - DNA, 1251 bp, M.catarrhalis
acaaactaccaaacctataccaaaaatgcaaatttaaaaaacaagatttcatttttgggtatccaaaaggcaggcatcgccgataaatcagatgaaagtttatttggcaattttacaaattttagtataatcaaaatggcgtggttttgtatctttgatttttatgatgaaaaaggaatgatgatgacaattgtgacggattttttaatgacccatgataagcggcgtattgcaatcattacattaaaccgacctgatgcactcaatgcgctcaacttggagatggtggcagccattcaagcgtgtttagataaatgggcaattgatgacagtgtggctgcggtgttgctttgtggagcagcagataaagcattttgtgcaggtggcgatattcgtggtttatatcatggctataatcccaagattttcccaaatccaactgccaaggcgtttttttctacagaatatgccttatgtaaacaaataaaaagttatacaaagcctatcatcgtttgggcggatggtattgtcatgggtggcggtatgggcttggcagtcgcatcaagtcatcgcattgtcacgcaaaccacaatgatggcgatgccagagattagtattgggctgtttcctgatgctggcggttcttattttttaaggcatatgcccaataagatcggtttatttttgggtttgacaggtgcaagaattaacggtacagatgcacttgctttaggtgtggcagattttggtatggcaagtgatgattttgatgtgttaatacaagcgctgaccactgccgattggtcagatgatgccaccaaaaatcatcagatgctcaatgcactgcttggtcagttgcatcataaccacactctaccaacagggtggcttttgcctcatcgtgatgagattgagcgtatgatgcagcaggcgggtgacttggcagcatttgatacacttgctagattgggttttaacattgaatatattcaacaggcatttaaaacttatatcgctggctcaccgacatcggcggcgattacatggcatatggcaaatcaagtggagaatatgagctttgatgaggtgatggatttagaatatattgttgcaattcattgctcgcataatggcgaatttgctgaaggtgtgcgtgcattattgattgataaggataaaaatccgaagtggcaatatacgccagatagcttgcctgatggttatatcaaaagccattttaaagcttggtaa

SEQ ID NO: 646 - DNA, 1632 bp, M.catarrhalis
cttatgacgcaacaaactacccaatccccaaatatgacagggcatactcaaaccaaagatgctgctgcgcactttcgtgaactccaagatatcatcgcacgcggtgaaatagccatgatgtcaggcgctgagatgcttgttcaagcattgattgatgaaggtgtcgagtatatttttggctatccaggcggtgcggtattacatatttatgatgctttatttaagcaagataaaattgaacatattttggtgcgtcatgaacaagccgcagggcatatggccgatgcatacagtcgtacaacaggcaggacgggcgttgttttggcgacttcaggtccaggtgcaaccaacactgtaacagccattgcaactgcttatatggattcaatcccaatggttgtgttggcaggtcaggtaccatctagtttgattggtgatgatgcgtttcaagagtgtgatatggtcggcgtttcacgccccatcgttaagcacagttttcaagttcgccatgccgaagacattccaacaatcatcaaaaaagcattttatattgcaggctcgggtcgtcctggtcctgtcgtggttgatattccaaaagatatgaccaacccaagtgataaatttgcttatatcatgccaaagacagtcaatatcagatcatatcagcctactaataaaggtcatggcggacaaatcaaaaaagccatcgaaacgctactatcagccaaacgccctgtactgtattcaggtggtggggtggtgcttggtaatgccagtaaagagctgcgtcaattagccgatacgctcaaactacctgttactaataccctaatgggactgggtgcttatccaggctcaggcgaacaatttgttggaatgcttggtatgcatggcacatatgaagcgaacatgaccatgcatcatgctgatgtgattttggcagtgggtgtgcgttttgatgaccgtgtgaccaataatgtcaaaaaattctgcccaaatgcaacgatcattcatattgatatcgatccagccagtatctcaaagacgattatggcacacattccgattgttggcgatgttaagctggtactaaatgaaatgcttgccttgctagcagagattgataagtgtatcgatgaacatgcgctcaatgattggtggcaacaaatcaatgaatggcgtaaacgccatggtcttcgctatgatgcagatgatatgactgccaaaacacatgccatcaagccccagcatgtggttgagacgctttataagctgacgaatggtgaagcaatcattacctccgatgttggtcagcatcagatgtttgctgcattgtattataagtatgatgagccacgccaatggttaaactcaggtggcttaggtacaatgggcgttggtttaccttatgctatggcagcaaaattagctcacccaaaaaagacagttgtttgtatcactggcgaaggctcaatccaaatgaacatccaagagctgtcaacttgtctacagtataatctaccagttaaaattttaaatttaaataatgctcagcttggcatggttaagcagtggcaggatatgctttatgaaggtcgccatgctcaatcttatatgcaatctttaccctga

SEQ ID NO: 647 - DNA, 540 bp, M.catarrhalis
cagctttggcacccgcctaagcgatggcaatttgtttatcaggaatttcttatgacaaccattaacaaagatactgttgtacaattcaactataccttaaccaatgccgaaggtgagattcttgaccaatcacgagatcagccattggtatatttgcacgggcatcataacattatcccagggcttgaaaaacagatgatgggtaaatcagcaggcgatacatttaaagtaacgattgcccctgaagatgcttatggcgaatatgttcaagaagcagtacaagaagtaccacgagccaattttcagggtgtggataacattgaagtgggtatgcaatttcaatcacaaacggatgatggtcatgtgatgcttgtcactgttaaagatgtgaatgatgagattgttgtggttgatggtaatcatcctttggcaggcgttgagctgacttttgatgttgaaattgttgaggttcgtgcggcaacagctgatgaaattgcccatggtcacgcacatggtgcaggcggtcaccaacattcataa

SEQ ID NO: 648 - DNA, 453 bp, M.catarrhalis
aaccgttataatgaatgctattttgatattgataagtcttttatgcctgatttttctttagaagttgtatttattgcactaagtttgatgatcgccatctttgtgatgattgaatcaacattgcttgagcgtaacggtggcaagctgctgcttaaaaatagtatatttatgttcatcagtctatcaacctcggcatggatggtggcagcgtgtttggcttggtattttttggatcttgtcggtttgggcttggtggtagcgatggtgtatccgctgtatgggcttttgggtttggcatattcggcaatgttgatgcgtggcattgaggttgatgatcctgccgaagtggcattacccaaaaaatacttaagcttttgcaaatcctttggtttggtctatagcatcttatgtttgactgccttacttgaaagcgtgggcttaattcaaatttaa

SEQ ID NO: 649 - DNA, 609 bp, M.catarrhalis
ttttttggtaatcattgtatgacacttattattggcattgaccctggttcacgcttgacaggttatggtattatcagtacaaataatgatcaattaacctttttagatgctggcaccatccgtacaaacagtagcgacatcaccgaacgcattgctcagatttttgctggagtttctcggattgttaatcattatcaaaaatacagcaataaacccatacaagctgccattgagcaagtgtttatggcaaataatcctgactctgccctaaagcttggacaagctcgtggcgccgccatcgccgctttgacagctcaagatttacaagtcagtgaatacaccgctcgtcaaatcaagcaggctgtctgtggctacggtgctgccgataaagagcaagtcactgccatggtctgtcgtattttatcattggatattatcccacaagctgatgccgccgatggtttggcgtgtgccatctgccatgcccattcatcacactcaatgcataaattatttggtgtaagtacgctgggcaaccgtactggtaacaaaaaaaagggtcgctggcggttggacgaagaatcactgcttaggctcaaaaatcgttaa

SEQ ID NO: 650 - DNA, 993 bp, M.catarrhalis
ccaagaggtaacaacatgaccacacaatttcaatgccgagtgcatactcagcgttttgatgaaaactatgagccagcgaccagcactcgtttgaccaccaactttgccaatctggctcgtggtgaaaatcgcaaagaaaatctacaaaatgccatcagaatgattaacaaccgttttaatgatttggcacattgggacaatccgacaaatgaccgttattcggtactcattgacattgtgtctattgatgttgatgtggcaggtaagggcgaatttttctcaggattagaatggctaaaaacatctgtggttgaccacaaaacaggcaaaactacccctggcatcattggcaacagcttttcatcatttgttcgtgattatgattttagcgtattgcttcgtgaatataataaggataaggctgaatttagtgtgccagagggttatggcgatttgcatggcaaattgttcaaattcatgatagcatccgaagaatacaaagcccattccaaaaaagcacccgtactgtgcctaagcgtggcgaccactcgcacttatcacagaaccaccaacacgcatccgattttgggcgtggaatatgtgcaaaatgattattcattgaccgatgagtattttgccaagatgggcttaaaagtgcgttattttatgcccccaaaatcggttgccccttatgcgttttattttgatgaaaatgctgatttgttgaacgattacaccaatttagaactcatcagcaccatcgccaccatggaagcattccaaaaaatctatcgcccagagatttataatgccaattcggttgcaggtcagatatacaagggcagcttaacttatgaagattatgctgtgccaaaagtggattatgaccgtgtggagcgtaatgatttggcagtcaaacaaggcaaaatcgccgaagagcagtttatcaaaccatatcaagagattttggatgcttggcttgccgaaaaataa

SEQ ID NO: 651 - DNA, 372 bp, M.catarrhalis
gctaataccaaatttattgagtgtaaggaaaatatgatgagcgagctgatcacaatctctggtcaaattacagttgatgatgtcaaatctttggcaaatcaaggatataaaacactggtcaataatcgtccagatggcgaagaaccaaaccaaccatcatctgatgatattgccaaagtcgcaggcgagtatggcattgaatatcggcatattccatttgcaggcggtatgcttgagatgcatcatgtccaagaatttgcagatttttacaaccaaagtcagcgtccgcttcatattttttgtcgtagtggcaatcgctcaagcatcattttacaggcagctcgtgaccatgatttgttagatgaagaataa

SEQ ID NO: 652 - DNA, 201 bp, M.catarrhalis
agatgcaccaacacctgttgcacaaaactgatcattttgttattggttatgagttttagattgggccaaatgaatgataatataccaatcttacaagtacttttaataaccaaaaccaaccgtaatcaacccaagaaccaaattacccatcggtcatttggttcttgggtagtttttattggctctcaatatatgatgtag

SEQ ID NO: 653 - DNA, 1212 bp, M.catarrhalis
ttgccggccaatcgcattaatatgccgcaaactgctgaagaaattttgtcaagtggtcaagcagatttggtgcagatggcgcgtccttttttggcggacagcgattgggtgaataaagctgcaagcaaccaagctcatctgattaatacctgcattggctgcaatcaagcatgtttggatcacacctttgccaatcagcgcgcctcttgtttggttaatcctttggcgtgctttgaaagtgaaatcagcgtcaaacccaccaaaaagcccaagaaaatcattattgttggtgcaggggttgccggtctatcagctgccgtaaccgctgccagtcgtggacatcaagtgacaatttatgagcaacatacgcacatcggtggtcagtttaatatggcaaaagtcattcccggcaaagaagaattttttgagacaattcgatattttcgtgagcaaatcaaacaccttaatatcaccgtacacctaaataccaaggtggataaagccatattaaatcagtcaagagcagaccatgtgattattgctactggcgtagttccacgcatgttgccctctctggaaggtgcaaacttgccacaagtcatcagttatagcgatcttttgactggtaaaaaaatcgcaggtgagcgtgtggcagtcttgggtgcaggtggcattggttttgatgtggctgaatttttaacacatggcagcagtgtatctgatgcagtcaatgatgcaacttacaagcccaaagcaatggatgtcgataccttctttacacattggggtgtggaccagcaggcatgttatcagaccaaaggggcattggttgaacccaattataccacgcctgtgcgtcaagtttatctgttgcagcgtagtgaaggcaagcttggtaaaacattaaataagaccacaggatgggtacataaagccgccatcaaacaagctggcgtcattcaaattgcaggcgccagttatgataaagttaccaacgaaggcttatggatcaccattgatggcaaatctcagcttctgcgtgttgatacggtcgtactgtgtatcggtcaagaatctgtcaatgatttgatgccaaagcttggcgatacacccaaagcagactatcaggtgattggtggtgccaaatcctccgctcaattggacgctaagcgagctattaaagagggttttgagctggctgcaagattataa

SEQ ID NO: 654 - DNA, 1641 bp, M.catarrhalis
ataatggcaaaagatgtaagttttggctcaaatgcccgcgaaaaaatgattgatggtgttaacattttggcggatgctgtcaaagttaccctaggtccaaaaggtcgcaatgtggtgattgataaatcatttggcgcaccgaccatcaccaaagatggcgtgtcagttgccaaagagattgaacttgaagataaatttgaaaacatgggtgcacaattggtgcgtgaagttgcttctaagaccaatgatgtggcaggcgatggaacaacaaccgcaacagtacttgctcaagccatcttggttgagggcatgaaaacggttgctgcaggcatgaatccaatggatctaaagcgtggtattgataaagccgtacgcgccgctgttgaagaaattcgtgccatctcaacacctgccaatgaccataaagcgattgctcaagttggctcaatttcagcaaactcagatgctaccattggtgagcttatctccaaggcaatggaaacagttggcaaacaaggcgttatcacagttgaagagggttcaggttttgaagatgcgcttgaagtggttgagggcatgcagtttgaccgtggctatatcagcccttactttgccaataaacaagacagcttgacttgtgaatttgacaatccatttattcttttggtcgataaaaaaatctcaaatattcgtgagattgtgccactacttgaaaaagtgatgcaaaccagccgtccgctattaatcattgctgaagatgttgaaaatgaagcattggcaacattggttgtcaatactttgcgtggcggattaaaaacttgtgcggttaaagcgccaggttttggtgatcgccgtaaagccatgcttcaagacattgcaattttaacaggtggcgtggttatctcagaagaagtgggcttaagccttgagactgctgagattgagcatttgggtactgccaaaaaagtaaccattggtaaagaaaacaccgtcattgttgatggtgcaggtgataaagccagcattgaggcgcgtgtagagtcaattcgtcgtcaggttgaagaatcaacttctgactacgacaaagaaaaacttcaagagcgtgtggcaaaactatcaggcggtgttgcggtcatcaaggtgggtgcggcaactgaaactgagatgaaagagaaaaaagaccgtgtagacgatgcacttcacgctacccgtgctgctgttgaagagggtgttgtgcctggtggtggtgttgcacttgtgcgtgctttatctgcattaagcgacctaaaaggtgataatgaagaccaaaatgcaggcatcaatatcctacgccgtgcgatggaagcaccacttcgccaaatcgtcagtaacgcaggtgatgaggcttctgtaattgttaatgaagttaaaaatggctctggtaactacggttataatgctgcatcaggtgagtatggcgatatgcttgaaatgggtattttagatcctgccaaagtaacccgttcagcattagaacatgctgcttctgtcgcaggtttgatgttgaccactgaggtgatgattaccgataaaccagcaccagaagcaccaatgccagcaggtggtatgggtggtatgggtggtatgggcggtatgatgtaa

SEQ ID NO: 655 - DNA, 780 bp, M.catarrhalis
catatcttgaacacaaaaaagcataaaatgacaaaattggtattattcaataagccttacggcgtgcacagccagtttaaaaaagatcatgacggcatgatcactttagcggattttattgatgataaaacgatgcgtgtggcaggaagattagataaagattcagaagggctattattattgactgataatggtaggctcaatcacgccatcacaacgccaccaactgccaaaaatgccaaagataagtatacaaaatgtgccaagacttatttggtgcaagtagaaaatattgcaacaaacgtacaaatacaggcattggaacaaggtgtgatgctaaaagatgggaaaactttacccgccaaagtacaaaaacttgatgaaaacgaactaccgattcgtttatggcagcgaaatccaccagtccgccagcgagtaaatatcccaaccacatggcttaagataaccattgttgaaggtaaaaatcgacaaatacgccgcatggttgcccatgttggtttgccctgcctaaggttaatccgatcacaaataggcatttggcaactgaatggcttggcagtgggtgaaagccgagttttacagttagaccagcaaacattacttaaattgggtctgtcagctcagccaacacccaagcaaaataagccaaccaacttgatatcaagcaacacaaagggagcggtcaatccaaaatctggtaaaattcatttgttaaaaaaaccatcttggcgtgtccgcccacctaagtttcgtgcttaa

SEQ ID NO: 656 - DNA, 849 bp, M.catarrhalis
aataaaatgaagcaatatcttgaattattacaacatattttaaaccatggcactgataaacaagaccgcacaggtacaggcacgcgttcggtgtttggttaccagatgcgttttaatttggcagaaggttttccattactgacgaccaaaaaagtacatatgaagtccatcattcatgagcttttatggtttttaaagggtgaaaccaatacaagctatttgaccgataatcaggtgacaatttggaatgagtgggcaacagcagaacaaacagctcgttttggcagagctgagggcgagcttggtcctatttatggtcatcaatggcgtaattttggtgcaagcaaaaaaagcgatggcagttatcatgatgatggttttgaccagatcgcttggctgatcaatgagattaataccaatccaaactcacgccgactgatcgtctcaggctggaatcctacagaggctaccgaggttgcattgccaccgtgccatacattatttcaattttttgtcagtcaaggcaaattatcttgccagttatatcaacgcagtgccgatgtttttttgggcgtaccttttaatattgccagttatgctttgttaactcatatggtggctcaggtatgtcatttggatgttggggaatttatatggacaggtggcgatacgcatctttatcaaaaccattttgagcaagtgaaattacagcttagccgtgagccattgccactttgttcattgcgattaaatcccaaagttcggagtatttttgagtttggttttgatgatattcaaatcgcagattatcaggctcatccagcgattaaggcaccagtggctgtatga

SEQ ID NO: 657 - DNA, 807 bp, M.catarrhalis
tattttaagaaaagtatgatgacaaaacatatcccaattttagatgatgttgccattgataaaatgaaaacggcgggcaagcttgccgctgatgtcttggtgatgttggatgaacatgtaaaaacaggtgtcagtacaggcgtgctagatgatattgcacaccagtatattcttgatcacggtgctattcctgccccactgaattataacggctttcctaaatcaatttgtacttcaattaatcatgtggtttgtcatggtattcctgaccatgaacggctgctcaaagaaggcgatattattaatattgatattacagtcattaaagatggctactatggcgatacctctaagatgtggattgtcggtcaaggttcagtgatggcacagcgtctttgccaagtggctcaaaaagcgttatatgctggtatgaaagtggttaaaaatggtgctcatttgggtgatattggtgctgccattcaagcggtggttgagcctgagcgttttagcattgtgcgtgaattttgtgggcatggtattggtcagaccttccatgctgagccccaagttttgcattatggcaaggcgggtacaggtattgaacttaaaacaggcatggcatttaccattgagccgatgattaatcagggcgtgtggcagaccaaaattatgaaagatggctggacggccatcaccaaagaccgtaagctatctgctcaatgggaacatacattgattgtcacagataatggttgtcttgtaacaacagcacgccctgatgaggatttaagctttttaagcagttga

SEQ ID NO: 658 - DNA, 1245 bp, M.catarrhalis
cagttttttgagatgacaacaaccaaaacgacagatgtttgtacgatagctcagatgagtgagcagggcgtttatccgtctgatgagcagcggcacagttttgccaagcggttactgacatggtttgagttacatggtcgccatggactgccttggcaataccatcatcagccgtcagcagatatttatgctgtgtgggtatctgagattatgctacagcaaacacaagttgtgacagtgctgaaattttttgagccgtttttggcacgatttgcaaccgtacaagagcttgctgtagcagattggcaagaagtagcgtctttttgggcagggcttggatattatgctcgggcaagaaatttacacgcaggtgcacagcaagtggctgattttattgacactcatggcaggtttcctgaaacggtcaatgagtggcaagcagtcaaaggggtggggcgatcgacagctggcgcaatcgttgcgatgggtgttaagaagtttggcgtcatctgtgatggcaatgtcaagcgtgtacttgctcgccatcgtgcagtttgtggcgatataacaaaaagtgcgactgacaaaaggctttgggaaattgccaccgcactaaccccgaaagagtatagtggacactatgcccaagcgatgatggatttgggtgcaacaatttgtacacgaactcagccaaaatgccatctttgccctgtgacagacgattgtattgcttatgcgttgggcgttcaaagtcagttacctgtcaagaaaaaagcaccgcccaaacctcattggcacagtattgcattatccctgacacattgcgggctgactttatggttgcaccgacaaaacggcggcggtatttgggatgggctttggagtttaccgatttttatgttgcctttggatgataatcaaaagcttgacaataacaccttaagcgatgccattttcaaggcgtggcaaagtgatgaaaaggtgcatgatttactacacagccagctcattgagattctgcctatacccacccaaaccttaacagcctatttacgccatacactcacgcatgttcattggcatctttatggcatgtcaatttgtcttaataatagtcaatttaaccaaattaatcaaacgcttactggtttgggtatcgactatttatggacagatacgccctataatttaccgttacctgctgccatgcataagcttttgacgcttagcaatagctcttgctaa

SEQ ID NO: 659 - DNA, 288 bp, M.catarrhalis
accgtacttgataaaacaaaaatcattgaggaatataccatgatacatccttttgaaaatgatgagcaagcgctgaccattggagatctgaccatcgagaatcattttgatgttgtgcaaatcttcggtgaactttctatcactaaatgtcaagacggtctaactcaagcgatggctttacaagattttgctaatcggttggtagcggcacttaaaaatgaacctttagatgaaataaaggctcatgatatgttaccatctgagcagattgataatccttttgcttaa

SEQ ID NO: 660 - DNA, 252 bp, M.catarrhalis
atgacccatgagtcaaatgccaaaaaaaccctgcttgattgtcttaaaaatatgctaaaatttagggcatatcatccatcattacaaatcactttttgtaaatttagcaagtctcgctgcccatccgtcagcgtcatgacaagccacaggacagggattagccatgccattaccatttttaaaacagcgtctcaccaagattatcccgaccaaagcactaagcaccaatccccaagcaccaatcccaaatag

SEQ ID NO: 661 - DNA, 936 bp, M.catarrhalis
gatacaaatgatataactaaaaataaggacaggccaatgctcatagaatttacaaaaatgcatggactgggcaacgatttcatggtgattgatctggttacccaacgcatgacactgactcccgaattaattcgcctacttgccgatcgacggattggggtaggatttgaccaattattaattgttgagccaccaagtcgcccagatattgattttaaatatcgcatttttaatgcagatggttctgaggtgtcccaatgtggaaacggtgctcgatgttttgcttcatttgtacaagccagaaaactatcttttaagcagcgtttacgagttgaaacctcaagcggtatcatcatcctaagcaccaatcgctatgggtgggtgcaagtagatatgggcaagcccaagtttgagcctgaccaaattccttttaccccaaagaccatcaccaaagttgggcgcgcctatcgcttggatgtcgatggcatacctgttcagctttatgtcgccaacatcggtaatccgcatgcaatcatcaaggtcgatgatgtcttggatgccgatgtcgatagattgggtaaactcatcgaatcacacgaagcatttcctgaaagagtcaatgtcaatttcgttcaagtcattaatcagcgtcatgtgcgaattcgtgtctatgagcgtggcgttggtgaaacccaagcctgcggtacaggtgcctgtgcttctgttgcgacaggtattcgggagggctggctagatgaaggggtggatattcgtgcccagttatatggcgggagtttggcaattcgttggcaagatggctactcactcatcatgactgggccaactgcctttgtgtatgaaggcgtatttagtccagatggtttggcggcatcggctggcattaagcttgacccaaatgcagatgatatttactga

SEQ ID NO: 662 - DNA, 1215 bp, M.catarrhalis
catacgatagagaaatttatgagcaacaacagccattgtagtgatattattatcgtaggggcaggaccagcagggcttgctttttcaagattttttaagggtagtgatgtgcgtttgacgctgattgaaaaatcatcattagccgctttacaaaaccctgcctatgacggccgagagattgccttaaccaatacttccaaagaaatcctacaaaatctgggcgcttggcaaagatttgcccctgatgagatttatcctttaaaagatgctaaggtgtataacggtaatttaaattacgctctgcattttcaagtacctaagttaatgcacagacagcgttcgcttgaccgattgggtaatttgatctctaatcacaacatcaaaaaggcgttgtatgatgaagtggcaacgatggataatgtcacgctcatcactgatgcaactgtcactgatgtgaatacagatgacaccaaagcctgcgtgactttgatgaatggcaagcagttgtatgcagatcttgtgattgctgccgacagtcgcctatctggcatgcggcgtatgcttggcattggggcgcacatgcatgattttggtcgtacggtgatcgtatttcgagtcactcatccgttatcaaatcatggcacagctcaagaatgctttttgtatggtcgcactttggcactgctgccgctgaacgaaaccatgacaaattgtgtcattacgctagataatacacaagcagatgagctgttaaagatgactccagagcaattggctcacgaagctcaaagaatgtttggcgatggttttggtacatttacgattgcaggtacggtacatcattatccactgatgggcgttcatgcacataagtttcatgccaatcgggcagcactcattggtgatgcggcagtcggtatgcaccctgtgactgcacatggctataatttgggtctgcagagtgccaatactttggcgccactgattttacaagcacaccgccgtggcttggacatcggctcaaatcacctactatctatgtacaatcgtcgccatcaggcacataccagacctttatatcatggtacgaatgccatggtaaccgtatttacaacagatacgctgcccatgcgtacggtgcgtgatatggcgttgcgtcttagtaataacttccccccagttaagcattggattgccaaacagttggtaggctaa

SEQ ID NO: 663 - DNA, 891 bp, M.catarrhalis
gtatggatagatatggcaatcgttcacccacagattaaccctgttgctttagacttgggcatgatagagctgcattggtatggtttgatgtacttatttgcttttgtggtggcctattttttggcatgggtgcgtaccaaatcccgaacagattttacccctgagatggtttcggatttggttttttttggttcagtgggtgtgattttaggtggccgtattggctatgtacttttatacaattttggtgagctgattgctaaccctttatatctttttcgagtatgggaagggggcatgagttttcatggtggatttgtgggcgtgttgcttgccatgtggtattttgcacataaatataaaaaagcaccctttgcggtactggattttatcgcaccctgtgtaccaacaggcttattttttgggcgaattgggaatttcatcaatggcgagctttggggacgaatctcatacgctgatgtgtcacatttgatgtatttcccgcaggctgcccgtgtagattttgagatgattcaggccaacccagctttacaagatattactgctaatatcggaggttatttgcttttgccacgccatccttcgcagctttatcaagcagcaaccgaagggatattattatttgtggtgctttggtggtttagtgccaaaccaagaccccgctatgccgtctcagcagtttttttattggtttatgggctaagccgatttatcacagaatttttccgccaacctgatgtaggctatgcactgatttttggttggatgagcaaagggcagctgtatagtttgccaatgattattgcaggtgtggttttaatggtgatggcgtatcaaaaacaaatctatgactggaataaaataaaatga

SEQ ID NO: 664 - DNA, 210 bp, M.catarrhalis
gtggtattttggcataaaaattatcaaattatcaatagttggtatatatttttattctttaaaaccgatattggtaccaattgcttacaaagatcaagtaaattaagttattttaagataatattaaatgtaattatcctaataaataatcatcgattaaatgaggtattaaagatattaactcaatgcctgaatgatcgcagattttaa

SEQ ID NO: 665 - DNA, 501 bp, M.catarrhalis
acaagctcttgccatcgctcaaggtgtgcgtttggcgacactggtcaaacagttgcaagcagacagcttatgaaacaatcacaagcactcagacgcattaagcccatcaaacctgtacatcaagctttgcgtattacttggtatgcttggatttttatgactttggtgggatatcctgttgctgtgagcctaaccacagatgcctcactgtgggcaggtatgggcgttcaaagtttggtactggtgccagctgtgatatttgccccgacgatacatcaaggaaaatcaccttatgcactcatgtgggttagtatgattatgttaatttatttgggtgcatcaggtgtattgacattacttcgtatttacgaacaatcgccaaaggcagttgcagcagccgaattaatcgagtttttgttgctacttactatcaatagccaattgctcatcttattaaagcgtctgcctgccatgcatactaagcacacccacccaaaataa

SEQ ID NO: 666 - DNA, 192 bp, M.catarrhalis
tatctcaaatggcatgatacagtgttatatgatattaagtgccaaaccaacataaaaccaaaagaaaaatcacccaagcagacggctggggtgatttacagtgtcatgaataaacagtcatttgcctatcattcgtctgatgtcattgatatgtttcttgtttttgccaaagaagtgatatgctttttttag

SEQ ID NO: 667 - DNA, 426 bp, M.catarrhalis
tacaatatcagccagttgatgatttggtgttgtgtcatgactggtaaattaataaaaacagctaaaaataccgtgtgccaagttgctttagggctaggtatctgcgtcaatgatgctcacagcaccatgatttttcaaagtgtgggggtatttggagagccagtttttagccaaatagcacccattggcaagccacccacagccatcaaagtacattattttagcgtcccaaaaaatcatcaaaatacacaagcctgccattatcttaaaaccagccttaacaccttgaaatcagggggtgtcatatacgaaattggtgaaaacggtcaacaaactaagctcacacccgatctgatccaacaaaaaattcaccacattcaaaccgctatcgacaatcattgtcgcaactcagtctatgctcattag

SEQ ID NO: 668 - DNA, 2412 bp, M.catarrhalis
ttggtgatgagattggcaaagccaccaagccgattgagtcttttgtggcgatgctttgggatattggtatcacacctgctttttcggtgcgaagtgtcgatgagctgcgtgctgccgtccgtgaccaaaccattgcttctgccatgcttgaggcaagacgttttggcaggtaatgaagatttgtcttggcaaccaattcaggcggttaaagaggtctgggatatagggtctttttatgatgccaaaatggcagaatcaaaagcacgctatttggcacataatgcgacagaatataatcttgaaccaaacatcaaaaacgcacctggtggacttagagatatccacatgattggatggcttgggcgattttattttggtagctcagatatcaaattgcttgcaaccactgattttatcaacgaaaacgaatgcaccatcttgcaggcaggtcagcgatatctatggtgcattcgccatcatttgcatacactggcgggtcgtggcgaggatcgattattatttgattatcaaaaagccatcgctgagcggtttggctattatacacgcactttagataccacccatcaagatatcacacaagctctagagacaatgatgcgtgtgtattatcagcatgccatgaaaattgcagctttttcagaggtattgtgcaaatatttttatgaaaattatttgtcagccactgcacgcctgattgatattgatgagacattttatttgatacagtctggttctgaccatcaatctagacctgctaaaattgctatccgtcgcccagatgcttttttggtagatccagccaatttattaaaaatttttttggtcatgggtcaaaagggcattcgtcagatcgcagcaagtacacttcgggcaatttatgcttcaagcgatttgattgatgaagaataccgcaaaaatcctgtacatcgccaattatttttagccaatttacaagagttaaattatctgtttcatcgcttgcgtctgatgaagcgttttggggtcttgggtaattatttacctgccttcggtaaaattatggggctgatgcagtatgatttgtttcatcgctacacagtggatgcacataccctattattggtgcgtatcctgcatcgctttggtgatgatcgtcttgataatcaagataaatacgggctggtagctgagatttatcaaagaattgcccgtaaggacattttggtcattgcagcgattttccatgatatcgccaaaggtcgagggggtgatcattctaagcttggggcggctgatgcttatgaattttgtttggcacatggtatgagtgaggcggatagtaagcttgtgcggtggttggtattagagcatttgacgatgtcgctgaccgcccaaaaacaagacatcagcgatcctgaggtgattgctaaatttgccgaatttaccagttccatcactcggctaaatcatttgtatgtcttgactgtggcagatatgaatgcgaccaatagccaactttggaatacttggcgagcgacactacttaagcagctgtacaccagcgtccaccaagtacacagtttgggcgtccatgttgttgataaagatcgtgtgattgatgatagaaaaaataaagcacaagacttattgccaatggtggataatcaccgactaaaagccctgtgggatggttttggggaagagtattttttaaagcaaaagcatagggatatcgcttggcaatccgccgaaatcttggcggcagaacatcggctaaaacaaggcaagccaatcatcgccatccgagagcatagcgatgtgtccttacgagggatgcagctgttgatttgtgcacctgatcaggataatttatttgccacgacggtttgtattttggatcagttgggtctatcggtacttgatgcgacaattttatcagccgatattgacggcacaagtacagcggtggactcttatgtcattattgatcgattgttgccaacggatagtagtataccgttattgttaagccctgaacgcaccagtcagatgatattagggcttgaacatggtctaaaaactggtggtgtgccagtaccttcgagagtttttgaagtggatggtaagcttaaacattttatcgtaccaactcaagtctacttttcagaagcgacatcattggcacaccaagggcatcataaaatgcacctgatcaccaaagaccgaccatcattacttgccaaagtcggtgcagtatttagcgagctaaatattcaagtacatggcgcacgcattaccactttgggcgagcgagcagaggatatcttttatttaagtgggttgcatggcgtatctttgaatgatgatgctttggctaaattaaaatctgcgatcattcaggcattgagttaa

SEQ ID NO: 669 - DNA, 531 bp, M.catarrhalis
ggcaccagtggctgtatgatggagaatattcaacttgtgcatgtggttgccatgagccaaaatcgtgcgattggaaaagataaccagttactttggcatattcctgatgatttgcagcattttaagcgtatcactcacggtggtgtgattgtcatgggacgcaagacttttgaatctttgccgaatttattgcccaatcgtacgcatattgttattacaagacaacccattgactatgaaggtgcggtgacggctcattcactacaagatgccattttacttgccaaagcttatgcacatgcaaaacggcagaacaaaatctttatcatcggcggtggcgaaatttatcatcaaagcctagagatggcggatgtgcttgagattactgaagttgatacggtcattgaaggggatgcattttatcctgatattgatgaaaagttcataaaaacagatgaaactaagactttttattgtgataaaagcggatttcaatttcgcttttgtacttggcaaaaagttttaacatag

SEQ ID NO: 670 - DNA, 984 bp, M.catarrhalis
caagccacaggacagggattagccatgccattaccatttttaaaacagcgtctcaccaagattatcccgaccaaagcactaagcaccaatccccaagcaccaatcccaaatagcaactatccacacttatttgagccactggatttaggctttactacgctcaaaaatcgtgttgtgatgggttcaatgcacacaggtcttgaagatagattttatcattatggcaaactggctacttattttgaagctcgagctaaaggcggtgtgggactcatcatcaccggtgggattgcacccaaccgcacaggatggctaatacctgcaggcggtacactcaaccgcttgggtgatatcgtacatcacgcacgcataacccgagcggtgcataagcatggtgctaagattttattacaaattttacactcaggacgctatggatatcatccttttgttgtcgcacccagtccaataaaatcgcccatttcgccatttaaacctcgccaaatgagccaaaacaatatccaatcaaccatcgatgattatgctcataccgccaaacttgccaaaaaagcaggctatgatggtgttgagattatgggttctgaagggtatttaatcaatcagtttttatcagctcgtactaataaacgcacagacagttatggtggcagcctagaaaatcgcatgagatttgccatcgaggtggtgcgtgcggtgcgtgaagcggcaggtataaattttatcatcacttttcgtttatcgatgattgagctggtcgaagatggtgcaaccatgcaagatgtcatcacgcttgccaaagccctagagttagcaggtgtgagtatcattaatactggcattggctggcatgaagcacgcattcctaccattgtcacaagcgtacccagagcagcatttacacgctacaccgccgccgtcaaacacgccgtcagcattccagtgattgccggccaatcgcattaa

SEQ ID NO: 671 - DNA, 1032 bp, M.catarrhalis
ggaaactttatgagcctaaatatttattatgacaaagattgtgatttatcaatcatccaaagcaaaaaagtcgccatcattggctacggttctcaaggtcatgcacacgcattaaacctaaaagatagcggtgtggatgtgactgttggtttgcgtcaaggttctgcttcatggaaaaaggctgaaaattctggtcttaaagtggctgaaaccagcgaagcggttgcaggtgctgatgtggtgatgattttgacgccagatgagtttcagcgtgaactttataaagaggtgattgagccaaatatcaaacaaggtgcaactttggcttttgcacatggctttgctatccattacaaccaagttgagccacgcgctgacttagatgtcatcatggttgcaccaaaagcaccaggtcatacggttcgttctgaatttaccaaaggcggcggcattcctgatttgatcgccatttggcgtgatgcatcaggtggggcaaagcagcttgcactatcttatgcagcaggtgtgggcggtggtcgctctggcatcatcgaaaccacttttaaagatgaaaccgaaacagatctatttggtgagcaagcggtactttgtggcggtgcggttgagcttgtcaaaatgggctttgagactttggttgaggcaggctatgcacctgagatggcatattttgagtgcttgcatgagctaaaactcatcgttgatttaatgtatgaaggtggcatcgctgacatgaactattcaatcagtaacaacgctgaatatggtgaatatgtgactggtcctgaggtcatcaatgagcaatctcgtgccgccatgcgtcatgcgttaaagcgtatccaagatggtgaatatgctaagatgtttatcgctgaaggtcaaaccaattatccatctatgaccgctcgccgtcgtaataatgctgcacatcctatcgaaacaacaggcgaaaaattgcgtgcaatgatgccttggattggtggcaataagattattgataaacaaaagaactga

SEQ ID NO: 672 - DNA, 762 bp, M.catarrhalis
attaaatttatctgtcaagcaggtacaaaacagatgtgtttaagatgtcatcaatccttggtagatattttggagcaaattttgagaaaaaacttaacggcggttttaataatgactttaggcggattgtcagcgacagcgatggcagcagatttaacaggctatttggcgacttatcgtgtcagtgctgatggcaaaacaggcacagccacacgcacactcaccaaaactggcaacaattatcgctatactgtcaatgctcgagcggcagggattgcaaccttaagccaagaagcccgttttagccttgttaatggtaatattatcccacaatcttcaatgatgtctgcacgcattttgggcattggtaatactcacagtgtacgctttaatcgtgccaataaatcagcagtcagcacttataaaggcaaaactgttactttagccatgccaaagccagcttatgatgatttaagtttggagacacaaattcgccaagagctgattaatggcaaatttaatggttcatatcaacttgtcaagcgtgaccaaatagagacgaccaaatttcgtcgtgctggccatggtaaaattactgtacctgcaggaacttatgatacggtacgcattgaccgtatccacgatgaccaaaaccgtgcaaccagcttttggttagcaccaagcttaaattatctgcctgtcaaggtcagccaaactgctgatggtaaagtgatattcatggagcttaccaagatcaattaa

SEQ ID NO: 673 - DNA, 1410 bp, M.catarrhalis
gaaaatattatgtcaaaaaaatatgccgtcgtcggtttgggcagctctggactgtcagctgtgaattttttggtcaatcacggtcacaaagttagcatcatcgatggtaatcccaatcctaccttggcagataaactgcccacaggcgttcattgtcattttggcagcttggacagtgaactcttaagctcagccgatcagatcatcatcagccccggcattaacccaagaacgccgagtattgtcgccgccaaggctcaaggcatccctgtgatcagcgatgttcaattgttcattgatacactcaaagcacgagatctaactcaagcaacaaacacaccaatcatcgccatcacaggctcaaatgccaaaagcactgttacgacattagtaggcgagatggcaaaacatgcaggcatgattgttggtgtcggcggtaatattggcacgcctgcacttgaattattaacgatccaaaatatggatttggtggtgcttgagctgtcaagttttcagcttgagcatatctcaaatttggcagctcaaggggcaacaattttaaatctctccgctgatcatcttgatcggcacgatggcatggtggattatttggcacaaaaattgcgtatttttgaaaattgccaaaccgccatcatctgccaagacgatgccaatttagccaagcaatgcttgaccacactgacaagcgttgccccaaatcacaccattatcacaacaaatagcttacttagccaccaaacggcagatttttatttatttgatgatggtgatggtatggcattatatcatcaaaaaaacaagcttttaccaatccatcaattaaaaatcaaaggcaagcataacctactcaatgccttatctgcacttgccttaggcacagctgccaatcttcccatggatgccatgcttgatacccttaagactttcaaagggctaccgcatcgctgtgaatatattgatgatattgatggcaaggcatattttaatgattcaaaaggtacaaacatcggctcaaccattgcagcaattgatgggcttggcacggtttatggcatatcatcactggcattgattttgggtgggcttggtaaaggtcaagattttagtgagctgtcagcatatgttatgcagtgggtggatagtgtgtatttaatcggtcaagatgccccgataattgagcaagatttactcaaaggtgatgcacatttggcatctaaaatatatcaggttggtacacttgatcgggcagtattggcagccagtcaaagcaccgctagggctgtgcttttgtcgcctgcttgtgctagcatggatcaatttaaaaattataatgagcgaggtgataagtttgttaacatggttcacgctttagcccatgcacccatttag

SEQ ID NO: 674 - DNA, 783 bp, M.catarrhalis
gagccgattatgttttttttattatctcctgccaaaaatttagatgaaaagactgctgttccgttaccatctcatacagtttatagcagccctcgattcattgagcaagccgctcaactaatgcaaactttaaaaaactatgatgtgattgacctgcaagaattgatgggcgtctctgccaagattgccgagcttaatgtcattcgcaatcagcactgggcttatccctttgatgaaaatgccaaacctgccatttatttatttgctggcgatgtctatacaggtttggatgcgtatcatctcaacgaaaaccaaattaattatttagatgatagattgggtattttatcagggctatatggtctattaaagccactggatttaatattaccctatcgactggaaatgggtactaaatttcagacaaagcaggcagataatctctatcaattttggggcgataaaattactgatcaaatcaatcagcatttaaagcaatcagacggtattttggttaatctcgcctctcaagaatattttggtgctgttcaccccaaacaaattcaagggcgtatcattacccctcgctttgaagatgcaaaaaatgatggttataaagttgtgagcttttatgccaaaaaagcacgcggactgatggtcaattatgccgctaagcatcagattcaagatgttgaagatttaaaatattttgataccgatggttattattttgcccccagtgtcagcgatgaaaatcattgggtatttcgcagagaatggtaa

SEQ ID NO: 675 - DNA, 1317 bp, M.catarrhalis
gataatgttatgacttttagcccagtcagccatcatcaagatggtgcactgtatattgacccccaagctttggcaaatgctttaccgcattttgagtatattgatggcactttacattttgatggtatcaacactcacacactcaaagaaatctatggcacgcctttgtatgcatattcacagcgtacacttttagaaaattatcaaagctacactgatgcctttgatgccattgaccatcaaatttgttatgccgtcaaagccaactcaaatcttgccatcctaaaaacactggctaaagcaggtgcagggtttgatattgtctccaaaggcgagctggctcgtgtgcttcaagttgccgatgccaaaaaggtcgtgtattctggtgttggtaaaacggctgatgatattgaatatgcactcaaagcagatattcattgctttaatgtagaatctctaagtgagcttgataccattaatgaggtagcaggtcgccaaaaccaaatcgcacgcatttcactgcgtattaatccagatgtggatgccaaaactcatccttatatctcaactggcatgaaagataataaatttggcatcagtcatgaacaagcggtggctgcctatgtgtacgcacatcatttgccaaatcttaagattgtcggtattgattgccatatcgggtcacagctactagataccgatggtttttctgatgcgttggataaattgattgagctgatagataccttgaccgataagggtatcaagcttcagcacattgatcttggtggtggcttgggcgtacgctatattgatgaaaatcctgtcagcattgatcaagttgcaacggtattactcccacgcttaaaacagcttggattaaaattgtacttagaaccaggtcgcagcttggtagcaaatgctggcgtacttttgacaactgtggatgtgcttaagcccaccgaatttaaaaactttgccatcgttgatgcttcaatgagtgagctgattcgcccagcactgtatgaatcacagatggcaatcattcccgctaagcttagtcgggatactgccaaaacttgggatgtggttggtacagtctgcgaatccagcgactttttaggcaaagatcgcattttatctttacaagttggcgataccctagccgtcacaggtgcaggtgcatatggatttagtatggcatgtaactacaatacccgcccaagaccgtgcgaggtgatggtcaatcatggcactcatcgcttgattcgcaagcgtgaagcgttagatgatctgtggaaagatgaactcatctaa

SEQ ID NO: 676 - DNA, 546 bp, M.catarrhalis
tatgtggttatcaaaaggggagcgtacctaatgccaaatcaagtacataaacatctgatttctgtattaatggaaaacgaagcaggttcgctgtctcgtgttgtcggtttattttctcagcgtggctataatattgatacgctcaatgtagcagccacggatgacccaacgatctcacggctgactttgacaaccattacaacacatgacaaaatcgaacaaatcaccaagcagctgcataaactgatcgaggtggttaaagtccaaaatctgtccgagctgtcaggcggtcatcatgttgaacgagagttgatgctcattaaggtgcgtgcaacgggttcaaaccgtgaagaaatcaagcgtaatgccgatatatttcgtgcccaaatagtcgatgtcagcacaaacttgtatacaattttaattactggtgatgctggcaaattggatggttttatcgatgtgattggtcgtgaccgtatcctagaagtggtacgctcaggtgtgattggtatcgctcgtggtgagaaaactttggcgatttaa

SEQ ID NO: 677 - DNA, 1503 bp, M.catarrhalis
taccaatctatcatatatttattaagggtacatatgaaagcactgttattgattccgacatttgacgctccaaatttttcaaccatcgcagaaaattttgccaaaagcattggtgcagcttacattgcaccatttgatggtgaaggcgatagcaagcttagagtagcagtcactgaaggtcggcttgatgagatgcttgaaaaagtagttgctgcccaaagtgcaaagctgacggttgttaaaggtttggcgactttaccaaatacgccttatgccagtttggtcaatcgtgatttggcaaatggtctggatgccgatgtattatttgtcagccaaaatgctgaagagttggctgtatttgctgctgcgtttggcggtcttaagtctgagcgtgtgctgggtgttattgcagcaggcgtagatgaatttggggtaactgtatgggcaacgattgatggtgagcagttgacagttgatgaagaagttatcaaaaactatcaagcaacaacaagagtcaaaaaactctcaccatatgcgtttcgcaatcaagttgtccaaaaagcacaagccgccaaaaaacgcattgtactgccagaaggtgatgagccaagaaccattgaagctgctgtaatttgccagagtcgtggcattgctcagtgtgtcttattgggtgaacgcaccaagattgaagcggtagcagcagagcgtggcgtggtattaccaaatgatattgaaatcattgaccctgccagcatcgctgaaaaatatgttgcccccatggtagaacgccgtaagggtaaaattgatgaagctggggcaaagcaagcattacaagatacggtagttttgggtacgatgatgctacatatgggcgatgttgatggtttggtatcaggagcggttcatacgactgccgacaccattcgcccagcgtttcaattgattaagacagcaccacagtacagcttagtttctagtgtcttttttatgctcttgcctgaacaagtcatggtttatggcgactgtgcggtcaatccaaatccaaccgcagaacagctggcagagattgctattcagtctgccaaatcagccaaagcctttggcattgacccaaaagttgccatgatcagttactctaccatcgattcaggttcaggtgttgatgttgatactgttaaacaagctgtacaaatcattcgtgaaaagtcgccagagttaaaagttgatggtccattacaatttgatgccgcaactgtcaaaaatgtcggtaaacaaaaagcaccaaattcagcggtagcaggtgaggcaaatgtcttaattttccctgatctaaatacaggtaacacgacctataaagctgttcaacgcacagctgatgtgatcagtgttggtccgatgctccaaggcttgaataagcctgtcaatgatttatctcgtggggctttggtagatgatattgtttatacaattgctctgactgcaatacaggccattgatgaataa

SEQ ID NO: 678 - DNA, 1404 bp, M.catarrhalis
cctatttgtatgctattagatatcacccgctttgaatatcgtacttataaaaaagaattatcagcacttattcatttaagtacgcccatgctgcttgcccaaatcgcccaagtaggtacaagtttcatcgataccattatggcaggcggtgcgggcaaaggtaatttagcggcagtggctctaggcggcagtgtttttattactgtttatgtcaccttaatgggtgtgatgacttcgctcaatcccatgattgcacaactatttggtgccaaaaagtcgcatgagattggtgaaatggggcgacaaggtctttggtatggggtacttatgggtgtgcttggcatgattttaatgtggcttagcatcacaccttttggactttggttggatatcgatgaaagcacttttattatcaccaagcagtatttatggtttattggtcttgccatgcctgcggcaatgatacatcgtgctttacatgcctatgcttctagcctaaataagcccaaaatcatcatgtgggtcagctggctatgttttttgattaatattccactgaattggatttttgtctatggtaagtttggtatgccagcattgggcggtgcaggttgtggcttggcaaccgcaattgtattttggctaaatgcaatcattcttttcatcttaatccaaaaagacaagcaactacaagcctttgggctaatggataagtttagcctgcctaatgttaaaatcctgcatgagattactcggcttggcatacccattggcttatcattttttattgaagttagtatatttacttgtattatgtttttggtcgctaggttaaatggcaacacagaagattatgtcgctgcccaacagattgcgatcagtttaaccagtttaattttcatcattccccaaagcttagggatttcgaccaccgtgcgtgtcggttacagcttagggtgtgaagagtttaatcgtgctcgctatatttcaggcgtttctattgccacagccatactcatatccatcgtaacagcaattttcttggtggcttttcgctatcctttggtgagcatgtataccgatgatatggcggtgattggcattgcaggcagtgttattttatatgccgctgcttttcaattgggcgatgccatacaatgtgttgcaagctatgctttgcgtggttataaagtcaccaccattccgatggtgattcatatcattgcattttggggatgtggcttaattccagggtattttatggcatttcatggcggtatggggatttatggattttggactaccttggtagtttcgctcggcgtggcggcagtgctactactttggtatcttgaaattcatagcaaaaaagtcatcgcccaaactcggattcgcaccctataa

SEQ ID NO: 679 - DNA, 1572 bp, M.catarrhalis
aaatcatgtattactggtagtttttgggcttatttttcattatttagtattcattttatgtcatttgccaaagtttttacacgctcagttgttggtttacaagcgccacaagtatttgttgaagttcatctttctcaagggttgcctgctctgacgattgtcgggttgcctgaagcttcggtacgagaaagcaaagatcgggtacgctcagcactgattaactcaggatacgaatttcccaatcgccgtttgacaatcaatcttgcacctgccgacttgccaaaagatggggcaagactggatttaccaatcgcaatgggtattttggcagccagtggtcagattgatgataaggttttagcacagtttgaatttgtgggagagcttgcacttaatggagagcttagacctgtttctggtgcacttgccatcgctcgtgcaattaaatccagtccttgtgatggtaagcctcgtacgctgattatgccaagcattaatgctgatgaagcggtcaaagtgggcgatatgacggtgctggctgctgagaatttagagacggtttgtcgtcatttggatgtggtgagcggcatcagccaaaatcaagaacatctcttatcgcccgtaactttgccaagtcagcctcaagtgatgcagtatgcgtatgatttggcagatgtcaaagggcagcatcatgcacgccgagcacttgagattgcagcggctggcggtcattcgctattatttacaggatctccagggtcggggaagactttgatggcatcgcgtctgcccagtattttgccaccattgaccgatgcagagactttagaggtggcaagtatctattcaattgcaggtgtcaattatgcgtttggcgagcggccgtttcgtgccgtgcatcataccatctctgcgactgctttggttggtggcggctcaaaacccaaacctggtgagattagtttggctcataaaggagcgattttccttgatgagattccagaatttgatcgtaaaacacttgaaacattacgccaacccattgagtcaaaacagattaccatttctcgtgcaaatgctcaagtgtcatttcctgctgattttcagctgattgccgccatgaatccttgcccttgtgggtattatggcgataccacaaaccgttgccgctgtcgacctgagcaaattaaaaaatatcaagacaaactgtcagggccgttattagaccgcattgatttacatattactgtgcctgctttacccattgaggatttacaaaatgcaccaaagggcgagtcatcagatgatgttcgccaaagagttgtggcagcacgcaatatggcgattgctcgtcaaggtaaagccaattatgagctgacggtcaatgaacttgatcaatttgccatattgggtcaaaaagaacagcaaatgctcaaaatggctcaatcaaagcttaatttgtctgctcgcagttaccaccgtattttacgcgtagcacgcaccattgcagatttggccgccagtgagcacatcaaaacagcacatgtggcagaagctttaagctatcgataa

SEQ ID NO: 680 - DNA, 1248 bp, M.catarrhalis
aatttccacatttttaattcaaaaatccgttataataaacagtttatacaaaaccaactcacagcagcactcatgtcccaattctccgataaatttcttggtttttttgataagctcaatccacgaacggtattgcttaccagtttgagcttgatcatctgtatcagccttttgatgattgcatcagcatccattccattttctgctgctcgcgatttggcatcactgaggtttttttggtatcagttggcatatgtcgtcatcggtactatgattgcaatgattgtttatcgcattcctttgagagtttattatcaacgaacgcatatcaatgtggtatttttgatgtgggtaaccgctttggggctactcatacttacagcaatgtttggtgatgtgattaatggatcgcggcgatggcttgaccttgggatatttaatctacaagctggtgaagttgccaaagctgtcatggtgtttgtaacagcagattatgtcgtgcgtcgatctgcagagctacggagcaatgtttttacaggggtgcgtctattggcatggtatttaccagtgggcggactgttgctatttcaaccagattttggtactgtcttggtactatttgccactttgattgtcatcatctttgtcagtggtgcgcctgcactacagtacgcttggattttattcatggcaatcgttttaggaggcatcgcagcttggcttgagccttaccgccgtgaacgaattttatcttttaccgatgcttttgatgatattcaaggttcagattttcagctggcacgcagtttgatcgcttatggtcgtgggcaattaagcggcattggttatggggatagtgtccaaaaattatcacacctacccgaagcacacactgattttctgcttgccatcacaggagaggaacttggctttttgggtgtggcaacagttttatttttggagatgctgattattcttagcattatggtcattagcctaagagcattaaaatgccgacaacttcgcttaagttataccatttttggttttgcggtggttatatttggtcaggtcatcatcaatgctggtatgaccatgggacttgcacccaccaaaggcttaaccatgccattttttagttttggtggctcatccatggttgtgcttttgattatgattggttttattttaagagtagataaagaaagccttgagattcatgcacagcgtctcaacgataaatattag

SEQ ID NO: 681 - DNA, 450 bp, M.catarrhalis
gaaaatataatgagcaaaattttacttcccacatccaccgcatgcagtttgccaaaaccatcttggcttgctgaacctgaaaaactgtggtcagaatggaaatttgagggcgatgagttattacaagccaaacaagatgctctgttggtgtcgcttgctgagcaaacccatgcaggcattgacattgtcagcgatggcgaacagactcgtcagcattttgttaccacattcattgagcatttggatggcgtagattttaatcagcgtgaaactgttcgcattcgcaaccgctatgatgccagcgtgccaagcgtggtaggtgaggtgtctcggccaatatcggtatttgtagacgatgccgaatttttacgcgctcatactgacaaactcatcaaatgggctttgcctgggcctatgacgatgaatggaaatttggatgatgggcattaa

SEQ ID NO: 682 - DNA, 531 bp, M.catarrhalis
aatagctcaatactttaccatagcacaaagaaatttgtgaacgaaacatttaataattgcccaaaatgttactgcacacactttgtaaaagcaggcttgggcaatggcaaacaacgatacaaatgcaaaggttaccatcactatttttctgtgaagcaacgaagcaaccaaaaaagtaatggcattaaaaaacaagccattgatacaaacagtaaacaaatcttaggctttgtctgtggtaaaacagacactaacacctttaaacgactttatcagcagttaaatacccataacattcaactgttttttagtgactactggaaatcttatcgtcaagtcattttaaagccaaaacatataacaagcaaagctcaaacttttaccatagagggctataatagtctcattaggcatttcatagcaagatttacaagaaagtcaaagtgttattctaaatccgaaaaaatgatagaaaacacgttgaatttattatttgctaagcggaatggtagcttaagatatgtattttaa

SEQ ID NO: 683 - DNA, 1002 bp, M.catarrhalis
tatttactgatgagcagattatcgcatttcatcgcacccactcattctagccatcaatcagatccaagctcacctgcttggggctatttatcatcttggtgtgatgagctaagactacaaaattactctaagcataccatcacaacctatcaaacagccttaatacagtttttcaattttttggagtctgataactatcttggcggcgatcctttggcttgccgtcgccaagatttaactcgattttttagcactcgcttagaagaagaaaaaataaaacccatcagtgccaagcttagcttatctgccattcggattttttatcaatttttaatcaagcaaggtgttatcgcagttaaccccacaacaggctataaaatcaaatcagcaccccgaaaactgcccactgtcgctgatgagctgctcataaagcaactgcttgaccaaaaaacgcctgaagatacagccaaagcatatctatggatacgcgataaagcaatgtttgagctgatgtatagtagtggacttcgcctatctgaactggcaggcttaaatatgggcgatgttaattttgacattggcatcgtacgggtgttgggcaaaggcaacaaaactcgccaagtccctgtgggcaaaaaagccatgattgctcttcaagactacttgcctcatcgtaacttatggcaaaagaaaaattgtaaagcgttgtttatcagtgagcgtcacggcactcgtcttagcacgcgtgcgatacagcttcgcctaaaagtatgcgccaccatggcgggcattgagcttaatatgtatccgcacctattacgccactgctttgcctctcatgtactgtcatctagcggtgatctgcgtgccattcaagagatgcttggtcaccaaaatatcagcactacccaaatatacacgcatgttgattttggcgcactgacgaaagtatatgaccatgcccaccctcgtgcgtatcgcacaaaaaataatcacggctga

SEQ ID NO: 684 - DNA, 609 bp, M.catarrhalis
tttatgaagataccttatattttggtattgtatgacaccaaccaagatgctaccaaaaatttggcctatctgattgcccaaggcattcatgatgctggtcttagggcaatgattcgccgagtgcccaaggtgtcagctgtcagtgaacagtcgcatcctgccatccctgatgagggtgatttgtattgtacagcagatgatctaagggcatgctcgggattggcaatgggcagtccgacacattttggaaatatgtcagcaagtttgaagtatttttgggataataccgtttcaatttggcttgcaggggatttgcaaggtaagcctgcttgtgtttttacaacttcaggttcaatgcacggcggtcaagaaagcacactgttaacaatgatgatgccactgttgcatcatggtatgcttttgatgggattgccctacgctcaccctgagctatcggtgacagtccgtggcggaacaccgtatggtgccagccatgtctcaggtgttaagcatcagcatgtcatgaccgtagatgaacaagctcttgccatcgctcaaggtgtgcgtttggcgacactggtcaaacagttgcaagcagacagcttatga

SEQ ID NO: 685 - DNA, 1521 bp, M.catarrhalis
atatttgacttggatattatgacaaattttttaaacaaactcccctttgctcatcatgcttggtttatgtacttacgcttacttgttcgccattttattgatgacgatactcagcaaaaagccgccagtctcacttataccacattacttgccttagttccgatattaacggtggtgttggtgattttttcaagcgtgcctgcacttgagggtttgcgtgaacaagttcaacaaaccatctctgccaatttattcccgactgccagtgagcaagtagcaggatatattcgttcttttgctgaaaaatctagtaatttaggacttgtgggggtagcaggtttatttgttaccgcaatcatgaccttaaataccattgagtatgcttttaataagatttggcgtgtccaagaacgctcaggcggtgctgccagcattatacgctactggacaatcatcactttaggcccggtgattttgggtgtggcatttggtgcctcaagtgctatccaaagtatggactttttaaatcgtcaaattgcaggttatggcattgattggggtatttgggcatatttggtttctttggcattgatgacttgtggctttattttattatattggttcatccccaaagcccaagttcccataaaaaatgctgccatcgcaggcattgttactgccattttatttgaaagtatcaagcaggtttttggtactgtgatgaccaattttaccagctatgaagccatctatggtgcgtttgccgccctaccaattttcttattgtggctatatatttcttggaatttgattcttttaggcgttcaaatcagttatacattgaccatttttgataccaaagaggtgcccgttcgccatccgttattaagccttttagatatgcttaatttaacatataagcgctatcaaaatggtgaagctgtcagcgaagatgaacttcgtggcatgctgggtcgcaaagagctgcccaaatggagtatgtatttagaccaacttgtcagtaatgattttattaccgaaaccaaaaataatgaatatatcttaaaaaccgacctaagaaccatcaatttttggaaattttataaaagcttgccttatccattgccgattcgtcatgagcttgatcaactagaatctgcagattatgatccatggtttattgaattgcatcatcacttagataaggttgaagatgctgccatcaaagagctggatgtaactttggcagaattgtttgaaactacacccttgagagaaaaacaagaaattgtacgcattgtctctgaaaataccgatgagcttggcgagagcaaaggctttgatgataatgctcgtcgcacgattgatgagtcaggaaatgttgtcatcattccagatggcaaagcttcatttaccgaaagtaaactgaccaaagtattacgcttactaaaaaaagcatatcacttctttggcaaaaacaagaaacatatcaatgacatcagacgaatgataggcaaatga

SEQ ID NO: 686 - DNA, 318 bp, M.catarrhalis
gcaagtactgttgcggttgttgttccatcgcctgccacatcattggtcttagaagcaacttcacgcaccaattgtgcacccatgttttcaaatttatcttcaagttcaatctctttggcaactgacacgccatctttggtgatggtcggtgcgccaaatgatttatcaatcaccacattgcgaccttttggacctagggtaactttgacagcatccgccaaaatgttaacaccatcaatcattttttcgcgggcatttgagccaaaacttacatcttttgccattatttactccgattttttgattttcagtttatga

SEQ ID NO: 687 - DNA, 2784 bp, M.catarrhalis
atgcccgctgtgtccatatcttatttccccaaagcgaagaaacacggcgtctatgccaaggcatctgcattgctgtcacgagtggtgttttcggtgggtgatgatattaccgaccaagagggtaatttgtatcaagtggcacgctgtgaagagatttcaggggtaatgcgttatcatttggcatgtggcaaaagcttgatggagacacggcttgcggcaaatattactttatcaaaaccacttgagcgtctgctggcagggcgtattgaaggagcggattggtatgagctacgccaagatgccttgcgtattcaggcgatgcttgcgcgtcatccactgcgtgggctaattggagccagagttgatatcattgcccatcagttgtatatcgcctatgaagtcggaaagcgacttgcgccccgtgtgctactggcagatgaggtagggcttggtaagaccattgaggcaggtctgattatgcatcagcaaatcttgacaggtaaggttaatcgtgtgcttgtacttgtgcctgacagtttacaatatcaatggatgattgagcttaagcgtcgctttaacttagattttgcgttgtttgatttggtgcgtaccgctgccatcaaagaacataatcccgatcaaaatgtctttttgaccgagcaatttattatcgcaggcattgatttattgctcgaccatcatgatttgtatgagcaagcatatgcagctgggtttgatttacttgtggtcgatgaggcgcatcacctgcattgggacgccgaacaaggcggtaatgataagtatgacttggttgccgattttgctgccagtattgcaggcgtgttgctattgaccgcaacacctgagcagttgggcgtagagagtcattttgcacgcttgcgtctgcttgatccgcaccgttttgatgatttggatgattttattgccacccaagatacttttgcagatgtggcgatggtggcatccttgttgattgatggacaagaactcacggccaaacaaatttgtgcagtcgcaaatctgttgggctttgaggagatagagctggctgatattaatgccaatgagcgtttgcgtacacatattatcaatgagctattagatcgccatggcacagggcgtattttatttcgtaatactcgtgatagcgttcaagggttttttgggcgaaccagtatcccttatccgctgcctctgccaacggcatggcaaaatacacactacacccagggcaaattgcgtgaacagctgtggggtgaggagcaatatccagatggtgcatggcttgagcatgaccctaaagtggcttggctgattgagctactacgccataagcttaagcataaaaaagtgttgctcatcgctcgtagcggtgctaccatcgaaagcttagaggcggcacttcggttacatgcaggcatcaagacggcaatttttacagaacagatgagcttacttgagcgtgaccaagcagcggcatattttgctgatgatgctggtgcacagattttattatgttctgagattggctcggaggggcgtaattttcaatttgcccaagacttggtattatttgatttacctgccaatcctgatacgcttgagcagcgcattggtcgccttgatcgtatcggtcagattgcacagattaagcttcatgtgccttttgtgatgggtactgcccaagagcgtttgtataattggtatgatggtgcattaaatatctttaatcaaatcagcccaacggctcaatctgtccaagatgcttttattgcagagctaaagccattgcttgaaggtgctgacactccccaaaatcgtgaaaatttagccacactcatcgcacaagcttccatctatcgccaagcgttagaagaggcactacaagcaggccgtgatagattgcttgagtataattcatgccgcccaaatgttgccgcacgcattgagattgccatgcgtgagcttgatgataacaaattgctgccgctgtttttggatcgttatttgacggctgtgggtatagattatagtgtacagcgtgatggctcatggattatccatccgattgatgcatctgaggttgatgtggagggcattgaaagcctgcctttggatgaagatggcatgaccttgacctttagtcgtcagcaggcgcttgctcgtgaggatatacattatatgacctatgagcatccactgatccaagccatccttgagatgattttgacgggtacttttggtaatacacaagttggcctgttaaaatcagcggcactgcccaaggggatgctgatgattgaaaatcagtttcgtattgaggtgattgctgctaagtcattgaatttatcagcttatttacctaaacaaagtttgcgtatatttttgagtgaacgaggcgatgatcttagccaagttgccaccagtgaaaaaattctaccactcatcgattgcttggataagggtcgtgctcgtcaagttgccaaggcgcgcgcaggggtcatagatgccagaacccaagacgccaaacgcattgcaggtatgcagcttgatcaaattagcacacaagccaaaacagcttttggggattatatgaacaaagaaattgggcgtctggttcgcttgcaggcggtgaatcccaatgttcgtgatgatgaaattttggcacttgagcaacgaaaatcccaaggtttgcaggcacttgatagcctatcattagtacccgacagcattcgagttttggtaacggtcgcacctgactga

SEQ ID NO: 688 - DNA, 201 bp, M.catarrhalis
taccactgcgtctatctgcagttgggaaagtggccagtatcagccagctttgggtacataaataccatgaaaactattataacaaattttattaaaaaagggaattatttttcatcattgatgactaataaagtaatcgccatcaaaaatcacggcaatccaagctcaatccatcatttaatcaaattaaatttgaattaa

SEQ ID NO: 689 - DNA, 642 bp, M.catarrhalis
tattatagcgtattttatttatatattttcatttatttattagatttaaaggagatgggcgtgggtgcattggtgggtattgccctgatttggtttgtcattgaaatgctgctttggtatttggtggcacaatttatcagtggttggtatgtatttttttggttcatcatcgcagcaatcattggaattatgatgattaaaaaagctgcaaaatcgcttaatccaatggcacagcaaatgaaagccatgcagcgtggtgtgatacccaatccgagtaatcaacctgctgagtcaacactggttaaatccatcgccatgggcgtggcggggctgttgttgttacttccaggtcttttaacggatgttgcagctttggtattattagtgccatttatccaaaccagactgaccgccgccgccaaaaattatgccgccaaaaatcaagataaaatgatgcagatgatggcgagtcaaatgggtggtaaaaacccttttgggggcatgggtcaaaacccttttgctcaaggtggtatgaagtcaaatccttttggtaagcatggcggctttggaacaacggttgatggggaagctaaaactgttgataaacaagttaagcgtattcgctctgccaatgatgaataa

SEQ ID NO: 690 - DNA, 1659 bp, M.catarrhalis
cttatgagcttaattaataaattaaatgaacgcattacgccgcatgtcttaacttcgattaaaaatcaagatggcgataatgctgataaatctaatttgttaaccgcattttataccatttttgcaggacgcttgagtaatgaagatgtgtatcagcgtgccaatgctttgcctgataatgagcttgagcatgggcatcatctgctcaatgttgcttttagtgatgtttcaactggtgaagatcagattgcttctttgagtaatcaattagccgatgaatatcatgtttcgccagtaacggcacgcaccgcaatcgcaacggcagcacctttggctttggcacgcattaaagagcaagcaggtgcattatctgtaccgtcttttattcgtactcaattggctaaagaagaaaaccgtttgccaacttgggcgcatactttattgccagcagggctatttgcaaccgctgccacaaccaccgccgagcctgtaacgacagcctctgctgttgtgaaagagcctgtcaaaccaagtgttgtgacagaaccagttcatccagctgcggctaccaccccagtcaaaacaccaactgcccagcattacgaaaacaaagaaaaaagtccttttctaaaaacgattctaccgattattggattgattatttttgcaggcttggcatggcttttgttaagagcatgtcaagacaaaccaacacctgttgcggcacctgttgcgacagatacagcacctgtggtagcggataatgctgtacaggcagacccaacacaaacaggtgttgcccaagcacctgcaacgcttagcttgtctgttgatgaaacgggtcaagcgttgtactcgcaccgtgctcaggttggtagtgaagagcttgcaggtcatatccgtgcagctattgctcaagtctttggcgtacaagatttaaccattcaaaataccaatgtacataccgctacgatgccagcggcagaatacttaccagcaattttgggtttgatgaaaggtgtaccaaattcaagcgttgtgattcatgatcatacggtacgctttaatgcaaccacgccagaagatgtagcaaaactggtagagggtgctaaaaatattctacccgctgattttactgtagaagcagaacctgaacttgatattaatactgcggttgccgatagtattgaaacagcgcgtgttgctattgttgctttgggtgatacggttgaagaaaatgagatggatattttaatcaatgcattaaatacccaaatcattaactttgctttagactcaaccgaaattccccaagaaaataaagaaatcttggatttggctgccgaaaaattaaaggcagtgcctgaaacaactttgcgtatcattggtcatacagacactcaaggcacgcatgagtataatcaagatttatcagaatctcgtgctgctgctgttaaagagtatttgttatcaaaaggtgttgctgctgaacgtttgaacactcaaggtgcaagttttgattatccagttgcatcaaatgctaccgaacaaggtcgcttccaaaaccgtcgtattgagtttgtacttttccaagaaggtgaagcaattactcaagtcggtcatgctgaagatgcaccaacacctgttgcacaaaactga

SEQ ID NO: 691 - DNA, 423 bp, M.catarrhalis
ttgggatttttgatggtcaatcattatgaaataaaaaaattaaaaaaatggcttgaaatttatcactgcgactccaaaaagcaatcacaactttttaattttcctcttagtaaattgattaacggagtcattatgaaaattcgtccattgcatgaccgcatcgttgttcgtcgtaccgaagaagaacaaaaaacagctggcggtattttactaccaggttcggctgccgaaaaaccgcaacaaggcgaggtgattgccgcaggtaatggtttagtgcgtgagaatggcgaggttcgcccattggatgttgcagtcggtgatgtggtgttgtttggtcaatattcaggtcaaacagtcaaagttgatggtgaagagctattaattttaaaagaaagtgatgtcttaggtgtacttgaggcttaa

SEQ ID NO: 692 - DNA, 1029 bp, M.catarrhalis
gatttttcattcaacttttccatcaaaatcatgccaaaatttaacaatttaaggtatgataaagcatttatcaatgacccatttatcataaaatatctaaataccatgtccaatcatttcatctttgatttaagtacgcatcacatcaccgcctttattcaaaatgccaatcatcttgatcaggtaaggcagtggcaaagcaaaaacctaccaaacctattagacattatcctaacgcactcaagcctgcctgaaccattaaacaaagcttgccgctatgcgatgagtaacggtggcaagcgtgtacgcccacttttggtattatcaacttttttaacgctcattaaaacaggtcatcaaacagatgatttgaccaaaaaaatacaaatgttatttcgtgccatgatggcagttgagctgattcacagctattctttgattcatgatgatttgccttgtatggatgatgatgcgttacgccgtgggcaaccgacttgtcatattgtgtatggtgaagatgtcgccctacttgcaggcgatgcacttcagtccatcgcttttgaagtattatttgagtgttacgacaaaaattcagccgatgatgccattgcatataaattagccaaactcttaagttgccgagcacggcgtatggtatcagggcaaatgcttgacatcaaaggggaaaatcaaatgctctctcaagacaagctagaagccatccatcgtgataaaacaggcgcactcatcgaagcggcagtgatgatgggtgcgatttgtgcagatgtgcagactgatactttaggttatcttaagcattatgctcgtgcaatcggattggcttttcaggtgcaagatgatgtgctggatatcaccgccgatacgataactttaggcaagccagctggcagtgatgaaaaacttgaaaaatctacttatgtcaaattgcttggcgtaaaaggtgctcaagagtacgccaatcaactgtttgaggaagccagatcacaggttaaatattggggtggataa

SEQ ID NO: 693 - DNA, 207 bp, M.catarrhalis
ttttgtaaattggcagaaagttatgggcataaaggtgtaaaaattaccaatcctgctaccatgcaagaagagctaaaacaagccctagaaatggatggtttggtatttattgatgtctatgtggataaaggtgaacatgtttatccgatgcaagtcgctggccaatcaatgcgtgatatgtggttatcaaaaggggagcgtacctaa

SEQ ID NO: 694 - DNA, 450 bp, M.catarrhalis
gtgaacaattcacatttatatcaccaaagccgatctatcataccaaagtatttccaatacggatcatacataaaaggagcttatatgaagctatctaccaaattattcaccttaggtgcaggcgttttattgtcagtctcagcatttgccaatgatgccattgttggtaagtggaagatgagcgaaaaaggtgaagaaaaagccatcattaccatcagtcaagctggcaacggctatcaaggtgtgatgacacaaggcttaaccgataaagccaaaaagcgtgaaggtaccatcgtattgacaaatatctcaagccaaggtgagggtaaatataaaggcaaaggtgctcatcctactctgcccatcaaaggcactgttaatattactgtgaatggtaacactatcaccattaaaagcatcgctggcacccaaacaggtgtaagacaataa

SEQ ID NO: 695 - DNA, 870 bp, M.catarrhalis
tttggtcgtcaaaaaccgtcagtcatcatcttaatcatatcattgctgagtatgaatacagaacaaaaacactaccgccatcaatatgtcatcggcgacttacaaggctgctttggtgcatttaatgagctattaagtgcgttaaattttgatgaaacccaagataaactttggcttgcaggtgatattgtagcacgaggtgaagattcgcttgccacacttagggaggcaaaacgcttatcagacattgacgcactgagcacagtgcttggcaatcacgatattaccttaatcgccacttggcggggtgtcttaacccccaaagcaaaagataagacgctaccgatttttgaagcatccgactgtgatgagctgcttaactggcttcgacagcagccacttttggtatttccagatgacaggaccgtactgacacatgcaggcattccgcccaattggtccatcactgaggcggcaggatacgccaaagagcttgaaaagcagctgtcgggcaacctaaaacagttagatcgtttattaccaaatctttattgtaaaaaaagcgaagtgtggtcagatgacttaaatggccaccaaagaatgtgtgccatcgccaactactttactcggatgcgtctttgtacccaatcagggcgattggaattttcttttaaaaaatcactaaaagatgatatgccaatggattttcgcccttggttttcttggtttgtggtacgagaaagacgcattttatttggacattgggcagcgttaaacgctgaggtagcgaccaaatttgtgcgtgcgcttgatggcggttgtgtatggggtggagtcttcaccacggggctggaaggtccacagatatca

SEQ ID NO: 696 - DNA, 1587 bp, M.catarrhalis
ttgtcaagcgatttattgatgatatttttatcaaaattaggcatttttgaagattctcacaaggtttttatggtacaatttaagtttttttatggcatattttccagccggattttatcattatttatagcgattaccaaacataaatcctatttgtacgaccttttgcataagccaaatactgacatgaccaacacgaacgataaaaaagacagcctccttacgcttcagccgccccacagcattgagatggagcgttcacttttggcaagcttgatgagtattaatgattcatttgaagacatagaaaatatcatcaacgccaatgatttttatggcgaaagacacaaaaaaatctttgatgccatcagtcatttggcgcgtgtcaatgagccatacgatagcatcatggtgcatgattatctaagtcgcattggtcagctggtatcagcaggcggtgaagactatctcattaccatcaatcaaagcacggcaaattattttaatctcatcaattatgccgaaaaagtacgagaaatgtcggtatatcgtcagctgatttcgtccgccaatcatatgctaaatttggcatatcacccaaaaaagcaaaccataacagagattttagatacgattgaatcggatatttttcgtattggggagagctttgctaaaggtagtagtaaaacaggcccacagcgtatcgatgatgtcatggcaaatgtcgtcactcagcttaacgacattcgcttacgccctaatggcctgattggtcttgatacagggtttattgagcttaataataaaacacttggttttcaaaatggcaacctaatcattttggcagctcgcccagcgatgggtaagacggctttggcactaaattttgcacaatcggcactgatgtccaataaagcagttgccattttttcgatggagatgcctgctgaatcgattgctatgcgtatgttggcagcatggggcagtattgatatgaagcgtctaatgtcggcgaatatgaacgaagatgaatgggggcgttttatgaatggcgtcactttgcttcaagacaagcatttatacatcgatgaccgttcagatcttagcccttctgaaatcagagccacttgccgtaggattgccaaaaaccaccctgacggtttgggatttgttttgattgattatatgcaattgatgcgtgtgcctggtatgggcgataacaaagtcaatgaaatgggcgagatttctcgcagtttaaaggcactggcgcgtgagcttaactgtcctgtggttgctctatctcagcttaaccgcaaagttgaagaccgcccaaacaagcgaccattaatttcagatatccgtgaatcagggcaaattgagcaggatgctgacttgattttatttgtatatcgccatcattattatcaccaagacaaagatgatatcaagcatttggcggaggttatcatcggcaaaaaccgtcaaggtgagcgtggtaaagtgccgctcaaattcattggtgaatatgtccgatttgatgatttaattccaggcgatatgcctgaagattatgatatcgatgaataa

SEQ ID NO: 697 - DNA, 1146 bp, M.catarrhalis
ataattttaagaataatgaatacgatgcgtagcacctctatcaccatccaccctaatgctttgacacacaatctacaaatcatcaaaagccagcttgaccgaacgaccaaagtacttgctatggtcaaagcagatgcatacggtcatggcatagatgcaaccgtccctgctttgatccatgccgatggctttggtgtagcgtgtttgtctgaagccatggcggtcaagcaagtacttgatggcatgaatcacaaaaaacccatcgtactgattgaaggtgcgttcagcttagatgagtggaaagtggcaattgaccatgattttggctgtctgattcatcatgaaaatcagctcatatgggcattgtctcatcggcccaagcaagaccaattttgccataccatttggctaaaatacaatacgggcatgagccgcctaggatttaatgacgatcacatcatcacggccgccaaatcgttggccgatgcaggctatcggctaattttgacaagtcattttgcatgtgcagatgacaaatcacacccactaaatgcacaacaaatcagcaaatttgatcaagccttggcgtgtattcgatcgtttgcacctgatacgcttgccagtttgtgtaattcagcagggatttttaattttaagcaccagcatcatgattgggtgcgtgctggtattgccttgtacggctctaagcccatcaccgatcaatcagccaaagcactcaatctcatgcctgccatgacgctatcggcacaagtgatggcaattcacaccttggcagctggcgacagtatcggttatagtgcactgtgggcagcacaaaaaccacatcaaattgctgttgtcagtattggctatggcgatggttaccccagagtggtgatgggtgctaaagtcagcgtgaccgatacttcaggcaatcgccacttatgcgatatcattggtagagttgccatggatatgtttatgattgatattgatgggcttgatattgccactaatacgcctgctgtgccgtggggcgattcgcccacgatagatgaggtggcaatgtgtgcagggacaattggctatgacctgatgtgccgtttcgccgtgttcgccaagggctgtcaggatcagcggtcatca

SEQ ID NO: 698 - DNA, 984 bp, M.catarrhalis
tcactgccgataaatcggcatttattgcacgagcccaaagtacttatcaaggtaggcaagcttagcaaaatacctgatttttatgtgattgatgtgcctgacaaaatagatcacatcacagaaaattggctggatagtcagttaactgataatttaaaaattcaatcaaaaaccattcctttggtgattgttttaaatataatttgctgtgatgaagttatcgcaggtcaattaaacaccgcgaacgctgccatggtagagcggcaactacatttggcacatgtgttagcaaaaatgcatcaaatccgtgccatcatcaccgctcctatacaaaaatctgtgatgattcaagcaggcatttgccttgataatggcgatatatttagcggtcataccgaatattttatgcacaaatcaaactgtcataaagtcgtgatgatgcttgctaatcgtgtgatgaaagtggcactagtaacaacacatttgccactcaaagatatctttgatgctattaccgccaatgaaatccaagaaaccatcaggattactcatcaaggattggtgacacaatttggtattttatcacccaaaatttttgtttgtggtcttaatccacatgcaggcgaagacgggcatttgggtgatgaagaaatttgcattatcaaccctgccttaaaagtattgatggctgagggtattaatatttcttatgccatgcctgctgatacactatttacaccgcagcacttggcggactgtgatgctgtgattgctatgtatcacgatcaaggtcttgcaccacttaagtcgcatggttttggtgatacagtcaatatcactttgggcttaccttatgtgcgtacatcggtagatcatggcacggcgttagatttggcaggaacaggcagagcatctagtagcagcctaaaacaagcgattttttatgccaataaaatgtcaatatctgactttgatttggcataa

SEQ ID NO: 699 - DNA, 888 bp, M.catarrhalis
tcacaatttttattcagcgttcaatcattaattatgcacattatcccaaagtccccgcaacaagccaagcatgcacctcgtaagcgttttggtcaaaattttttacacgatactcatatcatctctcagattgtgaccgctattcggttagacaggcaggataatttattagagattgggccaggtcttggggcattaaccgagcctttgcttgctgaggttgatggcatgacggtgattgaacttgaccgagatttagcatctcagctgaagattaatattggtgccaatagttattctgattttacgatcatcaatgataatgcgatgcatgtcaattatcgtgcgttggcggagcagattggtaaaggtgtttttcgggtggtgggcaatttgccttataatatttctacaccgattttatttcgcttgcttgaatttagtgatgtgatcaaagatatgcactttatgctccaaaaagaagtggttgatcgcatcacagctgagcctaattcaaaagaatatggcagattatcggtgattatgcaatattattgtcaatcggattatttactcactgtccccaaaggggcatttaatccaccacccaaagttaccagtgcagtttttagactaacgccttataaaaccaagcccattacagcaatggatgagtcggtgtttgctttggtggttcgtgaaagctttaatcatcggcgtaagactttaagagcaatttttaaggcaaatgggttgttgccgactttagatgaatcagattttgaaaaaatcggcatcaatccaagtgcacgccctgagacattgtgtgtacatgagtttgttttacttgctgatttggtcgtcaaaaaccgtcagtcatcatcttaa

SEQ ID NO: 700 - DNA, 3291 bp, M.catarrhalis
cccattttatcaatcaaaaaaattatcaataatttatcaacaaagagaaccgccatgccaaagcgtaccgacattaaatccattcttatcattggggcaggtcccattgtcattgggcaagcctgtgaatttgactattcaggcgcccaagcctgcaaagccttaaaagaagagggctatcgggtgattttggtaaactcaaatcctgccaccatcatgactgacccgtccatggctgatgccacttatattgaaccgattacctggcagacggtagagcaaatcattgccaaagagcgtcctgatgccattttgccaaccatgggtggacaaacggcacttaactgtgcgcttgaccttgacaaacatggcgtgcttgccaaatatggctgtgagctgattggggcgaccaaagaagccattgaaaaagccgaagaccgtgaactgtttgataaagccatgaaaaaaatcggtttggaatgccccaaagcagaaattgcacagagcatggatgatgcttttgccattcaagctaaggttggttttccgtgcattatccgcccatcattcaccatggggggttctgggggtggcattgcttataaccgtgaggagtttattgagatttgtgagcgtgggtttgacttatcacccacccaccagctgctcattgatgagagtttaatcggttggaaagagtatgaaatggaggtggtgcgtgataaaaaagacaactgcatcatcgtctgttccattgaaaactttgaccccatgggtgtacatacaggcgattccatcaccgtcgcccctgcccaaaccttaaccgacaaagaataccaaatcatgcgtaatgcgtccatcgctgtgttgcgtgagattggtgtggagacaggtggctcaaatgtccaattcggcatcaatccaaaaacagggcgtatggtggtgattgagatgaacccacgagtcagccgttcatcagcattggcatctaaggcgacaggctttcccattgccaaaatcgctgccaaacttgccgtcggctataccctagatgagctaaaaaatgacatcacagggggcaaaactccagcgagttttgagcctgccattgactatgtggttaccaaaatgccacgctttaactttgaaaaattcccccaagctgagagcgtgctaaccactcaaatgaaatcggttggcgaggtgatggcaatcgggcgtaattttcaagaatccatgcaaaaggcactgcgtggtctggaaataggggtgacaggatttgatgagcaattagactttgaacaaaatgatgacagcatcatcagtaccttaaaactcaaactcaaaacccccaccccagaacgcattttttatatcgctgatgcactgcgttttggcttatcggttgatgatgtttttgctgacaccaacattgacccatggtttttggtgcagattgaggacattgttcacacagaaaatcagctaaaaacccttggcatgggcgacttaacccccaatttgctacgccgtcttaaacgaaaaggactctctgatgcacgcattgccaaattgatgggcgtgtctgaaaaacaatttcgcaaaacccgttggaacatgggcatttatcctgtgtataaacgggtggatacttgtgccgctgaatttgaaacatcaaccgcttatatgtactcaacatatgatgaagagtgcgaggccaacccatcaaataaagacaaaatcatggtcatcggtggcggcccgaaccgtatcggacaaggcattgagtttgattactgctgcgtccacgccgcccttgccatgcgtgaagatggctatgaaaccatcatggtgaactgtaaccctgagaccgtttcaaccgactatgacacatcagaccgtttgtattttgagccaatcaccctagaagatgtgcttgaaatcgtacgcaccgaacagcccaagggtgtgattgtgcaatatggcggacaaacgccactaaaacttgcccgtagcctagaacaagcaggcgttcccatcattggcacaagtcctgatgccattgaccgagccgaagaccgtgaacgctttttgcagatgattaacaagctaaacctaagacagcccagtaacagcattgtcaaatcatcagaagaaggcattcgtgaggcggcgaaagtgggctaccccttagttgtacgcccatcatatgttttgggtggtcgtgccatggaaattgtctataacgaagatgaacttaaacgctacttgcgtgatgcggtgcaagcgtctcatgaagcgcctgtcctgcttgaccatttcttagatgatgccattgaggtggatgtggattgcgtatcggacggcaaagaggtggtgattggtggcatcatgcagcacattgaacaagcaggcgtgcactcgggcgattctgcttgctccattccgccttactcattaagtgatgacattcaagatgacatgcgtcgccaaaccgtcgccatggcaaaagagcttggtgtggtcggcttgatgaatgtacaatttgccatcaaaggcgaaacagtctatgtcttagaagtcaatccaagagcgtctcgtaccgtgccatttgtctccaaatgtatcggcgtgtctttggcaaaagtcgccgctcgctgtatggcaggacagactttggcagaacaaaacttcacccaagagattgtaccaagtcattattcagtcaaagaagcggtatttccttttgccaaatttccaggcgttgaccccattcttggccctgagatgaaatctacaggtgaggtgatgggtgtggggcagacctttggtgaggcgtattataaggcaacactgggcagtggtgatagattgacagggctgccacaagagggggagaccaaaacggtctttatctcggtgcgtgatagcgacaaagcgggcgtggtagatgtggcaaaacgcttggcaggctttggttttaacatcgttgccacaggcggtacacatgatatgctggtaggtgctggcgtagcgtgtaagcgtgttaataaagtcagtgaaggtcgccctcacatcgtggatatgatgaaaaatggccaaattcaccttgccattaataccacagagggcaagcaggcattaaaagactcgttcccaattcgccgtgaagccttgcaaaataaaatactggttgcaaatacactcaacgcagggcgtgcggtgtgtgaagcctatgagacgactttgccgtttgatgtttataagctgcaagatttgtatgcttcataa

SEQ ID NO: 701 - DNA, 417 bp, M.catarrhalis
gtgatgaatccgcttgacaaagcagtgataaatacgatgagtgaggcagattggcaaaatcgcttggatgatttgtcatattatgtcctaagacaaaaaggcaccgagcaagctttcacagggctttataccgataccgaagtggagggtatttatcgctgtaagggttgtcatacgccactatttgatagcagtgccaaatttcattcaggttgcggctggccaagttttgataaggttatcgccgataatgtcgttgatgaaacgctggatttatcgcatgggatgcgtcgcatcgaagtcacttgccatcattgtggtgggcatttgggtcatgtttttccagataattatgtcaccgatacggggcttagatattgtattaattcagcagcggttgtacttgataaaacctaa

SEQ ID NO: 702 - DNA, 381 bp, M.catarrhalis
atcatgagtacaatcaaagttgatcgccataccaattcagaacctgccacgcttgatctaagccaagcactgacagctgacgcaacgcccaatgacattgaatctgccatcgctcaccaagattgccttatttttttggttgctaactttatggacggtcgtatttttagcctaattcgccatactagacatcaaggttttcaaggtgagattattgtaggcggtgaatttgcccttgatcaggccaattactttgtcaaatctggtgcgacggcatttttggtcgatgaaaccaatgttgagacactaacaaaaactttgcaagatttggcaactggttatgatggtaaggctgttagtcacttaccattatttagttaa

SEQ ID NO: 703 - DNA, 336 bp, M.catarrhalis
ataattatcaccactatgaaccatttacccagcctagatgacgatggtcacctaaaaaatcataccgattggacacccaaaatcgcacaaagacttgcggatacgattggggtaacacttgaaagcgagcattatcaaatcattggcgaggtgcgtgttttttttgaaacttatcaccacagtccatcaacacgcccattaattaagtatctgatggcaagcttgcccaaccttgatattagcaatcaaaagctacaaaaactgtttaatacaggcttggttgctcggcatgtcaaccgcattgcaggcttacccaagccaccaaattgtttataa

SEQ ID NO: 704 - DNA, 282 bp, M.catarrhalis
atggcaaaagcatcatccatgctctgtgcaatttctgctttggggcattccaaaccgatttttttcatggctttatcaaacagttcacggtcttcggctttttcaatggcttctttggtcgccccaatcagctcacagccatatttggcaagcacgccatgtttgtcaaggtcaagcgcacagttaagtgccgtttgtccacccatggttggcaaaatggcatcaggacgctctttggcaatgatttgctctaccgtctgccaggtaatcggttcaatataa

SEQ ID NO: 705 - DNA, 930 bp, M.catarrhalis
caacttatttactcaaggaattttatggctatcgacattgtcatcaaccagcgtcatctacaaattcagctcaaacagcttgagactgtttggcatactgtggtgaatggctataatcttagccaagcagctgagcttttgcacaccagtcaatccagcctatctaagcaaatcgctgcacttgaaaatcagctaaaagcagatgtatttacgcgtcaaggtaagcgtttaacaggtctaacccctatcggtcgggcacttttgccacacattgaagcgatttttgctgaaattcgtaccattgagaatttaagccttgattttaataatgctcaagcaggcactttgactgttgccaccacacacacccaagcccgctatgtcttaccccaaattgtcaaagaatttcgtgaaaaattggataaagtcaacttagtattacagcaggctgatcctgaaacgattgctcaaatggtgattcgtggtcaagccgatattggtattgccaccgagtcgctacttaataatgccgtgcttcgatgtcatcgctattatgattggtcgcatgtggtgattgttccaaaaacacatgaactggcagaatttgccgatgtgcctgatggtgttgatttaccgaccttagccagttatccgattgtcacttatcatggcggctttacgggtcgtggcacgattgataaggactttgacaaagcaagattctatcctgacattgttttggcagcacttgattcagatgttatcagcacttatgtatcatcagggcttggccgtggtattattgccgagatggcatatcaacctaagcattatcctgatttggttgccattcctgtaaaccattttgggcgaattaaccactggattgcggagcgtgaccatagcgaaatttcgaaaatttggtcatga

SEQ ID NO: 706 - DNA, 213 bp, M.catarrhalis
ttattgatttataatattaatttaaaatattataaattatattatgctgttatttttattttggcaaaaaactttgacaaaaaaatacaaaagctcaattattgtgggttttgcgttaactgctcccatgttacaatagggtatttgtcattcaaatttggacaaaatcatttgccaaatctgcttaataaatcattcggtactggagtatga

SEQ ID NO: 707 - DNA, 198 bp, M.catarrhalis
ctgcctttatattatattaaaaaatattatattaaaaataattatttagattgtattaaaaataattatcaaaaaatcgcccagagaacatcaccaccgagcgacaggatttgcaattggcttaagaataattataccgctaaattccataccaatcaatcgacgaatatgtcagatctatcatcaataccacgatga

SEQ ID NO: 708 - DNA, 1677 bp, M.catarrhalis
atgtaccaatacagctatgccgaccaaaagctcgttgatgagcgagtgtcacaatttcgcagccaaactgaacgctttttatcaggtgagctgcctgaagagcaatttttacctttgcgtctgcaaaatggtctttatattcagcgtcatgcgccaatgctgcgtattgcgattccttatggcttaatgagcagtcatcagctgcgtactttggcagagattgcacgtgattatgataaaggttatgggcattttaccacacgcaccaatttacaattaaactgggtaaaacttgaagaagtgcctgatattttggcaaaattagctgccaatcaaatgcataccattcaaacttcaggtaactgtattcgcaacaccaccaccgacccttatgctggcattcatgccgaggagattgccgacccacgcccttattgcgaaattatccgccaatggagtacttttcatcctgaatttgcctttttgccacgcaaatttaaaattgccgtcatcggcacaagaactgaccgtgctgccacacaggtgcatgacatcggtctacatttggtggagcgtgacggcgaaatcggttttgaggtcattgttggcggtggcttgggtcgcacaccgattatcgggaagttgattcatgaatttttaccacgcaggcatttgctgagttatcttgatgccattttgcgtgtttataatttagaaggtcgccgagataataaatataaagcacgcatcaaaattttggtagaaagcttaggcaaagatacctttatccaaaaagtcaatgatgaatggcaaactttaaaagatggtgatttgacattaagtgaggcacattttgctaaagccgaaagctattttactaccccagcttatgagcagattgatcgcttggcagtacaaacacagttagatgagtttttggctgataaggatttttacaattggtatgagcataacactgttgcccacaaaatcaatggctataaagccgttgtcatctcattaaaggctggcgttgttgatggtaactatgtgcctgcaggcgacattaccgatgcacaaatgtttgcactggcagatttggcagatgaatacagcttgggcgagattcgtgccacacatcagcaaaatttggtacttagcgatgttaaaataactgatttatacatactttggcaaaaattaagtgcacttgaccttgctcgtgccaatatcggcactttaaccgatatgatcgtctgccctggctttgattattgtgcgcttgccaatgccaccacccacaatatcgccgaatccatcgaaaaacaattcaatgacttagactatctgtatgacttaggcaacattcgcttaaatatgtcaggctgtatgaatgcatgtgcacatcatcatgtgggcgatattggtatcttaggtgttgataaaaaaggcgagcattggtatcaaattagcttgggcggcaattcaggcgagcatgccaaattggggcaaatccttgggcgtgctgtcgctgctgacgaagttgctcaaaccatcgccaccattgtaaatgtctataaaaatgagcgtatagaaagccatggacatatcgaaagcttcgctcaagtcattgaaagacttggtataacaccctttaaaacagctgtctatcactaa

SEQ ID NO: 709 - DNA, 987 bp, M.catarrhalis
atcattcggtactggagtatgactgtgacgatagcaatcaattcacaaaatcaaaaacccatcaagcgattgggcttgatttttggtgtgatcaccacttgcattttggcaggatgtgccagtaagccaacctataatagtacctcaggttcgggcagtcatcgtacttcaggttcaggtggtttggcaataggttcacaggttatcacggacagtcagggcgtaccaaatcgctatcaggtgaagcagggcgatactgtcagtaagattgctcagcgttatggattaaattggcgtgagattggacacattaataatctaaatagcagttatacgatttatacaggtcaatggctgactttatggtcaggtgatctcaaggtgcgtgagcgtagtatcagctctggtgtgaatacagctcacacaccttcgcctgtggcggttcagtcaagcagaccaccagtacagcagcatcctgccgtacaaaaacccacgccacctgttgttgtggtaaaaaaacccacaccgactccgcctgtggttcagcagccagcaccagttgccccaccagtgacagaagcaccatttgccacgggtagctcaggggtgatgcaatttcgctatcctgttggtgcgaccaatccagtggttcgacgctttggtacggcgacagtggccggctcaactgttaccagtaatggcatgtggttttctggacgagatggcgatttaattaacgccagtaatgcaggcacagtcattcaagctgatcacaatatggacggggcgagtattgtgattcagcataccaatggatttgtttcaagctatatccatattaaggacgctcaagttaaaacaggcgatacggtgcgtaccggtcagcgtattgcaagcatgaaaaatcagccaagcggtgcggcactatttgaatttagaatttctagaaatggcgtgtatgttgatccattgacagtacttaaatag

SEQ ID NO: 710 - DNA, 201 bp, M.catarrhalis
gtgcctatccaacactttgccgaatttatgaatatgccaacactcagcctgcctttattgctgctatgccaaaaaatcaagaagatgctgttgaatgattggttaattaaaaatccaattaaaaaagccagtaaaacactggcttttgatggcttaactgttggcatgtcttttattgtattgaatcgaattaaatactga

SEQ ID NO: 711 - DNA, 1437 bp, M.catarrhalis
agagttacgcataaagcttcagcaacacgactggtaaaacctatgatgcccacgccatctcatctgaccaccatctctatcatcggacacactaatgtcggcaaaacatcgctactaagaaccttattacgagacagcgattttggtgaagtaaaaaacgcctcagcgactacacggcatgtcgtcgctgttgatatactaagcaaagacaatgtaccactaattactttacatgacacaccaggattagaggacgccacaggtgtgatggattttttgcagaatcataccgatggccgtgcagatggtatggaacgcttatctgtgtttttacaagcaattcatcataatgatgcacgattagagggtgattttagccaagaagccaaggtcatcaaaagcttacttgaggcagatattgcactttatatcattgatgccaaagaacccgtacttggtaaatataaagatgagcttgccatcttggctggttcggggacgccaattttgccagtctttaacttcatcaatgaccccaatcatcatatgcaggcttggcgagaaatgctgtcacggcgtgcgttacatgtggtcaatgcctttgatacggttgcttttgactttgaaaatgaaatggcgttatggtcaaatcttagcctactgtccaaccacgatcaaaatatcgaaaagctcaagcaagaacgcagtgatacatggcatgagctgctggaaattggctctgagatgatcgctgattttttaatcaatgtcgccgcttatcgccaaaaaattgcaagcggtgctgatacgacaccgacattaagacagatgcaaaatgcagtgcgtcaagctgaatctgtcttgcatgataacttattaaatttgtatcagttttatcatcaaaatatcgtctctgattgcccagatatcaaaagccaaacccaagatgtgtttgatggcgagctattggctcagtatggcatacgcacagcaggcggtagcgtcacgggaatgattatcggtgcaggcattgatgtggcgactttgggtgcaagccttgggcttggcacagccatcggcggtgtgattggtggactgctgcccaattccaccacactcaaagataaagccatgggcgtacaaacactcatgattaatgcaccgacgatgactttacttgccgctcgtgcccaaaatctgcaccaccacctaagacatcgtgggcatgccagtctcttagatattaccgccagcgataaaaacctgccttggcagagcgataaattaccaagcccaatcaaaaaagcacgcagccatcccaattactcaagcttaactgacaatgatgacgataagacagctcttagatcagacttggcacaacatttggcagaaattttagtgatgcacttacaaagactggacataaatcactaa

SEQ ID NO: 712 - DNA, 1095 bp, M.catarrhalis
tataatataaaggcagttatgcgacattttttatttgatatcatttttacttttgtctgcttggtgattgcagcatggtgggggtatagccatggtggcatctctgagatgtttttggcactgggcattacagcaattttggcaatcatggagatttcattatcatttgataatgccgtggtgaatgcctctattttaaagggttggaatgatttttggaaaaagatttttttgaccgtaggtattttgatcgcagtttttgggatgcgattgatatttccaatcgccattgtcgcagtaactgccaatttgggtatgggtgaggtgattcatctggcactgaataatccagtccagtatgccgagcatcttaatgcacatcatgccgaaatctcagcatttggaggaatgtttttattgctggtgttcttaaattttatgtttggcgataaggatgtgcattggtttaagtggctagagtctcgcttggtcaagtttagtaaagtagacgccatgagtgtgtttgttgcgttggttgttttgatgatctctatgagctgggtagaagaagcaaagcaaggtgtcgtcatggtcgcaggcatttgggggattttggtctatttgggggtgagtgtactatcggcactcctagagggtgatggtgacgataaggcggcggtatatgacgcaaaaggccgtgagatcacaaataccgctggcgtatcatccacaatcctaaagggtggtattgcaggctttttatatcttgaggtgcttgatgcgtcttttagttttgatggtgtcattggtgcttttgccatcacgaatgatgtgatcgtcattatgattggcttggctatcggtgcgatgtttgttcgttctatgacgatttatttggtaaacaaagggactttaagcgattttatttatttggaacatggtgcacattatgccatcggggcgcttgccatcattatgttgctatcgacacggtttcatgtgcctgagattatcactggattgattggcgttgcatttattgtgttgtcagtatttaattcgattcaatacaataaaagacatgccaacagttaa

SEQ ID NO: 713 - DNA, 660 bp, M.catarrhalis
tcactgataaaaggatttttaatttggcaactttacacacttattttcgcagctcggccgcttatcgtgtccgaattttttggcattaaaggtttgtcgtaccaaaaaaatttcatcaatctaaagcaatcacagcaaacaaccaaagcatatcaccaaaccaacccccaaggtcttgtacctgcatgggaggatgattctggtagctatggtcagtcatttgccatcatgctacttcttgaggataagcaccccacacccgccctactgcccagcgaccctgccaaaaaagccgagattttaagtgtggtgcagcacatcgcttgcgatatccatccactcaataatttaagagtattaaattatctaaaaaataagctacacttggatgcaactggtattgatgattggtacgcacattggatacagttgggctttgatgccttagagacaacattaagccaaacagcgggccgatattgctttggtgatacaccaacctttgctgattgttttttaattcctcaaatgtacaacgccattcgctttaatgtggatctgagtgcctatccaacactttgccgaatttatgaatatgccaacactcagcctgcctttattgctgctatgccaaaaaatcaagaagatgctgttgaatga

SEQ ID NO: 714 - DNA, 1665 bp, M.catarrhalis
aaaaacaagaaaagtatacaaaattcagctaattcaggtaaaatgcaaagaaagatatctcctatttttacgccattttggcattattatttgataccattaaaattggatgacatgattatgagcaggataactcaatcttacacaaaaccaagtgcatggcaagcattttatcacgcatattttaataaacattcagttgcactgttatttttaggattttcagcaggcatacccattttattaattttctcaagtttggggctttggcttcgtgaagcaggcattgaccgtgcgacagtgacgatgtttagctgggcagcactgggctattcatttaaattcatttgggcaccgctggtagatgcactggcgctgccgatattaactcggctgcttggcagacgtcgcagctggttgctattcacccaaattttggtaattactgctttggttttgatggcgatgaccaaccctcaaagtggtgaggcgatgttaagcatcatggcggcaggtgcagttttgcttggattttcttcagcttcccaagatatcgtgattgatgcgtatcgtattgagagtgcacctgctgatatgcagcctgctttatcggcaacctatgttatgggttatcgcattgggatgattgtatcgggtgcaggtgcgttgtatttggcagatttttttggttcaatgatggaggcttactcttatctggcatggcaaaaaacctatttgattatggcagctgtcatgggtattggtattttgaccacgctggtgatttcagaaccaaaaacggtggttaagcccatcacccaaacctcaaaaaacgacctgagacttgttgttgtctttatattgtctgtattggcattcatcttggtatttcgtggcatgggtagtatcctacctgagactgatgatgttttactgcaatttgtctatggaacagtgagatttatgcttagtatcatcgcttttggtttggtaagttttggattggtccaagccaaaatcgcccccaaagagatggttataaaaacttgggttgatcctatggtggatttttttcatcgttatggtcaaaaggcagtgcttttattggtattgattggcttgtatcgcatcagtgatattattgctggtaatatctcaaacattttttatcaagatttgggctttagtaaaacccaaattgccgatgctgtcaaagttgtgggtgtggttgcttcgattgctggcggatttgttggtggctggcttgcccaaaagataaatatcatcaaagcgatgagtcttggtgcgattttggcttgcacaaccaatctgttatttatttttttattttatacgccaactgtgccgatgatgtactttgctgtcattacagataatttggcagcaggtttggccagtaccgtattcattgcgtttttatcagcattaacctccattcggtttactgcggtgcaatatgcattattttcatcattaatgactttgttgcccaaattaattggtggctattcaggtagtatcgttgatgcaacaaactacgcatttttctttggatttacctttgtgatcggtattcctgtgttattattgatttatttggttaataagcatattgatatcaaccaaccacaaattgatgaatga

SEQ ID NO: 715 - DNA, 297 bp, M.catarrhalis
aacaaggttgaacaagcgttaaatgaattgaatcacttacccatatcaaacacacatcatattttaagaaccatgtattatatgatgcgacatcaattattttgggacggtaataaacgcatagcaatgatttgtgccaattacgaacttatcatggcaggttgtggcatgttaaatatcaatgaaaatcaacttgaaacatggcatacattattatcagcattttatgaaagcaatgatgataacaagattgtggcgtggacttatgagaattgtttatatggcatgacagtctaa

SEQ ID NO: 716 - DNA, 489 bp, M.catarrhalis
tggcaagcttgcccaaccttgatattagcaatcaaaagctacaaaaactgtttaatacaggcttggttgctcggcatgtcaaccgcattgcaggcttacccaagccaccaaattgtttataattacttaatattaggatttactatgagtggattttgcaccctaaatatcgcctctactgatttgaccatgacagtattgatgacacccgatatggcgaacttttcaggtaatgtgcatggcggtactatcttaaagctgcttgaccaagtcgcctatgcgtgtgccagtcgttatgctggtggctatgtagtgacactatcggttgaccaagtgatttttaaagagccgatttatgttggtgagctggtaacttttttggcgcgtattaaccatgtcggcaccacttcgatggaagtgggcatacgccgtagaagcagaaaatatccaaactcgcacagcacgtcataccaacagttgttattttaa

SEQ ID NO: 717 - DNA, 231 bp, M.catarrhalis
aagatgccatggacagattggatcgtttttttgccaaaaagcgtcgagaatttggaacaaattaacccatcagtcatgataaaaacgccttggcttttacatggggcgttttttatgattggtcatggcgataatatccccaaaatcactacccatattccatttttgaatttaaatttttggtatcaaacacttaacataatgcaaaacaaatcagctaagccaaaatag

SEQ ID NO: 718 - DNA, 972 bp, M.catarrhalis
aataacttgctcttttggaaagctgttatgaattttaataatcgtgaataccgtgataaatgccgtgctttaacattaaagctgatgagtgataataaagttcgtaaacgccaagagatttatcaaggtgtcattcaattgggggaattttctgatgaaattttaactttgcgttttaacagtggtcagccaaaagtagaaaatgccatcgcttggtcaatcagttctcgaaccaaagcaggcatcttaaatcgcatcagtaaagccacctatcaaatcacacccattggtttaaaaatggcgacactgtggcaaaataaaacacacattagcgaaaaactgtatgatgaagctgatttacctgattggaaaagttatttaaaaagcagagcagaaattaaacgcaagaaaaaactgtcagataagaccagcattgaaactgatgataatgatgacatggattttgaaacccaagccaaaaatgccattaaaaatcttgaaacagaaatttcagttgaactgttaaataaattacaaaaaggcacgcctttattttttgaaaaatcggtattaaagttattgcttgccatgggatatggcggtaaagaaaacttgtttgaacatactggcaaatcacacgatggtggcattgatggggtcatcaaacaagacccattaggcattcaaaatatctacattcaagccaaaagatatgccagtgataacatgattggttcaaaagaattacaatccttttcaggggcattacagggcaatggcgtggaacggggtgtgtttatcaccacatcatcattcaccaaatccgcccaaggattttctcaaaaattattgggcagaattgtcctgattggtggacaagagctggttggtttaatgattaaatataaagtgggcattcaagtcaaagaagtgcttgaaatttgtgaaattgatgaagatttttttgaatga

SEQ ID NO: 719 - DNA, 1848 bp, M.catarrhalis
aagcttgctcggtgcctttttgtcttaggacataatatgacaaatcatccaagcgattttgccaatctgcctcactcatcgtatttatcactgctttgtcaagcggattcatcactcactccttcaaatttcatcagtatgcaagatttacttgcatatcaaaatcttaattcatcaatcaaatttgtaaagtataacttgcaattgatgattttatggcataaaatcatcaattgcaatacaggatatattaccatgaatgacccacaaaataccatcacaaaacaaggtttgcgactaaaattacggcgaaaagctttggggctatcagctgaagccttggcatctaagatgagtgagcttggcgtgcctgtcagtcgtggtgcgatcgccaattgggaatgcggtaaaaatggcattgtcatgagtaaattacccatattagcggcagctttaggtgtcagtgaaagttatcttataagtggtgatcatttgaccttacagacaaccaaacgaaaaaccgttaatgaaatttggccaaaatcaaccctcatcaaatcatctgttaatcaaacgcccattattttatcatcggaatacgccatcatgccccaaaccaagcccttaaaaaaatccaataaacttgccaatgtttgctacgatattcgtggtgagttactacaaaccgccaaccgtatggaagctgaaggccagcggattattaagctcaacatcggtaatcctgccccttttgggctattagctcctgaagaaattgttcgtgatgtggcgcttaatttgcctgaagcatctggatattctgattctcaaggaattttttccgccagaaaagcgatattgcaatattatcaaggcaaggggctgttatctgcgatagatgtcaatgatgtttatatcggtaatggtgtcagtgaattgattgtcatgaccatgcaagcgctacttgatgacgatgatgagattttaattccgatgcctgattatcctttgtggacggcagcggcaaatttagcaggcggtaaagcggtacattatcgctgtcttgaagatgatcattggcaaccagacttaaaagacattgaaagcaaaatcacatcacgcaccaagggtattgttatcattaaccccaataatccaacaggtgcggtctatactgatgaaatcctaaaaagcattgctgcacttgccaaaaaatatgatttggtgattatggcagatgaaatttatgaccgcattttatatgatggcgtcacgcatacccccatgtgtacaatcacaaatgattgtttggttctaacctataatgggctatccaagtcgcatcgcattgcaggctatcgcgcaggctggcttatggtttcgggcaaaaaacaccatgccaccgattttattgaagggctgaccatgctggcaagtatgcgtctgtgtgccaatgttcccgcccaatacaccatccaaacagccatgggcggctatcaatcaatgcaagctttgactgcaccgacaggacgcttatataagcagcgtaatttagcggttgagcgtctgaatgccatcaaaggcatcagctgcaccatgccccaaggtgcattttattgctttgctaagattgaccgtgatatctaccctatcgataatgatatgaaatttatgatggatctactcattgaagagaaagtattgataatccaaggtacaggatttaactgggatcagcccgatcatttccgagtcgtatttttaccaaatcttattgatttagaagatgccatggacagattggatcgtttttttgccaaaaagcgtcgagaatttggaacaaattaa

SEQ ID NO: 720 - DNA, 1050 bp, M.catarrhalis
gttgatattttattattcacaattaaggattatccaatgcaaggtaaatttatcatcaaaactttaaccgctgctgtcatcagctgcacaagccttgtgtcacaagcatcaatcagcggaaatagtcatgacggtattgtcgctgttgtcaatgatgaaattattttaaaaagtgagctcaatcaagccactgagctggtcgcaactgaaatccaaaaaaacggcggcaatgtcactcaagatcaagcacaaacgctggctttagatgagctaatcaatgaaaaacttcagcttgccatcattaatcgtgctggtgtcattccaaatgatgaggtgattgatcagcagttattacaaattgcccaatcccaaggcgtgaatagtttatcagagtttcaatccaaacttgatgccgagcgtgcaggcagttatgttgcgttgcgtgcaaacttaattcaagatgccgccatacaagcattatggcaaaatcagattcaaagccgtgtacgtattaccgacgatcagattgatgcttttttaagcagtcctgaatcagcacgcttaaatcaagttcagtaccgccttttacatattcgtgtgccttatcttgataatactgccagcgagcaaaaccgccagcaggccgccttagttgctgagcgtgttaaatcttctttagatgctggcatgaatttggatcaagccatgcaaaatgctcgtggtgattatacgcccgatcttcaaggtgctgatactgggctgattaatgccaccgctctaccgccagccattgctgccaaagtagataagctaactattggacaaacatcaacgccgatcgttaccgtaaatggtattgatatcgtcaaagtggttaataagcaacaacaaaatcaagtcatcgtacctaaatggcaaaccagccatattttggctcgtattgatagcaatcaaagcagtgatatcgctgaacaaaaaatcaatgccatttatcaacaattacaacaaggtgccgattttgggacctttggcggcaacttattcagatga

SEQ ID NO: 721 - DNA, 201 bp, M.catarrhalis
aatacaaacaggttgatgatgagtcaaagtgattttaatgaaatattgctacctaaacctgaatatcctgaagcatgggaatgctgcggcagcgagtgcggagattactgtgtttatgagatttatcggcgtgataagatagactatgatgcacaacaaaaacgccttaaggaatttttggacaaaaaaacagctgaatga

SEQ ID NO: 722 - DNA, 603 bp, M.catarrhalis
gaattgtttatatggcatgacagtctaaaacatcattcattaaaaataccattaatccgatttatatttttaatttcaatggaaaaaacatcaatgacaatgattttaagcattttaatcctattttttatcatcagactgttatttttagccgtctccattaaacatgaaaaagccttgattgccaaaggggcaatacaatacggaaaaaccaattctacggtgcttgcggtggttcatacgctttattatttggcatgctttatctcggtatggctttctgacactgcttttaatggcatatccttggttggcacgctgatggtaggcgcttcatttgtgatattggcgttgattatcaagcagttgggggagatttggacggttaaaatctatattttgccagaacatcaaattaatcgttcgtggttatttaaaacatttcgccaccccaattattttttaaacatcatacctgaactgattggcatcgccttattgtgtcaagcgtggtatgttttattgattggcttgcccatttatttgctggtcttatttaagcgtatccgtcaagaagaacaagcgatggcaacacttttttaa

SEQ ID NO: 723 - DNA, 381 bp, M.catarrhalis
tttatgattttactacttgttacttcatcaccacacagccatgcaggcaaacttgcagttgaatacgcaaccaagcaattacacttgggtaatcagatttcggtatttttttatggcgatggggcttataccgccaatcgactgatgtggcaaactgccgatgtaccaagcgttgctaagcaatggcaagcattatcaaataatcatggcatcaccctgcccgtctgcgttagtaccgctttggctcgaggtgtctgtgatgcccaaaatgccactcgccatgggctaatcggtgataatctgttgccaccgttttctttggttggactgtctgagcttgctatgatgattgatgatacaacatcagtggtacagttttaa

SEQ ID NO: 724 - DNA, 501 bp, M.catarrhalis
atcataaacattgaaaggaaaattatgcaacgctatccaatgacgccagaagggcacaaagcgcttgaagatgagctaaaacagctaaaaaccgttgagcgtccacgcattaccaccgcaatcgccgaagctcgtgaacacggtgatttaaaagaaaatgccgaataccacgccgcccgtgagcaacaagggttttgtgaagctcgcattcgtgacatcgaagccaaacttagcggggctcaaatcatcgaccctgctaaactgcccaaagagggacgagtggtatttggggtgactgttgtgcttgaaaacatggatgatggtgctaagcgtcgctataaaattgtcggtgatgatgaggcagactttaaagtcggtaaaatctcggtcaattcaccgattgcgcgtggtcttatcggtaaatctgaaggtgatgaagccaaaatccaaacgcccagtggactggctgagtttgagattttggaagtgatttatgcataa

SEQ ID NO: 725 - DNA, 2823 bp, M.catarrhalis
ggcggctgcatggtttctttgcattttatgcccaatcaagctcagcttgactgcctatcactggcaagcccatttgcatctcaaatttatcaaaaacacagcgatgacgcccaagcatttttgggagaatatggttttgagcgaagcttgtcaagcttagattttgatgcattggttcgtcgttttgttgggcttggtaagaccaattatcttgattttaccaatgaagagatggtcatgtcaggactgcgtaagctacgccaaatgctgatgcttaagtggatttggcaagatgccttgtcggtgatttctttggaagagttgacgcatgagttgtctgattttgccgacagctgtatccagttttcaaaggattttgtgtatcacaagctgaccaaacgctatggcgagcctatgattcgccaaaaaaataaaacactcaaagatgaacttgccatcatcgctatggggaaattgggcgcacaagagttgaatttatccagtgatatcgatctaatttttgtgcatatcaataatggtgaaacgaacggcaaaaaagtcattgataattataaattcatgcgtgatcttgggcgtggcataattaagcttttggatgaaaataccgaacatggttttgtctttcgagtggatatgcgtctgcgtccttggggggatggctcaccgctggtgatgcatatggcggcattggataaatattttagccaacatgggcggacttgggagcgttttgcttggctaaaggcgcgcgtggtcaatgacattagcgatgaatttgggcaaacgcttaatcaattatcaagaaattttgtgcatcgctattatattgattatagtgcatttagtgcattgcgtgaaatgaaagccatgatcatcaatcagcaaatccaaagacaggatttggataatgtcaagcttggcgtaggcggtattcgtgatattgaatttattgttcaagcgtttgccctgatttatggcggtcaccatattcgtattgctgaaaatcctgcatgtcttgactgtttgacggtattaaccgagcttaattatattgataacgatgaaagtaaacaactggcagcggcgtaccgatttttacgccgtttagaacacgctatccaagcacgctacgaccaacaaacccagtgcctgccaagtgattctgatgagatgcttgccatcgcacagaccttaggctatgagtcggttaaggcatttcgctcggtgctggatgcacatcgtcataatgtcagcagaccgtttggacgcatggtaacagataggcaatcccccaagcaagaaagcttggatattgctcagattcggtcgtcattggatgatgtgctgggggataattcagtagtcgtgctcgatgagtttatgagttctcggttggtgacggggcttgatgatgtcgcaaaagataggcttaatcaggcctatcccattatcttacatgctttattgacacacgcccaaaaaggcggtgcggagttggcaaaaatcgccttgcccagattgattgcgttactagaggcgatttgccgtaggtcaatttatttggtgatgttgagcgaaaatccagatgcaacggtgcgtttaatcccaacactatcggcaagcttatggatcgcccgagagcttgcacatcatcccgtactgcttgatacattccttcaaaagcgttatctacatctgcctgataaagctgagcttaccgacattctaagacaaagcttacttagagtagaaccttttgatgatgaaggctatttgaccaccatacgattattcaaaaaaactcaagttttggcagtagccaccgccgatgtattaggtttgcggcacaccatgaaagtatctgacagtttgacttatatcgctgaagtggtacttgagtcggcattgtatcgagtatttcatgagttgtctgtcaagcacggttttcctttattaaatactcatgagcgtgcaagcatcgctgattgtggctttgcgatcattggttatggaaaattaggcggtcttgagatgggttatgcatcggatttggatttggtgtttttgcatcgcattgacgaaaaaagcgaaactgatggcgaaaagccaatcagtggcatgaaatttgcttctcgcttgatccaaaaactcatgaactatctggcaacccaaacccgtgatgggcgtgcttatgagattgatacacgcttacggccctcaggcaatgctggcgtgccagtgatttctgcccatgcttttaagatgtatcaaacagacaaagcttgggcttgggagcatcaagctttggttcgggcaagagggttgacgggcgatgtgttggtactacaagcatttgaccgtattcgcaagcaggtcttaaccacgcccagacaagagacacaggtacgacaaaatgtcattgaaatgcgtcaaaaaatgcaacatcatttgggtacaaaaacgatgcggcgtgcgtatggcgagactgagcagtttaatctaaaacaagattttggtggcctgatagatattgagtttttggctcaatttatggtgcttgcctatgcaaataagtacccaaatttggcaatttggccagataatgtacgcatttttgaggaagttgaaaaaacgggtatttggaccgccaatcgctgtcaaaagctgacacaagcttatttggacttgcgtaaaaaaacccacgaacttgccttgtctgaacaaaaaaatatcgtcgatgatcaagcgtggcatgagctacgccaatttgtgcgagaggtttgggaagatgtcttaggctga

SEQ ID NO: 726 - DNA, 936 bp, M.catarrhalis
tttatgagcatggcaacccaagaaggcaaaatgtggctagatggtgccttggtagagcagccagatgctaaggtgcatgtgctgactcacagcttacattatggcttggcggtgtttgaaggggtgcgtgcgtatcagacgccagatgggcgtacagcgattttccgtttacaagcgcatacagagcgtctattaaactccgccaaaatttttcaattaaattgtacttatggctttgatgagcttgtccaagctcaaaaagatgttgtgcgtctaaataatttggcatcagcatacattcgtccattgatttgggtgggttctgaaaagcttggtatcgctgccaaagataataccattcatgctgcgattgctgcatggcattggggcgcttatttgggcgaagaaggtattaaaaaaggcatccgtgttaaaacctcaagctatacccatcatcacccaaatataaccatgtgcaaggcaaaagctgccagtaattatcctgtctcaatcctagccaaccaagaggtgactcgtaatggctacgatgaagccatcttaatggatccacaaggttttgtctgtcaaggttctggtgagaacctatttttggtcaaaaatggcgagctacatacccctgacttatcaggcggtgcgctcgatggcattacacgccgcacgattattgagtttgccaaagatttgggcattaaggtcatcgagcgtcgtattactcgtgatgagttttatttggcagatgaggtgtttatgactggtacagcagctgaagtgacaccgattcgtgaatatgatgatcgtatgataggcaatggcggtcgtggtgaattgaccgaacaactacaaactttgtattttgatgttgttcaaggtcgcagcgataagtatcagcattggttaagctatatcgatgaatga

SEQ ID NO: 727 - DNA, 492 bp, M.catarrhalis
atggtattgatatcgtcaaagtggttaataagcaacaacaaaatcaagtcatcgtacctaaatggcaaaccagccatattttggctcgtattgatagcaatcaaagcagtgatatcgctgaacaaaaaatcaatgccatttatcaacaattacaacaaggtgccgattttgggacctttggcggcaacttattcagatgacacaggttcagcttcacaacatggcagtttaggctgggttaatgaaggcgatatggtgccagaatttgaaaccatgatgaaaaatacagcaaaaggtgatttttcaacaccatttcgctctcaatttggttggcatatcctaaaagtcaacgatattaaacaacatgatattaccgagcaatatcgacgcaacgctgcacacgaatatctattcttgcgcagcgcaccacaggctcaagaagattggttgcaagaattacgctcaagtgcttatattaaaatttatgaataa

SEQ ID NO: 728 - DNA, 378 bp, M.catarrhalis
tcattagagatttttatgaaacatttacacatgcttttggcgattattgtgctgtttatttttatattacaagcattaccaatgtttatgggcaaaacaccaaaagcatccaataccctcaaaatcttaaatcatgtattttatacagcggttattttgactggattgggattattttggcagatttatcaggttgcaggtactcagcattgggcacttgccaagttggttttactgattgttgctgcgtccgccaccattaaggcacagcgtcattataccaataccccatcccaagccaaagcaggactgatgattgcttcggtggcttatgtgggtattattgtattggcgattactaagccaacgctattttga

SEQ ID NO: 729 - DNA, 798 bp, M.catarrhalis
aaactgtggataaactgcggatcaataaggtgtgttatggacagtcatacagttgatggtcatcttactgatgatgaaatgatgcgatatgctcgtcaaatcttgctagatgattgggatgtcacatcacaaattcgcctaaaaaatagccatgcgattattgtgggtatgggcggcttaggctgtcctatcgcacaaatcttggtgcgagcagggattggctcaatagatatcattgatcatgatgttgttgatgtcagtaatttgcagcgacagattttatacactgcgttggatgtcggtaaatctaaagcgatggcagccaaagatgcactacaaaagcaaaacgaatgggtgagtatcaccgccatcactgataaaatcacccaaaccaatactgatcaattcatcaaacataccgatcttgtgattgattgtacggataattttttgattcgtgatatattaaatcgcacttgtcatcagcacaagcttgcactgttatcaacatctgccatcgctcagacaggtcagattgcgctttatacgactgatacggcgtgttatcagtgcgtctttggtgatgcgttaggcgatgagatgaactgtagtacctctggtgtgttggcaagtaccgtatctgtgattggtgctttggcatcacaggttgcacttagttttttgggcaagcatatcaatccgattgccaatgaattgctgatttggcaaggtgagcaatttcaattaaaaaaactaaacatttgccgtgatgagcattgttcggtttgtggcgcatga

SEQ ID NO: 730 - DNA, 891 bp, M.catarrhalis
gcgatgcaagtatccaatcggttagccctaacaggtctaaccattaaacaaattcgtgcaatctttaagcagcttcagtctgatgtattaccaatgcattggcttgatggttggttgatgcatgtgcttgataaaccctttatatttctgatgacggatgaagattatcagccaactttggaggaatcatcaaaaattaccgcaggtattatgcagctgtcagcaggtaagcctttggcatatctgactgggcaacaaagcttttgggggcgtcattttttggtgaatgcccatacgctgatacccagagctgatactgaaattttggttgagacaatcttaaattatgccaaagctcaacaaaaaatccgccaaacagacaacaaaaatttggttaatattttggatttgggtacgggtacaggttgcattggtattacgctggcactggagttggaatttgctcaggtggttttggtggatatctcttctgaagcacttaaagttgctgagcaaaataaccatcgcctgaatgcacggtgtcaacttttgcaatcacattggttgcagaaagtcagtggtcaatttgatattatcgtcagtaaccccccttacatcaaagaaaatgacgagcatttggtaaatcttaagcatgagccaatcacggcacttgtggcagctgaagatggtttgacagatattcgccatattattgaaacaggtagggcgtatctcaaagatggcggattgatggcaattgagcatggttttgaccaagcggaggcagtgcgtaacttgtatttgtcatctggttatcttgatgtatatacgatccaagattatgggggtaatgacagagtaacgcttgggagatataaaaactgtggataa

SEQ ID NO: 731 - DNA, 1368 bp, M.catarrhalis
aataataaagtgagcattatgaatactttgccattattttttaacctaaataacaaaaccgtgctgattgtcggtgggggcgatatcgcctaccgaaaagcacaattaatggcaaaggctaaagcaaagcttgtggtgattgcgaaacattttgaggctgaatttttggattttttacagtctcatcatcatgtattttttcaaaaatcctttgaaccaatcgatcttaatcagcatacacccactttagtgatcggtgcaaccgatgaccatgaagtaaatttggtcattcatcgtgcatcaaaagcgtatggtgtgccggttaatattgtcgatacgccagatttgtgtgattatatttttcctgctattgtagatagaaacccaatcgtgattggtgtatccagtaatggcaaagcgcctgtacttgcacgcttgattagagccaaaattgaatcatcattgcccagtcgcttaggagagcttgcagacaaagcaggtaaatttcgagataccatcaaaaactctctacccaccatcactgaacgccgatatttttgggagtcaatttttgatcgtgccttaaaagatgaaacaattggcacactcagcgatgagcttaatcaatttaaaaatcatgatacccgcttgggtgaggtctatattgtgggtgcaggggcaggcgatccagatttattgacttttaaggcactcaggctcatgcaacaagcagatatcgtactttatgacgcactggtatcaaatgacattttagagctttgtcgccgtgatagccaaaagatttttgtgggcaaaaaaagaaaagatcacaccaaaactcaagatgaaatcaaccaactattagttgattatgccaaacaggggcatcgggtattacgcctaaaaggtggtgatccatttgtctttgggcgaggcggtgaagagatgctcgcctgccaagctgcccatataccctatcaggtggtcagtgggattacagctgcgttggcggcaagcagttatgcaggcataccactcacacaccgtggtatcgcaacttctgtacgatttttgacgggttgttatcaaacaaatgagccgtttaatggtctaaatagtacttaccaaactgatgagactttggtgttttatatgggtctgcacgcactgactaaaattattgattctttaatcagtgctggcctgccaaatgatttacccatcgccatcatctcaaatgccagcctacccacccagcaggtgctaacaggtacactgacagatattattgataaaaagcatcaatccaatcttatcgcacctgccattattattgtcggtcatgtggtcgatttgtatcagccataa

SEQ ID NO: 732 - DNA, 348 bp, M.catarrhalis
acaaaatcggtttttggcgaaaaaaacatcgttgaagtcattcacagcatgtcacgcttggaaaatatcaataccacttttccccagagcaaaaccatgattgatggcatgagtgtgagtggcatttcaacccatgacatgcaagtgctgttaaatctaaaaaatgcgtggcaatttattttatcatcggacagtcaatttgacttggcatttgcgtgcaaagtcaatggttttgtggcatacaatgaaagtttggcgtggggcgagctaagaactggcaatgtttgcattagtggcgtgagttttgtgccagacattctgcttaaaacaaggttgaacaagcgttaa

SEQ ID NO: 733 - DNA, 1251 bp, M.catarrhalis
aaaattcgggtgaaattcatgacagctcaaatagcaaaaaaagccattttagccctcgctgacggtacaatttttcacggcatcagcattggtgcaatgggcagtagcgttggcgaagtggtatttaacaccgccatgacaggctatcaagaaatcctaaccgacccaagttacgccaaacagctggttaccttaacctacccacatattggcaacacaggcaccaacagcgaagatggcgagtctggcagtgaacatcgcatttgggcatcagggctgattatccgtgatgccaccatcatcagttcaagttttcgcaacgatgaatcactcaccgactttttacaacgccatgacaccgttgccattgccgaaattgacacccgaaagctgacccgaattttgcgtgataaaggggctcagcacggttgtatttatgccatagacagcgacacggacatcacagctgacgatgaaaacaaagcggtgcaacttgccaaagagtttgcaggcttgacggggcttgatttggcaaaagaatgctgccacccacaaggatttgaatggacacaaggcacttgggaacttgctgacaaccctgccaccaccgccaaatatggcaaaacagacagcccaacaggcgggtattttaaacagcttggcaaacacattagtaaaaaatttcatgtggttgcctatgattttggcacaaaaaccaacattctacgcatgctggtggataggggttgtcatgtgacggttgtccctgcccaaacaccaattagcgaggttttggcaaaaaaccctgatggtatttttctctccaacggccctgctgaccctgccgcctgcacctatgccattgacaatatcaagcacatcattgagcaaacggagattccaacttttggtatctgcttggggcatcaattattgggcctggccagtggggcaaaaaccatcaaaatgaaatcggggcatcatggggcaaaccaccctgtgcaaaatttggcagatggtacggtgatgatcacatcacaaaaccatggctttgccattgatgaagcgaccttacctgccaatgttaaagccacgcatcgctcactgtttgatggcacaaatcaaggcattgagttgaccgataaacctgcatttggctttcaaggacacccagaagccagccccggtccacatgattgttcggtgttgtttgatagattcattatggaaatgcaaaaggcgaaagtgtga

SEQ ID NO: 734 - DNA, 1353 bp, M.catarrhalis
ccatttcaattatttcataaaaaaacgatgattatgccaacatttttaccaaaaaatccagtatctaccgccaaaaaagcactgaaccaaagtgtgcatgttttaggtcgtattcaaaaaactgccagtgttgcaggcttgtcagcacttagaatggctaagggtgataaaatggatgcgtaccttttgcgtgaagcgtttgagcagatgggcgtaacttatatcaaacttgggcagtttatcgcaagcacgccttctattttccctaaagcgtatgttttggcttttcaagggtgtttagaccagacagcgccagtacgatttgaacaaatccgccaagtgttgattgatgaacttgaaacgcctgagcgtggattgggtgatattttttcttatattgaccctaagcctctggcatctgccagtatcgcccaagtgcataaagcggtacttgctgatggcagacaagtggcactaaaaatccaaaaaccaggtgtagatacggtcatgcaaaccgatttgggggtgctgcatagtgtattttgggtgttagaaaaagcagtgcctagcctaaaagcggcaaatcttgcaccaattattgatgaaatgcgtgccagaatgttggcagaaactgactttttggcggagagccatcatattgataaattcttagcacatctacatcaagtgggtaatacccaagtgactgcccccaaggtacatcatagattatccaccaaaaaggtgctggtcatggacttattagtcggtaagtcattggtcgatgagtcgcttgtttgggatggtacagtaggcaaagacagtaaaaaaatcatgaatgatgttttggatacatggtttttatccttgatgatgacgggtgaatttcatgctgacttgcatgcaggcaatctgatgctacttgatgatggacgaattgcttttttagactttggcttaatggggcaaattcaaccaagtagcctgcaggcatgttttaatttggtacaaagcctacaaatgaacgattatcatggtatggcacaagcgatggtcaatattggtatgacgcacgcacctaataagatgaacattgatcatctggcaaatgacttacggcggatgcttggtaaaatcatgcctgagtccacgcctgcaccagccaataacgacagcctaaatgtcatgatgctagaaatggtcgatattggtaagcgtcatggcatccatttccctagagattttgcattattaaccaagcagcttttatattttgaccgctttatggtaactttggcaccagatatggagctgtttgaaggcaatcgcttggacttggttaaattgaattaa

SEQ ID NO: 735 - DNA, 309 bp, M.catarrhalis
tggatgaaatttttaattcatatcaataccgacagcgaattaatcagctatgaagcaattgctttggcactgactttggcaacatttgatcatgatattcagattgagctgggtgaaaatgttttagttttactaaataatcccaaaagccgaatatatggcatgatacagtctttggcactgtatgatcttcccaaagcataccataattttcaagcagttaacgccttagataaggtcattcaattatcattacaatcaggcagtttggcattggatgactatgactcaaaactttattttcagtag

SEQ ID NO: 736 - DNA, 210 bp, M.catarrhalis
agttataaggcttgcaacatgatacatccacattttgattcaacaaatccccaaaaatctgcacccatcgggatttttgattctgggggtggtggcttatcggtgtatcggcattttgtaaaacttatgcccaaagagcgatatttttattatgcagataccccaaatctggcttatggcaacaaatcaggcgatgagatcttgttttga

SEQ ID NO: 737 - DNA, 702 bp, M.catarrhalis
caagataatttagcaaaaatcaggctaatttttgataatttggcatggttttggtcaaataataggaataaaatgatgatggataaagataatattaataataaaaacaatgacttaaataattcacttatccaaaagctgacagctatccaaaccaagcaggtcggcaagatccgtaaaattccaccattacaaagctggcagccaagacgaacgacacctttggatatcgaaatccgtgataatggtgaatggtggcatgaaggtcagaaaatgactcgtcagtcacttgtggatctatttgccagtgtgctgtgggtggagtggcatgatgatcaagccattcattatcttaaaaccccaactgacaagtatcaaattcatgtggctgacgcaccattgtttatcaatcaagtcactcaagtcacggatgctgatggtgagtggataaaatttggtacaacaaatggcgatgtcattcgcttggatgaagatcatccattatattttaagcgatttggtgatgaagaacgggtatatattgatacacgctttgggttgactgcacgcttgatgaataatgccatgtatcatttgatccaaatgggcaggcttagccaaatccaagaaaatggacagaataaaaccgtgctaaaactcagtagcggtggtaaaatctatcaaattgaacagcacggttag

SEQ ID NO: 738 - DNA, 888 bp, M.catarrhalis
cacatcaataagaacatggctttaaagattttttctccagcaaaaattaatttatttttgcatatcattggcaagcgttccgatggctaccacgatctacaaagcgtctttcgtacgctggattttggtgattggttaagctttggtctcacggatacaaaaaaacctttaatcacgctgacaggtgctgagggcttaaccaaagagcttaaccaaaatctcattgtcaaagctgtaaccttacttgccaaacactttccaaatcacgccaagccgttgataattgatttgcaaaaacatatcccaacaggtgcaggcttaggcggcggctccagcaactgtgcgacgacactcatcgcactcaatcagctgtgggcgcttgatttatcgcttcaagctttgattgattttggtcagcagcttggtgcagatgtgccattttttatttttagtcactttcaccaacaagatgcgattgtctgtggcatcggtgagattttaacaccacttaagctgccctcagcgcgttatttactcttatttcctcaggcacatctgtccacagctcagttttttgcacaccctgacttacaaaaaaactgcttgcccataccaaatattggcagtcgctatgatgactatggcaatactatgaccgatgcgtttttcaatgtctttgagccgattgccgtcatgcactcgcccgccgttgccttggcacttcaatatctaaaatcacgacaagtattcactggtacgaccgcacgcttaccaggtactggcagtacggtatttttacccattcctgacaacatagatgacgcaatgctcaaacactggcaagctgctgcaccatgccccacaatcatgacacaaaatttatattaa

SEQ ID NO: 739 - DNA, 2019 bp, M.catarrhalis
gttatgaattggctttggcgtaaacggcggtatcactcacacgatgtctcaaaattggcacatcaaggtacacctgcacccaaaaattctgacaaaaccttgaaaatatccaagtccatcctgaccgcttcaatactcgcaggcttgatggtagccaccactctaccgacgcacgccaatatctttgatcctttgttacgcattttattgccattttataaaaaatcaccaaaagctgagggagaagctaaagaacctttagtagaacccaaagagcctttaaaagatgatattattcagacacccgctcatacgcatacaaataaagaagcgtcctcggtggtcataccccaagctgagacaacaaagcgatatgccaacattcctgagattttgctcgaagatacactgatcgccgaaaatgttgagcctatactcaacatacctgatttatatgcactgatggatgctgaatttgctgctgatcgaggtgatatcagacgagcgttgaatatttataaagcagaatcttttaaaaaaaacgccaccaatgtgtttgagcgtgccttatctttatccattgagtatgaaacgcctgctcaatcattggcgtttgccaccgcttggcaggatcgcaatcctgaccatattcctgcttggttttatgtaacccacttagcactaaaagcgggtgaatataaccaagcggccgcaatgatatcaaccatcttacactacgatccacgctcagatttagggcaaatcttgactggtatcataccacccaaacgagaagataaacgagcgttattatacgctttacagggtcttggtgaaaacaatgcgtccatctctgtacttagagcggggatcttgatgggattggcggattatcaagcggcacgcctgcatgtcaatcaagccttaagcattgagccaaataatttggcatttattaccctaaaattagatatcttgcgtgctgccaatcagttagatgaactttggaaatatctacatcaagcacgcaaacaactacccaaagaaaaagagctttatttgtacgaagctcggcatctgattgaagtgggtgaccttagtcaagcttggcaacttttgacacaagctgtcaaaaatactcaagataaggacattatactcttggcaggactggtaggacttgacagcggtcgttataccgatgccattgagatacttaaacctttaactaagaatacagagatagcaagtcaagcgcattattatatcggtattggctatgaacgcctaggcaatccccaacaagcacgagaaaactttgaaaaagtacatcattatgaacatgtgcttgatgccaccaataaagtcgttggtttttatttggcggataataacacgaccgatgccatcaaaacactgattcgcctgcgtgatgaatttgaaaattacgccaccgacagctatatcctccaagctgagatttatttgcgtcaaaacaatcaacaaaaagccaaagatctgctgacggtcgcaaaccgtgaatatcctgatgatgaccgcttgctgtatgccagttttcaattgctcgaaaatgaacttgagccacaagataaacgccaagccatcgatcgactgcttgagattgatgaatacaatcctcgctatcgcttggcagatgccaaacttcgcctcagtcaaaacgccaatgatgatgatgcactcaataccgcctcagagattagcaatatcagctttgatgatccagagtatgacagccagcttcagttggatgccctgcttgttcttggtaatcacgcactggctgaacaaaattatgaagcagtcattgattatctgcaagcaccttatgaagtgatgcccaatcttaatgttggtattacactgcttcgagcttatcaagggcttggtaataatgaagcagtagcaaatcttttggctgacttacagtctcgttttgccaactctagtgccattgctgacgatagccaaatttattaa

SEQ ID NO: 740 - DNA, 1407 bp, M.catarrhalis
catcaaagctgttataatagtgagtttttaactggcaagatctttggctttttggtcgtttgtatgaaattagctgtcatcggagtcaatcataagactgcccccgtttcattgcgggagcggctttcgtttggctcggatatgcctcaggcaattgagcaactatcaacattggcaaatggctgtaccatcgtctcaacttgcaatcgtagcgagctttatgctggtatcgttgatgatgtggtcagtcagcacgagtctcaagatgagcaatcaggcgggctaatttctgctaagcttcaggcgattggtgaatggttggcagagtttaagggcatttcatttgatgagattgctccttatttgtatacttatgaagactcacgtgcacttaatcattggctaagagttgcagcaggtttggactcaatgattcttggtgagccacagattttaggccagattcgccaagcggttgcactgtctcgagagtatggcggtgtagacagtgattttgggtggctgacgcagcaggtttttgctgcggcacggacggtacgccgtgataccaaggttgggcagcaagcggtaacattaggttttgcaaccgctcgtcttgctacgcagatttttgatgacccaagtgagttgaccttcttattggttgcggcaggcgagatgaatcgattggttgcacataatgtcgccgctttgggtgttaaaaaaatcatcatttgcaaccgaagccctgagcgagcccaagcactgtcagatgagctatctgagatggctcagcaggcggggcgttttcttgagattgagcttgcaggtttggacagattgggcgaagttttaccacacgcagacattgtcagtagttgtagcgggagcatgcaggcactcatagataccgccatggttaaatatgcgcttaagatacgccgtcatcagccgatgttgcttgtggatttggcagtgccaagagatattgatcctttggttgggcagcttgattatatctacctatattcggtggatgatctacagcatgtcatcgcaggtaatatcgctgagcgtaagcaagcagcagttgaagcggagcttttggtcggtcagctggtagcagatatcgaagcacagatgcaaggacaggttgcccgcacgcatatccgagattatcggcaaatggctgaggcacgcactcaagttttacttgcacgggcgatgtcacagattgatcaaggtgatgatgccaaagcggtgttaagcgagttttctcatacgctcagtcaagcacttatgcacagcccttcaaggctgattcgtcaaattgccaaaacatacgatgcagataccctagatttggtgtcgcatgaactcattcatagttatcgtaagccaatttaa

SEQ ID NO: 741 - DNA, 798 bp, M.catarrhalis
ctttcgattcgcttttataggatttttaccatgtcatatatggctgtcttttcaggtagtgccaaccctaaacttgcccaaaccgttgccgataatctgcacattcctttgggtaaggcagacatcaatcgtttttctgatggcgaaatcgctgttgaaatcaaagaaaatgttcgaggtaaagatgtattcattctgcagccaacctgtgcacccaccaacgatcatttgatggaagttattttattggcagatgcactgcgtcgctcaagtgctggtcgtatcacagccgtgattccttattttggctatgctcgccaagatcgtcgccctcgttcagctcgtgtgcccatctctgccaaggtggtcgctgatatgttgtcgattgctggtattgaccgtattatgatggttgatttgcacgccgatcaaattcaaggcttttttgatgtgcctgttgataacttatacggcacgcctgtgctattgcgtgatcttaagcaacaaaactatgaaaacttaatggttgtttcaccagatgttggtggtgtggtgcgtgcgcgtgccatggcaaaattacttggtgatgctgatcttgccattattgacaagcgtcgtgctcgtgccaatgaatctcaagtgatgcatattattggtgatgtatctgggcgcgactgcgtcattggtgatgatatcgttgatcccgcaggcccactgtgtaaagccgctcaagcactcaaagaccatggggcacgccgggggggtggttatataacccaacctgttttatccggttaa

SEQ ID NO: 742 - DNA, 591 bp, M.catarrhalis
gcatctaggagacagattgtgaaaaaaattgcatttgctgctttgagtgtatccgtacttttattaagtgcttgtaccaacatacaaccaagcacccaaacgcccaccaccctgcctactgcggatacccctcttaaatttgcggtcacaggtaaaatcggcgtggttaccaccacccccgaaggtaggcaagcaggtagtgccttttatacttggacacaagaagatgatcgcttcgctattgaattgacaggtatgcttggtattggtgcaacccaaatccgttataacgggacaactgccgccttggacagtgaacgcacaggcacgataactgccgatacgcctgaagcacttttattgactgcaacaggctggcaagcaccaatctctcagctaccacactggatcttaggacgcggcgctcctgatgacagcacagccggctatgatcacttaggtcggctggtgtctgctgctaatggtgcatggcatgcccaatttgattacgacaaaacctctttgccgtcacgccttcgcatcacacataccaaccagcacagtataaccatgacagtaacacatcaataa

SEQ ID NO: 743 - DNA, 1665 bp, M.catarrhalis
ttcatgcaaatcgaacgcgactctatggaatttgatgttatcatcgtgggcggtggacctgctggtctatccgctgcaatccgcttacgccaattggcaatcgctgctggaatggatgagttcaccgtctgcgtcatcgaaaaaggctcagagtttggggcacacaccctatcaggtgccgtgatagaaacgcgcgcacttgatgagctgattcctgactggaaagagcgggacgcaccgatcacagtagaagccaaagaagaccgtgtgtatatgttgaccagcgaaaagggcagcaccgccctacccagctcaattgtaccaagcagtatgcataatgatggtaattatatcgtatcacttggcaatgtggttcgctggctggctgagcaagcagaaagcttagaggtgatgatgttcccaagctttgcagccagtgatgttttatatcatgaagatggctcagtgcgtggtgtggtgacgggtgatatgggtctaaatgcacaaggcgaaccaaaaaacagctttgagcctggctacgaactgcttgccaaatacaccatctttgctgaaggctgtcgtggacatcttggtcagcgtctgattagtcgttttcatttggataaagacaaagacccgcagcactatggcatcggactcaaagagctttgggagattgatgccgacaagcacgaacaaggcgtcatcatgcatggttcatgctggccactgtcagaaactggtactacgggtggctggtggctgtattttgccgaagacaatcaagtcagctttggtttggtggttgatttgtcttaccataatccatatgtctcaccatttgacgaacttcagcgtcttaagcttcacccaatcattcgccctattttagaaggtggtaagcgtctgtcatatggtgcacgagccctaaccaaaggcggtctaaatagcttaccaaaattaacctttgctggcggtgtgctggtgggtgatgatgcaggttttctaaaccctgccaaaatcaaaggcacccacacttcaatgaaatcaggcatgcttgccgccgaaagcatctttaatgccattcaagcaggacgcagctctgatgaagtggtcgaatatcaaactgcttttgagaattcttggctatttgaagatgctcatcaagctcgcaacttctcaccatcattacatcgcatgggtacttggatgggcggtgtgttcacttttgttgagcaaaacttatttggcggtaaaatgccattgaccattcatgacaacaccccagattactcaacacttgataaggctgaccatgcctataagcccaactatccaaagcctgatggcaaactgacttttgacaaattatcaagcgtgtttatctcaaataccaatcacgccgaagatcaaccaaatcatctgcgtctgacagatccagcagtgcctgtctcactcaatctaccgctttatgctgaaccagcgcaacgctattgcccagcaggcgtctatgaaattgtacacaaagaaggcaagacgcctaaatttgtgattaacagccaaaactgtgtccattgtaaaacctgcgatatcaaagatccatcgcaaaatattacttgggtaacacctgagggcggtggtggccctaactatccgaatatgtga

SEQ ID NO: 744 - DNA, 225 bp, M.catarrhalis
gtcagcttatcattaggaatggtaatgattgagtctacatgttgggtcaaagcatcaatgccgttacgagcagcagcagctcggcgtttgccctcaaaactaaacggtgttgtgacaactgcaaccgtcaaaatgcccatttcttttgcaatgcgagcaaccacaggggctgcacctgtacctgtaccaccgcccatacctgcggtgatgaatgccatattataa

SEQ ID NO: 745 - DNA, 486 bp, M.catarrhalis
tttatccaatcatcaaaacttatcatcatcaaaactgcccaaatcgcaaaagatacttgcataatgataagtctttggtttaatatgatcacacttcatcaccatatgggaatcataatgcaaaagatgacttacaaagctatcggcttaggcttggtgcttgctttgactggctgcagtgcctttcgggtgtataccatcgacttacctcaaggtacaccactatctgccgcccaagccaatcaaatacaagtgggcatgaatgccaaccaagtgctatatttacttggctcgcctgccttgcgtgacaccctagcaccaaaccgctgggattatatttatgaccataccgcaggcacggatggcaaacgccaaaaaaaatccgacattaaaaacgcatcgcaatacttgagcattcattttaataaccaaggcatcgtgacacgcattgacggtcgtgacagcttgcctgatactcgccattaa

SEQ ID NO: 746 - DNA, 657 bp, M.catarrhalis
aaccaaacttttcaatcaaatcatacaatcttatatttaattattggatttttcatggaaaaagtcaccattccgacaccgtgtcaacaacaacttaatcattactgcaaaaaatggaaaaatgataaaaaacttgaaaattaccgcatgcaagaacaatccctaaataaattattccatgagttgttgccattaaataacgacatatcagaaatcttgatcaaatcttcagtacttaatgatttttatagcacaaatatttttactatttatccagttgcaaaaaaaattcagtcattagatattgataagtacttaaaagaaggtgatgcagatttagttatggacataaaaaatgttaccattaatggtaaaaataaaaacttttattcatttgccacaaaatattatagccatcatgatgctatgaatcaccccatttacgatgcatatgtagataaagtactaagacactttcgccacaaagacaaattttactcttttaaaaatgaagatttaaaagattactgtcaatttaagctaacactgatagaatttcaacattattataagataaattgtaccctaaaggatttggatagatacttatggttattgggcaaagcgttttttaataaatacaagtcaattccatga

SEQ ID NO: 747 - DNA, 231 bp, M.catarrhalis
ataaagtatccgctgagcgtggataataaagaccagcaagcacaaagttttaagccaaaaatcagccagtcaatggctgattttttattgataacttttaagattctaaatgaacaaacatccccaaagcgtcatactttgaggatgtttatttttcgctttaaatcagccaattggcttaatgctaaattatttaataccagttggcttgatatgatgatcagcgattag

SEQ ID NO: 748 - DNA, 237 bp, M.catarrhalis
gtgattaacccaaccacatctgccattgcaaaggcttctgcttggtcgtgggttaccaaaatggcagaaacattttgggagataagcaggcgacgcacttctttggagaggttggtgcgaagctcaacatccaaatttgaaaatggttcatcaagcaaaatcaaactcgggcgtggggcaagtgcacgcaccagtgcaacccgttgctgttgtccccctgacagctcatgtggatag

SEQ ID NO: 749 - DNA, 201 bp, M.catarrhalis
tatgtattaccgcttgaagagtcacacgatttccttaaaccacttcaaaaaatgcccaaattggtcaatgagcatcaatttatcaataaaatattaagcttggttacgccaagcgattgcaaaaccattcttatatctaagatccacagagtcaatgcgtccaaaatcatttgccaaagcactttgcaactgtatggctaa

SEQ ID NO: 750 - DNA, 336 bp, M.catarrhalis
aacctgaaaccgtgtgcatacaagcagtcggagcccgaccacttaatcgttttgaggataacaatgaatttttactacgtctatgtcatacaaaacgtggataatcatgatgagttttatgttggttttaccaccaatttaaaacaaagaattgatgaccataataatggcacaacttactcaaccagagcaagaacatggcgtattgtttattgtgaagcctacattaatgaacaagtggcaagaaaacgagagcgaaccataaaaaataatggtcgtatgagaactttcttgatgaatcgtgtcaaatcacaatttgacaatcagaacgattaa

SEQ ID NO: 751 - DNA, 504 bp, M.catarrhalis
cgcattaagcctaaccttagtacattcatcatttgccagtcaaatgagatgatattgttaatgcccaacaaagacgatttgggtaaatggctaccgtgggcgaatgattttagtgaaaatagttatcgtgaatttgtcaaatttgccctacatcaatatgccgatgacaaagccattcatacccatattatttatgatgataaaattatcggagcggtgagtttaaataacatttatcatcagcttaaaaaggcagaaattggctactggttacaccaagaccatcgggggcgtggtgtcatgacctgtgcggtgcgtgcaatcatggacattgccaaaaacatctatggcatgaatgtggtggagattaaggcgggtgagcataatattccaagccaacaagttgctaagcgattgggatttgaattttgtggtatcattgccaatcatgaaaacatcaatggtgaaattattaatcatgcggtttatatgtatcggttttaa

SEQ ID NO: 752 - DNA, 444 bp, M.catarrhalis
tatatggcttttacaaataaagatttgcgtaaagctggcttaaaggttactttgcctcgtatcaaaatattagaactgcttgaaaatgctgagcatcatcatatgagtgctgaagatgtctatcgtgcattagcagcacagggcgaagatgtgggtttggcaacggtgtatcgtgttttgacccagtttgagcaagcaggcatcgttgagcgacataattttgagaataatttatcggtctttgagattgtccaagatgaacatcacgatcatctggtctgtgatgtgtgcggtaagattgttgaatttcataattcagtcatcgaagaagagcagtttaaggttgccaaagcgcataattttaagctatcagggcattcgctgatactatacggcgtatgtgatagcccagagtgcctaaaatcaagcgatgaaacccaataa

SEQ ID NO: 753 - DNA, 1050 bp, M.catarrhalis
gttgcagttactgttgtttattgtttcatcacattgctcatagaaggatcgattatgaaaaaactagttatggctgcattggtgatggcaactgccgcaccagcgtttgccaatgaaattgtcgtatattcagcgcgtgctgatgagctattaaagcccatcgcagaagcctatcaacaaaaaactggcacaaaagtgaccgttgtcagtgataaagcaggccctttgatggaaagactaaaagctgagggcaaaaatacccaagccgatgtgcttatcacggttgatggcggtaatctttggcaggcaacacaagctggtgtcttacgccccattaactcttctgtattaaaaagcaacattccatcgcatttgcgtgacccaaaaaaccattggtttggattatcagtacgggctcgtaccattttttataacccaaataaggtcaatccaagcgaactttcaacttatgccgatttggcagacccaaaatggaaaggcagattatgcttgcgtacctctaataatgtgtacaaccagtctttggtggcaacgatgattgcaaaccatggacaagccaccaccgacagagtggtcaaaggctgggtagcaaatttggcagccgcaccatttgcaaatgacacagcactgttagaagccattgatgcaggtcgctgtgatgtgggtattgccaatacttattattatggacgcttgctaaattctaagcctcaggttgctaataatgttaaagtattttttgccaaccaagcaggtaaaggcacgcatgtcaatgtttcaggtgcaggcgtggtaaaacattcagacaaccctgccgaagcccaaaaatttatcgaatggctatctagcaatgaagcacagcgtttgtatgctgaccgtaattttgaatatccagccaatatacaggtaacgccaacgcctgctgtagctcgctggggcagatttaaacaagatttcatcaatgtatcggtagcgggtcaaaaccaacaaaaagccatcatgacaatgaaacgggcaggttataaataa

SEQ ID NO: 754 - DNA, 246 bp, M.catarrhalis
aaggagaataccatgctatcagaatatcgtgaacttatgaccaaactcaaagccgaaggcgataagcactttttgaagctatttgatgagcataataatctagatacgcaaattgataattttgaaaaagatcccgtcacctcagccagccgtgctcaagaaattgatgagatgaaacacaaaaagctacatctaaaagatcagcttaaaacttatttagataaagtatccgctgagcgtggataa

SEQ ID NO: 755 - DNA, 912 bp, M.catarrhalis
acaataccaacaaatggctttattatgctagagattcgccacctacagatgatgcacgccctaaaacgccatgggtcgcttgccaccaccgccgatgagatgaacctaacggcctcagccatcagtcatcagctcaaagagcttgaaaactattatgacattacgatggtcaatcggcgtactcgccccatcagcttcaccccagcaggcttgatggtacttgagttggcagagcgtattttaccacaggtggcacgcacccaatccgacattaaacgcctcgcacatggtcaggcaggtaggctgcgtttggcgagcgaatgccatagctgttttgattggctgatgccgattttaaacacctatcgtgggcaatatgctgatgttgagcttgatttttcaacagggtttgaccctgagccgcaccaaatgctggtagatggcgagattgatttactcatcacctcaagcgatttgcccattgatggcattgactatttaccgctatttacttatgaaagccgattggtggtcgcaccaacccaccctttggcaagccaatcagtcatcaccccccaagatttgtgcgaccaaacgctgatcgcctatcctgttgaagaaagccatttggacatcattgcccaatttttgacgcccaatggggtaacacccgccaacatccgcacaactgagctgaccgccatgctcattcagctggtcgcctccgaacatggcgttgccgctctgcctgattgggttgtcctagaatacgaacgcaaaggctgggtggtctcacgccccctaggtacaggcgtgcattgccagctgtatgccgctactcgcagctctgatgcccagctttattttatgcaggggtttttaaacttattaaaagatatccaaaaaccctaa

SEQ ID NO: 756 - DNA, 2604 bp, M.catarrhalis
aaaaaaaatgccacaggtcattcggtggcatgttctgaatttgccaaaggtcataccaaaaaggcagttttgggcagtttattgattgttggggcgttgggcatggcaacgacagcgtctgcacaagtccaaggcgcgtacatcggtggtaatcggaatgtcaaccaagccacaggcaagtactctaccgtcagtggtggcgattataacgaagccaacggcgagatctctaccatcggtggtggcttttttaacaaagccagcggcgagagctctaccatcgcagggggtaggaataaccaagctacaaaggagaattctaccgttggtggcggcaagtttaaccaagccaaaggtcgtaactcaacggttgcagggggctataacaacgaagccacaggcatagactctaccatcgcagggggcaggggtaaccaagccacaggtgcaggttcatttgccgcaggtgtaggtaaccaagccacaggtgcaggttcatttgccgcaggtgtaggtaaccaagccaatgccgacaacgccgtcgctgtcggtaacaagaacagcatcacaggtaaagactcagtagccatcggctctaataacaccgttgcacaagatcatacctttattcttggctctaacacacaagatgtacagagtaactcagtgctactgggtaatgagaccgctggcaaacaggcgaccactgttaagaatgccgaagtggatggtctaaacctaacaggatttgcaggggtgtcaaacgctggtaatggtactgtatctgtcggtagtcagggtaaagagcgtcaaatcgttcatgttggtgcaggtgagatcagtgccacctcaacagatgctgttaatggctcacagctacatgctttagccaaagttgttgctgacaactacaatgacattcttaacaacctagatgatatctacaatcttgatgatggtatcaaagatcttgatgatgaggtgggtttattaggcgaagagattaactcacttgagggtgaaatttttaacaaccaagatgccattgctaaaaaccaagcggatatcaaaacacttgaaagcaatgtcgaagaaggtttattggatctaagcggtcgcctgcttgatcagaaagcggatattgataataacatcaacaatatctatgagctggcacaacagcaagatcagcatagctctgatatcaaaacacttaaaaaaaatgtcgaagaaggtttgttggagctaagcggtcacctcattgatcaaaaatcagatattgctcaaaaccaaacagacatccaagatctggccacttacaacgagctacaagaccagtatgctcaaaagcaaaccgaagcaatcgacgctctaaataaagcaagttctgagaatacacaaaacatcgaagatctggccgcttacaacgagctacaagatgcctatgccaaacagcaaaccgaagccattgacgctctaaataaagcaagctctgagaatacacaaaacatccaagatctggccgcttacaacgagctacaagatgcctatgccaaacagcaaaccgaagcaatcgacgctctaaataaagcaagttctgagaatacacaaaacatcgaagatctggccgcttacaacgagctacaagatgcctatgccaaacagcaaaccgaagccattgacgctctaaataaagcaagctctgagaatacacaaaacatccaagatctggccgcttacaacgagctacaagatgcctatgccaaacagcaaaccgaagcaattgacgctctaaacaaagcaagctctgagaatacacaaaacatccaagatctggccgcttacaacgagctacaagatgcctatgccaaacagcaaaccgaagcaattgacgctctaaacaaagcaagctctgagaatacacaaaacattgctaaaaaccaagcggatattgctaataacatcaacaatatctatgagctggcacaacagcaagatcagcatagctctgatatcaaaaccttggcaaaagcaagtgctgccaatactgatcgtattgctaaaaacaaagccgatgctgatgcaagttttgaaacgctcaccaaaaatcaaaatactttgattgaaaaagataaagagcatgacaaattaattactgcaaacaaaactgcgattgatgccaataaagcatctgcggataccaagtttgcagcgacagcagacgccattaccaaaaatggaaatgctatcactaaaaacgcaaaatctatcactgatttgggcactaaagtggatgcctttgacggtcgtgtaactgcattagacaccaaagtcaatgcctttgacggtcgtatcacagctttagacagtaaagttgaaaacggtatggctgcccaagctgccctaagtggtctattccagccttatagcgttggtaagtttaatgcgaccgctgcacttggtggctatggctcaaaatctgcggttgctatcggtgctggctatcgtgtgaatccaaatctggcgtttaaagctggtgcggcgattaataccagtggtaataaaaaaggctcttataacatcggtgtgaattacgagttctaa

SEQ ID NO: 757 - DNA, 714 bp, M.catarrhalis
ctatatttcgctatgcctatttataaaggcttgataagtaaatctgagtatatagcagcgtttaattttaataaagttataacaaaggtgatgatggtgaatactttgaatatgcccaaaaaagggttttgtgttgattggtcaaggttaatcgataatcggttggagacttttttgcaaacgggtattttggtattagatgaggtatttgaccaacaagatgttttatcacttcaaaaagaaagtggttttattgactataaagtagcaacgctagcccacggtgagagacagcaaagtattcgtggtgatcgtattcgctggattgatgaagactgccccattggtatggactatttacgcagcatcatgttactggctaaatattttaatcaaactttgtatgcagggattcgccgtagcgaagcacattatgcatgctaccctgtcggatttggctatcagtggcatgtcgataatcccaaaggtcgtgatgatcgtgttatttctgccgtattttatctgaacgatgattggcaaacaactgatggcggagagattttggttattgacaagacgggtaaacaacaaacactacagcccaaagccaaccgcttggtaatctttgacagcaatcttaaacatcaagtcaatatcacttatcgctaccgcttttcgattgccacatggatgagacgggatagccatctttaa

SEQ ID NO: 758 - DNA, 1194 bp, M.catarrhalis
caaaatgtcgcgaaaaggtacttgagttcatgtaaaaagtcatccataataactacctttattactgtaaatgtttggttgcataagtttatgtcaaaaaaaatcaatgtactcatgatggcagcaggcacaggggggcatgtgtttcctgccttggcggtggcagatgaaatggtggctcgtggggggggcattcattggcttggcacgccaaagggcatggaaaatgagcttgttgccaaacacggtcataccatgcaccacattgacatgcaagggcttcgtggtaaggggctggtgcgtgccattaagttgccttttatgctgttcaaagcggtcatggcaagtaaaaatatcatcaaaaacaataacatagatgtggttatcggctttggcggttatgtaaccgcaccgggtggcttagcagctaagctgtgcaaaattccactcatcattcatgaacaaaacgccattgcaggcatgagtaataaaaatttggcgcgtcatgctgataaagtattacaagcctttgatggggcgtttgacagcgatggcaaaaaggtgctaaccgtaggtaatccagtacgccagtccatcgccaatattgcaccgccaaaagagcgttatttgaatgatgattcaccgcttaaagtgctggtggtgggcggttcgcttggggcaaaagccatcaatgaagcggtggttgaactgttaaagctgtcggataagcccctaaccgtgcgacatcaatgcggtaaagataaccacaacaccatgttggtcgcctattcacaagcacagattgacacaagccgtcatgtctttgaggttatgccatttattgatgacatggcacaggcatacagttgggcagatgtggttatttgccgtgctggggcattgaccgtaaccgagatagccagcgtaggtgttgcagcgatttttgtgccgctaccacacgctgtggacgaccatcaaaccgccaatgccaagagcttaactgacaaagaggcagggattttgttgcctcaacatgagctgtcgggtgagacattggcacagattttaactggtcttgaccgccaaaaatgcttagacatggcaaaaaaagcacaagagagtgccaaacatcatgtcgcaaagacagtggcagagctggttttggcgtatggtgatgataaaggcagtcagtaa

SEQ ID NO: 759 - DNA, 225 bp, M.catarrhalis
tccttttacgctgacgacaatagcaagatggaaccacctgatcccttcccgaactcagaagtgaaacgtcttagcgccgatggtagtgtggttcgcccatgtgagagtaggtcatcgtcagcaccttattttaaacccctctttgcagaagcaaaggggggttttgtttgggggttgattaagtccagtttagcgcttttaaaatttttttcaatgccatcttga

SEQ ID NO: 760 - DNA, 2298 bp, M.catarrhalis
gcaaaacaagcaaagtatggcataataccgacgattgtaaccaaatcttatattgacattcaaggagtttatatgaataaatctaccattatctacacccataccgatgaagccccagcccttgccacgcattcgctacttcccatcattcgtgcgtttggtgcaaccgctggcgtggattttgtgaccagtgatatttctttggcaggtcgcattttggcggcttttccagagtatctcacccaagagcagcaaacccctgatgctctagcccaacttgccgaactggtcacccagcctaaggccaatatcattaaactgcccaatatttcggcatccatgccccagctgctggctgccatcaaagagcttcaggctaaaggctatcagctgccagactatccaaccaacccccaaaccgaccaagaaaaagacattcaaaaacgctacgataaaatcaaaggcagtgcggtcaatcctgttttgcgtgagggcaactctgacagacgcgccccaaaagcggtcaaaaacttcgccaaaaaatatccgcacagcatggggcaatggagtaaagacagccaatcacatgtggcaacgatgaatggcggtgatttttttgctaacgagcaatccaaaactgtggcggatgccacaacagtttcttttatatttacagacacccaaggcaaccaaagccagcttcgcaagcctctggcactaaaagcaggtgagatcatcgatgcgaccatgatgagcaaaaaagccttgctaagctttttaaaagagcaagtccaagacgccaaacaaaaagatgtgctattttccctacacatgaaagctacgatgatgaaagtgtctgaccccatcatctttggtcatgcggtgcgtgtgttctttgcccctgtatttgagcaatatggcgataagctggcagaagctggtattaatgtaaataacggctttggccatcttttggcaaatcttgataaattggacgctgatacacgcacaggtgtcacagaggccatcgcacaagcctatgcgaccaatccagatatcgccatggtagacagcgataaaggcatcaccaacttacatgtaccaagcgatgtgatcgtcgatgcgtccatgcctgcgatgattcgtaattcaggtcgtatgtgggataaaaatggcaacgccaaagacaccaaggccgtcattcctgatagcagctacgcccatgtatatcaagcggtgatcgatttttgtcgtgagcatggtgcgtttgacccaaccacgatgggcagcgtccctaatgtggggctgatggcacaaaaggcagaagaatatggctcgcatgataagacttttgagattgagcatgatggtaccgttgagctgattgatgatcatggcacggtgcttagctctcataccgtagaagcaggcgatatttggcgtgcttgccaaaccaaagatgccgctgtcaaagattgggtaagcttggcggtgaatcgtgctcgcctaagtggcacgcctgccattttttggctggataaaaaccgtgcccacgatgctgagctaatcaaaaaagttcatcactatttgggcgatttggataccgatggcttagatatccaaattctaccgcctgccgatgcgtgcttggcaagtcttgagcgtatgaaacaaggtctagacaccatttcggtaacgggtaatgtgttgcgtgattataataccgacctattcccaatcctagagcttggtacttctgctaagatgctatctattgtacctttgatgaatggtggcggtatgtttgaaacgggtgctggtggctcagcacccaagcatgtacagcagtttaacgaagaaaatcatttgcgttgggacagcttgggcgaatttttggcgttggcggtgtcatttgaacatttggcacagaccacgaacaacgccaaagcacaagtcctagcagaaacgcttgaccgtgcaaccgaaaaactgctactcaatgacaaatcaccaaaacgcaaagttggcgagcttgacaatcgtggcagtcatttttatttagccatgtattggtcacaagcgctggcagcccaaaacagcgataccgccatggcggataaatttgcccccatcgccaaagccctaagcgataatgaagacaccatcgtcgccgagcttaatcaagttcaagggcaatctgttgatatcggtggctattatgcccctgattttgccaagactgcggcggcaatgcgtccaagccaaacgcttgagcaaatcctagcacagcttcactaa

SEQ ID NO: 761 - DNA, 1467 bp, M.catarrhalis
caattaagagcatttgataagacacgcttgcaacatgggatggactcgatgacgcagataagattttcagaagcaataagcaaacttcaatcacgatttggtgatcagctttcaaccaatatgaccacccgtgagcagcacgcacatacgacgacttggctgcttaatcagcctgctgatgcggtcttgactgccaagcataagtacgatgtggcagatgcgatcaagatttgttatgaacaccatatgcctgttatcgcatttggtatcggctcatcattggagggtcagctaaatgcaccgtatggcggactttgtattgatatgtcgcagatggatgaaattgttgcgattaatgaagaggatctgacggcgaccgtgcaagcaggcatgaccagagaagtactcaatgactatttgcgtgcaacagggttattctttccgcttgaccctggagcgaatgcaaccattggtggtatggtcgctactcgagcatcaggcacaaatgctgttcgctatgggacaatgaaagaggtggttttgtcgctggaggtggtattaccaacgggtgaaatcatcaaaacaggcacacgagccaaaaagtcatcggctggttatgatttgacgcgtttgattgttggttctgaagggacgcttggcattgtcacagaggtgacggttaagctatttgggcaacctgaagtgattgggagtggtacttgtcattttccaagcattgatacggcttgtcaggcgaccattgccaccattcagatgtgtttgccaattgctcgtattgagctgcttgacccgattcagattcgtgcatgtaatcagtattcaggcttatcattgcccgaaaaagccaccttatttgtagaatttcatggtactaagcagagcgtggcagagcaggcgactttatttgagcaaatcatcgaagactttggcggcagtgattttgagtggggcagtgatgaagcagtacgaaaaaaactgtggagtgctcgccatcatgcgtattatgctgcctgtgcgcttagaccgacggcgcgtggactgtcaaccgatgcatgtgtgccaatttctcgactggcagaatgtgtgacacaaacccaagccgatatccaaaagtcaggtatgcttgcaccaattgtcggtcatgtgggtgatggtaattttcatgtgctactgcttgttgatacaaacaatgatgaagagcgacaaaaggctgaagaaatccttgagcgtttggctgtgcgtgcaattgaaatgggcggtacttgcacaggtgagcatgggatcggacaaggcaagcgtaaatatatgcaaaaagaacatggtgctgccatcggtgtcatgcaggcgattaagcaagccattgaccctcgaggcatcatgaatcctggtaagatttggtttgaccttggcgataatactatatccaccaatgaatcaaaggcctaa

SEQ ID NO: 762 - DNA, 900 bp, M.catarrhalis
ctatgttactacgacaaagtactaagcctactactaataagacaattttaccaaaatattatgataaatctgattgatacacatacgcattttgatatcccagaatacgatgataagcgcgtgcaatttgcccaaaacgctgataaaaatggcgtacggcatttgctattaattggctatttggcaaaatattttgaacgcatggttttggtcaatcaagccattaatgcactcaaacacgcaccaagatcacatttggcttttggactgcatccgttgtatatcaatgaacagcatgatgatgatttgggtattttagaagattatcttaataattatccgaccatcgccatgggtgaaattgggttggatacttatgctaagccactaaaacaacccgacatttttcaaaaacaaaaacgattttttgttgagcaaattcagcttgccaaagcgtatgacttgcccattttgctacacatccgtaaaaatcatgccgatgttttaaaaattttggctgagcaaaattatcatgctcatgacaggggtggcattgcccatagttttagcggcggagaacaagaggcattggcttttgtaaaacacggatttaagcttggtattacaggtcagattaccaatccaaatgccaaaaagttgcgtcggtctgtgaaagcggtttttgataagtatggtattgaggcgtttgtgattgagacggattgtcctgatatgatgccgttgccttgctcgcatttgggacaatttaatgaacctgctcacttgcattgtgtgctagatgagctgtctgaattatttaattatgataaacaattattagcaaatcagctttggaaaaatagctgtgatgcactgcgtatggattggagatatgactga

SEQ ID NO: 763 - DNA, 1137 bp, M.catarrhalis
gttatgaaatacggaatggctgatgaatttcaaccagaaaccaatggtcaagcacgaatcattgtctttggtgttggcggcggtggcggtaatgctgttgagcatatggttcgccaaaatgttttgggcattacttttgtttgtgccaatactgacttacaagcactaaataaattatcagcaccaaataaaatccaaatcggtgcggacgcaactcgcggcttgggtgctggcgctaaccctgaagttggtcgtaatgccgctgagagcaatgaagatgaaatccgtgccatgctcgagggttataatatggcattcatcaccgcaggtatgggcggtggtacaggtacaggtgcagcccctgtggttgctcgcattgcaaaagaaatgggcattttgacggttgcagttgtcacaacaccgtttagttttgagggcaaacgccgagctgctgctgctcgtaacggcattgatgctttgacccaacatgtagactcaatcattaccattcctaatgataagctgactcaagcatatcgcaatttgacgatggtagatgcttttaaaaaggcggatgatgttttattacatgcggtaaatggtttgactgaaaccatcgtaaacccaggtatgattaacatcgactttgaggatgtgcgtactgcaatgagtgccaaaggtcatgcgatgatgggtatcggccgtgctagcggtactaatcgtgcctctgaagcgatggaaaaagccattcgctctcctttacttgatgatctcaatctaagaaatgcccaaggcttgattattaatatcatcggttctggtgtgagtatggatgaggtgatgtctatcgttgccattggtgagggcatgatggatgaagatgcacatgtattttatggtttggtagaagatcctgatatggaagatgagattcatgtgacggtcgttgcgacaggtctgacggttaatgagcgggcagtaccagtcaaattatcaggaaataagcaagaaacattaagaacgcatacaagtgcattggcagaagaaaatcagcaagcctccattccacgccaaggtgtaccaaagccgatcagtgttggtacttttttgcaaagagagcaacaaaaaaatagttga

SEQ ID NO: 764 - DNA, 399 bp, M.catarrhalis
cctccacatcttaaagatggcaatgcccaagagatcatcgatggcgttcaagagctggttgaaaatcagcgtaaaactcgttacgaaactgcccaaggtgaacttgaaaaagctcgtaacgaaaaaatggttcgcacagacctacaacaaatctatcgttctgccgttgagggtaatgcggttaccttacttgtttgccaaggttatggcgtacctgcaaccatcgatgaacaaaacgcaaccttattggttgccgaagatgcaaccgatgatggcgtaaatgatgatgccgttgccgaaatcatcgaattggttgatcataatggcggtgaggtcgtctttgtacctcgtgagcaaatgaacgaaaaagagccgattgctttgatgactcgttactaa

SEQ ID NO: 765 - DNA, 1209 bp, M.catarrhalis
agaaatcaccatttaggaaatgctatgactaactctccagaacttgccctatccattgaacttatccagcaggcatctgtcacccctgatgataaaaattgccaaaatatcatcgccaagcatttatccaagatgggttttgactgtgagtttatgtattttggtgatccaaatgactctggagatcatgccgaaatcaaaaacttatgggcaattaaaaaaggaagagatctaaacgcaccagtcttgtgttttgcaggtcataccgatgtggtaccaataggtgatgaatcagcttggaaatttccaccattttctgccaccgtccatgaaggcaaattatatgggcgaggtgcatcagatatgaaaacagggattgcaagttttgtgattgctgctgaaaattttataaaaaaccatcctaatcatactggtagtatcgccatgcttatcacggctgatgaggaaggtcctgccattaatggtacaatcaaagtcgcccaaaccttaaaagagcgcggacaaaagatagacttttgcttggtcggtgagccatcaagtacgcagtcgttgggcgatgtcatcaaaaatggtcggcgtggctctttaaatgccaaactgactgtcacaggcaagcaaggacatatcgcctacccccatttggcaatcaatcccattcatgcagcctgtcctgcacttgatgagctcatcaagacgcattgggatgacggtaatgaatatttccccaaaacctccttgcagatttctaatatccgctctggtacgggtgcgaccaatgttattggtggcacttgtgagattttgtttaattttcgttattgtacggaaaatactgctgaaaacttgatggcaaaaacgcacgccatttttgataagcattttagacataccgatgcaacctatcaaattgagtggacgctttcaggtgtgccttttttgaccgaaaaaggagaatttgtttcagcgtgcatcgatgccatcaaaacagtcactggcaccaatgcccaactatcaacctcaggcggcacttcagatgggcgatttattgcacccataatgaacgcacaagtggttgaattgggcgtattaaataccaccattcaccaagtggatgaatctgttgatattgaagacttagaacaattaactcaaatttatgaagaaattttgataagcttaattgaataa

SEQ ID NO: 766 - DNA, 186 bp, M.catarrhalis
ccgcgggtacacagcatcttcactgcgatttcgatttcactgagtctctgctggagacagcgctgccatcattatgccattcgtgcaggtcggaacttacccgacaaggaatttcgctaccttaggaccgttatagttacggccgccgtttactggggcttcgatcaagagcttcgcttacgctaa

SEQ ID NO: 767 - DNA, 312 bp, M.catarrhalis; identical to SEQ ID NO: 80

SEQ ID NO: 768 - DNA, 294 bp, M.catarrhalis
acagtttcgcatacaggactatcacctactatggttggctttcccacgccattttgctactgtaaaattgatcggctcctccgtgttcgctcgccgctacttacggaatctcatttgatgtcttttcctcggggtactgagatgtttcacttctcccggtttgccttacacagtaaactgtgtaataaccaacttatgttggttgggtttccccattcagaaatcgccgggtcacaggatattgccacctcaccgacgcttatcgcaggctatcacgtctttcatcgcctctga

SEQ ID NO: 769 - DNA, 1065 bp, M.catarrhalis
ccaagaaggcaatttatggcggtcgatttttcaaataccctaattgtcgcaatttcggcgacagctttgtttgatttggcaaaaaatgaagccaagctggctgaattggttgccaaagataaagataccgccgcgcgtaaatttcaagcataccagcaggtgcgtgaaaatgagatcttagataaaggctcaggctatcctttgattgaagcactgctcaatcttaataaacatcagccaccgatggaatatcacattgagtcgccctatgttgaggtggtgattgtctccaaatcatcacctgatattggcattcaagtgcttaattcgattcgtgcctatggtcttgggattactcgctcagcatttatttcaggtgatttggttgcagattatatcaaggattttaatgttgatttgtttttgacgaccaatcataaagacgctcagcaagttgtagatgccaaaatttgtgcgtgtgcggtacttgatgcaacaccgatcagtattgataagctcgacagtcatcagcttcgcattgcttttgatggcgatgcagtattgtttgatgattcaggcgagctggtttttaagcaagaaggtttgtatgcttttcatgcacgagaaaccgaaatggcagatttgccgattgaaaaagggccgtatgctgattttttgatcaaattatccaaattacaagccaaattacccaaccaatcgaccgatgcgccacacaatccaattcgcatcgcactggtaacagcacgcaatgcacctgctgatatgcgtgccatcaaaaccctaaggcagtggggtgtcacggtggatatggcattttttttgggtggtcttgataagaccaatgtgctaaaaacatttgcaccgcatatcttttttgatgattcgatcaagcatattgatgctgcacgctcagttgtaccatcagcacttgtgccttatcattctgaatctcagctaaatattctagcacctcaagcaatccctgatatggaagatcgggcatttactcccattaaacccaaaaaacccaagacatcgtcatga

SEQ ID NO: 770 - DNA, 1752 bp, M.catarrhalis
catcaatttaaacgcacttggtatgatgcccaatgctcacaaatttcaaggatattacaaatgccaaaagccaaaaccgatgctaccgatagcacacaaaccagttttcataccgcagataccacgacaggtcaaatgacttttgcgatcattcagaccaatttttgggtgggggacatcgcaggtaatgtcaaaaaaatgcacgctttaaccctagacgccaaagctcgtggtgcagatatcgttatctttcctgagcttgctttggtaggttatccgcccgaagatttgctattacgcccaacattgggtgaacgggtgcgtgaagcgatggcaaaacttgccgaaatcgaaggcatcgtcgtgattttgggttatccgcacattgatcatcatggcacattcaattcggccgccatcttacaagatggtagccaaaaaggattttatcataagcaatgcctaccaaactacggcatctttgatgaacagcgatatttccaaaaaggtcttaatcaagtcttgtttgattataaaggcgtaacgattggtcttttgatttgtgaggacatttggcatgatgaacccattcaggcactgaaacaagcaggggctgatttggtcatcgtcatcaatgcgtcaccttttgaaattggtaaacaaaccgcccgcaaatcactgttaacccgacactcctccacccatcatttgcccatcatttatgtcaataccgttggcgcccaagatgacattgtctttgatggtggctctttaatcacacaatcagatggccgtgtggcacacgaaggcgtgagattcttaaatcagcttttgatggcacggtttgacacccaaaacaaaacctttgatacacaagctaaagcacctttggtactgtctgaagagtctgagatgtatcaagctttggtcgtgggcctaagagattatgtcaatcgctcaggctttaagggggtgattgttggcctatcaggcggtattgacagtgcactcaccctttgtattgcggttgatgcgttgggttgtgatcgggtgtatgccgtgatgatgccgtatgaatacaccgctcaaatcagcctagaagatgccgaagcccaagcagcacgcttaaatgtgtcttatactgtctgccccattcatgatgctgtggcaggcttacgctcagccttagcgccactgcttgccaatagcgagcctgatgtcaccgaagaaaacttacaagcgcgcgctcgtggcacgatcttgatggcactgtctaataaatttgggcatatggtcatctcaacaggcaataagtctgaaaatgccgttggctactcaacactttatggtgatatggtgggcggatttgatgtcctaaaagatgtgtataaaaccgatgtctatcgcttggcgaactatcgcaatcgcctggaggataatcctgttatccctgaacgagtgatcactcgcccgcccagtgctgagctgcgtcccaaccaaaaagaccaagacagtctaggcgattatgagacgcttgatagcatcctaaaaatgtatattgatgacgatttgggctataaggcaattgtggcggcaggatttgaaccaaaaactgtcgaaaaaatcctaggcatggtggatcgtgctgagtacaaacgcagacaaggtgctatcggtaccaaaattaccaaaaaatcgtttggtcgtgaacgccgttacccattggtgaatggctggtcaatcaaaggctaa

SEQ ID NO: 771 - DNA, 237 bp, M.catarrhalis
ttagctcctaatacaaagcctgcgtatgccaaaatcgcactccaaattaaggaacccaatccagttaatatcaaaaaaggcaataagggcatgtgtgccatacctgctggaatggatatcagtgagcgtatcgcagggatcattcgtccaaaaaatatgacagatttaccgtgccgatcgaaccatttttgggcattgcttacatcattggcggtaatcaaaaaatacttaccatag

SEQ ID NO: 772 - DNA, 726 bp, M.catarrhalis
tttgtgactaaaatctctatgaagacaatgactgtaaagccatggcattctgcattgatgataattgtattgattgcaatttttgggttgttgaccaactacttattaaataatgaaacagttaaacccattgttatagaaccaaatcagctaaccaaatcacagtttggtgcactgcagcaggctattgaaccgattggtaaagtacaattttttggggcagatttggtaaaaatccaccaaactatcagccagctgacttgggtggaatctgctaatgtgcagcgtgattggaataatggcgtggttgtttcggtcattgcacgcaaacctattgctaactttggtagtgatagattgcttgatgccgatggcgtcgtgtatgagcctgccgaaagcagtcagctgatgaatcctaatttggttaatttgcatgggcaagataccgaatctcagcagatcatgcaaaagcttaagcggatcaatacttggtatgcgcctttagatgttcaggttcaggatttgattttgacacctcgtcaaacttggattatacgatttaataatggcatgcgtatcatggttgatcatgaagatgcagagcaaaaattgtacaatttagccatacagttgcaaagtgctttggcaaatgattttggacgcattgactctgtggatcttagatataagaatggttttgcaatcgcttggcgtaaccaagcttaa

SEQ ID NO: 773 - DNA, 1005 bp, M.catarrhalis
acgctacataaatacacaagagttagagcacgccattcaagatgtcttaaaagattaaatgccgtcatgacccaaattatcctatcatccaaccaaatccaccgcctgcatcatgcgttttttgtgccacaaggtgaaataaaagccactttgcttatcgtgcatggcatgagtgagcatggcggtcgttatgctgattttgcaaggtttttggcagataatggcgtacttgtggcaacttatgaccagcttgggcatgggcagacagtcaaggacaaatacgagcttggtttttttgacgaaaaacaccccgtccaaaccctgtgtaaagatgtcatcatcatggcggataaattaaaagacaaggcacgcacgctcacctcccgcccagtcccccattatatcatggggcattcgatggggtcattcattgtgcgaacggtactgacccatcacagtacacgctttgatggcgtgatactcatggggacagcagacagttttggactgctcaatcgcatgagtttggtgagctttgggctattaaatcagctgtttgccaaacaggtgaaccaaaaggctgctcatctgatgaatcatgttttactctcccagcttcgctcgcccatcagtgcctcaccatttgcttggcttagtgaaaatattgatgccgtcagagcctttgaaacagatccgctgacaggatttgcctttaccaataatggctggatgactttatttgctttgatgcagcgtgccatgcgtcctgattggtataccaatatgccaagcaattacccaattttattaatcagtggcaataatgaccccgtaggcaatatgggtcaagacattcaaacactacaagaaaaactgatacatgccaactgctcggtcagtgttcaactttatcctaatatgcgtcatgagccactgcatgaaaaacaagcacaaaaagtctttgtggacatcttagcttggattgagcgtcatctaagagtttag

SEQ ID NO: 774 - DNA, 465 bp, M.catarrhalis
tgtgatggcaagcaagcaataggcgatatatttttcatgcaaatcatttttttagacagccatcatttaccgacactgccaccacttgccttgaccatcggtaattatgacggcgttcatttgggtcatcaagcgttattatcagcactggctgatgatgccaaagcgatgggtttgttacctgcggtgatggtatttgagccacagcctagagaatatttttcgcctgataatccaccagctcgattgaccaatttgaccgaaaaagcagagcaaatcacgcaattgggcgttcaatatctgattgtggcaagttttgatgatgcatttcgttcattatcagcggcggcgtttgttgatcttttgcacagcttaaatgtgagccatcttgtgcttggggatgattttcgttttgggtcaaaatcgtgttggcgacaaaacatttttgcaagctgcaggatttaa

SEQ ID NO: 775 - DNA, 741 bp, M.catarrhalis
ccaattttaaaccctaaaagaaggtgcgtaatggacgctatgataaccattgatgataatcagttgctgaccaattaccgcttgattaagcaggcactgaataccgccaatgatcaagctgtgcagatgaatccaactcatcgtcctgccaaactgattgcagtttctaagaccaagcctgttgcgatgatacaaaccttatttcatcagggtcaacaggattttggtgaaaattatctgcaagaagcactgggcaaaatcagtcaattatcacaattacccatcatttggcattatattggtagcattcagcgtaacaaaacccgagatattgccaagcactttgattgggtgcataccttagagcgtgaaatcattgcccagcgtctcaatgagcagcgtgcaggcatgcagccgcttaatgtgttgatacaaatcaatattgatgatgaaagcagtaaatcaggctgtaaaccaaccgaactgcccacgctcatagaacaaatcatcaactacaaaaacctaaacttgcgtggcgtgatggtcattccaagtcagcaaaccgtagatgcgtttgcccgcacaaaagtactatttgatgcgatggcaaggcgttttgacttgccaaactgggataccatcagcatgggtatgagtggcgatatgacacaagcggtagcacacggttcaaccatggtgcgtgtgggaacagcgatttttggtgagcgagaccatcggtag

SEQ ID NO: 776 - DNA, 1113 bp, M.catarrhalis
caccgtttaaaccaccacttaactgcggtcgccgctttattgcggctgcatttggagtatgccatgaatacgcctgatttgatggagttattaagatttgcccatcaaaaaaacgcttcagatttacatttatccgcccaacagcccattatgctgcgtattgatggcaatcttttgcccatggacatcacgcccattgatacagatggtatcatgcagatgctacgccttgtgatggatgacacagattatcatcaatggcaacacaatcttgaacatgattttgtactttcgcttgatggcatcgctcgctttcgggtgaatgtattttttcaggcacacggtgcagcggctgtttttcgggtgataaaaacacacattcccagcctacaacagttaagctatgatgaatatatttatgatagtatgctaaaaatagctaagcttcaggcaggcttggtactcatcacaggagcaacaggctcaggcaaatcaacgacacttgccagttttatcgaccacatcaaccaacaccaaaaaaagcacattatcaccattgaagaccccattgaatatgagcatagctccaagctttcgctgattaatcaaaggcaagtcggtaaagatacccgaagctttcaaaatgccctacgctcagcattgcgtgaagatcctgatgtgatcttagttggcgaacttcgtgatcttgagaccattcgcttggcactgacagctgccgaaactgggcatttggtgctggcaaccttgcacacggacaatgccccaaagagcattgaccgtatcattgaggtgtttgatgctggcgaaaaacacatgattcgcacgatgcttgccgactcactaaaggcagtggtcgcccaacggctattgcctgcccaaggcggtggtcgtgtggcagcgtttgagattctcacgcatacgcctgcggttgcccatttgattcgtgaaaataaaatttctcagctgccttctgtcattcagaccagtttgacccaaggtatgattgatttgacgcaatctttatcacgcttggctgaaacaggcaaaattacgccagccactgccaacgaacaaatcaatatgctgcgataa

SEQ ID NO: 777 - DNA, 237 bp, M.catarrhalis
gtaactataaaatcatctaaatgggcttgggagattatgatgaaactaacttggcaagatactttagatatcgccatcgccttgagcgaaaaatatccaaatgaagatgtgcaatacattcgtttcaccgatttacatcaatatgtgtgtgaacttgaagattttgatgataatcctgatggctctaatgagcgaattttagaagccattcagatggcgtggctagatgagctataa

SEQ ID NO: 778 - DNA, 348 bp, M.catarrhalis
tatagcataaacccccaaactttgtggtatagtaatcttaggtttctaaaaattagtggtgaattggcgtttatgtttgcttttattttaaatattatcatcatcagtgtggtcatgtggctgtttttgaaatttatgtatcctaagccacccaaagcgttcttccccaaagaaggcgatgatacaagcgtgcggcattgccactactgtgggcatgcgttggcaacctatcgtggtattttattgaacgaaaatcagcctaatgaacggtttttttgtaatgctgaccatctcaaatcttatgccgatactcatccaaaagaaaatttaccaatgattaacgattga

SEQ ID NO: 779 - DNA, 945 bp, M.catarrhalis
aaattaaaaaaaggcaaaaacatgagcaaacttaatacaaaagatgggcaaaactttggcaaagtggcggttatctgtggcggaacaagcacagagcgtgaagtgtcgctaaatagtggcatggcagtgctaaatgccttattatcaaaaggggtggacgcccatcattttgaccctgctgataccgacatatctcatttgcgtgcctatgaccgtgtgtttaatgtgttgcatggcacttttggtgaagatggcagcttgcaaggcgtgcttgatggctttaatctgccttatacagggtgtggtgttttggcatctgccatcgccatggataaatttcgctgtcgtttgctgtggcagtcgctcgggctaccaaatgtgccttatgtggttttgcatgatgacagcgatttttctgccgtagagcgtgaatttggtttaccgctatttgtcaaacctgctgccgaagggtctagcgtgggtgtgtttatggttgagcaagcaggtgatttggcaaaaatttatcccaaattaaagcaataccatggcgagattttggcagaaaaagcgatgatgggcggcgaatatgccataccactgcttggtgagcaagttttgcccagcatccgtattatccctaagggtaaattttatgattatgaagccaaatatttgcgtgatgacaccatttatcaatgcccatctgatttgacgccagagcaagagaggcaaatgggtgaattggcattaaaagcgtttcgtgcgattggggggcgtggttggtctcgtgtggattttttaaaggggcatgatggcaagctatatgtcctagaaatcaacaccgtccctggcatgaccgaccacagtcttgtgccgatggctgccaaagaagcagggattgggtttgatgagctgtgcttacaaattctacgccaaacgctatga

SEQ ID NO: 780 - DNA, 969 bp, M.catarrhalis
tttatgaaaaaagccgctattattttagtgaatctgggcacaccagacgccccaacgcccaaatcggtacgccgctatttaaaagaatttttaagcgacactcgtgtgattgaaatccccaaattaatctggcaggtgattttaactggttttgtgctaaccaccagacctaagcgtgtggcacatgcttatgccagcatttggatggatgatggctcaccgttattggtcatactcaaaaatcaagccaaagatttgcaggatttattaagccagcaaggcataaaaacccctgtttatcctgcaaccacttatggcaatccttcgattaaatcggtgatagaggatttgctggccgacggggtatcatctttgattgtattgccactgtttccgcaatattctgccacatcaaccgccgctgcctttgataagattgccaaactgttattgcacaaaagacagctgcctgagcttcatttcatcacagaatatcacaatcacccgacatatattgaggcattggcacagtctgttgagcgttattgggcggtgcatgggcgtgccgataagcttttgatgagctttcatggcattcctaagccatatgccgataagggcgatccataccctgaacaatgccgtacaaccgccgttcttttggcagatcgcttggggctgtctatcaatgagtgggcgatgagttttcagtctcgttttggtgcccaagagtggctaaaaccttataccgatgagctgcttggtgaatggggagcggccagactttcggtacaagtcatcagcccagcattttcagccgattgccttgagacacttgaggagcttgcggttgaaaataaaggcaattttttgcaagcaggtgggcgggcgtatgactatattccagcactaaacaccgatgagctgcatattcaaatgatggcggaacttgtcaaacaatatatataa

SEQ ID NO: 781 - DNA, 1608 bp, M.catarrhalis
atgcccatgaattcatcttccattttgccccgcttgtggcttggtctgtgtgccttgttggttttggtgccattatccgtcattgtctttgcacttaacagttttgatactgaaatttggcagtttttgctggattatgagttgccactgctgcttaaaaataccacattactggtactgggggtgggcattggggtaacagtacttggcacaacaaccgcttggctgactgccatgaccgattttccgttgagacgcttttttggttgggcgatgatgttgccacttgccatgcccgcttatgtgcttgcttttgtgcagttgggtatttttgactatacaggtaccattagtacttatttaaggcaagcgtggggctttgaaaatggtctgccagatattagaaatggctttggcttaacgatggtcatgagcctaactttatatccttatgtttatttgttggccaaaaatgcctttggcagcatgggcaaccgagctcttgaagcgggggcatcattggggctgtcatccgtgcagtcatttttgaagctggcattgcccatggcaaggccttggattgctggcggcagcatattagccttgatggaagtattggcagactttggtgcggtcagcgtctttggctatgacacttttacaacggcaatttatcaagcatggtttgggttttattcgcttgataccgccaaacagttggcaagtttattaattggccttgtgtttgtttttttgctgcttgaacagctaagccgtggtcgtcgccgttttgagaccacagggcgcgccagtcatcaccgaaatattgtcttaactggtcataaaaaatggttcgccactttgtactgtgggctgattttatgtttgtcttttgtcattccaatcattcagctgaccgcatgggcgatgtcaagttggcaacaaattgtgcttggtgaattactgatgcaaatttggcactctgtcagcatcagcctaatgagtgctgtggcggttgctgtggttgcattatttatcgccatcgcatctggcttggataaaagtcgctatgctttgattgccaccaaaatatccacactgggctatgccatcccaggtacggtattggctgttggtgtctttgtgcctgttgcatggcttgataattggctcattaccaatatggctgtattttcaggcagcgatgcaatttttaagggaaccatctttgccatgctcatcgctttattgattcgctttttggctttgggtgtccaatcggtggatgctggcatgaaacgcattcgtaacacacacatagaagcagcggcttcactgggagcaacaccttttggtacggtgtatcgtgtctatttgccactcatcaaaagcgcccttggcgtcagcatgttgatggtctttgtggacaccatgaaagagatgcccatcacgctcatgatgcgtccgtttaattgggatacattggcggttaggatatttgcctttaccagtgaaggcttgtatgacaaggcatcttttccagcacttgctatcattttaactggattgattcctgtcatcttattttctaaaatgaatcaaaaataa

SEQ ID NO: 782 - DNA, 1035 bp, M.catarrhalis
cactctgagaaaaccatgttgcgtattgacaatctttgtatcagttttgaccacaaacccatcttaactgacatcagccttcatcttaaatcaggtcaaatcgcctgcctgctgggtgcctctggctgtggtaaaacgacactactgcggtgtattgctggttttgagacgccagatagtggtgagatttatattcaagacaagccactgtatgccaaaaatatccatctccccgcccataaaagacaaattggcatggtatttcaagattatgctttatttccacatttaaccgtggcggataatattgcttttggactctctgccatggataaaactgccaaatccgagcgtgtggctgaaatgctggtactcattgggatgagtgagtatgccaattactatccacatgagctgtcagggggacaacagcaacgggttgcactggtgcgtgcacttgccccacgcccgagtttgattttgcttgatgaaccattttcaaatttggatgttgagcttcgcaccaacctctccaaagaagtgcgtcgcctgcttatctcccaaaatgtttctgccattttggtaacccacgaccaagcagaagcctttgcaatggcagatgtggttgggttaatcactcatggcagattgcaacaatggggtacgccagatgcattgtatcatcagcctgtcaatgagtcggtggcaagatttatcggtgaaggggtactcattgatgccacaaaggtaacagagtcaaattttgatgcctcatttgggcgtattgccgttggtttacctttgggcagtcaaaaagccctgattcgtccccatgatgtcaagccaagccaagaccctaatgccatcgctgttaccgtgattgatagagattttcatggcggttactggctatataccctacaaactcatgacgaacaaatactgctcatgcaaatctcaatggcaacaagtcatcgcacccaccatgtcggtgataaaattggcgtgatgatacatagagcgtttggtatttaa

SEQ ID NO: 783 - DNA, 471 bp, M.catarrhalis
tatcataatgaccaacttttatgtaatttttacaaaaaatttgacaacacaatccaaagccatgctaagataagcttagctaaattttgtttgatcaacttaggatatcttatgttagctcaattacaagccttagagcagacgatcatcgccatgaaaaagcaatatgcggttaccgcaaccgaacttgccaatctcaaacaacgcatcgccggggacgatagtgccaaacaaatggaaacactacaagccaagcttaatcaggcattggttgatattgatcatcataataaccgtgtggatgacctgcaacaaacccaaaatgccctagaacagcaagttgatgagctttatcaagccaatcgagcgttaatcacccaaaatcaagatttaaaagacaaaaacgccttggccatctcacgcgctgaggtgattcgtgattggctgtcaaaaatcgatcgctccaactag

SEQ ID NO: 784 - DNA, 990 bp, M.catarrhalis
tttatgatagaaccaaagtcctgcccatatggcggggcttttttaatgttaatgatgccagttgatgatgaattgggaatttggattatgaaaaaaatagacctgcacatgcacagtacttgctctgatggtactaatacaccaacagaattgattaaaaaagtcgctttggcaggcattcagatggcggcattaaccgatcatgatacaatcaaaggattggatgaagccaaacagactgctaaaatggtcggcgtggagctgattcgaggggtagaagtcagttgcacccataccttatctgggggctatggtaagcatcaagaaattgataaaattatccatgttgttgcactgaatttttcggatacactcaagatgaatgaagcactgcaatcactacaagacagccgacatctgcgtggacgacaaatgacccaaaaacttgccagtttattgatgaatcatcctgatgaagagcctgtactttttgagcatttgtggcaaaaggtgctagtcaaagcagatggtaatgctcgtgctgttgggcgtgcacacattggtcaagttttgtatgaattgggctatgtgtctagtgtgcaggctgcctttgataaatatttagcagacaataaaccagcttatgtacccatacaaaccatcagcatggcagatacgattgcacttattcatgagtgtgacggcttggctgtgcttgctcatccaacacgatataaactatctgcaacacgcacgcaaaggctcatcagtgattttgctcaatatggtggcgatggctgtgaattgccaaatcatgagccattaagttgtattgagatggttggccgtacaattgctaaacatggtttggcaatatcacttggtagcgattttcatggcgacacgatgccatggcgaaagcttggctcaacggcagtgaagagcgataaccaaataggcatctgggagcggtttggtgaaatatactga

SEQ ID NO: 785 - DNA, 192 bp, M.catarrhalis; identical to SEQ ID NO: 84

SEQ ID NO: 786 - DNA, 1575 bp, M.catarrhalis
tattctcgggagtatatgatgttagaccaaaatttattagatgccgttaaatcctacagtgccaatatgactcgtccaattcaattggtcattggtgcaggcgagcatgaaaagcgtgccgaattgattgattttttaactaaaattgctggtacaactgataaaatccaatttgacgctcaagtgatcgataatcgtttatcaccgatgagctttaaaattaccacacaaaatcgtgatacaggtattgtatttagtggtattccaggcggtcatgaatttacttcattgattttggccatcttgcaggcaggtgggcatgcattgaagcttgatgaggatatccaacagctggttaagcacattcaagagccactaaaatttcaaacttttgtttccttatcttgccataattgccctgatgtggttcaagcactcaatcagtttgcgattttaaatgaccatattgaaaatgagatgattgatggtggtgtatttccagaattggttgctgagaaaaaaatccaaggcgtaccagcggtatttttaaacggtaaaccttttgctaatggtaaggttgatactgccaaactgattgaaaaacttcaagagcagtatccaaatttattagcatcagcaaatgaagtccagcttgaaacacaagatgttacagtcatcggtggcggtccagcaggcacagcggcagcaatctatactgctcgtaaaggattgcgtgttgcgatcgtggcagatcgtatcggtggtcaggttaaagatacgcaagatatcgaaaacttaatttctattcctttgaccaatggtaatacattggctgcgaatttggcaacacacataaaagagtacaatattaccgtcaaagagcatgtcagcgtaagcaagcttgaggaggttgatggcggctatcaggtgactttaagcacgggtgccagctggctttctcgtactgtgattttggcaactggtgccaaatggcgtaagcttggtgttaagggtgaggatgaaaatattggtaatggagtcgcctattgcccacactgcgatggcccattttttaaaggtaaagatgttgcggtgattggcggtggtaactcaggtgttgaggcggcgttggatttggcggggattgtcaatcatgtgactgtcttggagtttggtgactcattgcgcgccgatcaagtgttaattgacaaagctgaagcacgagagaatatcacaattataaaatcagcagcaacgaccgaaatcactactgatggtagtaaagtgaatgcgttgatttatcaagatagagtgagtggcaatagccaaacattgccattatctgctgtttttgtccaaattggcttggtgccaaattcagagattgccaaaggcttggtaacaatgacgccgcaaggtgagattgaaattgacgccaaatgtcgcacaagtaaggttggtatttttgcttgtggtgatgtgacaacagtgccatataagcagattaatattgccatgggtgagggttctaaagcaggattagcggcttttgagtatctgatgatgaatggctga

SEQ ID NO: 787 - DNA, 675 bp, M.catarrhalis
ataaaaagtttgagtaaaaagtggggaattatgggcatgatgatgcagctgatggactttattttgaccattgatcagcatttggcaatatttttacaagattatggcatgtggatttatggcatcttatttttgattatttttgttgaaactgggcttgtggtgatgccgtttttacctggagatagtctgttatttgctgcaggtgcgttggccgctgtgacaggtgcgataaatccgatcttattgatcatactgctgtctttggcggcggtgttgggcgatacactcaattatcacatcggtaaatatatcggacctaaagtatttgtcacaaattcccgctggatcaatcatcagcatttggttaatacacaaaaattttttgcaacgcatggcaaaaagacgattattcttgcacgctttatcccgtttgctcgtacctttgcaccatttgtggcaggtgcgggcagtatgcattatcgctattttttaagctataatatcatcggtgggtgtttatggattatgtcatttgtgctattgggctatttttttgggaatcagcctgccattaagaataattttacttatgtgatttttggtattattatttttagcatcttaccagttatttttagttttattaaacaaaagcttaataaagccgcttag

SEQ ID NO: 788 - DNA, 204 bp, M.catarrhalis
ttgatgatttgttctatgagcgtgggcagttcggttggtttacagcctgatttactgctttcatcatcaatattgatttgtatcaacacattaagcggctgcatgcctgcacgctgctcattgagacgctgggcaatgatttcacgctctaaggtatgcacccaatcaaagtgcttggcaatatctcgggttttgttacgctga

SEQ ID NO: 789 - DNA, 207 bp, M.catarrhalis
  unsure (1),(3),(5),(35),(36),(41),(42): Identity of nucleotide sequences at the above locations are unknown.
nantnttttcgcgcagcctgtctgactcgttatannacgannaaaatatatactaatttggcggcgggtggtcgtggcgttgccatgccactgacagtccgtgagcgtgaattgcccgaaacaattgcgccaattttgatgcataaaggtatacattttgtggcgcgtcgcgcgtcaccggtggtcatattcccgaaattgatgtaa

SEQ ID NO: 790 - DNA, 360 bp, M.catarrhalis
tctagtacgctggcaatttttgcagctgagtcagaagcgaccgtacttcgtctgccttttgatgccaaagagcgtgtgattttggggaataagttcgctactcgtgatttgatgcgtgatttatcagaggcggtgaattattatgtgctggttgttaccagcgaaaacgctcgcctattggttggcacgaacggcactttgattaaagaagtggtgggcgacagtccacgccaagaagtccatgatgagttggcattccccatcaaaaataccacattaccaacaggcagtaaatcagaccgtacaggctcatcagatgaccacagctatctcaaaagagtttatgaatcgtgtggataa

SEQ ID NO: 791 - DNA, 1101 bp, M.catarrhalis
ttttttcagcgaaattgcaacagggcaatcatattaattctaggaatatctatggacgaaaataaagaaaaagcactcaaagccgccttggctcaaattgaaaaacagtttggtaaaaataccatcatgcatttgggtgatgaaacagccaagcttgatgtggatgtggtctcaacaggttcgcttgggcttgatattgcattgggtatcggtggcttgccaaaaggtcgaattattgagatttttgggcctgaaagctctggtaaaaccacactgaccttacaaaccattgccgagtgccaaaagcaaggcggtacttgtgcctttattgatgctgaacatgcacttgatccgatttatgccaaaaagcttggcgtcaatattgatgatttgcttgtctcgcagcctgacaatggcgaacaggcacttgagattgccgatatgctcgtacgctcaggtgccattgatctgattgtcgtagactcggtggctgctttgactccaaaagctgaaattgaaggtgaaatgggcgacagccacatgggtctgcaagcacgcttgatgagccaagcactgcgtaaaattactggcaacgccaaacgctcaaattgcatggtgatttttattaaccaaatccgtatgaaaattggcgtcatgtttggcagtccagaaacgaccacaggtggtaatgccctaaaattctatgcctctgtgcgtcttgatattcgacgcattggctctgtcaaagatggcgatgagattattggttcagaaacacgcgtcaaagtcatcaaaaataagatggcaccgccatttcgccaaaccgaatttcaaattatgtacggtgagggcattaaccgcctaggcgaggtgatcgatttgggtgttgatattggtgctgttggtaagtcaggtgcttggtacagttatggtgatggtaaaattggtcaaggtaaagccaatacggtcaaatatctgcaagaaaatcctgccattgccagcgaaatcgaagccaaagttcgtgagattaaattagccacagtcacacccatcgtagaatcagatgagtctgaagagcatttagaagatgataatttctaa

SEQ ID NO: 792 - DNA, 1482 bp, M.catarrhalis
cacccaaacagagaaacagtcatgccaaattcaaccaaagtcaaaacgctcccaaaacgcctaatagaaatcccagagatgcgacgcattcaaaacattcattttgttggcattggtggggctggcatgtgtggcattgccgaagtgcttgccaatcaaggctatgtggttactggctcagacattaaggcaaatgcgatgaccgagcgtctagaaaacttaggtgtaacggtacatgttggtcatgatgccagcaacatcaaaatggccgatgtggtggtggtgtcatctgccattgaccgacaaaaccctgagattagggccgccttaaaagcacacattcctgtggtacgccgtgccgacatgttgggtgagctgatgcgataccgtcatggcattgcggtggcaggggctcatggcaagaccacaaccacaagtttattaaccatgatgctcaccgaagcggggcttgacccaacttatgtgattggcggtaaattaaacgcctcaggcaaaaatgccgccttgggtgccagccgttatttggtggcagaagctgatgaatctgatgcgtcttttttatctttgcgacccatggcgtgtgttgttaccaacattgatgaagaccacatggagacctatgaaggcagctttgataaactaaaacaagcctatgtgcagtttttgcacaacatgcctttttatgggctggcggtgttgtgtggcgatgacaaagagctgtatgccatgattgatgacattgcaagacctgtcatcacatatggccttgaaaaacacaacgatgtgcaggcggtagatgtgattgcagacggcacaaaaacccatttcaccgtactaagaaaagacaaaaaacccttacccatcaccttaaatatccctggcattcacaatgtctataatgcccttggggcaattaccatggcaaccgatgaaggcgtgagtgataaagccatttgccaagcggtagaaaaatttgcaggcgtgggcagacgctttgaaaacaatggcagctatcccctaacagatggcagcggtgatgtggtattgattgatgattatgggcatcaccccaccgaaatcgccatgaccatcaaagcggcacgccaaagttatccagaccgccgtttggtgatgatgtttcaaccacaccgttacagtcgcacaagggattgttttagcgagtttgtcaatgtgttatcgcaggtggataagctgattttgcttgatgtgtacagtgctggcgaggagctgattaagggggcaacaagcaatgatttggcgcgttcattgcgtgagcgtgggcaggttgaaccgattgtgttaaatgtcaatgacaaagaacaaatcacccaagtgcttaaaatcaccctaaacgccaatgatttgctgatgacccaaggggcgggcaatgtgggacaactgtgtcaagaattggtcaaaaatgggttgtttttggggtga

SEQ ID NO: 793 - DNA, 591 bp, M.catarrhalis
atcctggtaagatttggtttgaccttggcgataatactatatccaccaatgaatcaaaggcctaacactcagcaaggtttcacactgattgagacattggttgttcttagtatcttggtaatcattggcatgattgctataccagcctatgactcgctcatgcgtcgttatgagtctcaaatggtgggtcggtatgttcaagaagcactccgacgagccaagattgagtcggctttgcaccaaaaagatgtcatcatttgcccaattaacaccttgggtgtgtgcgatagatttgggcagtctggtttgatggtgtttattgacaaaaataaaaacaatcgcaaagatgacagtgatgctttggtgttaaaagaatcatttgagctaaaatatggcatgttatcaatgactgtggcactacatcggcattatattaagttcatgggcgataatgcaaagcctcgtggatacatgggtaatgtgcgttattgttcgcttaatggcgatgctgcattgagtcaccaaacaacgattaatatgcatggtttgagcagaatcgaaaatggtgatgttaccaagctcggctgctag

SEQ ID NO: 794 - DNA, 993 bp, M.catarrhalis
aacttccaaagatattgttttattttatcaaacttaggtacaatagaaccatcattaagtgatgataaaattacatttttaaggactgttatgatcacactacgccaattagaatttgcgcttgcagttgccaaacaccgtcattttaagcgtgccgctgaagaatgtaacatttctcagtcagccttaagtttgggtatcgctgaacttgaaaaacagcttgatacacagatttttgagcgaaataataagcaagtactcatcacgcccatcggcgaagagattttagagcgtgcccaaagaatctctagcgaaatcaatgatttaatgactcgagcacacagccaccaaatcccccttgcctatccgatgaccattggtatcattccgaccattgctccgtacttactgccaaaagtattgccgacacttaagcgattacacccacattttgaactgtctgtggtcgaaaaacaaactgaacgattaattgaacaagttcgctacggtcatattgatacagcaatcattgccctaccttatccgcttgatggtctgcatgcgtttgagttttgggcggaagatttttttgcaatcttatctgaaaatgatgaacatatccacaccgataaaatcaacagcgacgatttatctaagacaaatttattactgcttggtgaaggtcactgcctgactgatcaagtgctttctgtctgtgcgctcagtaaaagtgagattcagtctagtttttctgatgccagcttaaatacattgattcaaatgagcttggcaggcatgggaacaactttagtacccaagatggcactagaacaaatcggtgaaaaaaccgttcatgccatacctttggcggaacctggacctcatcgccgattggcttttattactcgtctcaattatgcacgtgtcaatgatgtgcgtctactcagtgagatttttggtcaagcacttgcatcctcagaaaatgaagcataa

SEQ ID NO: 795 - DNA, 243 bp, M.catarrhalis
cgttggactggaacccttggtcttccggcgaacgggcttttcacccgttttgtcgttactcacgtcagcattcgctcttgtgatacctccagcacaccttacagtgcaccttcacaggcttacacaacgctcccctaccacttaattgaaacaattaaatccgcagcttcggctcctagtttgagccccgttacatcttccgcgcaggccgactcgactagtgagctattacgctttctttaa

SEQ ID NO: 796 - DNA, 225 bp, M.catarrhalis
caagcttttatccatcactcacaaccaaaagccacaaaaacccataaaaaagcagccagtaaactgactgctttttttggtgatgatagacaattagaactcgtaattcacaccgatgttataagagccttttttattaccactggtattaatcgccgcaccagctttaaacgccagatttggattcacacgatagccagcaccgatagcaaccgcagattttga

SEQ ID NO: 797 - DNA, 897 bp, M.catarrhalis
ttttcacttatgaactacaaacatgcctatcatgcaggtaactttgctgatgttgtcaagcacattttattgttacaattattaagccaatttagtgctaaagccaagccattttatgtgcttgatgcctatggcggtcgtggcttgtattcattggcaagcagcgaaacccaaaaaacccaagaagcacagcgaggtgttgttgtgcttgagcaagccgttaaggcaggcttggacggactgccaaacgctgtcagccgatatttatcagacttagcgtttgcccgccaaaaatacgaccaatatgtctatcctggttcaccctggtggattgcccatcatggtgaatatcactctacaaatgcaccactacgagcagaggcatttgaaacggtggcagatgagtatgatgcactcaattatcagctttatcagttgccaatcggcattcatcatcgagatgcctttgagggcgtgcgtgctgttataccgcccaaagaaaagcgtggcatcattttattagatccgccatttgaacaagaacataaagactttagccgcttggtagatttattggttagcagccataaaaagtttgcgacagggacttttattttgtggtatcccattaaaaatattgaggcagttgaattattttataaaaaaatgaaacgcactggtatcaaaaaacaactggtctgcgagttaaatttatatcctaatgatgtcgctgttggactaaatggaacgggtctattggtcatcaatccaccgtggcaatttgccgataatgcccaagaagtcattgagtttttggcacccattttaaagcccaaagatgcaccccaaatgactcttggtgagatggcagtggttaagtggttggttgcagaataa

SEQ ID NO: 798 - DNA, 357 bp, M.catarrhalis
ggaatcattatgagtcaagacacccaaaattcaccatcatcggccatcatcgccaaagaagaatttcgcccaattgatatcagtatcgcaggtacgccgcatcggattgtctgcccagtcgacgaaattaaaaacctagagcatggggctgaatacatcaaccacaaaatccgtgatctacgccgtgaaatcaaacacaaaacaccgaccaatgaagagtttttggtgctggtttgtttggagctgtatgatgaagtacaagccctaaaaactcaaatcaccaagaccgatgacgaaaaagccaaagtcgccgccatgatagataaaatcaatcaacaagcacgctcgatgctttga

SEQ ID NO: 799 - DNA, 831 bp, M.catarrhalis
ggagtgattatgtcaacacttgcaactatcattgaaacggcttttgatgaccgtgccaatttcaccgcccaaaccgtcagcccagaaattcgtgcggctgttgatgaggtgattgaagcgttggataatggctctttgcgtgttgcccaaaaaattgatggcgagtgggttgttcaccaatgggtcaaaaaagcggtattattgtcctttaaaatcaatgacaacaaacccatgaatgcaggtgaattgggtttttatgacaaagtggacaccaaatttaatggctggacagaagaagatttcaaaaatgcaggcgtgcgtgtcgttccccctgcggtcgctcgcaaaggttcattcatcgccaaagatgtgatactcatgccatcttataccaacatcggtgcttatgtggatgaggggacgatggtagacacttgggcaaccgttggctcatgtgcccaaattggcaaaaatgttcatctatcaggcggtgtgggtattggcggtgtgttagagccactgcaagcaaaccctaccatcatcgaagataactgctttatcggtgctcgctctgagattgttgagggggtcatcgttgaggaaggttcggtcatctccatgggcgtgtacatcggtcaatccacacgcatttatgaccgtgaaacaggtgagattttttatggccgtgtgccagcaggttcggttgtggtaccaggcaatttgccaagcccctgtggaaaatatagtctatatgccgccatcatcgtcaaaaaggtggacgcccaaacacgagccaaaaccagcctaaatgacttattacgcaccgagtaa

SEQ ID NO: 800 - DNA, 636 bp, M.catarrhalis
acgagtactatggaacaagtgagtgagtgggttttggtcatcatggacaagctagatttggttggtgtcagtttaatgatgtttttagaaaatatatttccacccatcccatcagagcttattatgcccgctgctggatttgctgcagccacaggtcagataaatttatttgccgtcatcattgctggcacaattggctcaatcactggtgccctacctttatattatatcggtacaaagctagacaaagcgcgtttgatacatttgacaaatcgctatggtaagtattttttgattaccgccaatgatgtaagcaatgcccaaaaatggttcgatcggcacggtaaatctgtcatattttttggacgaatgatccctgcgatacgctcactgatatccattccagcaggtatggcacacatgcccttattgccttttttgatattaactggattgggttccttaatttggagtgcgattttggcatacgcaggctttgtattaggagctaactaccataaagtagccaactatgtcagtaccatcagccattatatcatcataggtgctgggcttattattttatttgtcagttataaacgcatcaaaaaattttggggtactcatgctaagtaa

SEQ ID NO: 801 - DNA, 648 bp, M.catarrhalis
aggcaaactatggcaacagattatttatcaggttgggatgattgggtgtcagcatttggtgactggacagacatatcgatcagcgagttgcatggcattatgactggcatcatgactgtgtgtcatgcacccgataccgatggttgggtgcgtttattagaagaaatgagctttgggatacctagtgaatcggcacttgagctgttgactgactatgccgaagatgtcagctttgcactcaaagataaagatgacgcatatggctatgaacccttagtacctgatgatgagcatgagttgtatgagcgtgttttggcactcaaagactgggcgggcggttatatcactggcatcggtgtggcgggtgtgacattaagtgcagatgaaaacgagctgattggtactttgatggagattgccgccattcgcttggatgatgaagaaagtctagagggcggtgaggagatgtggctacagttatttgagtttgctcgcatggtgcctgtcagcttggctgttcgtcagcgtcaagatgtcaaaaacttggcattattaaaaggtctgccgcctgaagcgaagacagccaatgagcttgcatcagaaaagttggcggtgccagtcattgatgtgatggcaagcaagcaatag

SEQ ID NO: 802 - DNA, 252 bp, M.catarrhalis
caggggttcttttcgcctttccctcacggtactggttcactatcggtcagtcaggagtatttagccttggaggatggtccccccatcttcagacagaatttctcgtgttccgccctacttaatatgtcgcttaaacagtttcgcatacaggactatcacctactatggttggctttcccacgccattttgctactgtaaaattgatcggctcctccgtgttcgctcgccgctacttacggaatctcatttga

SEQ ID NO: 803 - DNA, 474 bp, M.catarrhalis
ggaatttgtatgaatgtcctaaaaaactgtattatcggattaattactgtattgcccacaatgacttatgcaaacagtcatttaggtttatatacaaatgacttagccaaatgtatggtttcatcattatcagccaatgataaacaaatcatccaaaatttcaccttgcaaagcatgttctctcatcctagcttgaaccaaaaaaatccgtattcccaatatgaaatcaatcaaacccaacaacaagttggcaggctaataacacgcttgtttgccaaagattgcaccaaagagtggataattgccatgtactatgacaacaaagccgtagagcaggcaagtgaaactcttggcttttatgccatgcaggatttgataaatcacccaaactataagcgttatgcgttgggtattgaacgctacataaatacacaagagttagagcacgccattcaagatgtcttaaaagattaa

SEQ ID NO: 804 - DNA, 942 bp, M.catarrhalis
tcactcatcatgacaatcaagaccttatccgaagttctagcagaaatgggcgaatcgcctgtttctgctgataatcatcaaatccaggtacttgatgaaaccaatttttatcaactcaccacaaccaagccgccaaagcttaaccgtttgccaaaaaataataccttaaaaaaaccaagccaaccaaaatctttagtgaccgcatcaagtcatgacacagccccaatcagtcatacgcccacagataaaacacaaccaccaaaagccctaaaaaaccaaaaacccaaatctttatccaaatcccaaattggcgaattattaaaacatgctcaaggcggtcaagattctattgccatgcctaaaaaacttgctgacagccttagtgatgttgccattgaaccattaatacaaactgacaaggcaaccaattatttacgctggcttgcgttttattatttatcacggcgagaaatgtcacagcatgaattacaaaaaaaactgcttaccaaaggctgcgaacctcaagcggtggaggatttgttacaagaatttgctcacaaaggctatcaatcagatgaacgctttgctatgatgctcgttcgtgaaagtatccgaaaaggtcgtggaaaaaaccacattctacaagttttaaagtctgccaaagtcaacttgcctgagagtgttgatagcattgaccaactgatccagcaagctggagcagactcattgaccgatggcactattcttacttgtgatgaatcagagacggtcaattggcttaagctggctgttgaggtgcgtacacgcaaatatggagatactatcccaacaacacctaaggataaagccaagcagctgagattcttgcagtatcgaggttttgagttttgggtttgccttgaggcactgaaattatctttagcggattttcaagaagcttaa

SEQ ID NO: 805 - DNA, 318 bp, M.catarrhalis
aagaacatcataatgaaagcaacactaaaacagctcaaacaaacccaagccaatcctgcggtaagtatttttgtcaaaacgcaccgcactcaccctgaaaatgaacaagatgccattgctctaaaaaatcagctcaaagttgccgaagaccgtattaccgaagagcatgataaacgcaccgctgacgccatcttggtgaatattaccgctcagacagatgagcttgaccacaactataatctagtacgctggcaatttttgcagctgagtcagaagcgaccgtacttcgtctgccttttgatgccaaagagcgtgtga

SEQ ID NO: 806 - DNA, 1053 bp, M.catarrhalis
gaatgcgtcatgaaagtattgggattggagacatcttgtgatgaaacagggcttgccatctatgatagtacgatgaatggcaggggcggcgtgctgtctcaggttttatatagccaaattaatctacatgccacctatggcggtgtcgtgcctgagcttgccagtcgagaccacattcgtaagcttgtgccgttatttaatgagatgttggatcaggcaaatatcaccaaatccgacattgatgcggtggcgtataccaaaggccccgggctgattggggcattgatgacaggggcattatttgggcggacgctggcgtatgggctgggcgtgccagcggttggggtgcatcatatggagggacatctgttagcaccgctattggccagtgatgaccccccaagctttccgtttgtgtgcctgctggtgtcgggcggtcataccatgctggtgcgtgccgatggtgtgggcgtgtatcagatattgggcgagtccatcgatgatgcggtgggcgaatgctttgataaaacggcaaaaatgctcaaactgccctatcctggtggtccaaatatcgaaaaattagccaaaaacggcaacccacacgcctatgagctgccaagaccgatgcagcataaagggctggatttttcgttcagtggcatgaaaaccgccattcataatctcatcaaagacacgccaaacgcccaaagcgaccctgccacacgagcagacatcgccgcaagctttgagtatgcggtggtggatactttggtcaaaaaatgcaccaaggcactacagatgacaggcattcgccagctggtggtcgcagggggcgtctctgccaatcagacgctacgccgcaccctgaccgagacgctgcgccaaatcgatgcgtcggtgtactacgccccgaccgagctatgcacggataatggtgcgatgatcgcttacgctggcttttgtcggctaagccgtgggcagtcggatgacttggcggttcgctgtattccccgatgggatatgacgatgcttggtatcgaatatgataattag

SEQ ID NO: 807 - DNA, 1089 bp, M.catarrhalis
atatcattaatcattaggcaagccatgaccgtccaaacctataccccaagcccaaaacctacccccaaaaaagccgtacaaggcgaaaaattgcgtggctatgacaaagtcgctcgcattcccatcaaggtcattcccactgttgagacccccaaaaagcccgactggattcgtgttaaattatccagtcctgccgaggtggaacgcatcaaaggcacactgcgtaagcaaaaactctacaccgtctgcgaagaagctgcctgccccaatctgccccagtgttttggggacggtaccgccacttttatgattatgggggatatttgtacacgccgttgcccattttgtgaagtggcacacggacgcccaaacccactggacaaagatgagccaaaacacaccgccgagacgatactcgggcttgggctaaaatatgccgtcatcacaagcgtggacagagacgatttaaaagatggcggtgctgggcattttgtggatgtcattaacgaatcaaaagcccttagtccaaattgcttgattgagattttggtgcctgactttcgtgggcgtgaacaggttgcactggatttattaacccaaaccgcccctgatgtttttaatcataatattgagaccgtgccacgcctttataaggcatttcgcccaggctcagactatgagcattctttgagcctattaaaacaatacaaagcacgccgacctgatgtcgccaccaaatgtggatttatggttgggcttggcgagaccgaagatgaggtttatgccttgcttgacgacctaaaagcccatgatgtggacatcatcaccattgggcaataccttgcccccagtaaaaaccacgctcctgtggacagatatgtacatcctgatgagttcgcccgttataccgaatatggcaaaaagctgggcttttttaacatttgggcaaatccgatggtgcgttcaagctactttgccgaccgtcagtattatggtgaagattgcccgccgcctgtgcgtagctcaaaagtccttgccgaagagaaattggcaaaggcagagcgtggcgaaaaagttgggtgtttttag

SEQ ID NO: 808 - DNA, 240 bp, M.catarrhalis
tatcaatcaatggcttatacacatgatatgatagataaaatcacaatcacaaaaatcaggcacattgtttgtattgatgtgctggctttgatgtttcacaatgatttgacatatttcatggataagatggcagatggttttttatcaggtcaaattttggataaaaaatatttttgcggtcgcttttttatcgaaagtttaattaaaataaacccccaagctcacaaccatgattgttaa

SEQ ID NO: 809 - DNA, 639 bp, M.catarrhalis
cacgatacaatcgtatttttgcttatatttatggtgtataatcaaataaatcaaccaaaaaaggtgaatattatggcagcaattattaatcaaaccattccagaattttcaacccaagcctatgtgaatggtgagtttaaaaccatcacttctgatgatgttaaaggcagctgggcgattttcatgttttatccacatgattttacttttgtttgcccaacagagctagaggatatggcagcacattatgaagagctaaaaggcttgggcgttgaagtgtatgcagtatcaaccgatacacattttgtacacaaagcatggcatgatgcgtcaccagccattggtaaagtacaatacccaatgcttggcgatggcactggcaaaatcactcgtggctttaatgtgatgattgaagaagacaatgcagcactacgaggcactttcttggtagatccagatggtgttattaaagttgctgaaatccacgatttgggcattggccgctctgctaaagacatggttcgtaaagtaaaagcagctcagtatgtgcgtgataatgacggtgaggtttgcccagctgcttgggaagcaggtcaagaaaccttgaagccaagcttggatttggtaggtaaaatctaa

SEQ ID NO: 810 - DNA, 822 bp, M.catarrhalis
aaaagggcaattatgtcagaaattcaaaagcctgaaacgcatactgcatcaaacgagcatgagcatgatggcatcacctttgaggtgattgagcctgagcattcaggtgataaacgcattatgacttcaggagtctatttgattccaaatttaattaccactttatcactattttcaggattttattccattattttaagcaccagtgcagattatcagcgtgcagggcttgcaatttttgtttctgctttcttagacggcatggacggtcgagcagcgcgtatgtttaatgcccaaagcccctttggcgaacaatacgactcattggcagattgcattgcatttggtttagcaccagcaattttaatctacagttttgctttggcaccattgggtcgatttggcatggcgtgtgcatttgtttatgcagcttgtgcagcatttcgtttagcaagatttaatgtccaaatcgatgttgtggataaaaaatattttattggactggcaagcccattggcagctttattaattgcgtgttctgtcttagttgcagctaaatatgccagtcttatgacggcaatacccaccgcattaacttggttttttgctctttggacaattgtctgtgggattttaatggtcagcaatataaagtattattcttttaaagaatttgataaacaaaaagttccatttattgtgctgttattggctgttttggtatttggtgttgtgttgtatgatattccagttggcttattggcgatagggattgcttatgtattatcaggttttgtgaccacattaaataaaaaattttaa

SEQ ID NO: 811 - DNA, 1308 bp, M.catarrhalis
ggaaatcgtgtgactcttcaagcggtaatacatattagctctacggctgtctgtacagtggttgggtattttgaaaccaaaggtttggaaaaacaccttagggtttcggctgtcggcttggcgcacacagatgctttttttggtggtcgcgttgatcatcgtgaatatcttttatcggcaattcataaatctgttcgtgaggccagcgatatggcgggtttacaaatcatttcacccgtcttgtgcatggcatctgccatgatgaatatgcagaatatgagtaatgaggttaatatcgatacagctgatcgtatggtaaccccagagcatattcgtcaagcaactcaagcgatgtctgatcaaatcataagccaagaccgtgcaccgtttcagatgaatcgccaattgatttttttagaagattatcatgtccaagatgccaaagggttgatgacggataaaatttgtgtggcaagtcatgtaattgatatgccaaccaatcagttaaaacagatgatcagcttggttgaacaagatgatttgcaggttgcatcatgtctgtttgatgggattgctggtgctgaatacgccttatctgaggatgaaaaacaagcgggggtttgttttattgatattggtgcgggcatgactaaggtgtgtatctataaagatggtattttgatttatagccattgcttggatatgggcggtgtgaccgtggacatggacattgccaaagagtgcggtattttacttacagacgcggacagctttaagagacaagaaggaacattgaatcgtcataaatattcgtcaggtgctgtggtgacctataaacgacataccaaacacgaaaaaaccatgctcagacgagagctaaatcaggtcatagaggcacgctatcgcaagctatttgataaagtcattgatgaaattgatgcatctttattggttagtttggatgctggaattgtcttggcaggcggtggttcgtctatggatggattacttgattttacaagaaaccatatcggcatgaaagtacggctaattacgaataatccaagggtgaaattggatcctgagcgtctatctgacgataatattaagctacttaataagcacctgtgcgataatacgctacatactgcgatcggtgcacttttatttatgggtagcgctcaatatgctcgtgatcagcagacccaagaagctgatgaactggatgattcttggatgactgagcgtgtgagtatgatcagccagctttttggacaatttactgcgtggattaagcgagttttttaa

SEQ ID NO: 812 - DNA, 837 bp, M.catarrhalis
caaatcagctttggaaaaatagctgtgatgcactgcgtatggattggagatatgactgatacgatacaaatggattatgaccgccgctttatgggggtaagtacactgtatgggcaacaaaatcatgataaatttgccaaagccattgtttatgtcattggtgtgggcggtgtgggttcgtgggtggccgagggtttggcacgaacagccatcgggcaaattgtcttggttgatatggatgtcttggtcgaaagtaatatcaatcgccaattgcccgcactaagccaaacactgggcgaaaataaaattgaagtgatggcagaacgcctgcgtggcattaacccaagggtacaacttgactgtattgatgagtttttgacggtcgataatatcaagaccatcttacccaatcgtgctcgtgtggcagcattaaaagctgaaggtagggcggtcatcgtgctagattgtgtggatgatatgtctgctaagcttgccattgccttacattgtcggtttaataaaattaaatgcgtcattgcaggcggtgcaggtgcaaaaattgacccaaccagaattggtgtggctgatttaagggatactactcaagatccgctattggccagattacgctcaaaattgcgagaaaaaggcatcggcactagccataaagaaaagtttgggttacgctgtgtatattctgatgagccaccaaagctaaccaataacctttgccaaacccatctaaattgtgggggatttggctctgctgtggtaatcactgcaactgtgggtatgctgatggttggtgaagcactaaaaatcatcagtactcactaa

SEQ ID NO: 813 - DNA, 765 bp, M.catarrhalis
ccgaccacagtcttgtgccgatggctgccaaagaagcagggattgggtttgatgagctgtgcttacaaattctacgccaaacgctatgatgtagttgtttatccatcaagcaatactccaaaaactgtggctgagctgattgcatattttgccagccatggtattactttgtgtattcaaagaaaatctgtcaagcatcttaattttcgactgactcaatcaacactgaaggtgagtgtacctagcgatattgatgagcaagtgttagtagatggtatttatgctaaaataccgtgggcaatacgctcttatcacgcattaatgatagaaaaaccgtactatgatacgctttggggtgagagattggatgtggcaaattggctaaacattcatcaagccaatttgccctgccgtaccttggggtacctaaaaaaattaccaaaacaggcattaattacttggatttatcggtatgaaatcaagcaacagttgccaagtttattatcccaatggcaaccaaaagtgggtaaaaaagccgccgccatccgcctaagacagatgtccagtcgttgggggagctgcaatactttgtctgcaaaaatcactttaaatacccatcttgcgtcttatcctttggggtgtttggcgtatgtgcttgttcatgaactgtgtcatctgtatcatgccaatcacagtgccaatttttggaaaagcgttgaaaatgccatgccagattataaatattggcatgacttattaaaataa

SEQ ID NO: 814 - DNA, 255 bp, M.catarrhalis
gtgctgggcttattattttatttgtcagttataaacgcatcaaaaaattttggggtactcatgctaagtaagtcttattctttacctaaaattattttccttgatattgatgatactttatatatcaaagacgaacaacgcatcctgcagagtgtcaaacctgctttactcgctctaaaaaatcaaggtgtactgcttgcaattgccacaggtcacacttgggattatacccatcgaagtacgcaagctgattga

SEQ ID NO: 815 - DNA, 261 bp, M.catarrhalis; identical to SEQ ID NO: 123

SEQ ID NO: 816 - DNA, 738 bp, M.catarrhalis
aaaatcaaggtgtactgcttgcaattgccacaggtcacacttgggattatacccatcgaagtacgcaagctgattgatgaggttggtattgactacctattaaccatgaatggtcaatacaatgaattcgctggtaaaaaattattcgattttccattgcaatatcagcaagttaaaaagatattagaagtatttgagcatcataacattgccactgcatttatgacaagggctgaaatcttttgtttcaatcagaatcacaatttgaaaactgctttaggtgcattggacatcacaccacaaccagctaataaagaaacttttgattttcatcaacccatttatcaaatcttagcattttatgaagatcatgaagccgagaaaatcattctaccacctgacattaaaacaactcgttggcatcggtacgctgtagatgtattggattatcaaagttcaaaagcacgctcaatagcaagactattaaatcagctaaatatctccaaatcaggggcggtagcttttggagatggcttaaatgatatggaaatgtttaagttggtgggagcggccatcgctatgggtaacgcacatcccatgttaaaacaacatgctcatattatttgcccacgccatgatcaagatggcattgaaaaaaattttaaaagcgctaaactggacttaatcaacccccaaacaaaacccccctttgcttctgcaaagaggggtttaaaataa

SEQ ID NO: 817 - DNA, 342 bp, M.catarrhalis
gaaattttattttcacgaatcaaatgggcaaccgcaggcgtatgcgtgagaatctcaaacgctgccacacgaccaccgccttgggcaggcaatagccgttgggcgaccactgcctttagtgagtcggcaagcatcgtgcgaatcatgtgtttttcgccagcatcaaacacctcaatgatacggtcaatgctctttggggcattgtccgtgtgcaaggttgccagcaccaaatgcccagtttcggcagctgtcagtgccaagcgaatggtctcaagatcacgaagttcgccaactaagatcacatcaggatcttcacgcaatgctgagcgtagggcattttga

SEQ ID NO: 818 - DNA, 234 bp, M.catarrhalis
tactttatattgctgaccattaaaatcccacagacaattgtccaaagagcaaaaaaccaagttaatgcggtgggtattgccgtcataagactggcatatttagctgcaactaagacagaacacgcaattaataaagctgccaatgggcttgccagtccaataaaatattttttatccacaacatcgatttggacattaaatcttgctaaacgaaatgctgcacaagctgcataa

SEQ ID NO: 819 - DNA, 1746 bp, M.catarrhalis
attatttcatcttataagagttattttatgaaagctagccaatttatatttgccactttaaaagaaacacccaatgatgccgatattgcctcaagccagctgatgcttcgtgcaggtctgattcgtaagcttgcctcagggttgtatgtttggatgccgatggggttgcgtgtactaaaacgcgttgagcgtattgtccgagaggaaatggagaaaatcgatagtcaagagcttttgatgccagttacccagccaggagagctgtggcatgaatctggacgctgggaggattacggtgctgagcttttaagattcaaagaccgtcacagccgtgattttgtgctagggccgacacacgaagaggtcatcactgatattgcacgcaatgagcttaaaagctacaagcagctgccgattaccttttatcagattcaaaccaaattccgtgatgaaatccgtcctcgttttggtgtgatgcgtgcgcgtgaatttaccatgaaagatgcgtattcttttcatattgataaagaatcgctcgccaacacttatcaagacatgtacgatgcctacaaccgcatttttacacgcttaggattaaattttcgagccgtacaagcagatacaggctcgattggtggctttgcgtcacatgagtttcatgtgttggcagacagcggtgaagatgatattgcgttctcaagcgattctgattttgctgccaatatagagcttgccgaggcggtttgttatgataagcgagcagcaccaacacaagcacgcaccgatgtggatacaccaaatatgaccacatgtgaagcggttgccgagcacctaaatattcctctcagccaaaccgtcaaaacactgattgtcaaaggtcgtcatagccaagataatccagaagcacccaaatttattgctttggttttacgaggtgaccacacgctcaatgaaatcaaggctgaaaaaattgccgatgctcatacgcctttgacgatggcaaccgaagatgaactcaaagaaattggacttatcaaaggctatatcagtaccgatttgcagctgcctgtttatgtcgatcgtgcggcggcggcattatctgactttgtgtcaggtgcaaatattgaacacaaacataccacaggcatgaactgggatcgtgatgccaccatcacgcaaattgttgatattcgtaatgtcgttgatggtgatccttctcctgatggtaacggtgtcattagcatcaagcgagggattgaggtgggtcatattttccagcttggggataaatattcaaaagccctaaactgctctgtccttggaaaagaaggcaaacctgtcactttgatgatgggttgctacggtattggtgtcagccgcatcatcgccgctgccattgaacaaaatcatgatgataatggcatcatttgggcagaaccagaagacaaggctgatagcatcgctcctttttatgttgccatcgtaccgatgaaatccaaagatggcgatgcggaagctaaggcccaatcgctataccaaaccctaaaagctcgtggtattaatgtattacttgatgaccgtgatgagcgagcaggagtcaaatttgctgaccttgaattgattggtattccgcatcgtattgtagtttcacaaagaaatcttgccgaaaataaatacgaatacaccaaccgagccacaggtgatcagcaaatgctaagcctagatgaactattggcattattttaa

SEQ ID NO: 820 - DNA, 1227 bp, M.catarrhalis
aaagggcaatatatgacaacacaatttaagtttggacaatatcctgatatcaatggatattttggtagacacggtggtcgttttgtgtccgaaactttgatggcggcacttgaagagcttgacgaaatttatcaaactgccaaagctgaccctaagttttgggatgaatttatggcggatttaacggactatgttggtcgtccgacaccgctatattttgctgaacgcttgacccaacaagttggtggcgctcagattttttttaagcgtgaggatttaaaccatacaggtgcccataaagtcaataataccatcggtcaagcattgctcgccaaaatggtgggcaaaaaacgcattatcgctgaaacaggtgcaggacaacatggcgttgcaaccgctaccattgccgcacgccttggcttggaatgcgtggtttatatgggtgcagatgatgttgagcgtcaaaagatgaatgtatatcgcatgcgccttttgggggcaactgttgtgcctgttacttcaggttctcgcaccttaaaagatgccatgaatgaggcgatgcgtgattgggtggcaaatgttgacaccacttattatatcattggtacagtcgcaggccgcaccccatatccgatgcttgtgcgtgattttcaggcgattattggtcgtgaggcacgcatacaacatttacaaaaaacaggccgcttgcctgatgcattggttgcatgtgttggtggcggttccaatgccattgggctgttttatgattttttaaatgatcatgaggtggcgatgtatggtgtggaagccaatgggttaggcattgatacacccaatcacgccgctcctttgcaggctgggcgcgtcggtgtattgcacggcaaccgaacttatctaatggcagatgatgatggtcaaattctaggtacgcattcgatttcggcaggtttagattatccaggtgttggccctgaacacagctttttaaaagatattgagcgtgttcattatgtcggtgtaacggatgacgaggcattacacgcctttaaagaagtgacttcaaaggagggtatcattccagcacttgaaagctcacatgcggtagcttatgggctaaaattggcggcgaccatgaagcctgagcaatcaatgattattaatatgtcaggtcgtggtgataaagatttacatacggttatggcaaaagatggcatgcaaattgattaa

SEQ ID NO: 821 - DNA, 642 bp, M.catarrhalis
tcaatcaagcaggatattttggcattaccgctaaagatgcccaagctaagagcagaagagttgctcaaagcattgggtttatgggataaaaaagatacgaccgcaagaatgctttctgggggcatgaaacgccgcttgatgatagctcgtgcattgatgcatcgccccaaattattaattttagatgagccaaccgcaggcgtggacattgagctgcgtcgctcgatgtgggaatttatagaatgcattaaccaagaagaaaaaaccacgattattttaacgacgcattatcttgaagaagctgaacagctgtgtaaatatatcgctattttggataagggcgaaattcgtattaataccgacatgaaaagcctgcttgccagcttggatgttgaaagctttattttagacttttcaagaccatttgagtcgcccattgtgcttgagcaagtcttacattatcaaaaaattgacgcacaaagccttgaggtcacgctcaaaaaaggtgaaagtttaaatgatgtctttgcacaattatccaatcagggcgttcaaattgccagcatgcgtaataaatcaaatcgtttggaggagttgtttatgaatttggttgaagaagatatctccaatcagcttggttaa

SEQ ID NO: 822 - DNA, 642 bp, M.catarrhalis
ggtgatatgaaacaagtcaaattttgtggtttaacacgccctcaagatgtcagtgctgctgtttgtgcaggggctgatgcgattggactggtattttatccacccagccccagagcggttgatgtcttacaagccaaacagcttgtggcaaatattcctgcgtttgtcagtgttgttgcccttgtggtaaatatcgatgatgatatgctgattaaaattgcccaagcagtcagctttgatatcattcagtttcatggcgatgaaacggcggatgaatgccaacggcaggcggcacttgtaaataagcgttggattaaagccgtgcgtgttgatgcattacgctatgacaccaagggcattcaaaagattatcgatgattatcatgccaaaggtgctgcatcgattttactggatgcttatcacgctgataaatttggtggtacaggcgagcgttttgactggtcaattattccaaaacagtcatcattaccgattattttagcgggtggcttgacgcctaacaatgttgcactaactcggcaattgccaatttatgcagtggatgttagcggtggcatcgaattagccaagggcatcaaagattttgataaaatgaaagcttttattgaagcggttagatag

SEQ ID NO: 823 - DNA, 858 bp, M.catarrhalis
  unsure (549): Identity of nucleotide sequences at the above locations are unknown.
tttgatgagaatatgatgaaaacaagaattgaaatgacttttgagacattgcgtcaagcgggcaaaaaagccctgattccttatatcatggcaggcgacccatgtcctgatgtgacggttgatttaatgcataagcttgttgagcatggtgcggatattattgaggtggggttgccttttagcgacccaatggcagatggtcccatcattgcccatgctgccgaaagagcattggcggcaggcgttagcactcgtgatgcactaaatatgattgctaaatttcgtcaaaccaaccaaacaacgcctgttttagtcatgggttatttaaaccctgttgaaatcattggttatgataattttgctaatttgtgtgctgatgctggcgttgatgcaattttgatggtggatttaccgcccaaccaagcagatggctatgcaaaatcactgaccgagcgtaccgatcatcccatgaatcaaatttttttgctggcaccaaccacaaaatcagatcgccgtgccaaggttatcgaaaactgtagtgggtttatntattatgtgtcactcaaaggtgtcacaggttcaggcgcgcttgatgtcgcagccgtgcgtgagcaggtagcaaaaattaagcaacaaaccccaatacctgtgtgtgtgggctttgggattcgtgatggtgattcagccaaggcattgggtgcggttgctgatggcatcattgttgggtctgaattggtcaagcattttgctgattgtggtcatgatgaacaaaaaattcagcaagccaaggctgggttattaaacaaaatggatgagcttagaaaatcacttgacgagcttacatcaagtaccaattaa

SEQ ID NO: 824 - DNA, 188 bp, M.catarrhalis
gaagacggtggctttgcacaatgacttgcaccgctgttcgacacccccagagcgattgctcaaggctaaaacgagatgatgacaatgaaaaaagctgttatgttttctgttgctgcattgttagcagtgtcaacaatggcaacccaagcacaagaagctgtcgcacctgcagaaactcagactgctga

SEQ ID NO: 825 - DNA, 303 bp, M.catarrhalis
agtgccattatgacaaaaagcccagattatgcccaaccaaacatacccgccttgcaactaaaaggactcagtaaaacctaccataatggttttactgctctaaaaggtattgatttgactgtaccacaaggtagtttttttgctttacttggtcctaatggagcgggcaaatcaaccaccatcagtattatcagctctttatttcccccttctgctgggactgtagaaatttttggtattgatttggtcaaaaaccctgcaaaggcgaagcaatttttgggtattggttccccaagaatttaa

SEQ ID NO: 826 - DNA, 846 bp, M.catarrhalis
acaatgagtattcatggtgttttaggtgagacaacaagttatccaaaaaattatgatgccagtatattatttgccatttctcgtagtttgggtcgtgatgaagttttaaaacaaactggcattcaagctgatcagctgacagatggcgtggatgtatggcaagcgtttgagttgtcatggctaaacttacaaggtatttgtaaagttgcgattgctcgcattcgcattcctgccaactcacccaatattgtggaatccaaatcattaaaactttatctaaatagcttgaattttaccaaatttggtgacatggcagaggttcaagcactcatccaaaaagacttgtcggcttgtgtggggattaaggtgagtgttgagattgtaccacttggcggcagcggctttgaggtacaagagccactgggtgtctgtattgatgaggtgcttgatacagaaggtgaggttattgcttgtgatgatattaattcagcgatattaagtcagccacctgtgcatcagatgatgacttatcaatttcataccaatttattgcgctcaaattgccctgtgaccagccagccagattgggggacgctgtcagtttcaatcacaaccaacaaagccttagattaccaaaaaatcctaagatatgtacttaccttccgtcagcataatggttttcatgaacaatgcgttgagcgtatttttgcagattttttagtgaattttgagccatcggccttgatggtgcaagccaactacactcgccgtgggggtattgatatcaatcctgtccgtgtgctaaaccatgctttgccagctgtaactagacaggtgcgtcaatga

SEQ ID NO: 827 - DNA, 783 bp, M.catarrhalis
gagtacgccatggattttagtaagcaatcggtagcatttttcaccattttaaaaaaagagattaaaagaatattacggatttggctacaaactttattgccacctgtcattacgatgactttgtattttgtggtttttgggcagatgatcggtagtcgcatcggtgagatgggcggcgtgtcttatatgcaatttatcgtcccaggcttgattatgatggcggtgattaccaatagctactctaatgttttatcaagtttttttagtatgaaatttcaaggtagtattgaagagcttttggtttctccactttcaaaacatacgattttattaggctatgtgggtggcggtgtatttcgtggcattgtcattgcattgcttgtaacgatagttgcacagttttttactcagttgacggtggtgaatttgggtgtgatgctgatgactatcttaggtacttcagtactattttcaattggtgggttgattaatgcgatatttgctcgctcatttgaggatatttccattattccaagttttgtgctgacgccattgacttatcttggcggtgtcttttattcgttagataatttatcatcattttggcaaaatttatctttacttaaccccatcgtttatatggtgaatgcgtttcgctttggtattttggggcatagtgatgtcaatgtttggtggtcgctgattgcaattttggtattttgtattctgctttatggttgggcgtatcgcttgttggtcaatgggtcgagactaagattataa

SEQ ID NO: 828 - DNA, 561 bp, M.catarrhalis
aacgagatgatgacaatgaaaaaagctgttatgttttctgttgctgcattgttagcagtgtcaacaatggcaacccaagcacaagaagctgtcgcacctgcagaaactcagactgctgatgcaactgaagtaactacagcggaagcccctgctcaagtggcagcgcctgtagaagaagcaccaaaagaaagtccacaggttcaaaagcttgtggcgatgtatcccaatttgatcgctcgtatagcaccttatggtaaagtttgttttgatggagaagaatgtgatattaatatcacagtacttgcaccagccgttgaaggtcaagctcgtgatggcgaaagcttgtataaagccatatgctcaacttgtcatgatgcaggcttgattggtgcaccaaaaattggtaccagcgattgggcatcaagaatcggtaaaggtacagcaacgctatataatcatgccatcaatggttttaatgcgatgcctgctcgtggcggtgctgatatctctgatgaagaggttcaaaatgcggttgattatattatccagcagtcaagctaa

SEQ ID NO: 829 - DNA, 201 bp, M.catarrhalis
aaatttttggtattgatttggtcaaaaaccctgcaaaggcgaagcaatttttgggtattggttccccaagaatttaattttatgcaatttgaaacagcacaagatattttaatcaatcaagcaggatattttggcattaccgctaaagatgcccaagctaagagcagaagagttgctcaaagcattgggtttatgggataa

SEQ ID NO: 830 - DNA, 2079 bp, M.catarrhalis
tcaaagcggtcttcacaacacaccaaacgagatatcaccatgagtactgtcaaaaccccccatattttctaccaaaaacgcacccttagccttgccatcgccagtatttttgctgccttggtgatgacaggctgccgctctgatgacatcagcgtcaatgcacccaatgttacccagctgccccaaggcacggtttcaccaacgccgaacacaggtcatgacaacgccaataacaccaacaatcagggcaacaacacggataacagcaccagcacaactgacccaaatggcgataacaaccaactgacacaagcgcaaaaaactgccgccgccgcagggttttttgtgatgggtaaaattcgtgataccagcgaaaaaaatgacccagattatagtgatgatttaaaacagcagtggctgggcaaattatatgttggtattgatgcccatcgcccagatggcatcggaaaaggtaaaaacttgcgtcagcccatcaccgccaatgacattaaacccttgtattttaacaaattccctgcattgtctgatttgcatttagacagtgaacgccatcgttttgaccccaaaaagctaaacaccattaaagtgtatggttatggcaacttaacaacaccctctaaaaacaacacttacatcaatcatcagcaagctgataataagaaaaataacaagcctgttgacccttatgaaaatatccgttttgggtatcttgaactacaaggaagcagtctgacccaaaaaaatgccgatactccaaatgacaaagaccgcattcccaaacccatgcccattttgttttatcacggagaaaacgccagcagccagctgcccagtgctggtaaatttaactacacaggcaactggctgtacctaagtgatgtcaaaaaacgccctgcactttcagcatcagatgatcgagtgggggtctatctcaatgccagtggcaaatccaatgagggcgatgtcgtcagtgccgcccacatttatctaaacggctttcaatataagcacacgcctgccacttatcaggtggattttgacacaaactcattaacaggcaaactgtcctattatgacaatcccaatcagaaaaacgcccaaggcaaatatatcaaaagccaatttgataccaccaaaaaagtcaatgaaaccgatgtgtatcaaattgatgccaaaatcaacggtaaccgctttgttggtacggccaaatctttgattaacgaaaacacaccaaccgcaccttttatcaaacagctgttctctggtgctgccaacccaaacaacccaaatcccaactcagatacgctagaaggcgggttttatggtgagtcgggcgatgagctggcgggtaaatttttatccaatgacaacgcaacttttgtggtctttggtggtaaacgagacaaaacagacaaacctgtcgccacaaaaacggtgtattttagtgcaggctttgaaaaacccaacaccagttttgtggataatgaaacgattggtagaattatcaacagtcaagggttaaatgataaaatcaatgaacagattgaagaagggactgtccctgtcagtaataatgaagaatattatgaatatgcgtggggcagaccaaaagcagagttcaccaaaaaagtcagcagcagcacccaagccgtgccagcttattttgggcaacatgataaattttattttaatggcaactattatgacctatcagccagcagtgttaataaattagcccctgccgatgctgtcaaagccaaccaatccattaaagaaaaataccctgatgccaaactaattaaagacaaagttaccaccatcgtgttacaagaagccagtggtgataagccgtataccgccattcatgccaaaagctatgaccacatcagttttggtgaagtattgtataatgataacttaggcaatccaacacgcagttattttgtgcaaggcggtagggcagataccagcacaactttgccccaggcaggtaaattcacttacaacggtctttgggcaggctacctgacccataaaaaggacaaaggttatatctga

SEQ ID NO: 831 - DNA, 480 bp, M.catarrhalis
gcacccaccgctcaaattgggcggccggggtgggcgatacgattggttcggccattttgttatgaggtggcatatcctgagacgacgcgtaaatatgcacttggcagtaattttttattaaccgtctcaaacgatgcttggtttggtacaacagcaggtcctttgcagcatttacaaatggtgcaaatgcgaagcttggagacggggcgatggtttgtgcgtgcaacaaacaacggagtgactgcattaattgaccatcaaggacggattatcaagcagataccgcagtttcagcgagatattttgcgaggtgatgtacccagttatgttggacgcacgccttatatggtttgggggcattatcccatgttggggttttctttggtgctgatttttcttagtatcatggcaaagaaaatgaaaaataccaccgccaaacgagaaaaattttataccgctgatggtgtggtagaccgctga

SEQ ID NO: 832 - DNA, 1821 bp, M.catarrhalis
gtttatcattatcaaggaaaagttatgctaaattcgtcaaatagatatcaagagcgtatcggtcttgctcgtcaaattctggcagatgaaggtgtggatgcgttgattatcccatcagccgatccgcatatgtcggagtatttgcctaaatattggcagggccgagcttgggtatctggctttacaggttcggtgggaacgctggttgtcactcagacatttgcaggcttatggacagacagtcgctattgggtacaagcacccattcagctggcaggtacgggcattgaatttcaaaaaatgcagatcggacagccgacttttacacaatatttggctgacacattaccagctggttctaaggttgccatcgatggcaatgtattgtctgtaaatgagcatgataatttaaaaacagcatttttggataaagatattcagttagtaacagacttggatttgttgtcaaaaatttggacagatcgaccacagttaccagatgccgccatttatgagcatcctgctgagtttgttgatacaacggttgccgaaaaattagcacaggttcgtgctcaaatccaacaaaagcaagcagatgttcatctgatatctagccttgatgatattgcttggttgttaaatttgcgtggatctgatgtggaatttaatcctgtatttttatcacacttgctattagacgataccaaggcgactttatttgttgatatcaataagcttgatgacaaaatacgcacctcacttgagtcgatgggcgtacaagttgctgaatatcaagcgattggcgatgcgattgctcaagtttcaggcaagctgttaattgatccatcacgcattgcgattggtactttaaagcagctttcttcatcggttgagctgattcgtgccatgaatccaagtacaatcatcaaagccatcaaatctgaggcagacatcgaacatattcgtgaagccatgcgtcaagatggtgcggcactttgtgaattttttgccgaatttgaagccaaaacatcacttggcgagcgtatcaccgaacttgatatcgatcgtatgctcatcgaggcacgcagtaaacaaaagcactatgtttcacccagttttgataccatcgcaggatttcaagccaatggagcaattgtgcattatagtgcaagtgaagataattacagtgtgatcgaaggtgatgggctgttactcatcgattcaggtgcacagtattataatggcacaaccgacattacacgcatggcaagcgtgggtcaagtgagcgatgatgaaaaacgcgatgttacttatgtactcaaagcacatattggactggcacaagcacagtttcctgaaggtttggcgtcatcacaagtagatgcgttagcccgaatccatttatggcgtcagggtttggattataatcatggtacaggacatggcgtgggctattttatgaatgtccatgaaggtccgcaagtgatttcagtatttgctccaacaacgccagagcgtgtgcttaagcgtggcatggtaaccaccaatgaacctggattgtatcgtgaaggtcagtggggtatccgtttagaaaactgtgctgtctgtgttgaggctgatcgcagtgagtttggcacatttttaaaatttgatgatttgactttgtgtccttttgacactcgtctcattttgcccagccttttgaccgaagatgaaaaatcttggctaaatcactaccatcagcgtgtgcatgatgagctgattgatcgtgtcagtggtgcagctaaagactggctgatcgaaagaaccaaagccatctaa

SEQ ID NO: 833 - DNA, 2157 bp, M.catarrhalis
ctgatgacaaaatcaactcaaaaaaccaccaaacaaacacaacacagccatgatgatcaagtcaaagagctggctcaagaagtcgctgaatatgatgatgttgaaattgttgctgaagtagatatcgacaatcaagctgtctctgatgttttgattattcgtgatacggataccaaagctgaccaagcagatcacactgatgacgcatctaaagcagatgatgagactgtggtagatggcgttaaacaaaaagctcaagaggctaaagaagattttgaaaataaagcacaagatcttcaagataaagctactgagaagcttgaagtcgccaaagaagctacccaagacaaggtagagaaaactcaaagtttagttgaggatatcaaggataaagcccaatctttgcaagaagatgctgccgatacagttgaagcgttaaaacaagcggccagtgataaggttgagactaccaaagctgaagctcaatcactaaaagatgatgctactcaaacatttgaatcagccaaacaagcggttgaaggcaaagtagaagccatcaaagagcaagtcttagatcaggttgactccctaaaagacgataccgatcaagataatactgatcaagatcaagaaaaacagaccctaaaagataaggcggtgcaagctgccaccgctgctaaacgcaaagttgaagatgtggtagatgatgtcaaacacaccaccgaatctttcaaaaataccgcaagcggaaaaatagatgagattaagcaagctgctgttgacaaaacagaagaggtcaaatctcagcttagccaaaaagctgatgccctaaaatcatcaggcgaagaactcaagcaaacagctcaaacggctgctaatgatgccattacagaggctcaagctgccgtagtaagtggttcggttgctgccgctgattcggcacaatcaaccgctcaaagtgcaaaagataagctcaatcagctctttgaacaaggtaagtccgctttggatgagaaagttcaagaattgggcgaaaaatttggtgcaactgagaaaattaatgcagtcagcgaaaatgtagatttggctacccaagtcattaaagaagaagcacaagcactacaaaccaatgcccaagaatctctacaagctgccaaggcggctggcgaagagtatgacgctacccacgaagataagggtttgaccactaaacttggtaaagtgggtgcctatttgtctggcatgtatggcattagccaaaataaaaataaacattaccaaggcgttgacttgcatcgtgaaagttttgataaagatgcatttcatgcccaaagcagtttttttgcaggacaaatatttggtgccaaagcagttgcagctaagaatgtggcagctaaagttgttcctcaatctaaatttgaagccatcggtgaatcactttataataaagtagctgaatggtcgaatgcatgggcaatcaaagatcttaaaaatgacccaagatttgatttaatcaataccatgaacacccaagagcgtcatgcttttgccgaagatgtcgccaatcaaaaccgtgcgttggcaacgcttggcggtgtggcaggcttagcaggcttaaaaggtgtgcttgctgatgcagcttggctattgatggtatcgttgcgtacagtttatcaagtggctgccatttatgatcagccgctgactggcaaagaaggtactaagaaagcttatggtgtgctgtcaggtgctaatcttgaaaaactccaagaaaaacaggtgattttgacagcgttggctttgggtagtagcatgcttgctaatgctcaacaaacaggcattaaagctcagttagatagcttgtctgctcgttatcgtgaaagccaaccttatgccaaacagtttttggatttggataaatttgttaatcttgataatttaaatccaaattggttgcataaaattttgccaatatctgcagtagcagtgggtgctcattataataatgagctgattgatgaagtcattggtacagcgatggcaaccttttcagatgattttgagcaaagcaatcaattgatttctaactcaagtgaaaatactgaaaatcaagaagcagaaaatactgaaaatcaagaatcaaccgccgaagcataa

SEQ ID NO: 834 - DNA, 597 bp, M.catarrhalis
aaaggacaaaggttatatctgatgatgcagagggccatcaagagaaaaggtcatgaagattatctgctaaccgaagactgtatcttcggagatgttgacgatgatttgaccgcatctgctgacccccaagatgatgatacagacgccgatgatgatggtgcagataatgtgtatcaaaaaggtgagattcgccctgaatttgccaacaagcacttgcccattaacgagcctacttatgaaaaaacttttgccttagatggcaaaaatacggctaagtttaatgtaaactttgataccaacagcctgacaggcaatctcaatgacaataatggtcatattgtctttgacattaaagatggcaaaattgatggcacaggatttaccgccaaagccgatgtgtccgattatcgccatgagattggcaataacagcagtggcggtttcttatacaacatcaaagacattgatgtcaaggggcaattttttggtacaaatggcgaagagttggcaggacagttacatcatgacaaaggcgatggcatcaatgacaccgccgaaaaagcaggggctgtctttggggctgttaaagataaataa

SEQ ID NO: 835 - DNA, 186 bp, M.catarrhalis
gttttgggcggtgatgtttggcaggtttcgggtaggctgatgagtaatacaaccaaagctcacccaacgcctaatcttgctcatgctctaacgcccaaagtggcacaattcagcggtctaccacaccatcagcggtataaaatttttctcgtttggcggtggtatttttcattttctttgccatga

SEQ ID NO: 836 - DNA, 204 bp, M.catarrhalis
actaaattaggcaggttacccatggcacatgatgcttcaaataataacccactcaaagaatcgctaacagcattgattggtactgtgctattgcttgtaatgattgcaggtattgcaatttcagcatggctacgcccagcaggtgagcatccagcccaagctgaacctgctgaagctgaagtcgccacattgcaaagtaattga

SEQ ID NO: 837 - DNA, 3012 bp, M.catarrhalis
gatttttttatgtcaaaatctatcacaaaaacacaaacaccatcagtccataccatgaccacgcaccgcttaaaccttgccatcaaagcggcgttatttggtgtggcagttttgcccctatccgtctgggcgcaagagaacactcagacagatgccaactctgatgccaaagacacaaaaacccctgtcgtctatttagatgccatcacggtaaccgccgccccatctgcccctgtttctcggtttgacaccgatgtaacagggcttggcaaaaccgtcaaaaccgctgacacgctggcaaaagaacaagtacagggcattcgtgatttggtgcgttatgaaactggggtgagtgtggttgaacaggggcgtggtggcagcagcggatttgccattcatggcgtggataaaaaccgagtgggcattaccgtagatggcattgcccaaattcaatcctacaaagatgaatccaccaaacgagctggtgcaggctctggggcgatgaacgagatagagattgaaaacattgccgccgttgccatcaataaaggcggtaatgccctagaagcaggctctggtgcgttgggtggttcggtggcgtttcataccaaagatgtgagcgatgtcttaaaatctggtaaaaatcttggcgctcaaagcaaaaccacttataacagcaaaaatgaccattttagtcagacgctggcagcggcaggtaaaaccgagcgtgtggaagcgatggtgcaatatacctaccgtaaaggcaaagaaaacaaagcacacagcgacctaaatggcatcaaccaaagcctatatcgcttgggtgcatggcaacaaaaatatgatttaagaaagcctaacgaactgtttgcaggcacaagctatatcaccgaaagctgtttggcaagtgatgacccaaaaagctgcgtacaatacccttatgtctacaccaaagcccgaccagatggtatcggcaatcgcaatttttctgagttaagcgatgctgaaaaagcacaatatttggcatccacgcacccccatgaggttgtctctgccaaagattatacaggcatttatcggttgttacctgaccccatggactatcgttcagactcgtatttggcacgccttaacatcaaaatcaccccaaatctggtcagtaaactgttattagaagacaccaagcaaacatacaacattcgtgatatgcgtcattgtagttaccatggggcaagattgggcaatgatggtaagcctgccaatggtggctccattgttctttgcgatgattatcaagagtatctaaacgccaatgacgcatcacaagcattatttagaccaggtgctaatgatgcccccattccaaaactggcttatgccagaagcagtgtgtttaaccaagagcatggcaaaactcgctatgggttaagttttgagtttaagcctgacacgccatggtttaagcaagcaaaattaaacctacaccaacaaaatatccaaatcattaaccatgacattaaaaaatcgtgcagccaatatcctaaggtggatttaaattgtggcatcagtgaaattgggcattatgaatatcaaaataattaccgttataaagaagggcgtgccagcttgacaggcaaacttgattttaattttgacctgctgggtcagcacgatttgacggtgttggctggtgcagataaagttaaaagccaatttcgtgccaacaaccccagacgcacaatcattgacaccacccaaggcgatgccatcattgatgaaagcacgctgacagcacaggagcaagccaaatttaagcaatcgggggcggcatggattgtcaaaaatcgccttggacgcttagaagaaaaagacgcctgtggcaatgccaatgaatgtgaacgcgcccccattcatggcagtaaccaatatgtgggcattaacaacctttatacaccaaatgattatgtggatttaagttttggtggacgcttggataaacaacgcattcacagcaccgattcaaacatcatcagcaaaacttacaccaacaaaagctataattttggagcggcggttcatctgacacctgattttagcctgttgtataaaactgccaaaggctttcgtacgccaagtttttatgaactgtacaactataacagcaccgccgcccagcataaaaatgaccctgatgtgtcttttcccaaacgcgcggttgatgtcaaacctgaaacttccaataccaatgaatacggctttcgctatcagcacccttggggggatgttgagatgagcatgttcaaaagccgttacaaggacatgttagataaagccataccgaacctaaccaaagcccagcaagagtattgtaaggctcatttggattccaatgaatgtgttggcaatccgcccacgcccaaaaccagtgatgaggtatttgccaacttatataatgccaccatcaaaggggtgagtgtcaaaggcaaactggatttgcatgccatgacatcaaaactgccagatggtcttgaaatgaccttgggttatggtcataccaaattggggaaatttgattacattgcacccaaagatgccgatggttggtatcaggctcgccctgctttttgggatgccatcaccccagcgcgctatgtggtcggtctaaactatgaccaccccagtcaagtatggggcattggcacaactttaacgcacagcaaacaaaaagatgaaaatgagctaagtgcccttagaatccgaaatggcaaaagagaaacacaaaccttaacgcacacaatacccaaagcctataccttactggacatgacaggctattatagcccaactgagagcatcaccgctcgtcttggtatcaacaatgtattaaacacccgctacaccacatgggaagcggcacgccaactgcccagcgaagctgcaagcagtacccaatcaacccgttacattgcaccaggtcgcagttactttgccagtcttgaaatgaagttttaa

SEQ ID NO: 838 - DNA, 1242 bp, M.catarrhalis
gatgaaattatgaaacgagttgtcatcacaggtgcaggcattgtttcttgcttgggtaatgatttagatactgtcaaggaggccttagaaaatgggcgttcaggcattcgctttaagcaagaatatgccgatttgggatttaaatcatgcgtggcaggtagtatagatcatgatgacttggacaccacaggcattgatcgtaaattaaagcgctttatgagcaacgccagcctttatgcatatatcagtgctttatcagcaatcaaaaacgcagggcttagcattgacaccatcgctgacaatcctagggtttcggtggttgcagcatcgggcggtgcttctactgctgatgtggtggcagctgcggatgccatgcgtgaaaaaggcttgcgtggcgtaggtgcaatggcagttcccaaaatcatggcaagctcggtatccgcggccttagcgacggggctaaaaatcaagggcttgtcttactcgctatcttctgcctgtgccacttcaagccactgtgtcggtcatgccatggagctgattcaacttggtaaggctgatatcgtactggcaggcggcggtgaaagtgagcattggacgcaatcgtgtatgtttgatgccatgggtgcaatgagtacacagtacagcgatactccacaatccgccagtcgcccctatgataaagatcgtgatggctttgtgattgcaggcggtggtggcatggttgttgttgaaagtcttgaatcagcacagtcccgtggggcaacaatcttggcagagattacaggctatggtgcaacttcagacggtgcagaaatggttgcaccaagtggcgaaggtgcggtcagatgtatgcaaatcgcccttgctcaagcaggattagccagtgttgattacatcaatagccacggcaccagcacaccccttggagatatcacagaacttaacgccatcgcaaccgtctttggtggagcaaagcaaacaccacccatcagctcaaccaaatctatgacaggtcatagtttgggtgcggtaggtacccaagagctgatctattgtctgctcatgatgaaccatgagtttattgctccgacgattaatatccaaaatttagatgacgctgccaaagattttgacatcgttacccaaactcgtcaaacagcactcaatagcatcatgagcaatagctttggctttggaggtaccaacgccgctttggttatccaaaaatttaacaattaa

SEQ ID NO: 839 - DNA, 492 bp, M.catarrhalis
tttagccctataatatattgccctaaatggggatttgcgttattggttgaaagtaccaaccaagatcggtgcttgattgatgacgaatttttaacaacaacgggagaaaattgccctatggcaactacaaaccagcttatccgcaagggtcgcacaaccatcaaggaaaaatcaaaagttcctgcgttgcaagcgtgcccacagcgtcgtggtgtgtgtactcgtgtctatactaccacaccaaaaaaacctaactcagccatgcgtaaagtttgccgtgtacgcctaacttcaggttatgaagtttctagctatatcggtggtgaaggtcacaaccttcaagagcatagcgttgtattaatccgtggcggtcgtgtcaaagacttgccaggtgtgcgttaccataccgtacgcggtgcacttgactgtgcaggcgtgaaagatcgtaaacaaggccgttctaaatacggtgctaagcgtcctaaggcgtaa

SEQ ID NO: 840 - DNA, 1635 bp, M.catarrhalis
agttttaatatgacctgtttaccaaagaccaaccctgctttaaaagtcaagcacagatttttaaagcaggtgctgttattgctttgtgttgatacattaacagcacaggcgtacgcccacagccatcatacgcccattcatacacccacgcatgagctgccatctgctgatgctttatcagatgaaggcttgggtaaggatttgggcagtttggacagtttggatagcccagatggtttgggtgatggtttaggcgatggtttgggtgatggcttaaaaagtgataaagcccctttacccatcaacgccttgaccgcccatcagaccaatgagagccagcctgccccaccgagcgtagatgtcaattttttacttgcccagccagaggcattttatcatgtctttcatcaagcgattgtgcaagatgatgtggcaacattacgcttgttattgccattttatgaccgcctgcctgatgattatcaagatgatgttttgttgttatttgcccaaagtaaacttgccctaagtgatggcaataccaaattggcattgaatctgctgaccgatttgagtaacaaagagccaacacttacggcggtaaaattacaacttgcttccttgttgctgaccaacaagcacgataaacacgcccaaatggtgctagatgaactcaaagatgatgcccactttttaaaattaagcaaaaaagagcaaagatgggtgctatcgcaaagtcgctatttacataaaaaatataaaatgggcttggatttgggcatcaactatctgcatttggataatatcaacgccgcctccaccatcacccagcccaatattaaaaaagatgccccaaaacctgctcatgggcttgccttatcgcttggtgtgaataaatacacgccgcttagtcatggcatgagtatttatacagccctagatgttgatggtaaattttatgatgacaaaagccacaatgaactggcggtttttgctcatgctggactaagaaaagatcaccaaaaaggttatgttgatgtcgtaccttttgttgggcgtatttttgccaccaatcagcagcatggcagattatcccccagaaaagacagtcagggcgtggcgtttggcagccatcatcggatcaatgataaatggcaaaatgcgttttttgcacgcatggaaaaaggcaattataccgagcgttatcaaggttatgatggcaagcgttatcatgtgaatgacaccattttgttgcaagatggcccaaatcgtcgctactctttgggcgtggggtatcagcttagccatctgcaagatgcaacaaaaagcagtcatgccacaaagatacattttggggtgttgcaaagattgccaaatggtctgaccgtgcaaggtagagtgagtgctgagcgtgagcgttatcatggtaaattattgcgtctggttaatcctgatgatgtgtatcgcacagataaaaccctaaccctacaaacctccatttggcacaaagacattcactggcttggattaacgccaaagctgacttatcgttacagtaaaaataacagtaacttaccagcactttatagccataacaaacaaaatttttatttggagcttggtcggtcgttttaa

SEQ ID NO: 841 - DNA, 1458 bp, M.catarrhalis
actaaaacaatcagaccactcccctttttcttttttgtattttgctttaaaatttgtatttttatttgccatttgataatgctaaaacatcactttgccaccacatacaccccaagtcaaatcacagctctcatcacgacgcatcaccctgattggcaagtgtgctttttaaataatgcacatcgccctgtgattgggatttgtcctaaggttgcatggacagccacttttgataaaaatctgtacattcacaaaaaaactcgtcaagcagatggggtacagagtttaaatggacgacgctacccatctacttatgacaactggcagcatgagctgacggcatatgccaatcaaatgaatctcgatgattatcatggcttaaatcatagcagctatgtgcatggatttatgggatttattagctatgatttatcagcacatcagttaaatcatcgcattaccctcaagccgaatcaaccttgtggctatttggcacattatgatatttatcttcagcccatcaaagacggctataacttaattggcatgggcgtttgttctgaattttttcagcatattacccatcagttatctgacttattatgtcgttgcctgcccacagcttcgccgatagactttcagcctatttggacaaaaacagagtatgccaaagcattttatcaaacccaagaatatctaaaagcaggcgatacttatcaaattaatctaacccaaaaatggtatgctcatttagaccgtctggcaaaccacttgcctgatttacaagacacaatgaatgcaccttttgcaggatttttacaattgggggaatttgaactactctccatctcaccagagctattttttgaattttacaaaacaaacggtaaaatccatctgatcaccaagcccattaaaggcacacgcccacgccatgcagaccctattatagatgatgagcttaaacaatctcttgcaaacagcgaaaaagatatcagcgaaaatctgatgattgtggatttgctcagaaatgatttgggcaaatatgcacaaattggtacggtcaaaacgcccaagcgtttcgccatcgaaagctttaaaaatgtgcatcacatggtcagcactgttacagcgacgctcagtgatacgcatccaattaccgtcttattcggctcgctgccagctggctctatcacgggtgcacccaaaaaacgggcatgcgagattatccatgagcttgaaacctcacctcgcggtgcctactgtgggacgatgggctatatgaattttgacggtacaggcagctggaatgtactcattcgcacactacaaaaatggcaagaatgcgagatctgggcaggtggtggcattaccatcaaatcaaatgttgatgatgagtatcaagaatgccaagataaaattggcactattttggcaaaaatgtctaagccaaaatag

SEQ ID NO: 842 - DNA, 690 bp, M.catarrhalis
ggtgcttttttatcatccgctgtttgtaacagcaaaatcaaggtagtaaccatgagtgaagaaaaccaaaccacagttttaagcgatgacacgcaaaaccaaatcacccaagagcagtacaacaagctacaagcagaagttgaacgattgcgtaaacacagcgagacccttttggctgaaaaaaagcaacaaagcgaacagcgaaaggctgagcaggctgaaaaagagcgacttgccgaagagactgcacgcaaaaagggggattttgagacgctagaaaagcagtatcaagccaaaatccaagagttaaacgagcaaatcgctaagcgtgataaagagcgtgatgagaatttggtcaaatcacacgcccaaaagctatcaagtcagttaagcgataaccctgctaaccaagagattttacaaatactcattgaaaagcgtttgttcgccaaagatggtcagctaagcgtgttagatgacagtggtgctgtatctatcatgacccttgacgatttggcaaaacaaatgcaaaactgtggtaaatacgacagcttaatcattggcacaaaatcctgtggtacaggttcaaacggtcaatcagctaagcgagcaggtgattacagtgaacaagagcgattagcacttgcccactcaaaccctgctttatttaatcaattatttttggagtaa

SEQ ID NO: 843 - DNA, 318 bp, M.catarrhalis
atggtaaacccaattctgctaaactgcctattaccaaagccacgcttgggcagcttcgcaaacaagcaggcaaagaaattgaacaatggtggcaggagcaatttggctatgatttctcacaatttaccgaatcagaagcaagataccttgcaaaacaaattcatagatatggcattgacgccatcagagatatactctttgcgtcaagaccttaaagatgcttataagcaaggcaaaggcttttttaaggagcgtgctaggcggctgcagagcacttatacaagccaagataaaatccttgcgccaaagcaaagttga

SEQ ID NO: 844 - DNA, 381 bp, M.catarrhalis
ggtgagctttacaattcagctaaggggcttttaatgggcattaaatggaataaaaagcttagcattgaacccattgctgataagattgacgccacttatcgcaaatttgccattgactgctataacaatgtcatcgccctaagtcctgtgcgtaaagggcgttacaaaaatgcccatcatatcagcattggcagtcctagctatgccgagacaggcggtggcattgaacttatcttaggcattccaaagcacacctacccactcatctacattcaaaacaacttgccctatgcgttgcgacttgaacacggctggtcacaacaagccccaacaggggtttatggcaatgcctttaacagtgcattgggcaatctatcatag

SEQ ID NO: 845 - DNA, 228 bp, M.catarrhalis
tcaccaacctataaggagaaattcatgtcattaccaaaagataaggttaagcctgcttttaattttacctatccatcagagcgagcgtattttgatgaaagcaaaagcacgctgactaacgcacaggtaacagaccctgccaaaagtggggcagactacggcatcaaagacccacaggtcaccgaagcactgacaggtacaaagagcgagaccgctaaggttgaataa

SEQ ID NO: 846 - DNA, 510 bp, M.catarrhalis
tcactgcatctgctttacaagccctacttacttcatttgttgccaccgaaacggtacaagcaccaccgctcaaccgtcaagaatacaatgatttgcgtgggtggcaagtgcctgacaatgaaattcctaacgatgacggctatcttgtcgttaatgcaggtgtgtccgaacgcaatgtggacggctttgatggttatgtgtcgtggttacccaaactttgcgtttgaagagcaatataaaaacgacaatttaacctttgggcaagcggtggagttgttaaaaggcggtaaaaaagtcgctcgtaaaggttggaatggcaagggtatgtatttgttgcttgctaccgacattgattttaagactaaggctaatttgtcagatatgcagaatgaaaatggcgaactgaccgtgccatctatcacgatgaaaacagcagacaataaatttgcagtcggttggcttgccagtcaaactgatatgttggcagaagattgggttgtcgtacagtaa

SEQ ID NO: 847 - DNA, 570 bp, M.catarrhalis
ttttgtattaaaattacccccaaactattaaaggttatgataatgtacgtattgtgcttgttccatgccgaagacaagctagggcgaaacaaaatccccatggcttatgctttagctttatcagaaatgcttggtgtggatatgatttggggtattgtacaagctaagcgtgcttatcgcacatcatctgatggcgtgggtagactcttaaaacgtgtcagttttgatggtgttgtattaagtggccatcattatatgattgttgatgatgtgattacccaaggtggcacattggcggatttgcgtggctttattgagagcaagggtggcaaagtaattttagccagcaccttgaatggtaaacccaattctgctaaactgcctattaccaaagccacgcttgggcagcttcgcaaacaagcaggcaaagaaattgaacaatggtggcaggagcaatttggctatgatttctcacaatttaccgaatcagaagcaagataccttgcaaaacaaattcatagatatggcattgacgccatcagagatatactctttgcgtcaagaccttaa

SEQ ID NO: 848 - DNA, 291 bp, M.catarrhalis
ggaaaaaataacatggcatttgatttaacactcttaaaaaaagacgctaagatgagtgctaagcgtgagattgaatttgatgggcttgaattgacgcttgaaattcaagcaagcgaagcatttaaacgagccgccgctgaggtacaaaagatagcaaacacgcccaaaaaggtaaccaaagacagcttaaagcgtggcaatcaagatgaaattggcgaatacgaagccatgctatttatcttaggtgagtactgtatcagtcttcaccacggggctggaaggatcgacggg

SEQ ID NO: 849 - DNA, 1002 bp, M.catarrhalis
tcaattatttttggagtaatcatggcaaaattaagagagatttttaataaaaatgtcaccttgtcttatcaggttaaagacaacttacagcggtcaaagttttggcaatcaggggcatttgtctcagatgcacgcttacgccccctgctaaacagcggttcattaacctttgatgtgccttttatccaccccattgatggcaacttagaagcgaactattccaacaccatcatgacagatattgcgatgccacgctcaatcgaaggcagtaaatcaaaagggcgtttggcactgttaaatgagggctttattgaaagccgtcttgaaagctatttgctcggtcaatcaccgctaaaacttatggcacagatgattgatgactattggctgacacaagctgaaaaccgtgccattgctaccttgtttggtcttttaaattatgaccaatctaatggtaagaagttatctactgacatatcaaaggcaactgctgatgattcatcaggctttgatgttcatgcgtttattgatgctgagggcacgatggatgaaatgtatcagggcaaaggtttgatggttgtgcatcctttgattgcaaccaagatgagaaaacagcgactacttgagagagtaaccaccgctgatgatttaaagccgattgaaacttataacggtcgtactgttattcagtctaagcgtgcaacagtgatcggtacaggcaaaaatgcaaaatatgtgtcttatttgttaggggctggggcatttgctgctgatatggttgcagggcatgatgatttggagcttgaacgcacggcgaacacaggcaacggctcaggtcataccacgctatggacacgccgtaacatactcatccacccccaagggtttagcttcatcggtgagcctagtacgctaacaggtggcacaaaaaatgaagcgctgtcagcgagttggacggacttaaccacagcggcaaactggcgattggacgctgatgcctga

SEQ ID NO: 850 - DNA, 423 bp, M.catarrhalis
cacttattgagccgtatttacaacagcctttgggaatgtttggcttgcctttggttagggtgtgaaatgggattaaatgctgaaattagtactgaaattacccaagcctttgatactgatttaaaagatgctgtcaaagacttcacaggcaggcgtgtcatcttatctgatgatgattgggcggttaatgatacccaagtactatctaccatcaattacagcggtaggggcgtttttacaggcttttacgcccatgagattgataacaagaccatcatgcaaagcgatgttaagctgatttgcttacaagatgagctgacagagataccacagattgatgatgagattaacgagatgaaaatcatcagtatcagtcatgatcctgctgaggtgagctttacaattcagctaaggggcttttaa

SEQ ID NO: 851 - DNA, 414 bp, M.catarrhalis
  unsure (341): Identity of nucleotide sequences at the above locations are unknown.
aattatacgagcaacacaggggcaatgatggacacagcacacattgaacaaacgctactgacgcatatcaaatcatgggagcattttgatgatgtacccttagccaaagaaaaccgaaactttaaaccccctgatggcatttggggcagggttacaattttgggtggtgtcaatcaagtacgcagtattagcaatacgcctaatatcctgcaacaaggcacgctggtgatacagctgttttgcccacaggatttaggcacggtggcgattaagcaaaaggcggatagcctagctaatcatttacaaacaaggcggtttggtaggcttgaactgttagcccncagcatcatcaatgtgccgtctaatgacggtatttatcaaataaatgtgagtgtgccggatcggtactattag

SEQ ID NO: 852 - DNA, 246 bp, M.catarrhalis
gaggattttatgaaattaatcactgcatctgctttacaagccctacttacttcatttgttgccaccgaaacggtacaagcaccaccgctcaaccgtcaagaatacaatgatttgcgtgggtggcaagtgcctgacaatgaaattcctaacgatgacggctatcttgtcgttaatgcaggtgtgtccgaacgcaatgtggacggctttgatggttatgtgtcgtggttacccaaactttgcgtttga

SEQ ID NO: 853 - DNA, 369 bp, M.catarrhalis
gatgaaacaatgataacacttgatgatttaacagacattgataaggctgatgaacaaaccgtggttattgtcaatgcgtggctaaataagcataagttaataccatttaaaaccataccagagccgataaagcaggcaggcagatacattgccaaagcgtggcttgatggggatttgtttgccacacgcaccgaaggacaggtcatctcaaagtcatcaaaggcaggtgatgtgtctgtttcaaaaacctatgcagatggacagatggggcaggctatgagccaaaacgagcaaatcgctttagcacttattgagccgtatttacaacagcctttgggaatgtttggcttgcctttggttagggtgtga

SEQ ID NO: 854 - DNA, 927 bp, M.catarrhalis
ggcttaggagtagaaattatgtctagtggagcatttgttaaaacggcgtatgccaaacaaacaggcgaaaccctgcctaaaactggctggaaaaccctaccaaatatcagcaatgggctaaccgttgccacagagcttacaaacagtgaaatgctgtcaggctcacgcatggcaaaagcaggtatggtaacatcagcaagtgtgcagggcgatattgagaccgagcttatgtttggggcgtatgatgaattaattgctgctgctttttggagtgaatggtcagcaggtgctagccctaatacgctaagcgttggtgcaacaaaacatcagtttgccatagccaaggattttagcgatattaatgttaaccatgtctttacaggatgcgttgtatcaagctttggtctgacgattgatacttcaagcttgatcaagctaaagtttggcatgacaggtctaggctatcaagaaagtaaaacaacttcatttgccaaaacaccgaccgcccaagcagataccgctaaggcaagcggtttgtctattggcgagattaaagttaatggcacaaaacttgatgtgtgtgttgaaagctttagttttgagcttgataaccaaacagaagtacaaaagtgcttgggcgataatatctatggtggtaatatcttagccatgcttaccaacattacaggctctatgacgattgcttatagccaaaaagcccatgagatgattagtaaccaaatgacaggggcaacgctaagccttgagttgccgattaagtttggtaatagtaagtatgtgattaaaatccccaaatttcaggtatcaggcgaaattccaagcccatcaggcacggatttggttaccgtggatttgtcttacacggtggttgatgaaagcccagtgattgagaaacataccgcctaa

SEQ ID NO: 855 - DNA, 447 bp, M.catarrhalis
atacttgcacccataaggatgaacgggatgatgaacgcagccacctttaccccttatcaacctactgaaggcgaagactatatgtctgatgcacagttagcacattttcgcaccatcttaaaaaactggcgtgaagaattaattacagaagctgaacgcacaaagacttatattcacgaagaaaccaacaccatgccagatattaacgaccgagcgactcaagaagaggagtttgcattggcactgcgtacccgtgaccgtgagcgtaagcttatccgcaaaattgacaaatctttggctgacattgagaccttagattatggctattgtgagacatgtggtacagaaattggtctgcgtcgcctagaagcacgcccaacggcgacacaatgcatcgactgtaagacactgtctgaaattaaagaaagacaaaatcacggtcaatag

SEQ ID NO: 856 - DNA, 393 bp, M.catarrhalis
tatgcacacacttattcccataccggttgtattgcattaaccacacacacaaaaattagaggtatagggagagtatactattttccgaccacactcaaacaaacttttggtgaagtagattgccaaaatcccagagccatggggggagtgtttcctttaacaaccaccaaaaaaccacagagacccgggcgggcggggggggatgttctaaaaaaccaccgccgggagggggcgggaaagcccttaaaacatccaaagagtttttggggtttaggcccaccttcccgattatgcaaaaagtttacccacaccatttacgctttaagagctaatttttccaaccggtcattgggttttatatttgagataaataaagttgttttttttccctaa

SEQ ID NO: 857 - DNA, 771 bp, M.catarrhalis
ccttgtatgaccaagatcaaatcagtgaacaatgaaccgaatatggcagatgataccgctaccaatcagctgcagctgacaacttttcacctaaaactcatcacgcttatcgccatgctcattgaccacatcggttgggtgtttgtggcaacttacagcatgaccgctgagatcatgcacacggtggggcgtttggttgcaccgatgatggcgtattttttggtgatggggctatgtcatacgcagaatcaatgggcgtacttggggcgtcttttggcttttgctgttctctcgcagccgatttttatggcatttcaatatgtcattggcagtgtcgatattatcacgcaagtgctttggggtaatgtactgtttagcttagctgccagcttggcggcattaatgatctggcagatgagcgtacctatgacgcttcgggtgcttggtgtgctggcgatggcgatgattgcagagattggggagtatggggcggcgatggtgatgtgggtgatggtgtttgaaatttttaaacatgacaaactcttacaacttaccgcttatgccctaagcgtccctttggcacattatttgatttatgggtgggcgttgacggtcggtcttgggtggatgaatgtgggtatgttttttgcgttaccactgatttattatcacacaggccagcaggggcacaggctgggtggccgatattttttctatcttttttatcccatacatttattgatgcttgtttgtttggcccagactgtctga

SEQ ID NO: 858 - DNA, 612 bp, M.catarrhalis
ctattgtacgcgacttttatgagaaactcagcaccccaagatgcccaaaatgtcttggcagacgctcaatctctacaagccattgacacagacgaaatcagcacccgccttgccaaattggcacaaacacctgatcagtttcgtaaaattaataccttcatgaagcgtcgctcacacatgagccattatcatgaacactccttattagacgctcattatcgcgctctttatgtcaattcaaccgatgagcttggcaagcttgacgatatctcaacaatcaaagatttacgagttttattgacagatacgctctatggcaatgatgcgtctttggcgcttgaaacagaatttggcatgggcaatagcttgtttgagatggctaatagtgcccctgaaaccaactctgttggcgttgaagttcatgaaccattttttgttcgttcggtggcgtgggcagatgactctacacaccacgttctattcatcatggagggtgatgctgtggcaatactggtgatctacccgcccacacaaaggacggcgtgtggttggatttttttgattttagggaaaaaaaacaactttatttatctcaaatataaaacccaatga

SEQ ID NO: 859 - DNA, 303 bp, M.catarrhalis
gacaaaccggctttatgtttatcaaactttatgtttatcaaaaaatttgttaaaataaaaattttacttgacactctgaatggaattttgcaaaatggaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaacagcctaacgactgtccatcattaccgacttttttggtga

SEQ ID NO: 860 - DNA, 1866 bp, M.catarrhalis
attgatattcatatcatgacaacaacacacccccaagctgaaagcccaacacaaaaaagacagcgactaaaacaacacgccaacgccctacccaatcgtccaggcatttataaaatgctgggtaaatcaggcgaaattttatatgttggtaaagcaaaatcactaaaaaatcgtgttggtagctattttgccaaaaccatcgaacacccaaaaacccaagcactggtacaacgcattgaacagattgagattatcatcacccgtggcgaaaccgaagcgttattactcgagcaaaatctcatcaaaaaccatcgaccgccttataatgtcctactaagagatgataaatcttatctatacatctatatcagtacggataaatttcccagactgtccattggtcgtggtaaaggtcggtatactcaagggcgtttttttggtccttatccatcggcacgcaatgccaaagaatcagtacagctgatgcagcgattatttatgattagaagctgtacgaacagtttttttgcacaaaggcagcgtccttgtctagaataccaaattaaacggtgtaaagcgccctgcgttggtatggtttctgccgaacaataccagtccgatgtgcgtgctgctttggcatttttacaggggcattctcatgaagtgcaagccattttggtcaaaaaaatggaggaagctgctgcggcattaaactttgaacaagccgccttttatcgagatcggcttgccatgattagcgatttacaagccaaacaggcagtatttcgcctacagggtgaagcggatgtctttgccattgctgctgatgctggtgcggttgccgtgtgtgttttgacggtgcgaggcggtcaggtattgggggtaaaaaactattttcctgatgatatcgaaccagccattaagagcaaccaagagcgtttaaaagaatttttattgtcgttttattttcaggtgagtgatgatttgcctgatgaaattatcagctctgttgctattgaagaggcatctatattggcagatattttgcaagtacagtttggcaaacgcaccacgattaagcacaaagtaaccacacaccgtgatgattggttatccatcgcaaacttaaatgccaataatgcgttatcagccaagctcaaagacagtcgggagctacaagcacgatttgagcagttaaaacaagtgcttgcccccatcaccacttgcaccattgaccgtattgaatgttttgacatcagccacaccatgggcgaagctgccatcggctcatgtgtggtgtttgaccaaaatggcccaaaaaagcgtgattatcgtcaatatgccattcatgatattaccgcaggcgatgattatgcggccatgcgtcaggtcttaatgcgtcgctataccaaacatccgttacctgatttattattgattgatggtggtaagggtcaattaaatgttgccatcgaagtattaagcgagcttggcaaattaaccgatactttgcttgtcggtgtggcaaaaggtgaggggcgtaaagctggtcttgaggtactacattttgtgacacatgagccgatagatttgcctgctgatagcaaggctttgcatctcatcatgcaaattcgagatgaagcgcatcgatttgccatcaccgcccaccgcaaaaaaagagataaaaaacgctcaagctcagtgcttgaggttatcccagggcttgggcaagtccgcaggcgtgatttattaaatcattttggcggtatacaacagctgcttggtgcatcacaagatgagatcgcacaggtcaaaggcattgggcccatgctggctggtacgatttataaggcattgcatgaataa

SEQ ID NO: 861 - DNA, 1002 bp, M.catarrhalis
aagcacgcccaacggcgacacaatgcatcgactgtaagacactgtctgaaattaaagaaagacaaaatcacggtcaatagcccattgatacctagacccattgggcgatttgcaccctcgcccacacaccatctgcatttaggctcgctgaccacggcggtagcgagcttttgtcatatcaaatcattaggtggtgattggctgttacgcatcgaagatgtggattttgagcgttgtcagcctaagtatacagacagcattttacatgatttggataagcttgggttacattgggacaaagaagttacctaccaatctaaacgcacagatatttatgatgagattttatccaatcgattatctgacatcacttatgcctgccaatgctcaagaaaacaacttgaggcacaccgaaatcaaaacgctaagccccacgcactcaaccagccaaccctctacccacgcttttgcctacataaagatttggataaatctcaccccaaaagtaaaattcgcttacagctgcccaatgttgagacagcatttgtagatgagctacaaggcgtgatttgggataatcctgcgttaagccttggtgatgttgtggtcaaacgccaaaaccaaatgattaattatattttggcttgtgccattgatgatggcttgcaaaatatcactcacatcatgcgtggactggatattatgcccatgacagtcgctcaaattaatattttacataaatgtcgcctaccaataccgagctatttttatcatttgccattactgatgaatacagatgggcaaaagctatccaaacaaaatcttgccacaccaatcaatacaaccaagcccagtgaaatgcttttatacgcactaaagctattaggtcaacacaccgtcaaagaaatgcgtgccgccaaaccgcataagattcttcgccacgccattgagcattgggataataccccgttaacgcatcgccacactttggccatcatttaa

SEQ ID NO: 862 - DNA, 2310 bp, M.catarrhalis
aaaatctataacttgccgaccatgaccacaagcccacagcagacgccaaaattagttgcccaagtggcactggcagtacctgtggctgatttttttgattatttatgccccagtcatctgcccttgcccaaaatcggtgccagagtgctggtttattttggggctaggcggctgattggtgttgtcattgaactgattgacgcatccgacagtcttatcgcacctcataagcttagacctatcaaacaattgattgatgatgacgctatcattgatgatgaattgctcaaactggcgagctggctgtcttcttattatcatcaccccttaggcgatgtctattgtgtgatgctgccgacactcatcaaccaaggcaagcccatatacgccaagcagcgatattacaaggccatctgtgatgatacggccatcgatcagttgccaaaaactgccaaaaaacaacgacaaattttaacacatctgatggcatatccagcaggtcttgggactgacaaacttcgccaaatcggtgcaacacgctctgcacttgatggtcttatcaataaaggtcttgtcatcactgatgagcatataccgcccaacaaacagccaccaccagtacaactcaaagaacctaagcttgatgccaatgacgaacaacagattgccttagatgccattaagaccgccagtgatttggggcagtatcaagggtttttgttggatggcgtgacaggttcgggtaaaacggaagtttatctacaagccatgcaccatgtgctagaccaaggcaaacaggtgctgatactcgtacctgaaattgggctaacgccccaaaccaagggcagatttgcctcacgctttcatgccaatatctgcgtgttacactccaagatgaatgacaccgaacgccttcaaggttggcaggcgtgtcgtttgggtcacgcacaaatcatcatcggtacacgctcaggtatcttatatccttttgcaaatcttggcatgatcattattgatgaagcgcacgatgcgtcatataagcaacaagatcatcttcgctatcatgcctgcgatgtggcgatgatgcgtgctttatttgccaagattccaatcattttaggaactgccacgccaagtcttgagcagctcaaactcatccaagatggcaaattaacaccactcaccctaaaaaatcgtgcaggcggtgctcaggcggttcgtatgcatttggtggatatgcgattgggtcgctctcatgctcagcatctcgatgggacaatcagcgataccgcttttgtacccaagacaattcaggcgatgcgtcattgcttggccaaaggtgaacaggtgcttgttttcttaaatcgtcgaggttatgcaccgattttaatttgccgaagttgtggtcatcaagccaattgccccaattgcgatgcacatttgaccgttcacaaaaaaagcgtacagcccatgcatggtgaactacgctgccatcactgcggctatcgtgcgtccataccgacaacctgccctgaatgccacagccctaatatggacagttttggtgcaggcacgacccgcctagttgagcaactacacgcattatttgccaatccacaagtcagccacacaacctatccgatttatcagatcgataaagataccatgcaaaaaaaagatgcatggactcagatgaccaaaaatatcaatactaacagacctgctattttggtggggacacaaatgattgccaaaggtcatcattttgaaaatgttacgcttgtggtcattgccaatgctgatttgggatttttatcggctgattttcgctcgcctgagcacaccgcacagcgtatcatacaggtggcaggtcgagcaggtcgtgccaaaaagccaggcaaagtcctaatccaaaccttacagcctgataataccctactcactcagcttgtgcgtcaaggttatcacgcctttgcccacgaactattacacgaacgatcgcagttgggattaccaccttttagccatgccgtactcattcgtgccgaaagtttacaccatcagcaagcaaaagacgccatcatcgccgccaaaggattgataccagccaatcacccttttgccatcaatgcacccatcgatgcacccatgaccaaaaaaaataaccgctatcaggtacagatgctcatcttggcaaaaactcgcccgcccttgcatgaatttttgcagacatggtggccatcagtacagtcactaccaagcagtaaagcggtacgcatgagtatcgacattgacccaatgggctggtga

SEQ ID NO: 863 - DNA, 2220 bp, M.catarrhalis
ccattaatcaaagtgaatttgtacgagccatctatgccagacagccaagaccttacaacaccgaccaatcttagccacccgcttgtggatgaagctcgtgacagcctgatgcgtgccgtcgcctatctaaagcctgatgagcgtgccgatgttttgcgtgcctgccattttggggatgtcgcccacatcaaagacaaacgaaaatctggcgagccttatatcacacaccccatcgctgtggcggagattttggcaggctttcgcttagatcgtgacaccatcgttgctgccattttacatgacaccatcgaagataccgaggtgaccgatgagatggtcacacaagaatttggccaaatggtcgctcaacttgttgatggcgtgacgaagcttaaatcctcaggcatgagcaagcaacaaagccaagccgccacttttcataaaatcttgacagccaccttatccgacccacgggttttgattatcaagctatctgaccgcttgcataatatgtccacgctcgatgctgtcagcgaagaaaaacaaaaacgcaccgccaaagaaacactggatttttatattccttttgcacgcctgatggggcttaacagcattgcagattatattgagctattatgctatcgcaatttaaaccctgatatgtacaacaaatttacagataaattattacagcatggattggggcgtaattttcaaaaaaccgaaattagcacttatctacaaagtctgctgtcgcatctgaatttggacggtcatgtacaagtccttgataaccgtactgcaatgtatcggcagttttttaaaaatcgtggtcaaatcagccaattaattcgccaatatgattttgaggttatcttaaaagatattgaagcttgcgacacgctggccacttatttgattcaaaaataccaaattggcaatcaccaaattcatgacaacattcgcaaacctttggcaggtggcaatcagtctttaaccttattttatgaccgtgattataatcacattaaaattacattaatgacacgccgcatgcaagaggctgctcggctgggtatcatcagtaatgaccgagctggcgtcagtcagtcagtcatccaagccagccttcggaatatgcaagatttggcaaatgctggtaaagcagagggtgatgatgcccatgttgtcatcattgaggagttaattagctatctgcacgagcgaaaaattgtctgttacagcccaaagggtcgtgcctatgagctacctcgtggctcaacggcgttggattttgcctatgcggttggacctgccatcgggaacattgctacgggtgctgacattaatcataagcatggtaagcttgggctagtgctggctgatggtgatattgtgagcattgacacggataaaaatgccacaccacgcgccgaatggctcggctttgtcgctaccaacaaagcccgaaatgagattttaaaatttctaaagcatctgcctgaagaccaaaagattcattatggcaagcaagcactagaccgtgccttaagcacttatggtaaaagtatcactgatttaacggatgatgattggactgatattctaaaatggcgtggtatcagtacgcctgatgagctatttatgcaactatcaacaggcatgctattgccacagcttgtggtttctcgtttatttagtgaagagattgatacggctgatgaccatgaaattactcgctctaaacatctgctggcaggcatcaaaggcgtggaggtggattttgcacgctgctgcaatccgatttatggcgataccattgttgggcatttgtctcgccaaggtttggttgtgcatcgtcataagtgctattctttacaagcaatacgcaccgatacaccttaccaaatcattcacttagattggaaatctgatcaatctttacaaaatcaacctgatgcgctgcgattccctgccatgctgcgtatttatgccagtttaaacgaagagcaaatcagccaagtcatttatgaaatgcgtgtgctgaatatcggtgttgagcaaacacacatcaaaacagataccaagtcagaccaaagcagtaaagtcggtacaacaacgctgcacattgtggtacgctcacgctctcatttggcagagggcatcgaaaaattacgcacattgcttggctatccaaacatcatgcgactgtatcaatga

SEQ ID NO: 864 - DNA, 255 bp, M.catarrhalis
agaataaaaaatctctgtcagcttcagacctgcttgtggatcggtggttgggattttggtatttctaagggtgtctttggtcacgatgtttggctttttaagtgtcaagtggtgataaaatgcgatattgtaccaaacctctacataaatggcgaatggattatcaatgatgcatgctgcttaaatggtaaaaactggcttgatagaaaagttatcatctgcattttaaaaaattatcattgtcttgctatttaa

SEQ ID NO: 865 - DNA, 183 bp, M.catarrhalis
aataagtacctaagccgtgttatcaaccaaaacccatatatcaaaacctatacaaaaagtatgggttttttcgtcaagcaattatgcttgttctttcaacccttatctgagatggtaatccgatatgagcgttcactctataaatcatgcccccacagcccccaaagatggtgcaaccaatga

SEQ ID NO: 866 - DNA, 648 bp, M.catarrhalis
caaactatggatatcttaaccaactttcccacccaactgctcatttactcacttgatatgattggtatcagtgcctgtgccatcgctgcgacaactttggcaatgtataagcggtttgatttatttggctgtatcttagtttcaatggtcaatgccattggtggcggtagcctgcgtgatatcatactagaccgtcatccgctgttttggatgactgatttaacttatgtcatactcattacaacaacatccattatctgccaactgttttttcatcgccttggacacattgaccgtgctttaaaattttttgatgccattggtcttgctgtgtttagtgtgattggcttaacggtggcgttatcgtttgatgcccatccactgattgccgtgatgatggcggtgatgacaagcatcgcaggtggtatcatgcgtgatatgatttgtaacgaaattcctttggttttacaaaaagaaatttatatcagtgccagcattatcggttctgctttgtatttagttttagaaatttggggatttgctgactggataaaacaaggtctggcattagtcagtatctttgggatacgcatgttggcactaaaatttgattggcacttaccttcaattgagcttaaaaaatcttga

SEQ ID NO: 867 - DNA, 192 bp, M.catarrhalis
atggaattttgcaaaatggaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaacagcctaa

SEQ ID NO: 868 - DNA, 1701 bp, M.catarrhalis
ggctttaattgggcaggtgaatcaaccgtttatcaagccctacaagcccctaccaataacacgctcattccttgtcctgccgagagtgtggattttgataccacacaaaacatttttattgaaagtgataatttagaagccctaaaaatattacaaaaatcctatgcaggcaaaatcaaaatgatatacattgatccgccctataatacgggcaatgattttatttatcacgatgattttagccaaagcaaaaaagagtatgaaattgccacaggcgatagaaatatcaatggcgaattattaaaatcctttaaaaagaacagcaaagacaatgggcattatcattctaattggcttaatatgatgttgccacgattgcatttggctcatactttgctttctgatgatggcgtgatatttatcagtattgatgataatgaacaggctcaattaaaattattatgtgatgagatttttgggggagagaattttgttgccactcttccaagacaaacatcagctcaaagaccttcacaagaaaaatatatttctattacgcatgactatctattggtttatgctaaaaataaaaattatgattttaactctgtaattgaaagagatttgtcaaatatcaaaaaagatagtaacggaacatacatagaaggggatacaagccctattctagcatcatctactcaaggttattcggctggtggggattatgatattgaattcaatggaaaaatatttaagcctgaagatagtagagggaacagaagacgctggctttggacaaaagaaagaatgaatagggcgatagagttagggattattattgaaacaagaacaacattgcgtgttagaaattatattgataaagaatttcaagttgggacaaatattttagtggataaaaatccaaatttaattctcacttccaatgatttaattaatccaaattataccaatcacaaaggcacggcttgcttgcgagatttattgctagaaaattattttgatttttcaaaaccattagatttaatcaaaattttagcaaaattactaaatggcgacaactccattatcctagacttttttgcaggttcggcaaccaccgcccacgctgtcatgcaattaaacacagaagataatggcaatcgacaatttataatggtgcaattaccagaattaaccgatgaaaaaagcgaagcctataaagctggatttaaaaccatcagcgaaatatccaaagaacgcattcgccgtgcaggagcaaaaatcaaagccgaaaatcccgataaaacccttgatacaggatttaaggtatttaaattaagtgatagtaattttaaagcgtggcaaattgacgatgatgatattgccaagcaattagaaatgtatattgaccccttaaaagataatgccaatgagatagatattatctatgaactgttattaaaaatgggattaaaattaacggcggatattaaatttgataacggcgtttattggctaacttgtgaaaataaatcgtatgccattgtgctaaattcattatcccaagatgagtttaacgccattattgccaaaaaacccgccaaaaccgttgtattggacaaagcatttttaaatgacagcgaaaaatccaatataattttgcaatttaaagatgctggactaaattttgaaagtatttaa

SEQ ID NO: 869 - DNA, 240 bp, M.catarrhalis
cactctgaatggaattttgcaaaatggaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaaccaacagcctaacgactgtccatcattaccgacttttttggtgaataattag

SEQ ID NO: 870 - DNA, 924 bp, M.catarrhalis
tatcatataaggtcatctatgtctaaaacgccacaatctgccatcattcccgaccattgccgtgctggcatctttatggagggcgattttatcaccaacaacacggcaaccatcgcagatgcctgccgccaagctttgcacactttaaatgagctacaagccaaatttactggcgaatctttaggtctgactattggctttggtgcacaagcttggcaacgctttggctataccaaagaaggcggtcaaatcaaaccatttcgcccattgggtaatggtctggcacctgccacgcagcatgatgtgatgtttcatattcagtcaatgcgtcatgatattaattttagcctagcaaaagaattggtagcgatatttaaggatatcgtccaaattcaatcagaaacgcatggctttcgctgggtagaaaaccgtggcttagaaggctttgtagatggcactgaaaacccccaagatgatgccgtgagtggcgtggctgccatcgctgatggtgatgatgctggcggtagctatgtgcttttacaaaaataccgccacgacttgaataaatgggataagttacctgtgtgcgaccaagaaaattctattggccgctcaaaagttgataatattgaatttgataaagccaaacgcttatcagattctcatttgggtcgcaccaatcttaaggaagatggtaagactttggaagtggtacgcaggagcctgccttttggcacagtgactggcgaacatggcttaatgtatatcgcttatgcagcacggctatggaatattgaagctcagctacttagtatgtttggcgagaccgatggtaagattgatttgctgcttaagcatgtcagtacggcggtttcgggtgcttattattacgcaccttcggttgaacgcttagaaaatctataa

SEQ ID NO: 871 - DNA, 1383 bp, M.catarrhalis
tccgatatgagcgttcactctataaatcatgcccccacagcccccaaagatggtgcaaccaatgactactacttgacccgtcaaaatcagatggagtctaatgtcagaagctaccccagaaaactccccctagccatcgccaaagcccaaggctgttgggtgaccgatgtggagggtaatgagtatcttgactgtttggcaggtgctggcacattggcattaggtcataatcatcctgctaccataaacgctatcaaagatgtgttagacagcggtttgccattacacacccttgatatcaccacgccaattaaagatgcgtttaccgaaaaactgttgtcatttttccccaaggattttgtgctacaattttgtggcccgacaggggcggatggtacagaagctgccattaaacttgccaaaacttatacagggcgtgataatgtcatcgcatttagcggcggttatcatggcatgacacatggcgctcttgccatgacaggtaacttatccgccaaacaaaaggttggcaatctcatggcaggcgtacagtttttgccttatccgcatgagtatcgttgtccgttggggctgggcggtgaggctggtgtggatgccttgacttattattttgaaaacttcattgaagatgttgaaagtggcgtggtcaagcctgccgctgtcatcttagaggccatccaaggcgagggcggtgtcgtccctgctcccaaaaaatggctgcaaaaggtgcgtgaagttaccgcccgccacgacattgtgcttatcctagatgaggtacaagcaggatttgcccgctctggtaaaatgttcgcctttgagcatgctgagattgtccctgatgtggtcgtcatgtcaaaagcggtgggcggcggcctaccccttgctgtgcttgccattaacaaaaaatttgacgcatggtcgccagcaggacatacaggcacattccgtggcaatcagcttgccatggcagcaggctataatgtattaacccaaatcagccaaaacaatttggcagacaatgcacgcattcaaggtgagtttttgcgcacagaactccaaaaaatcgcgagccagtacccttgtatcggtcatgtgcgtgggtgtggtctgatgatgggcattgagattgtggatgaacgccaagaagctgaccacatgggttcatatcctgccgacggtgagcttgccgccgccatccaaaaagcctgttttgataataaactgctgttggagcgtggtggtcgtggcggtacggtcgtgcgtcttttgtgtccgattaccatcactaccgacgagtgtgaacaggtcatcactcgctttaaaaaggcggtgggcgaagcggtgaaagcagtgcgtggctaa

SEQ ID NO: 872 - DNA, 561 bp, M.catarrhalis
ttaactaggagaaaaacaatgaaaactttaaaaacactattggcagtatcagcttcttcgttattggcgatgagtgctaacgctgccatcagctatggcaattctgctgatgcccaaccttatgttggtgccaaaattggtcaagtagatgccaagcaaatcaacggtaaaaataccgcttatggtatttatgcaggttataactttgaccaaaattttggcgtagaagccgaatttgttggttcagacgccaaagaatttaatgcaggtatgagtcctgtaaaaggtgatgtgaagtcttttggtgcttatggcacatatcgctataacttcatcaataccccattttatgccaagggcaaattgggcattgctaagactaaagtagatgttaccagccgtaatgcaactacatactcaaacaaaagcgacaaaaccagcctagcaggcggtgttggtgttggctttaaaccattagcaaatgtgggcgttgaagcaagctacaactatctatcagaagatgccaatgcaattagtttgggcactcatttggctttttaa

SEQ ID NO: 873 - DNA, 189 bp, M.catarrhalis
ggatgtcttatgtgctgtaaaatcgaccttaatagccaaaaagacgctgcacattttcttggtaaagttgaaccaaccctattgccaaaaacagcggacaatgtcgcaccttcgaacaccgtctatactggcgaagcgatgagcctatttgataaacttgttgcctattttcgcaccaagcacatctaa

SEQ ID NO: 874 - DNA, 972 bp, M.catarrhalis
tcgctgttcatcgcatttaaccaaagagttgccatgtttcgcctaccttttttagaagatacaacgccgccaccattttatcaaagtcatttgagtgatgatgaacgcacccgattggatcgatggtttattggtcatcgctcccaagcgtactatttgagacgatttgctgagtttgatcgagtgggtcggttacacgcaaaatggcattgggcggcattttttatgacatttggctggctgctgtatcgtaagcgttacttagattgcgtggtgtattgtgtggcaggctggtcatttattaaggttaatattgtcatcatcttggcagtggcagaatatgcattgattggatttttggcagatggcatgcagtggcctgtgcgtattttgattggtcttgcggtttgggtattttggtcgggcatggtcgcacgctgggcggatgcgtattattatcgcacggctcgccgagaaattgcagatgctctagagctataccctcgagatgaagctgcacaaaaacagcatcttaggcgtgaaggtggtgtaagcttgcttggtttgtcggtggcatttgcgatgtttgggctaattttatcaatcattgttgggcggtttgtaccgatgtatgtcaaacaagctgagcaaaagcttttgtttgatgtctatagcgaagccaatgcggtggttaagcgtgtggatgtgattatggcgaacacaggtcaatgcccagtcaatttacctgtcaccagcacacatcatcgtgctgatatccaagtggtgacacaagcagatggtattaataccaaatgtgctgtcgttgcgaccgttttaaaggcatcttatccacttagctatctaaaagggcgaactttgacaatatacagtacgcctacccaacatggattggtatggcgatgccaaacctctttatcaaaaaaacaaacccccaaacggtgtattggctaa

SEQ ID NO: 875 - DNA, 639 bp, M.catarrhalis
ggtcatatcatggcaggcacgctttttatcatcaccgccgcatcaggcacaggcaaaacctcactggtcaaagaactgctcaaatgtaccaagggcttatgtgtgagcatctcgcataccacacgccaacctcgcccaggcgaaattaacggtatacactatcattttattgacaccgcaagctttcagtcattaattcaagcatctgagtttttagaatatgcccaagtatttgaccattattatggcacatcaaaacaagccgtcatagatttattagcccaagggattgatgtcatcttggaaattgattggcaaggtgcattacaggtcaaagcacaatttgaccaagcggtgatgatttttatcctaccgcccactcgccaagcgttggcagagcgattatcaaaccgtggtcaagacagccaagaggtcatcaaaaaacgcttggcaggctcactggatgaaatacgccaatacgatcaatttgattatgtggtgattaatgatcgctttgagatggcgttagatgatttacaaacgattattaagagccaccgcctgacgctacatgcacagcaggctcgccatgctgctttgattgctgcattatttgatgatacgccaacctatccatga

SEQ ID NO: 876 - DNA, 1554 bp, M.catarrhalis
gacatagccatgccaacttttgaacaacataaacaagccctactgtgcaacgacccacaatccatcgccgattatgaacgcacgatgacgcacgccgtccaagcggtcaagacatggctacaagatgataacatgtatacaggtggtagcatcagccagttgcgttcacagattgcttttaatccaaccaaagacggcttaggcattgatggggcgttagagcgtgcgataaatctgtttttaaacaacagcctaaaggtgcatcatccgcattcgcttgcccatttgcattgcccaaccatggtaacatcacaaatcgccgagatactcattaacgctaccaaccaatcaatggactcatgggaccagtcgccagcaggctcgctcatggaggttttgctcattgactggttacgccaaaaggtgggttatggggcaggacaggcaggtgtgttcacatcaggcggtacacagtccaacctgatgggcgtgcttttggctcgtgattggtgcattgccaaacattataccgatgaagacggcaaaccgtggtcggtacagcgtgatggtatcccccccgatgccatgcaaaatgtcaaagtactgtgctcccaaaatgcccattttagcgtacaaaaaaatatggcgatgatgggcatgggttttgcttcggttgtaagcatccctgtcaatgacaacgcccaaatggatacccaagctttggccgatattatggcagatttgcacgctgatggtaacatcgtggcgtgtgttgtggcaacggcagggacaaccgacgcaggggcgattgacgacattaaagccatccgtgccttgtgcgataaattcggtgcgtggttacatgtagatgcggcgtggggcggggcgttattactgtctaatgattatcgttctatgctggacggcattcatctgaccgattcggtgacgctggattttcataagcactattttcaaagcatctcttgtggggcgttcttgctaaaagatgagacaaattaccgctttatgcactatgaggcggagtatctcaactcagcctatgatgaagagcatggcgtgccaaatctggtctcaaaatccttgcaaaccacacgccgatttgatgccctaaaactgtggctgacgatagaggcgttgggcgaagagctgtacggctctatgattgaccatggggtaaacttaacaaaacaagtggcggattatatccgtcatgctgatgggctagaattgctcgttgaaccgcagtttgcttctgtgctgtttcgtgtcgtgccaaagggttatcctgatgagtatttggacagcctaaaccaaaatgtggcagatgagttatttgcccgaggggaagcgaacattggcgtaactcgtgtcattgacagccgtcaagatgtgcagtcgttaaagatgacgacacttagccccatcgcaacgcttgaagatgtcaaagccttgctggatcaagtattagcagaggcacacagaattggcgatgccatcaaagacggcacttatacgccgcccattgggtga

SEQ ID NO: 877 - DNA, 813 bp, M.catarrhalis
gcagcatgcatcattgataatccattcgccatttatgtagaggtttggtacaatatcgcattttatcaccacttgacacttaaaaagccaaacatcgtgaccaaagacacccttagaaataccaaaatcccaaccaccgatccacaagcaggtctgaagctgacagagattttttattctctacaaggtgaagcgttgacggctgggctaccaacaatttttattcgcctaacaggctgtcctttgcgttgtcattattgtgatacgacctattctttttcaggcggtgagcgttgggggcttgatgatatcatgacgcatattgcccaatatccttgctggcgtgtctgcgtaacaggcggcgagcctttggctcagccaaatgccattgcattaatgcacaaactggtacagtcgggttatgaggttagccttgagacagcgggtgctttatcggttgctaatgtaccgccattggtctcaaaagtcatggatctaaaatcaccatcatcaggcgaggctgataaaaacttatgggaaaatttagcccatcttaccttgcacgaccaaattaaaatcgtcattgccaaccgcacagattatgaatgggcaaaaaatatcattaccaaacacgctttagacgataaagttggcacgatttggctatcacccatgtttaacatccaagaaaacacaagccacgcaccgaaactggcaaccgatttggcagaatggattttaaaagacgctctgcccgttcggtttggcttacagctacataaaatcatttgggcagatgctaagggcaaataa

SEQ ID NO: 878 - DNA, 687 bp, M.catarrhalis
ggaaaaagcatgcaaacactgtcaatgactggcaaaaaactgattatatttgatttggatggtacgcttatcgatagtgcccctgatttggcggcggcggtcaatggcatgtatgccaagcttaacttaccgcctatgccaattgatatcatcaaaagctgggtgggcaatggttcgctaaaattggttgagcgagcaatgcaagcacatcatatctatgatacgactatgattcaccatgcccatgagttatttttggcagaatatgcccataaaacaattgaaaatacgcaaagctatgcaggggttatacaagggcttgaacgattaaaagcagcggggttttatttggcaatttgtaccaataagcctgagcgttatttgcctaaaattttatcacattttggatggctgacactgtttgaccaagtgattggcggtgatacgctcagcgtcaaaaagcccgacccaacgcctttattatacctgtgtcaatcactgggcatcgcaccgactgatgccattatggttggtgattccaaaaatgatattttatcagggcaagccgctggcataactacgcttgctgtgcgttatggctataattatggtgaaaaaattgatttagcaaaccctgatgctgcgtttgatgattttgatactttaatgaatcatattttacaataa

SEQ ID NO: 879 - DNA, 2610 bp, M.catarrhalis
tcaggggaaataagaatgcagctcaaatacgaacatctggattatcaaaaacaggcgattgatagtatcgtagatttatttcaaggcgaaattacgcatcatcaagatgattttagcttgtcggacaaagacaatatgcgtgtgattgccaatgaattatctttatccaaagatgatatttttaataatttaaaaaatatccaaacgcaaaatcagctttctttatctgataaattggataatttgtattttagtgtagaaatggaaacgggtacgggcaaaacttttgtttatttaaataccatttttgagctttatcaacgctatggctggcgaaaatttatcattgttgtgccaagtgtcgccattcgtgaaggtgtattacaaactttaaatagcacaaaagcccattttaaagatgaatttaattcgccaatttatcattatggtgaatatagcggtcaaaaaaccaatgcattaaaacattttgcgacaagtacaaatattgaaattttggtgatgaacattcaatcttttgaaaaagaaagcaatatcattaatcaacagcgagaaaatggcgtattaatggagttaatccaagcaacgaatccaatcattattattgatgaaccacaaaatatcagcagtgataaacgcaaaaatgccattgaaaatttaaatccattatttacggttggatattcggcaacgcataaagaaattatcaataaagtatacagcctaaatcctgtacaggcatttgaaaaaaatttggtaaaacaaattgtcgttaattcggtgatatcacaagataaaaataatgcctttattgaactaaaagaaatcacaaacaaaagcggtttgaaagccaaaataatatttgatattagcgaaaaacagcaattaaaacgcaaagcaattaccgttaagctgggcgatgatttatatgaaaaatcaaagcaaaaccccaactatcaaggatttataattacaggcattgatttagaaaaccaaatgattaaattctctaatggtatcgaaattgcccgtggtgtaaatatggattgtcttagagatgaaataatgaaacagcagattcattatactattaaagagcatttaaagcatgaaaaggagttaaataaagacggcataaaagtattatcactgttttttattgacaaggtagaaaattatcgcaccaatgcacaaggtgaattggggaaattttatgagtggtttgaagaattgtacgaattagaaaccaaacaatcagctagtggcgtacataaaggctattttagccaagacaaaaaaggcaatgctaaaaacagcaatggtaccaccaaagatgataatgatgcctatgagctgattatgaaagataaagagcggttattgtcgcttgatgagcctgtgcgatttatttttagtcattcggcattaaaagaggggtgggataatcccaatgtttttcaaatttgtactttgaatgaaaccacatctgtaattaaaaaacgccaagaaattgggcgtggacttcgtttacctgtgaatcaaaaaggcgagcgaatttatgatgaaaaagtcaatattttgaccgtgattcccaatgaaagttatgagcaatttgccaacagtttgcaacaagaatatattgatgattgtggcattaaatttgaaaaatctcatcttaaaaatgccaaaaatgaacgcacggtaacttatcgttttgatgcgtttaccgacccattatttttacaaatttgggagcgtattcgccataaaaccagctaccgtgtacaatttgatagcgatgaattgattgacaatgccagtcaaaaaatccatgtcatgccaaaaattgacataccaaaaattgaaattaaaaaagcaaggatggtgcaaaacagtgaaacaggcatagaaacgcaagagattttttctcaaagtgaacatattcaaacgaagtttgtgatacctgatattttaaaagtattgcaacaaaaaacaggtttaactcgcaatacattggtacagattttacagcaatctggtagaattgatgaagttaagagcaatccacaacgctttattgaaactgtagcagaaatcatcaatgatgaattgtacgatttgatgaaaaatggtatctattatcaaaaattagataaagtgtacgaacaaagtttatttaagacttataaaatttatgccaatcaatatacttttaatgtaaataaaatggataaaaccatttataatggtgtgttggatttagattcaaataccgaaaatcaatttgcaacagattgtgaaaattatgatgagcaagtggcattttattttaaattacccaaaaaatttaaaataccaacgccgattggtaattacaacccagattgggcggtggttataaaaaagaatggcgagcaggtttattttattgctgaaaccaaaaatacaggcgataaatccattcaagatggggtggtggttgataaattgaagtgggaagagcggtttaaaattgcgtgtgcaaaacgattttttgaaataaatgatgaagtggattatcaagtggtacaaaagatcaatgaattgacctaa

SEQ ID NO: 880 - DNA, 288 bp, M.catarrhalis
tttaagagaatatccatggcacgagtaaccatcgaagactgtctagaaaatgtcgataatcgttttgagttgattttggtggcaagcaagcgcgcccgccaacttgccaatggtaaagttgagccaacggtcgccgttgataacgacaagccaactgtacttgcattgcgtgaaatctcagcaggtcatgtcagccgtgcgatcttagatgagcctgatgaggacttatttccaaagtcaaatcaatcctacgaaatcacacctgagcagttgggcaataccctataa

SEQ ID NO: 881 - DNA, 456 bp, M.catarrhalis
gcctatttgataaacttgttgcctattttcgcaccaagcacatctaatgcatctattttgggatttttaaatatcatgagcaaacaaatcattcatacagacgacgcacctgccgctgttggtacctattctcaagcggtcaaggttggcgataccatctatatctctggacaattaggtcttgacccaaaaaccatgacgctcaaagaaggctttaaggcacaagccgagcaggctatggataatttacaagccattgccaaggcagcaggtggcagcttgtctgatgtggtcaaattcaatgtctcgctgactgatttgtcggattttgcgacacttaatgaagtttttgatgcctgtttaaatgccccatatcctgcccgtgctgctgttcaggttgctgcactgcctaaaggtggcgtggttgagattgaagctatcttacatttgtcataa

SEQ ID NO: 882 - DNA, 1779 bp, M.catarrhalis
ggcagtttgatggtgcgtcaagattcccaaaaaacactcacacttagcccaagattgaccgagccactcaatcaggcactgcgtgatcagctggactcatcaacacttgcacgagttttacaggctaggggtgtacacgatatcagccaaatagatacgcacatctgccagctgcttgcggcagcagatttgatgggtattgatacagcggttacgctcattgataccgccattgaccaaggtgagcgtattttaattgtcggtgattttgattgtgatggggcaaccagtacggcattgatggtgcgtgtcctgcgacaaatgggcgctttggtggattttttggtgcctgaccgatttaagttcggctatggactgacaccgcaaattgttgagcatggtgctgcattgtatcgcccaaacttaatcatcacggtggataatggcatctcaagccatgatggtgtggccactgcccatcagatggggatcaaggtggtgattaccgaccatcatttgaccaccaaaccatcaccgcctgccgatgctgtggtcaatcccaatcagttgggttgtcattttggtagtcgctatcttgttggtgtgggtgtggcgttttatgtgatgggcaggcttgccaagcatcgccgccaactgggcaaatccagtgccagtgttgccaaatatttagatttggttgctctaggcacagtcgcagaccttggtgtgctggataaaaataaccgcattttggtcacgcatgggctgcagctgatccgtcaaggtcgatgcgtcgtgggcattttagccatcttagagcaggcaggtaggcaacatcagaccatcaccagtgacgattttggatttgccatcgcacctaggattaatgccgctggacggatggataatatgcgtattggtgtggagtgtctacttactgatgattggggagaggcacaccgattggcaagtaagctaaaccagcttaatcaagcaccccgccatgttgagatgagcatgaaagatgatgccattgccattgtccaaagtttatctgagtttgatgagacaccgactaaaggcattgtgctttatcaagatgactggcatcaaggggttatcggtattgttgcaggtcgcctaaaagaaaaattataccgtccaagcatcgtttttgcaccagcagataccgcattggtcggcaagtcagatgatatcaaaggctcagctcgttctattgcaggcatacatattcgtgatgtcattgaaagcgtggcactggctcatcctgatttgatcaagcattttggcggtcatgcaatggcagcaggcttgaccattcaaaaggctgattttgaacgatttaatcaagcactccaagcggtactgttggattttgatgatgatgtattttatgaacaaaaattcaccgatggagcgttattgcctgacgagtttagcctaagttttgtggatagattaaaaaacatcagcgtttggggcaatggttttgtaccgcctgtttttgatggcaagtttgaggtgattaaccatcgtatcttaaaagataaacatctaaaacttagcctaaaaatggcaggggtgcaatatccgattgatgcgatttggtttaattatcaagcggacagttgggattatcgagcgtttggcgtgcatattttgtatactttggatattaatgaatggcaaggcagccaaagtctgcagctggtgattaaggacttggcggtgatgagtgtggcggcattgtctgtttag

SEQ ID NO: 883 - DNA, 978 bp, M.catarrhalis
aatgggcggatattttgggaaataccgagtaacacgatgaaaatattattagccaatcctcgtggattttgtgcaggtgtggacagagcgattgcgattgtcaatgaagcactacgccgttttaatccgcccatttatgtccgtcatgaagttgttcataataaatttgtggttgaggatttggcacgccgaggtgcggtgtttgttgaagagcttgatgaagtgcctgatggggcgattgtcattttttcggcacatggggtttcaaaggcggttgaagatgaagcaaaacgccgtgatttgacggtatttgatgcaacttgtccactggttaccaaagtgcatattgaggtgggtaaatttgccaaagggggcatggacgccattcttatcgggcatgcaggacaccccgaggtagaagggacgatggggcgttttgataccagttttggcggtcgcattcatttggttgaagatgttgaggatgtggctaagcttgactttgagcgtgataagtcattggcatttgtcacacaaacaacgctatcaatggatgatactgccaatgtcattgatgcactcaaagaccgatttcctgccatcaacgcccccagaaaagatgacatttgttatgccacccaaaatcgccaagatgcggttaaattgctttctcgtcattgtgaggttgtgctggttgtgggcagcccaaactcgtcaaattctaatcgcctgcgtgagcttgccgagcgaatgggcaggcgggcgtatttgattgataatgctggtcagatgagccaagcatggtttgagggcgtgacatatgtcggtgtaacagcaggggcatcagcacctgagatactcattcaagaagtgcttgatacactgcaattatggggggctgatgtgcctactgagctatcaggcatcgaagaaaatgttacttttagtttgccaaaatcactgactaaggcagtttga

SEQ ID NO: 884 - DNA, 870 bp, M.catarrhalis
acgtcccctttacctactccaacaaccctaccaaataggcctaccatcaccagcaaccatacctttaatatcgttcaattatccgatctacacctgacgggggacattggtcaagcccccagttatcagcgatttttggcagtttttcagacagcaaagcatctaaacccagatttatggcttttgacaggtgatttggtgaatgatggtaatagcgatgcttatgattggttatttaatcagctacaagcaaccaaaataccctatttggctgtcgctggcaatcatgatgtgacacacgaaattggcattcatttggcacaccaagagcggatacatgtgccgattttacccgatcgacgcctaaaaaattgctttcggtatacttttcaagcagggcatgattggcaaattttattactaaattccagtgtatcaggcgaaatatttgggttattaactcatgaaacactactttggcttgatcaaactttaaccactcactttgaacaaaccatcatcgccctacaccaccaccccacaaaggtcagttcagattggatagatgctcatctactcaaaaatcatcaagatttttggcatgtgattaaaaaacacgctcatgttcacacgattttgtgcggacatgtacatcaagtacatacgctgcatccactaccagcacatcaggttcagttgctaagctgcccttcaacagaccgtcaattcatgccttttgtggataattttcaaattgctgacacgcctgctggctgccgtatgatacagattgacaacaaaggcatcgtatcaagttacatacaaattgtgcaaaatacgcattcattttgtcttaataatgcaaattaa

SEQ ID NO: 885 - DNA, 1791 bp, M.catarrhalis
aaaaattttacctatttttacaagagcatgttagcaaatatgaacaaaagcgtaacaccaacatggacaaccgctctacctgattggcaagagcgtatcgtcaagggcgagtcccttatcccatgtaaaccgctgtttaccacgatgagtgacattgcgttgcgtgtgtttaaagagctggcactggttgatgtcatcggttgcccaaagattggggcggtgagtaaagcgtgggtgtttgactttgtggcaatcatttttggggcgtatgaccctgccgccaaaaaacgcttgattaaagagttttttcttttaatcagtaaaaaaaactcaaaatctacgctagccgctggcatcatgctgaccgctttgattttaaatgaacgccaaagctgtgagcttgtcatcgtcgccccaaccaaggaggttgccaataactcattttcgcccatgcaagacatgatacgagtagatagtgaattatctgctctttttaatgtctctgcccacaccaaaaccatcacccaccgatttacaggggcaagtttgaaggtcatcgccgctgagtccaacagtttggcaggggtcaagggggcgtatgtgctggttgatgagctttgggtgtttggtaagcgagcaggggcggccgccatgctccaagaagccatcggggggcttgcatctcgccctgagggctttgtcatctatttgtccacgatgagcgatgaagcacctgctgggatttttaaagaaaagctggattatgctcgctcggtgcgagatgggcagattgatgatttgcgatttttgcccgtgatttatgaatttccgcaggcttatattgacagcggcgattatgtcaagcctgaaaattggtacatcaccaaccccaatttgggggcaagtgtggacatggattatttgaccgatacgctaaaacgagccaaagagtcgcatgataaaaataccttgcaaaccgcccttgccaagcatttaaatgtagaaattggcatctcacttagagccaaccgctgggcaggggcggagttttgggagcaagcaggacgagcgtttagccttgatgagctgatagaagccagtgaagtcatcaccatgggcggagacggtggcggtcttgatgaccttttgggctgtgccgtcgttggacgcttgccaaccccaaaatatatttacacagacgataacaatgtccgccatgaggtcaaacagtggtgggtgtgggcccgtgcgtggtgtcatccgattgccttagagcgacgaaaacaagacgagccacgctatcgtgattttgaaaccgatggcgacttggttatcgttgaaaatgtgggcgatgatgtggcagaatttgctgacattgccaaaaaagtctatgacagtggcaaactggataaaatcggtcttgaccctgctggggcagatgatattgtcatcgcccttgaaagcatcggcatacccaaagacacgcacatgacaggcgtatcacaagggtggaagctgggcggttatcaaaaagtgtgcgaacgcaaaatcgccagcggtgatttgacgcacgcaaatcagcccctaatggcgtggtgcgtaggtaatgcacgggttaaactgtcaggctctggggtaagtatgagtaaatcagaaagcggtaacggtaagattgaccctgtgattgccatgctaaacgccgtggcacttatgagccaaaacccagctgtgcctaggagtgatgatgatattgggtcttcaccacggggctggaaggagccgcggatgtgc

SEQ ID NO: 886 - DNA, 306 bp, M.catarrhalis
agcttgaccacatcgtcaacaaggcggtcggtggcactgatgacaaaacaaacctacaaatcttatgctaccaatgccacaaaaccaaaacccaaagcgaaagcaaggcggggggcgtgctacaatttttgggctaagcgtgcggacaccacgccccctctcgtttataaaaaaaatttgatttgggaaaaaaatctccgtttctccgccaatggacgcagtaataaaagttacataaaattacattataaagaatatagaaaggttaaacatggcaatcactcagaagcaggaagcgtatgctaa

SEQ ID NO: 887 - DNA, 648 bp, M.catarrhalis
ttttttatctaccgcttatcacaaatttttatttttaaaaaaagtttctcaaaaattaaaatcaaccctgcacaccctgcacaccctgcacactttttaaaatctttattaaaaccaataggttataaatgtcaaatctgtgcagggttttgttcagggtttaaaaatttgacaaaaccctgcacagcttttcataatatcccaaagccacaccaaggacaaaccatgaaacaccacatacccaaagcccagcttgttgccattgccgaaagttttgcaggggttagccgatttgctgatgcctgctatcgttactactattaccacgaccaagccagccgtgattatttgttgtcatcattggcggtagagtttgccgaatatctgactaagatacctaccaaacatcatcagcccatcatcaataccgccttgatagagataagctacccccaaaaaaatcttagtcgctctactttttgtgcaaaagagcgggcttgttgcatgggaattagtcgtcgccaatactataacttacatgcaggtgaagccattgataatatcattggcaatattacaggtattgccaaagttgtcgctggcaaggttcgtgaacagcttggaataaacttaaaactgggctattga

SEQ ID NO: 888 - DNA, 387 bp, M.catarrhalis
atgatgagtgatgatttgattaaccacccagcacattacacttcttgcccgagtgggattgagtgcattgacattgctgagctgttgccgttttgtttgggtaattgttataaatatttgcaccgagcaggattgaaaggcgatgaattaactgacctaaaaaaggcagtattttatgctcgtcgtgcttatttaaatgatgagaaattgaccgaaacagcccaatcgctgatttttaaagttgctcgccatcaggctgacgaaaaaagaaagattttatcttgttttgccgctgcccacataaaaaaattttacctatttttacaagagcatgttagcaaatatgaacaaaagcgtaacaccaacatggacaaccgctctacctga

SEQ ID NO: 889 - DNA, 324 bp, M.catarrhalis
caaatcacggaaaccatggcaaaacttggcaacttaccgccacgcttaaaacccacccaatcccacaccccaaagaaaaaatggggtcaagctcgtggcggacgatggtggcggcgacttcgtgctgaatttttggctcgtaataactacacctgccagttgtgcggtcgtgttggcggccgcttagagcttgaccacatcgtcaacaaggcggtcggtggcactgatgacaaaacaaacctacaaatcttatgctaccaatgccacaaaaccaaaacccaaagcgaaagcaaggcggggggcgtgctacaatttttgggctaa

SEQ ID NO: 890 - DNA, 453 bp, M.catarrhalis
aatgcttggcgatgggggcgagccatgagtgataaacgcccacccctaaattttgactacatccaaacccaagccacaggtcattatgtcagccgtatttttcctgccgttggcatcaaactacacggcaatggcaaaaagcatcagccttgtccgctgtgtggcggtacagaccgttttcgctgcgatgataaggacggcacaggctcatggatttgtaaccaatgtggtgctggcacaggctacacactggtgcgtgattacaccaaaaaagacgcatacgaaacgcacgctttgatggctgacattttgggcattgacggcggcaggcagattaaccgaagcggacaaacaagcatgggcaaaagcccaagccgaacgcttatccgcccaaaaacaagccaaaaaacaagcacggcaaaccgctgccaaaaccgcccaaaaccgctttaa

SEQ ID NO: 891 - DNA, 558 bp, M.catarrhalis
aattacattataaagaatatagaaaggttaaacatggcaatcactcagaagcaggaagcgtatgctaagaatgtggcaagtggcatggactttcatacagccgccctagaagctggctgtaaaaatcatgaatctgcccgaaagttcgtggcggacatggcaaagcgtgagaatgtgcaagcccgtatcgctgacttaaaaaaagtacaaaacgctctggggcaagacagtcaaaacaaccaagacaaccaaaacaatcaagacgataaaaacaatcacgacgagccgactgccacagtgccagacgcaccacagaccccaaaatacgaaacgcctttggggtttttgaccgccgtttttaataacgctgatggtctgtacacgccaaaagaacgcattaacgccgccatcgctttattgccctacaccgagcataaactggctcagacaggcaaaaaggaagatgagttggataatgcaaaaaataaaagtgaaaatgggcgatttgccacactgtcaaatcaggcggacatgttcggcagtgagctgttgcaatga

SEQ ID NO: 892 - DNA, 774 bp, M.catarrhalis
gtttcggttgttaattcagctaaaactaacggaaactattatatgaaaaatttaccccaaattcaaccccatgacacacttacccaagcggtaaatgctcgtgagttacacgcatttttgcaaaataaagaccattttgcaacttggattaaagaccgtatcgcacaatatgattttcaagaaaatcaagattttgtgactttttcggaaaattccgaaaaaggtcgtccacgcctagaatacgccatcaccctagacatggcaaaagaactctctatggtcgagcgtaacgagcagggcaagatggctcgccgttattttatcgagtgtgagcgtgtggctcgtcaggtcatgactgcccccatgccagtccgtcctaccacgcccacactgtccaaggtggattttgccgttttgcagacggtcgtgcgtgatttgtcagcacagatggcacacccaaaggcgagcgagatggcaatttgggcgagactgcgtgccgtgtgtgatgtgtccagcattcacaacattcgctatggcgacatgtggacggtgcagggcgagctgtctcgcattgggcgtattttgcgtccttatgctgattttcgcaaatccaccgaaaaaacactcatcaaacgtatttgcctaggcgaccacaatgctgtatgggaagccatcaaagtgatggatgataccgcagacggctattcactatttgttgatgataaggcgttttatgccttagaatgcttggcgatgggggcgagccatgagtga

SEQ ID NO: 893 - DNA, 2394 bp, M.catarrhalis
tggctgacattttgggcattgacggcggcaggcagattaaccgaagcggacaaacaagcatgggcaaaagcccaagccgaacgcttatccgcccaaaaacaagccaaaaaacaagcacggcaaaccgctgccaaaaccgcccaaaaccgctttaacaccgccacgcccaccgacacccacgcctatcttgccaaaaaaggcgtacgctcgcacggtcttagggcagatgataaaggcaatttgctcataccgctgtattatcacaacacccaaacaggcaacatcacgctgtgtaatgtccagtccatcagtgctgacggcggtaaattattcgtcaaagatggccttgtcggcggtgcgttttatacgcttggcgatgtgctatctggcgatacaatcctaatttgcgaaggctatgccacaggggcaagtatttttgaagcgttaggcagtatctaccctgtcatcatcactttcaatgctgataatatggttaaatgtgcgtctattatccgcacgctgtacccacaacaccgcttgattttttgtgctgatgacgataaagctacagaaattaagacaggcaaaaacacagggctaatggcagggaacgagtccgccacgctcacagggagcgaagtcatcagtcctgattttggtgatgatgaacgcacgaccacaggtgagctgaccgattataacgacctgcacgctcattttggcatggaagttgtcaaggctcagcttgtccacgccctaaaccgcccacgccccaaagtcatcacagacacgcacggtggttataccctagattatttgaatgaaaactttgcccaaatcaaagatattggcaaagtcaccaacaaaatctatgacctagtcaatcacaccgagatgaccaaaacccattttatgggacttgtcggtcgtgaacttgccaatgcgtggctttttggtggtaaacaaaaaagcattgaccgccgtgaagtccaagacaacaccgccaaacaatttgccaaggcttacggcagtatttttgagcaatattggtatattcaaggcacaaaagaagtgtttaattttaaaacttacaaaagacagcctgttgataccttacgcttagaattcccaaacgaatttgatgcgtggaataaatcaaaaagccgtcaaaaagtggaatcggacaacatttggtttgaccccacggacaaaaaacgcccccaaaacggcgaaaactacatcaatacatttaagccgtttgccatacagccatacaccgcccaagagcttggtattgatgataagcagttgaatgagcattttatgatgggcatgtgttcgcctgttatcaatcttatcaagcatttgtgtggcaatgatacccatgccttagactgggtgctaaactggcttgccataccgctacaaaacttaggcacaaaaatggataccgccttgattgtccatggacacattcaaggggctggcaaatcgctgttttttgaccgtatcatgagaaaaatatacggctcatacttgcttacacttgggcaagggcaactagaaagccagtacaatgactgggtagaaggtaagctgttcgccgtctttgaagagatttttcagggcaaagaccgttacagccacatgggtatgattaaacagctcatcacaggcaataccgtttatattaacaaaaaattcatgagcggctggacacaagataactttgttaataccgtgtttttgtcaaacgatatgcagcccttgtcgcttgacgagaacgaccgccgtcatgttgtgttatatccgaccgccgttattcccgatgccttgcgtcatgaaattggggcggcgatagatgacccaaatcagtcgttgatacgagcattttacacttatcttttactaaaagaccccaaaaatcaaaacgcccacagcacagccatcaatactaaagccaaggcacagcttacagaaattagcctagcaagctgggagcggttttatgtgtactggaaaaatggtgatttagagataccctatgccacttgtttgaccaccgacctttatcattattatgtcttttggtgcaaacaaaacggcgagcgtggcacatctagtactaagtttttaacctttgttagcgtgcgtgaacacaaagaacgcatacgctatcaatacaacctacaaaatggcgacagctttattcccaaaagtggtcagagcatggcattcatcatcggcttggacatgagtaaaaagcccgaccaaaacacattcggcatttgcatatctcgctttaaaggtgctataataaaagcccaaagctcacacccatcggtaaacaccaacaaccgctcatctcacgaaaattctaatccgttcatttaa

SEQ ID NO: 894 - DNA, 885 bp, M.catarrhalis
attatactgtctatgtctgatgacaattcaagcacttggtcgatgcgtggtcttaggcgttggttatccaccgcacctgaaactcgagatgatttattaaagctggttcaagactctcgccagtttttagagcctgatacggttgatatgcttgaaggggtgcttgatctgccagcaacccaagtgcgtgagattatgacaccacgcccacaggtgcatgcgattgccagcgatgatgatttatctgatattttatcggtggtgcttgaaacagagcattctcgctatcctgtttttgacagtttggatgatgatgctgtggttgggattttgctgattaaggacttaataccatacctaaaagccaaagctgacggtaaagagcagccgctcaaattggctgatattgtacgaaagccgttgtatattagcgagacggcacgctcagatacactgctacgctcacttcaaaaagcccaagtgcatatggcgattgtggttgatgaatttggctcggtctctggtgtggtgacaatggaggatttgcttgaggagattgtcggtgatattgttgatgaacatgatgatattgacgaggacagcgacattaataacatcattccacaccctgataaatcaggcgtttggttggtgcaagcttccacactcatcagtgattgcaatgagattttaggcagtcattttgatgatacagatgttgatacaatgggcggtttggtcatgcaagcattgggctttgttagccatcttcaaggtgcggttgttcaaatcgatgaatggcaaattaccgtggttgatgttgaggcacgatttattcatctgttggagcttgtgctgataccacagcttgagaatgctgaataa

SEQ ID NO: 895 - DNA, 2892 bp, M.catarrhalis
attttattgttaaatggtaaaaagtcatctaatcgcactgcccatttacccattagaatggattgtttatctattcttgacggaatatttagtatgcttacaaaaattatcagtacagtcattggtacaaaaaacgaccgtgaattaaagcgtatgcgtaaaattgttaccaaaataaacagttatgaatcaagcattcaatcgttatctgatgatgaattacgccaaaaaaccgaagagtttaagctgcgtcatcaagcaggcgaaagcctagataaactcttgcctgaggcgtttgctgtttgtcgtgaggcgtctaagcgtgtcaatggcatgcgtcattatgatgtgcagttgattggtggcatggcattgcacgaaggtaaaatcgctgagatgaaaacaggcgagggtaagaccttgatggcgaccttggccatttatctaaatgccatcagtggcaaaggggttcatgttgtcacagtgaatgactatttggcaaaccgtgatgcacaactaaatcgcccgttgtttgattttttgggtttgacagttggtgtgatttatagccaacaagccccccaagaaaaatttgccgcctatcgagctgatattacttatggcaccaataacgaatacggttttgattatctgcgtgataatatggtgtttagcctaagtgaaaaaaaacaaagaccattaaactattgtattattgatgaaattgactccattttaattgatgaagctcgtactccgctcatcatttcaggccaagccgaagactcagcacatctgtatgctttgattgacaatatcgttgagcgattggtgcgttccaaagatgaagaagataataaaaataatactgatggcgacttttggattgatgaaaaaaaccgtacgattgagattagcgaaaaaggctatgaaaaaatcgaaagctttttggcggaagtcggtgagcttggcgaaaatgaaagcctatacagcccagcacgattaccattattagcacatgcacaagcagcgatacgcgcacatcatttatttgtcaaaaatattcattatatcgttcaagatggtgaggtgatcattgttgatgaaaatacaggtcgtaccatgccaggtcgacgatggtcagatggtttacatcaagcggttgaagccaaagaaggggtagagattcaggcagaaaaccaaacgatggcaaccaccactttccaaaattatttccgtctgtatgataaattatcaggcatgacaggaacggcagatactgaagctgctgaacttaagtcaacctatgatttagatgtggtcatcattccgacacatcgaccgattgcacggattgatatggatgaccagatttttttgaccaagcttggcaaatataaaggcatcattcgtgagattaaacaaatcaccgaaaaaggtgcgcctgttttggtgggtactgcgaccattgaggcttctgaggagctgtcttatttattaaatcaagaaggtattgctcataatgtcttaaatgccaagcagcacgagcgtgaggcagatattatcgcacaagcaggtcgtcctcgtgcggtgaccattgcaaccaacatggcgggccgtggtacagatatcattttgggtggtaattggcaggctgagcttgaaacacatgaagtcatcaccgatgagatgcgtcgtgaggcactcacagcttggcaggcacgccatgatgaggtgttggcagcaggtggcttacatatcattggttctgagcgtcatgaatcacgccgtattgataatcagctgcgtggacgggcagggcgacagggcgaccctgggcaatcacgattctttttatcgcttgaagatgatttgatgcgtatttttgcaggcgatcgtattaccagtatgtttcgtgcagtgggcttaaaagaagatgaagccattgagcataagatggtttctcgtgcaattgaaaacgctcaaggcaaggttgaagctcgagattttgatgcccgtaaaagcttgcttaagtatgatgacattgccaatgaacaacgcaaggtcatctattcacaacgagatgatttattggcagagatggatttgcaagcaggtattcaggcgatgcaccatgaagtatatcacgccttaatcaatcaatttgttccgcctggctctatcgatgaccaatggaatattgatgggttagaagatgaaatcgaagaggcgtttcgttttgatatgccaattaatgattggcttgatgctgatcgtcgtttggatgaagagggtcttcgtaccaaaatcatcgaaactgccattgagcgttaccagactcgtcgtgagcaaatgggcgaacaaacagccgcccagcttgaacgccattttatgctaacaagcctagataggcattggaaagaacatttaacccaaatggatcagctcagaaaaggcattcatctgcgtagctatgcccaaaaaaatccagaacaagaatataagcgtgaatcatttgagctatttcaatcgatgcttggtgcgattaagtcagatttgattcaagatttggcgcgtgtacatgtgccaacgcctgaagagcttgccgccttagaagaacagcgtcgccagcaggccgaacaaatgcgtatgatgtttgagcagcaggcacagcttgacgatgctcaaagtttggataatcgccctgctgaagaaacaccacgcccattgggtcgtatgacagtgactttaggcactacttctgtggcacataaagcggctgatataacaacggatgaggcattggtgattcccaaaaatacccatcgtaatgcaccttgcccttgcggttctggtctgaaatataaacaatgccatggcaaactaagctag

SEQ ID NO: 896 - DNA, 309 bp, M.catarrhalis
gggaataaccccatgaaaaaactcatttggcaagcgttagcattgtcagctatgattgtactgtctgcttgtgcccaaaaaaccaaagaggcaaccgccaagcctgttgaagaaaaagaagtgcctatgtcggctgaacctgccgagccaatgatcgttgtaccgagtgattcgtctgactcatcgattgagcaggtagtacctgaagcatttgctgaaggcgatagcacccaaatcgctgaagtgatagagattgatgagaccgccaaaactgccactcaggatgccgaagtccaagaagggcaataa

SEQ ID NO: 897 - DNA, 813 bp, M.catarrhalis
ggtgctccgccaatgattaaataccaggcatggtggggtatttgttttaaagccaatgagctggcttcaaaattcatggtcaatactgatacggaagaaatcggtgaggtgtatatgggctgtgctggtggtattgatgcagatctaagcttgccactgatgtggcaaaaaaatccctttgatgcgacactaagcctaaccattaaagggctgcgtggtgggcattcaggactggatattgataaaaatcgtgccaatgccattaagttgatggcaagagtgctggttaagcttttgggtcagttcgatggacaatttgccatcagtcacatcaaaggtggcacgctaagaaatgccattccacgagaagctcaagtcgttatcagttgccaacagtcatctttatccgcactgatagataccatcaatgacgccaccgctcaaatctttgatgagctaaagcaggctgagccaaacttgatagccgttatcgatactactaagcttgggcctaaagacaatgtgctaacttgggcgtcatcttgtcaagccatccatctgatcaatgcactgcctagcggtgtggtgcgtcaaagcgatatcgccaaagacactgtggagacttcattatcctttggacagcttaagatggatgatgatgtacttaaatgcgtactgcttatccgctctttggttgattcaggtaaagaggcggtttgtgatacgctgtcaagtattgcccatctatcaggtgcacagattacttttgctggggaactatgtggtgtgaattccagaaacccattttggtaa

SEQ ID NO: 898 - DNA, 210 bp, M.catarrhalis
aatccatcaaccatcagctcatcaaacatcgctttgccagcacgcattgccaaaggattgcctgacagtgtgcctgcttggtacacgcccccaagtggtgcaatgcattccataatttcacgcttaccgccaaatgcaccaacaggtaatcctgcaccaataatcttgccaaaggttgtcaaatcaggcgtaatgccaaaatgcgcttga

SEQ ID NO: 899 - DNA, 735 bp, M.catarrhalis
tatcatccaacccaaaaggataattttatgacaataacgaatcgtacactcaccaccaccgcacctgatggcacaccactacttagccacattgccctgccaaatgataccaccaagacaggcaaggcacgggcaattttggttgctcctgaatggtggggtgttgccgatcacccaaaaacagtcgccgaacgtttggccgctgagggatttgtggcagtggcaatggatgtttatggtgagggtaagatgacaacagacgctcatcaagccaatgaatggatgtctcagatgcttgagtattctgatgaacttatgaaccgctgtcaagccatttaccaagatgtggccaatttacccgaagtagacaaagagcgtatcggtatcgcaggattttgttttggtggtaaaattgctctggatatggcacgccttggtacaccgctcaaagctgtcgcaacatttcatggtaatcctgccgccatcacacctgccaccaaacaaaagtttatcgccaaagtcttggttgcacatggtgcagaggattccatggtctcaatgcaagcaatcgatgatctaaaaaaagaacttgaagctgctgatgttcaataccaagttgatatctatgacggtgccaaacacggctttagcaatccacatgctgatgaacgagctcgtgataatggtattgacttgggctatcattcccaagccgcccaaagaaagctgggctaa

SEQ ID NO: 900 - DNA, 1329 bp, M.catarrhalis
ttcatttatcataaggacgcagtcatgacacatatccgcccagccaatgaaaaattgtttaatgatgccaaacgccatattgcaggcggtgtaaattcacctgtgcgtgcatttgctggtgtagggggtgtgccagtatttgtccagcgtgcaaagggtgcgtatatttatgataccgaaaataacgcctatattgactatgttggttcatggggtccgatgattttgggtcatgcacatgatcgagtcatcgatgcggtgaaggctgctgctgaagatggcttgtcttttggagcaccgaccccatctgaaacaaccatggcggatttgatttgtcaaatcatcccaagtgttgatttattgcgtatgacaagctcaggcacagaagctaccatgagtgcgattcgactcgctcgtggctatacaggtcgtgataaaattgtcaaatttgaaggctgttatcatgggcattcagacagcttgctcgtcaaggcaggttcggggatgctagatatcggcgagccgacatccaaaggtgtaccgattgattttgccaagcatactgttactttgccttataatgatattgaggcattgacagcatgttttcatgaatttggtcatgagcttgcgtgcgtgattttagagccaatcgcaggcaatatgaacatgatcattccaacccaagcatttcatcaaaccttgcgtcaattgtgtaccgagtacggcgtggtgctgatttttgatgaggtgatgacaggatttcgtgtcggtcttggcggtgctcaagcgcattttggcattacgcctgatttgacaacctttggcaagattattggtgcaggattacctgttggtgcatttggcggtaagcgtgaaattatggaatgcattgcaccacttgggggcgtgtaccaagcaggcacactgtcaggcaatcctttggcaatgcgtgctggcaaagcgatgtttgatgagctgatggttgatggattttatgagacgcttggtcaaaaaaccacatatttgattgatggcttaaaagccgcggcagccaagcatcaagtagcttttcaggcatgttcggtaggcggtatgtttggtatgttcttttcagacagtttgcctaagaattttaatgatgtggcaaatctttgcgatgcccaaaaatttgccaagttttttcatggtatgttggatttgggtgtgtatcttgcaccgtcggcatttgaagcggcatttatgagtgcggcacatacctatgaagatttggataaaaccatccaagcagcagagcaagtctttttacagctatcacaagcgtcatga

SEQ ID NO: 901 - DNA, 726 bp, M.catarrhalis
caacttttgaataagagacaaaccatgactgatttttgttattttgaaatgactggtacagacagtgaaaaattcttacaagggcaaattactgctaatatcgctgatattggtgagcagtttttaccgacagcaatttgtaatctaaaagggcgtgtacaatttgggatttggattgcacgaactttggcaggctttgatattgttatgagttctgatatggcagataattttatcatgcatattaaaaaatatggggcattttccaaaattaccctatcatcagccaaccccatttatcctgatgtgatcgatgacatacccacttttaataaaacccagcaaaccgataccaagctttgggagcaattaagcatcaaaacaggtaattattggctgactgccaaaaccagtgagatgtatcaaccccaagagctgcgcctacaccaaaaagggggtgtggcttatgataaaggatgttatttgggacaagagattattgcacggctatattttaaggctcgcccaaaggcctatctacaccgcatcttgggggtgggtgctatcccagctactggcggtgatatggggcgtatgagtatcgttaatgcactcgcaaccgatacaggttttgaggctttggtaatcgcccgccctgaggatttaacgacagttgaaattctacccctacccaaagccttacaagaagacattggccgcaactag

SEQ ID NO: 902 - DNA, 243 bp, M.catarrhalis
ccagatttggggtcacgaaccctgatattaaggttatccatgcaggggtttgagggtggtttaataagcaaaagccatcttatatgggacattgttcccaattggtcttaccatcaaaaaatgcccactcacctaattaaatggtggcatattgagtcgggggcgggtatattgcgactttttgaccgagattttggcgaagcacccaatttaaacgttaaatcatcatttgccatttcataa

SEQ ID NO: 903 - DNA, 480 bp, M.catarrhalis
caatatggtattgtcatgatttatgatgaattgcgaccaaaattttgggaaaattatcccttagatgcgttaacagatgctgaatgggaagcattatgtgacggatgtggcgcgtgttgtttggtgaaatttcttgatgatgacaatgttaaattgaccgaatataccgatgttgcctgccagctattggattgctcaacaggattttgccaaaactatgccaagcgtcaaacgattgtgccagattgtattcgcttaacacctgatatgttgcctgatatgttgtggttgccacgccattgtgcttataagcggttgtatcttgggcaaaatctgccagcatggcacaggctcattaaacatagccaaaaccatggtgcaggatttgcgaaagtttcaactgctgggcgatgtgtgagtgagcttggtatgagtgatgaagacatagaaaggcgagtggtgaaatgggttaaaccttga

SEQ ID NO: 904 - DNA, 348 bp, M.catarrhalis
ggtgaaatcatgaacttacctgactgtccgcaatgtcatgaatcttatacctatgctgatggtatgctgttgatttgcccaatgtgtactcacgaatggcaagagggtggcgagaccgaggcactgcctatcatcaaagatgctgtcggcaatatcctaaatgacggcgatgcggtcacggtggttaaagatttaaaagtgaaaggttcaagcacaccaatcaaagttggcacaaaagttaaatccattcgtttgatttatgatgcaccagatgaccatgacattgattgtaagattgatggttttggtgcgatgaaacttaaatcttcggttgtcaaaaaagcctga

SEQ ID NO: 905 - DNA, 528 bp, M.catarrhalis
ggtgatttaatttcattaatacaactcactcacttctcacacttttactatgaaatcttagcttgtcatatgcgaaccgctactaattctatccggcctaagaccaccactcgccagttgccattaccgatatcggtgatggcggctttgtctgctggtgcaatgtttagtttggcacttgcgccttattttattatccccattgcgggtctttcaccaatgctggtgtatgcactggtaaaaaagtgcgatagccctaagcgggccttttggttgggtgaactctaccgatttgggacttgggtggtcggcgccttttggctatatcactccattcactactatgggcgaataccaagttggggctgcccttgtattaaattggggcaatgtccctcattattggggcttgttcatgcccttgatcgcattggccatttgttccatttaatgcccaaacaacccaatatttttttgcacgaattttggatacctccaacaaaggttaaaaacattggggtttattag

SEQ ID NO: 906 - DNA, 210 bp, M.catarrhalis
aaaagtgcgatagccctaagcgggccttttggttgggtgaactctaccgatttgggacttgggtggtcggcgccttttggctatatcactccattcactactatgggcgaataccaagttggggctgcccttgtattaaattggggcaatgtccctcattattggggcttgttcatgcccttgatcgcattggccatttgttccatttaa

SEQ ID NO: 907 - DNA, 354 bp, M.catarrhalis
attaaaacacatattaaggatttacccatgcatagtcaaatcaccctttacaaacaaatccatcccaagcagtgtgatgggcttgccaaattgggctttaaaagcctgatcaatctgcgttttgatgatgagattaaaggacaacccaaagggtatgacatcgctcaaagtgctaaaaacgctgggcttagctatcacactctgcccattggtattgatgacattcatcttgcacaagcccaagcattcgctgatctgattaacaatgcaccaaaacctgtgatggtattttgtggtacaggctcacgcgccaagcgtctgtatcaatgtgctgtcgtttctgggctaatctga

SEQ ID NO: 908 - DNA, 249 bp, M.catarrhalis
cttcattcagagagtataccgcacaccactttgattaaaaaagctcaaaatgcacaaattggcttatctgcttctgacatgagtatcggcgtgacaagcggtcgccacggtatctatccaaagattagctggaagatagacgccaacagccgagcgtacattgccaaaaagcagatgctatcttacttatacggtgagcatgctagacactgtatatttatccaaggtatcaagatttacggagaataa

SEQ ID NO: 909 - DNA, 768 bp, M.catarrhalis
agacatattggcggtgctagcacaacgagtacaggcgtggtaggtgctgaccgaaaacagctattgttaatttcaagccaagaaatcatgcagctatctcatcaagcctatttacaaaccatcaatgaagcacgcaccaaaggtcggcttgataacaataccgctcaagttcgacgccttcaccgtatcgccaatcgtctgattccacaaacggcggttttgcgcccagatgcgacccgttgggattggaaagtacacgccatcaccgacaatcaaatcaatgcttatgtcatgccgagcggtaaaattgtcttttatactggcattattgagcgtcttagattaactgatgctgaaattgcagctgtcatgggacatgaaatggcacatgctttgcgtgaacattcacgagaaaaagccagtcgtcatattgctacccaaggtgtgcttagtattgccgtgaatgcccttggattgtcaggtgggcaagcacaattggttggcttggcaggtcggcttggattggatttaccgcactcacgcacccaagaagcagaagctgataaaattggcattgagctgatggctcgtgcaggctatgacccaaatgctgcgatcactttgtggcaaaaaatgcagtcagctggcggtaatggcgtgccacagtttttaagcacacacccaagctccaccaatcgcattgccaatttaaaagccttagtcccaacagtgatgccgctatatcagacatcacaaaacattcattaa

SEQ ID NO: 910 - DNA, 558 bp, M.catarrhalis
tcaatgcatggcagctggataaatccgatgccatctgttttggcattacttttttcacttcaattcctttcgggtttaaatagcggtttggttgtcgggcttttggcaagttttgcaatgatgatttatcggacacaccaagtacacattgcgatcgtggggcgtgttggcgacagcgagcattttcgcaatattgagcggcatacagcaactacttttgatgggctgttacttttacgcatcgatgaaagcctgtattttggtaatgctcagtctgttcatgccaatttaatgcgattgtctgatgataccaacattcatgatattgtgctgattatgactgcggtcaatcatatcgatttatccgcccaagagatgctatgtgcctttaatcaaagctgtatcaagcgaggtcagcacctacatttggccgaggtgaagggccctatgatggatattttaaagaccagtcctgtgattgaaaatctgtcagggtgcatttttttaagtgccaatcaagccgtacaaagtctaaccaagcctagcacagatctttaa

SEQ ID NO: 911 - DNA, 768 bp, M.catarrhalis
cgccaccgcggatccttccagccccgtggtgaagacaagatgaccttaactgatgctgatattttgcgtatgaatgcactagagctttcgcatgatgacctattttttcatgaatttgccaaatcaattaccatttatgaagatgaggacatttgggtgctggataaaccagctggactcttgagtgttgatggacgcatgctaaaggtcagtttgcagtcacgacttttgtgtatcaatccaaatattaggctgatccatcgattggatatggacacttcagggctgattatttttgccaaatccagtgaggctcaaacgcacattagtaagcagttcattgaccgtattccccaaaaagaatatcaagcggttgtgtttggaacactgatgatagatgataaaaagggtgtcgtcgatgtgcctgtacgctatgaaccaaccactaagccacgccatattgttgatatggattggaataaacgggcgttgactcattatgaggtgatgcatcatgaattacgctgtgatgacaatggtagggcatatcctgtgactcgagtggcactcaaacccatcacagggcgtagccatcagcttagggtgcatatggtgcatttgggccatgtgatgattggtgatcccatttatgctgaagatgtggcactcaaactgtcaaatcggttgaatttgcatgcacacaagcttcgcttaaagcacccaacgcatggcatttggatggattgggtcagtccagtgccattttag

SEQ ID NO: 912 - DNA, 330 bp, M.catarrhalis
gtcattatcatgaataatcaaacagcaaaggcattaactgcagcactacaagcactcagcccaagtatactatcattgcaaaatgaaagccatatgcacgctggctattttgaaggcaaagaaagccactttaagcttgtgatcgtcagcgacgcttttgaaaaacagcgtctggcagctcgccatcagacagtctatgccttggctcagccttttttaactgtcaacggcggtatggtgcatgcccttgctattcacgcttatacgcctagcgaatgggtgcagcttgagcaaacgcccaacagccccttgtgtgcttctcgtcgctaa

SEQ ID NO: 913 - DNA, 1143 bp, M.catarrhalis
ccgatgagcatacaaggtctactgcctcgttggattttacagctcattcagcacccacgcactgctttatcggacattccagctggactgatgatggcagtgctggttatcccccaaagtttaggctacgcaaccttagcaggattaccacccatcatgggtctgtatgctgccattacccctgtgattgtctatgcatggataggtgccagtagtgtctcctccatcggtcctgtggcaattactgccatcatgactgcatcggcactgtctggctacgctacaggcagcttacaatatatttcacttgccattgttcttgcctttatggtaggcgggattttattgattgctggactgattcgtttgggctggattatgcagtttgtcagtcgtggtgtcgcctcaggatttatcagtggggcagcggtattaattatttttagtcaactcaagcacatcattggcatacctctaaataccgacagcttaatcaacttatttttaagtatttataccagcaatcagcccatccatttgccgacagcgttacttgggattggtgccaccttgttatttattatcagccgttatggtgaatcgataatttggggctggctacccgctcagtggcgtgggtttggcaatcgcttttttgtcattttaattgttgccatctctatttggctcagccatcatatcggatttgagcaaatgcagatcagattgctacaacctttgcccacaggattgccaaagattaccttacccaatttttctgcaaccactttactagatttattaccctcggcactcttgatcgcactaatcgcttttatctcatcaagtacgatctctgcacagcaggcacggatacgaggtgagtcatacgatgcccaacaggaacttggtggcttggggttaacgaatattccccaccggcctcttgggggtttttccggtcccagggggcatttcacgcaccagcctaaaactttccgtgggtgccaaaacaaccatgggcatccatcatttgggcttttgggtgtattgctgattttgcttgtttcggggcaatatttgacaaggcctgccctaccgctatttagcaagcagtcatcatcagttctgtcatctcaatga

SEQ ID NO: 914 - DNA, 186 bp, M.catarrhalis
agcttaaaggcgtgtgccgtgattgccaccaaaagccataatacgcctatcatcctacaattagaccaagtcagctatcgtgtgagcgatggcgatttggtgagtggtgtcagactgaatattcatgcaggcgagatgattagcttaatcgggccaaatggggcaggcaagttccaccttagttaa

SEQ ID NO: 915 - DNA, 213 bp, M.catarrhalis
catctcttttatgatagtggtaataaaatttggacataccgccatactcgctccaaaccgatggcaagaaattttatcccttataatttcttttctttgggtgaaaccatacagaccaaagaacttgtcattttatttgacagcaaaggcatagtttcaaattatacttttagagaaaccgccaaccaatccaaagctggtttggcagaataa

SEQ ID NO: 916 - DNA, 453 bp, M.catarrhalis
ttaaagatttacaattggtttataataagctcagacaggcagcgattacacgagaaatctcggaaatcgttggtggtgctgccgctgtttcttaggaaatcatttaaggcgtttaatatgttaaatcatcatattcgcctgactatttccgctttactgacggcacttttggtaacaggttgtgtttctactggtaatgttgcaatgaaagagcaaaaccaacaaaccattgagcagaccatcattaagggcaagaccaataagcaagagatttctagtagatttggttctgctgatagcatctcttttatgatagtggtaataaaatttggacataccgccatactcgctccaaaccgatggcaagaaattttatcccttataatttcttttctttgggtgaaaccatacagaccaaagaacttgtcattttatttgacagcaaaggcatag

SEQ ID NO: 917 - DNA, 183 bp, M.catarrhalis
tttagtccatacattgataaatttgactgtggattaacgattgactttatttttatcagttatattatagcagtagtagtaattatcaatcaagaccatcattttaagttatattacaaacaaaaccaagttattatccaatttttatggcaagtcttatgttataaaataacatttttatga

SEQ ID NO: 918 - DNA, 435 bp, M.catarrhalis
tcaagccttttaatcaaaatcaaaatcatgaagcttatgagccgtcctgcccagcgtaataaaaaatctgccatctatcaagtccaaatgcgtcaaatttgggtcgttttgggcgtcatgatatttggcttggtactcagttatgtgatggcagatggcgataggctaattgccaaaggtttgtcgattggtgctttgattgcctttattggacagttgatttttactcgcatcgcttaccacactgtgggtgctaagcacgctcgtcaaatcatgttgaatacttatttgggctttgtgatcaaatgggcgacgaccttagctttatttgcttctgtgttcttaaagattcaatcaatcagcccagcttcggtaatcatagaatacctcattttgattatcagccaaaataaggtcttgatcaagatgaaataa

SEQ ID NO: 919 - DNA, 909 bp, M.catarrhalis
acatcagggtacttatcaatgacaacatttgcattacgaacgctttttaaaagctctgttttgtatcaatctttaaaagctgtgatcctattacccatcaccacgattttttcagtatctgcgatggctggcatggtcagcgttagtaattatccgcttgcacttttgagccatgaagttacccaaggtcagcatgatgccaaagtgctgcttaccgctggagatgttgggcatcatggctcactctcaccaagtaaagtcaaattggttgaagacagtgattatgtcatttggtttggtgaatcgcttgaacaaaatttggtcaaaacattggcagatgcaccgaatgcaatttcattattacagtttaacgccttcaaccgcctgcctttaaggcatattgatggcagccaaaaaccagattcagaagatgcacatatttggcttgatccagaaaatgctaaagccattgtgcgtgcgttgtctgtggtgcatggtcatgccaatccagagcataaagccaaatatgcccaaaatgccacagattttgagcggcgtatggataaagccgtccaaagcgtacaggtcaatggcatgacaccatattgggcgtatcatgatgcttttcagtatatcgaacaggcggcaggactgaaatttgcaggggctttgacgcctgatcatcacttaaacccaaaagccagccaatttaagcgactgaatcaaacaagaccgcagccatttatgtgccttgcgtctcaaggggtggtctcagacggcattaaaaataaacttggtaatgtcaatgtgactattattcaagaggacatgagtggcatgggtgaagattttatcagtgcatgggtggcacaggtgaatgcactgcaaacatgtgctggcatcaaataa

SEQ ID NO: 920 - DNA, 1491 bp, M.catarrhalis
agaaaccgccaaccaatccaaagctggtttggcagaataaaaaacaagataagcaagcaggagaacgcaatgagcggtcgtattgtacagattattggtgcggtaattgatgttgagtttagccgtggcgatgtcccccaaatctttgatgcacttcatgttgatggtactgaaaccacccttgaagtccaacaacagttaggtgatggtgtggtgcgtaccattgccatgggttctaccgaaggcttaaagcgtggcttgcctgtctctaattcaggtgcacccatttcggtaccagtcggtcaagcaacactgggtcgcattatggatgtcctaggtcgcccaatcgatgaagcaggtccggtaaatgctgaacaaaaatggtccattcatcgtgaagcaccaagttatgatgaacagtcaaatagtacagaacttttagaaacaggcatcaaagtgattgatttgctttgtccatttgccaaaggtggtaaagtcggtctgttcggtgctgctggtgttggtaagaccgttaacatgatggagcttatcaataatatcgccctaaaacactcaggtctgtcggtttttgctggtgtgggtgagcgtactcgtgagggtaatgacttctaccatgaaatgcaggatgcaggcgttgttaataccgaagattttactcagtcaaaagttgccatggtttatggtcagatgaatgagccaccaggaaaccgtttgcgtgttgccttaactggtttgaccatggcagagtatttccgtgatgaaaaagacgaagcaacgggcaaaggccgtgatgttctgctgttcgttgataatatttatcgttacacattggcaggtactgaggtatcagcacttttaggtcgtatgccatctgcggtaggttatcagccgactttggccgaagagatgggcttgctacaagagcgtatcacctccacccaatcaggctcaattacatctgtgcaggcggtttatgtaccagcagatgacttgactgacccatcacctgcaacgactttcgctcacttagatgcaacggttgtactaagccgtgatattgcatcacaaggcatttatcctgcggttggcccactagactcaacatctcgtcagttagacccacaggttattggtgaggagcattacagcgtagcgcgtggcgtgcaagaggtgctacaacgctacaaagagctaaaagacatcatcgccatcttgggtatggatgaattgtcagaagaggataaactggtggtttatcgtgctcgtaaaatccagcgtttcttgtctcagccattccatgtggcagaagtgttcacaggggcacctggtaaatatgtggcattgcgtgataccatcgctggctttaaagcaatcatcaatggtgagtatgacgatctaccagagcaagcattctatatggttggcggtattgacgaagttgttgctaaagctgaaaaattaaaagcataa

SEQ ID NO: 921 - DNA, 1563 bp, M.catarrhalis
atcaaaggaaacaaggcaatgcaacaattgaatccagccgaaatcagcaatctgattaagcagcgtattcaagaccttgacgtaagcgcaactgcaaaaactgaaggcgttatcgtcagtgtctctgatggtattgtgcaaatccatggcctagaagaagctatgtatggcgagatgatcgagtttgaaggcggtgtgtatggtatggcactaaaccttgaacaagattcagtcggtgcagttgtactgggtgaatatctgtccctacaagaaggtcaaaaagcatattgcacaggtcgtattttggaagtacccgtaggtcctgaactacttggtcgtgtcgtcgatgcattgggtaacccaatcgatggcaaaggtcctattaatgccaagctgaccgataaagttgaaaaaatcgctcctggtgttatcgctcgtcagtctgttgatgagcctgtcatgactggttataaagcagttgataccatgattcctattgggcgtggtcagcgtgagcttatcattggcgaccgtcaaactggtaaaaccgctttggcaatcgatgcgattattgctcagaaaaactcaggcattaagtgcgtgtatgttgctattggtcaaaaacgctcaaccattgcaaatgtggtgcgtaaattagaagaaacaggcacattggcttatacgactgttgttgttgcgtctgcctctgagccagcagcattacaatatatcgctccatattctggttgtacgatgggtgagtacttccgtgatcgtggtgaagatgccttgattgtttatgacgacctatcaaaacaagctgtcgcttatcgtcagatttccttgctattacgccgtccaccagggcgtgaagcataccctggtgatgtattttatctacactcacgcctgttagagcgtgcatctcgtgtcaatgctgactatgtagaagcatttaccaatggcgaggttaaaggtaaaactggatctttgacagcattgcccatcattgagactcaagcaggggatgtatcagcattcgtacctactaatgtgatctcaattaccgatggtcagattttcttagagtctaatctatttaactcaggtattcgccctgcggtaaacgctggtatctcagtatctcgtgtgggtggtgcagctcagaccaaaatcatcaaaaagctctcaggtggtatccgtacagcacttgctcagtatcgtgaacttgctgcgtttgcccagtttgcctctgatttggatgatgcaaccaaacaacagttggaacatggtgtgcgtgtgactgagctgatgaagcaaaagcaatacgcaccgatgtctattgctgatcaagcggcagttatctacgcctcaaatgaaggctatttgtctgatgtacctgtagaaaaaattggtgcatttgaagaggctttcttacgctacctacgcaacgatcatgctgcattgatgagtgaaattgatgaaactgccaactataatgatgacatcgaaagtcgtctaaaagctgcagttgagtcatttaaagcatcagcaagctactga

SEQ ID NO: 922 - DNA, 483 bp, M.catarrhalis
caacgaggtgattggatgatcaatttaaccattttcggtcagctgattgcttttgcaatctttgtgctattttgcatgaagtttgtatggccaccactgatcggcgcgattaatgagcgtcaacgcaaaatcgaagaaggcttaaatgccgcagaaaaagcaaaagcggatttggtttctgctgaaaagcaagtagaggcagaatttgcagctgctaaaaccgaagctgcatctatcattgagcgtgcgaataaaaccgctaaccaaatgattgaagatgctaaagaacaagctcgccttgaaggcgaacgcatcatcgttgcagctcatgcagctgtagagcaagaagctgcccaaactcgtgaacaacttcgctcacaggttgccagtcttgctgtactgggtgccgaaaagattttgcaagacaaaatcaatgaacaagaacacgccagcatgcttgaacagttggcggctaagctgtaa

SEQ ID NO: 923 - DNA, 891 bp, M.catarrhalis
gttaaaataagaagcttatttatggcagccgaacagacatctacagaatatattgctcaccatttgaccaattggacatttggacaccaccctgaattgggctggaaagtggctcatgatgccgctgaagctcagcagatgggatttatggcgatccatgtggactccatgctttggtcaattggtttgggtattttctttttggcgcttttttgggcggttggtcgtaaagcgacttcaggcgttccaactaagctacaagctcttgttgagatgattgttgatttcgtatacaacagtgttcgtgagtcttacaatggtccatcaaagctgatagcaccgctgtcattgacgatttttgtgtggatttttttgatgaacttaatggatttggtgcctattgactggataccaagcctggctcaatgggtaggttcattaatgggtcatgatccacatcatgtatatttcaaaattgtaccaaccacagacccaaatattactttgggtatggcgattggcgtatttttcttaatcattggttttggtttgaaatataaaggcgttggtggctttattgcagaatttacattgcatccttttagtgcaaaaaatccaattttgcaagctatcttaatcccaattaacctagtacttgaaattgttaccttattagcaaaaccaatctcattgggactgcgtctatttggtaacatgtacgcaggtgagcttattttcatcttgattgcactgatgccattttggattcagtgggcactgagcgtgccttgggcaatcttccatattctagttattactcttcaggcgttcgtgtttatgatgttgacgattgtatacttgtcgttaatctcagcagaatccgaacattaa

SEQ ID NO: 924 - DNA, 198 bp, M.catarrhalis
cccttctttggaatgtttccacctattatttttatccccgcccattatgtcaaccttcaggtttcttcaccttttgtgcaatttgaaaccaagattccttccaccttatttttttttccccaaatttccaacccaaatacctccttacttggcttcttggggacaccccaaaatccgcctccacctaacccaatttaa

SEQ ID NO: 925 - DNA, 525 bp, M.catarrhalis
aaggttgttatgcattcagctcatcatcactgccatagccatcatcatgatagttatcatcaaaatcccgagcagcgcttggctgatgcaaaagcctactgtgccaaacgaggcgccagatttacgccactgcgcgaagaggtctttcagctaattttgcaagcagaaaaacccatgggtgcatatgacttaatcagcgcacttcaacaaagccgcttatctgatgcaaatgcaaaaaaaaccaatatcgcaccggcaaccgtgtatcgctcattggaatttttgattgaagaagggttgattcaccagttaagttccatgaatgcttatgtcccttgttgccaccccagagatcggcacgcggcgtcatttttaatctgccgatgctgtcaaaaagtggaagaatgtagcaatcttcctgttgatagaatgatgaattttgccgccaaagatgcaaactttttggttgagcgtagcaccatagagcttaaaggcgtgtgccgtgattgccaccaaaagccataa

SEQ ID NO: 926 - DNA, 609 bp, M.catarrhalis
ttagaggatatcatggctgaacttactaccttagctagaccatatgccaaagcagcatttgattacgctaaagagcataatgcgatcagcaattgggaagcttttttgttgattgcaagcgatgttgtacgcaatgaagattttgcttcactgctgaacaatccagccatttctgcacaacaaaaagcagatattctgatggatgcctatggcaaattaacagcagagcaagcatcacaagcgttaaccaactttataaaacagttggcagagcatgacagattggcgcttatgcctgagatcactgctcattacaccaagctaaaatcacaagagcttaaacaggttgatgcttatgtaacttcagcctttccactaaccgaagctcaaagtaaaaagcttcaagagcgattagcactttcaacaggttctatcgtgattttgcacgaatctgtagaccccaatttgttgggtggagctacgatcaagtggggtgacaagtttactgatggctcaatgcggtgggaaggtaaaaccattaagaactcaactaactgcggcagtaggcagctggctaaatcaaaggaaacaaggcaatgcaacaattga

SEQ ID NO: 927 - DNA, 255 bp, M.catarrhalis
ggagacatcatggatccagtaatcgcacagtacacactacttgcagtagctctactaatcggtgcaggtgcactagcaacaggtattggttttgctatcctaggcggtaaattcctagaaagtaccgctcgtcaacctgagcttggttcacaactacagaccaaaatgttcatcgttgcaggtctgcttgacgctgtaccaatgattggtgttggtatcgcaatgcttctattgttcgccaacccattcgcataa

SEQ ID NO: 928 - DNA, 930 bp, M.catarrhalis
gcgttggttttaacgcaccataaacccttttataataagtccagtattggaataattatggcaagcttaaaagaaattcgtgctaaagtaaccagcattaaaagtacgcaaaagattacgcgtgcaatgcagatggtggctgccagtaagatgcgtcgtgcccaagagagaatggaattgggtcgtccttattcagatggtatacgccgtgtcatttcacatttggtgcaagcgcaatcagattataagcatccctatatgattaaccgtccggtcaatcgtgttggttttgtggttgtaacttctgaccgtggtttggcaggtggtttgaacatcaatctattcaaaaacttgttaaaaacagtcaaaagctatcaagagcagtcagttgaaattgaatttgcagtaataggtgcaaaaggcgtgggcttttttaagaactttggcggtagagtaacctcagctgtcactgactatggcgataaccctgcacttgagcaaattaatacaccagttcaaaccatgcttgatgattatctcaatggaaaattagatcgcatttacttggtgtataaccagtttatcaatgctatggctcaaaaacccgtggttgaacagattgtaccattggcagagagtgagtttgatgacactgagcttcaggcacacagttgggattatatttatgagccagacaccaaaacgctcattgatagcctactattgcgttacattgaatctgtagtctaccaatccgttcgagagaatattgcctctgaacagtcagcccgtatggtggcgatgaaagcagcgacagataatgctggtaacttaattaaagatttacaattggtttataataagctcagacaggcagcgattacacgagaaatctcggaaatcgttggtggtgctgccgctgtttcttag

SEQ ID NO: 929 - DNA, 417 bp, M.catarrhalis
cgactgctggtctattgggagaatgatatggcaacttttaagtgccgagtggtaagtgctagagaagagatatatgtcggtgatattagtatgttgattgcaaatggtcactctggcgaaattggcattctggcgggtcatacaccattgattactttgctaaaaccaggtcctatgcgtatgaaatctgccgatggatcaagcgaagaggtggtttatgtgtcaggtggcgtactcgaggtacagcctcatgttgtgacagttttggctgattctgccgaacgagcatatgatttggatgaagcaaaaattgccgaagctcgtcgcaatgctgagcaggctttggcaaatcaaagtgccaatattgacacaactgctgctctaaccgcattggcagaatcattagcacagttgtct

SEQ ID NO: 930 - DNA, 216 bp, M.catarrhalis
gcaatatattctgtagatgtctgttcggctgccataaataagcttcttattttaactcaaaaaagaaaaattggtgataaacgccaaatcaaaaaacgaagttaccatttaactcttttcaatccattgttagcagcttggctgattaatattttatcaaccgtacttcccttgtccattaatttcgacaaaatccatacttttgcattgatttaa

SEQ ID NO: 931 - DNA, 1686 bp, M.catarrhalis
ttgaatacgctaagcgcggcattgatccacctccgtggtgaagactggcttagcgaagccccttaccgcatgatacaaaataacctacacccagatgtcgccgaaaacccccaaagtcttgtggtctatggcggaattgggcgggcggcacgcaactgggaatgttatgaccaaattttggcaagtctaaaacagctagaagatgaccaaacactgcttatccaatcaggcaaacccgttggcgtgttcaacactcacgaaaatgcccccagagtgttaattgccaactccaaccttgtgccacgctgggcaacttgggagcattttaacgagcttgaccgcaaagatttgttcatgtatgggcagatgaccgcaggcagctggatttacattggcacacaaggcattgtgcagggtacttatgagacctttgccgaagcagggcggcagcactttggcacaaaaaaaggcgacaaaagcaccgataactggaaagggcgttggattttgaccgcagggcttggtggcatgggtggggctcagccactggcagcgacttttgcaggggcgacatcgcttaacattgaatgccaacagtcaagcattgattttcgtttgcgtacaggctatgtggataagcaggcaaacgacttagaccacgcttatgaacttatcaaagaacacaccagtaaaggtgaggcggtatccatcgctcttttgggcaatgccgctcaaattttgccacagattgttcagcgtgccaaaaatggcgacatcaagcctgattttgttaccgaccaaacatcagcccatgacttaattcatggttacctgcccattggctggacggtagatgattggagggctgcccaacaagacccaagccaacatgccaaattgacccaagaggctgccaaatcgtgtgccattcatgtgcaagccatgcttgatttgcaaaagatgggcgtgcctgccaccgattatggcaataatatccgtcaagttgcctttgacgctggggtgaaaaatgcctttgattttccaggctttgtgcctgcttatattcgtccgctattttgtcaaggcaagggcccgtttcgttgggtggcactttctggcgaccctgaggacatttataaaaccgaccaaaaaatcaaagagctgttcccagagaacacacatgtacataattggctggacatggcaaaagaccgcattcactttcaaggtctgcctgcccgcatttgctggctgggtttgggtgagcgagacaaggcaggtctggcatttaatgagatggtgaaaaatggcgaactaaaaggcccgattgtcatcggacgagaccacctagacacagggtcggttgccagccccaaccgagaaagtgaatccatgaaagatggcaccgatgcggtgtccgactgggcattattaaatggcatgctcaatgtggcaggcggggcaacctgggtaagcctgcaccatggcggtggtgtgggcatgggttatagccagcattctggcatggtgattgtcgccgatggcacagaagcggccgccaaacgccttgccaatgtgctggtcaatgactgtggcagtggcgtcatgcgtcatgctgatgcaggctatgaattggcgattgaaactgccaaaaactatggcttaaatctgccgatggtgaaataa

SEQ ID NO: 932 - DNA, 1074 bp, M.catarrhalis
gaaatcattatgacaccccccaatgtttatcatcaagcccctgattttaaggcatacacaggcagggcagaaccttttgaaaatgacaaagcttgctattggtatcagtacattcaagcgtttgatgatgctcttaatcgaaaaaacaatcaaaaaaaccagccaaaaattgccctaattggatttgcttgcgaccaaggggtgaaccgcaaccaaggacgcattggggctaagcatgcccctgatgccattaaaagcagttttgccaaattaccaatttcatatcaaacacaacaagcctttcaatcaatggcgggcattgttaccgatgcaggcaatgttgtctgtgatgatgatgacacaatttgccccaatttgttagaaattgctcaacaagattatgctgataaaatcagcacggtgctaaacgccaatgccttgccgattggtttgggcggtgggcatgaaatcgcttgggggtcgtttttaggcttgtggcaacacatggcatccgcctccacgcctttggcaaacattggcatcatcaatttagatgcccattttgatttgcgtcaagaccaatacgccacctctggcacaccgtttcgccaaattgctgaacatttggacataaaagagcagccatttcattatttgtgcgtgggcatcagtcagtttagcaacaccgccagtttatatgagcaagcctttgatttgggggtgagtgtgattggtgatgatgattgccatcgccttgattggcaagcgattgaacaaaaaattttggcgtttattgcaccgcttgatgtgatttatttgaccattgatatggactgtttggcaggttctgtcatgcctgcggtgagtgcggtggcggccaaaggtttaagccttgattttgttgagcgttgtgttttgctgattatcaatacaggcaaagttaaggtgattgacatggcagaagtgtcaccaaaatatgacattgatgggcgtgggttaaaagttgctggtcgtttattggcggtgatggttgaagcggttttatcatcatcattcaaatcattgtctagataa

SEQ ID NO: 933 - DNA, 1305 bp, M.catarrhalis
ccatttgttatgtatgataaaaccatgaaaaataccatgatgaaaacacattttgacttattaatcacccatgccaatatcgccaccatgaacagcgattttggctttcatcttgataatcaaagcaatcaaacaaccaagacggcaacgccctatgggcaactgaccaatcacgccattggcatcaatgatggcaaaattgcatggataggccatcatgatgacgcatcgtcattcaccgctgataggctgattgacgctcaaggcaaatggctcaccccagccttgattgattgccacacccatttggtgtatgcaggcaaccgcagtgatgagtttgaagcacggctaacaggggtcagttatgaacaaatcgccaaaaacggcggtggcatcatctcaaccgtcaatgccacacgccaagccagctttgatgaattatacgcccaaagtgaaaaacgcctaaaagcattgcttgctgaaggcgtggcaacccttgaaatcaaatcaggctatgggctggatttgcaaaacgaacgcaaaatgttgcaagttgcccgcaagcttggacaagattatggcatcacggtcaaaaccacctatttggcagcccacgccacaccgccagagtataaagacgatgatggcaacgcccaaaacgatgcttatattgataaagtctgtgagtggttgccaattttgcatcaagaaggtttggttgatgcggtggatgcgttttgtgaaaacatcgcctttaacaaacagcaggtaaacaaagtctttgagcttgcccaatcgttgggattgcctgttaaattacacgccgaacaattaagcgacatgggtggtggggcgttggtggcaagttttgatggtttgtctgctgaccatattgaatacctaagcgatgacagcattcaacgcatggcacaatcaggtacggtgggcgtgctgttgccaacggcattttatgtgttaaaagaaacgcaattacctccgattgacaaaatgcgacagcaaggcgtggcgatggcaatatccaccgactgtaaccccggaacatcgccatctgcttctattttgctggcgatgaacatggcgtgtaccttatttaaactcacgccagaagaggcgctggcaggcacaacattaaacgccgccaaagcgttgggattgcaagacagtaaaggcaaaattgccattggttatgatgcggacattgccctttgggacattgagcgtcctgcggatttaagttatttgattgggcaaaataaatgtgttgatgtgattaacgcccaataa

SEQ ID NO: 934 - DNA, 237 bp, M.catarrhalis
ccaatggcaattttgcctttactgtcttgcaatcccaacgctttggcggcgtttaatgttgtgcctgccagcgcctcttctggcgtgagtttaaataaggtacacgccatgttcatcgccagcaaaatagaagcagatggcgatgttccggggttacagtcggtggatattgccatcgccacgccttgctgtcgcattttgtcaatcggaggtaattgcgtttcttttaacacataa

SEQ ID NO: 935 - DNA, 1578 bp, M.catarrhalis
aacaaattattgtttggagaaaccatgaattcgctcatattaaccccacgaaacctcacctttgcccagcttcgccaagtgtacgatggccctgtcaaaatcagccttgacccaacagcgtatgaagcgattgacgcatctcgtcaagcggtgcaagccatcattgccaaagataagcccgcctatggcattaacactggctttggcctgcttgccaaaaaacgcatcagtgatgatgagcttgagctgcttcaacgcaatttgattttatcgcattcggttggcacaggcgacagattgcctgatgaggtggtacgactaattatggtgatgaaagtatcaagcttggctcaaggcgtgtcaggcgttcgccgtgaagtggtggacagccttttgggcttaatcaatcacaacatcattccccacattcctgccaaaggctcggttggggcatcaggggatttggcgcctttatcacacatgacgcttgccatgttgggatttggcgatgtgtctgtgaatggcgaaaaaatgtcagcaaaaaaggcccttgatgacgcagggttaactccgattgtgttggcggccaaagaaggattggcactgattaacggcacgcaaacatcgaccgccttggctttgcgtggctattttatggcacaagatttgctggcggccgccacggtggttggcagcatgtccattgacgctgccaaaggttcagatgccccatttgacgctcgcattcatgacgctcgtgggcatcatggtcaggcacaaatcgccagtgctcatcgccagttaatcgctgacagccaaatccgtgcatcacacaaagaagatgatgaaagagtacaagacccttattgtttgcgttgtcagccacaagtgatgggggcgtgtttggatgtgattaaccaagcaggcaaaactttgttgattgaagccaatgccgttaccgataacccgttgatttttaatgacaatgatggccctgtggcaatctcaggcggtaactttcatgccgaacctgtggcatttgctgctgacatgttggcacttgccatcagtgagattggttcaatgagtgaacggcgtatcgctttgctcattgatgccactttatcgggcttgcctgcctttttggtcaaaaatccaggggtgaactcaggatttatgatagcccatgtgaccgccgccgctttggcctctgaaaataaatcacacgctcacccagcatctgtcgacagcattccaacctctgccaaccaagaagaccatgtgtcaatggcgacttatgcaggcaggcgtttatatgacatggcttgtaataccgccaccattgtgggcattgagcttttggcagcggctcaaggcgtggattttcatctggaagagggtttacacacctcaccaaaacttgccagtgttcatcaaacattacgccaaagcgtcgcccattatgacaaagaccgctactttgccccagacatcgaaaacgccaaacagctggtgattgatggcaagctgattgacagctggcgggagttgcgtacggattggtttttggcaaaatag

SEQ ID NO: 936 - DNA, 891 bp, M.catarrhalis
agacctgtatttcattccttatctgatgagcaacaaggctatctgtttacctttatcaccatgtgcatttggggtgcttttgggctaatggctcgtatgaatgcctattggcatattcagatttgggatgtattgcttttgcgatttggtatcgctgccgctgtgcttttacccattttatggtggaaaaaagactaccaatttttgtttgattttaaactgctgatattggctctagtgggcagtattgggtattgtatctttgtttatagcggatttttttatgcccctgtggcacatggcgtggtttttttaaatggtacatttccactatttgccgctctcattggctatataatgctaaggtcgcccatcgaccgacaaacaggtatcggcttatcaatcatcgtgatgactttgcttttaatgaccatcagcatcatcattggcgatggtcattttgggcgtggcgatttgatgtttattgccagtggtttatgttggggcttgttttcggtactgcttcgcaaatggagcttttcggcatggcatatcatgtgcggtgttgcgatttggtcggcggtcatctattcgctgatttatgccctgtttatcacgcctgctttttataccgccctacctacgcatttggcaattcagggtatttttcatggcatctttgtggtcattattgccacattaacttatgccaaagctgtcgcaaaaattggcatcttcaaagcaggtagtatcgccaacttagcaccctttattgccagtatcattgcagtgccactacttggcgagatgctaaatactaccttagttatgggcttaattggcatggcaatcggtgcgttacagccttggcgttggtttattgggcgttaa

SEQ ID NO: 937 - DNA, 762 bp, M.catarrhalis
ttcatgatgtcaactttactcattaacacccgacccaagcaccgtgggcaagccattcgtcaaatgacgggtatgccagtcattgatctgccgctgttagacatccagacgctgcccatgacagagaccaaagcatcgatgatgcgtgcatggcttgatcatgactatgatgtgcttgtggtgaccagcgttgagtcagcacggcgagcacttgaatatttagataagttgcatggtggccatcattggcaatccaagttgcctaatgcacccattgttgctgttggtttggcaactgccaaagtattgactgatcgtgggctgcctgttgttttacctagggttactaataacgagggtatgctggcaatgactgagattcggtcgctgatatcaggcagtcgggttttgatttggcggggtgctggtgggcgtaagctgttacatgagacattaaaagcacgaggcgttcagattgatgtcattcgttggtatgagcgatttattcccatggatttgatggataattttcagaaaaatttaaaaataatcaacgaaaaagctgatgtctttgtcattattagtagcgaaatggcctatcaagcatggcggaggttgccgcatcatagacagtatcactatttggcactgggtgagcggcttaagaatatcatccatgcttatgagcctgatgtgatggttgatgagcttgtgacgcttgagcctactgaaatttaccaagtaattcaccaaaatttctga

SEQ ID NO: 938 - DNA, 1845 bp, M.catarrhalis
cttatgtcgttcttttcatattttgaaaaacgtttagagtcttttcctgatattagcctgcccacccatacccattcgctggcttcatttatttatgcctgtactttgggatatcgtggttggcttttgttgtttacagtattaacagcaattgcaggcatctattgggcatatgtgtatgcgtggattgggcaaattgttgactggcttagtgtgtattctcccagtgaattttggacacaaaaaaagtcagatctattgatcatgctggcaatcagtgcattcattccgttggtgcttttgtttgaaacaaccattcaccatcaggtgctacaaggagtagtaccaatgcgtttacgctggatttttcatcagcaaatgctgggccagtcgatgcaattttatcaagatgaattctctggccgtgtgtcagccaaggtgatgcaaaccgctttagcggtgcgtgatgtggtcatgacgctgattggtgtgtttgtctttattctcacatttttggtgggagcaggggctgttttgactgggattcacccactactgacagtgccatttgtattttggattttagcggtttcggctttattggtatttgtattgccacgccttcagcgtaccagtcggatacaggcggatgctcgtgctttgatgacaggtcgaattaccgatgcttatgctaatatcaacacagtgaagctatttagccattcacaccgagaatctggctatgccaaagaagccatgaaacattttttaggcacagtgcatgaccagatgcgacttgtctcactgcttgaaattttggtttctgtgattgctgtcttgacggtctcaggatcggttgcgatgagcgtgtatttgtggatgtctggcgtggtgggtgcaggtgcagttgcggtttcaggggcacttgctattcgtttgcagggtctgacccattgggtactttgggagacggcgggattatttgaatatctaggcacggttcaagacggtatgaagactttgaccacgccacatcatgtggtagatgaccctaatgcccaagtgtttcatgtgaaacaaggacagattgattttaagcaagtttcatttaactatggtaaaaaagaccaaagccaaccattgcttgatgattttagtttatccatcaaggcaggcgaaaaagtcggattggtaggtcgctcaggggcaggtaagtccacgctggttaatttgcttttgcgattttatgatattgatggcggtcaaatttacattgaccagcaagatattaagaccatcacccaagaatctttgcgtcaaaatatcggcatggttacccaagatacttcgctactacatcgtacagtgcgtgaaaatatcgcttatggtcgtcctgatgccaccgatgatgagattatcgcagctgctaaagcagctcacgcatgggattttatccagactttaaaagataaatttggcaatacagggcttgatacacaggttggcgagcgtggtgtcaaactatcaggtggtcaacgccagcgtatcgctatcgctcgtgtgatgcttaaaaatgcaccaattttattgcttgatgaagcgaccagtgcgttagatagtgaagttgaacatgccatcacccaaagccttgatgatatgatggcgggcaaaactgtcatcgccatcgcccatcggttatcaacgatcgcctcgatggataagcttgtggtgatggatcggggtcatatcgtagaaatgggcagtcatgatgagctgattgccaaaaatggcgtgtatgcatcgctttgggcacgccaaagtggtgggtttttggccgaccattaa

SEQ ID NO: 939 - DNA, 333 bp, M.catarrhalis
tcagttcaaccgaattttttacttaataagatgagggcaattatgcaaacctttaacccgaatgaccatatggttttttgtcgtaaatatcaacaaaatcttcccaaattacccaatccaccgtttcctaatgctaaaggtcaagaaatccaagataccatatctgccaaagcttggaatgcatggcttgagttacagaccatgctgattaatgaaaagcatctaagtatgattgacccacaagcaaaaaaatatctcaatgaacagcgtgagaagtttttggataatggcgattatgaaaaacctgcaggttataaaccactaaaagcttaa

SEQ ID NO: 940 - DNA, 510 bp, M.catarrhalis
tgttcatggccactcaaaaaggccattttcagaataggccgggatttgaagcggccaaaaatcgcatattttaggggaattcatctgataaagatttggtcatttacccttcaaaaacctcgtaaaaaatcagtggtttatattgcaagtgatatcaattgcccttattgtaaattcctacacgaacgcatcgatgagctgaatcttcaaggtgttaccatcaaaattatcggctatcccatttatgatgaatcacgactgcctatgaatcatatttggtgtacgacagacaacgccaagcgtgccgccctgctatctgctgcaatgaaaggcattatcccaaatagccaagcccaatgccaacacaacccaaatccactatctgccatccaaaaacaggtaatgccacttgccatcatgggtacgccagcggtttttgatgcccaaggcagagaatttacaggtgatttatccaaccatgaaatttaccaatttttaaaccttcgctaa

SEQ ID NO: 941 - DNA, 186 bp, M.catarrhalis
tgcgtcttgacagcgcttgctcttcttcacgaccgcacaggtcgcttagaaaacacagacatgcgattggtgatattactaattcttcacgaccgcacaggtcgcttagaaattaaaatctacgccatccaaatgctcaatgaacttcacgaccgcacaggtcgcttagaaaacgctctagcttga

SEQ ID NO: 942 - DNA, 228 bp, M.catarrhalis
acgcctcgtgcttttaatgtctcatgtaacagcttacgcccaccagcaccccgccaaatcaaaacccgactgcctgatatcagcgaccgaatctcagtcattgccagcataccctcgttattagtaaccctaggtaaaacaacaggcagcccacgatcagtcaatactttggcagttgccaaaccaacagcaacaatgggtgcattaggcaacttggattgccaatga

SEQ ID NO: 943 - DNA, 357 bp, M.catarrhalis
cgtctgtcagcgtgcgtgtttcattgctttctaagcgacctgtgcggtcgtgaaggagaaaaatggattttcgttgccaactggagatttctaagtgacctgtgcggtcgtgaaggcactcaatcaccatcaatcaatacaaatacttttctaagcgacctgtgcggtcgtgaagttgataaggttttggtctctatgtgcaaagattttctaagcgacctgtgcggtcgtgaagagccgaccatgcaatgctttcacattcagcactttctaagcgacctgtgcggtcgtgaagaagcgacctgtgcggtcgtgaagaccaactccgccaatcgcttttcatctaatattttctaa

SEQ ID NO: 944 - DNA, 282 bp, M.catarrhalis
atatctgaagcgtatcacaaaaacggcaaatatccgtccaagaataacgcttatcaaagaccacgctcacaaggcccgctgatcgtccatttggacagttttgttgccaaaattggtgacctaaagtatcaggattggcagggtggagtacttgagcaaaagcaggctcatgttttaggtatgtcaaaagctcgatggcatttttgctttgtttgtcgtagcgcagggctaagcttggcaggctacgataaactcgtgcgcaatcatcacctgagacgctaa

SEQ ID NO: 945 - DNA, 834 bp, M.catarrhalis
ctgcactttcttcacgaccacacaggtcgcttagaaatagcaccgcccagccgcccacacacgcacattcttcacgaccgcacaggtcgcttagaaaaagcgattaatccgctcaccaattgttctgttcttcacgaccacacaggtcgcttagaaattttgttctatggctacgctgattatttaaaatttttgtgccaatcccttgaaaattttatccttaaccattatgaagatggggaatttatattaacttttttggggcaatttatgaccgagcaaaccaccgaacaaaccactatggaagagattatgaccgagcaaaccaccgaacaaaccactatggaagagattatggctgagacgacaaccgagcaagtcgaagcacttcatagccaaatccaagcgctagaaaatgaagtcaaagaagccaaagagactgctgcgcgtgccaatgccgaaagctataacgcccaacgccgcatggaacaagaaaccgacaaagccaaaaaatttgcactacaaaagtttgccaaagagcttttggaggtggttgacaacctagagcgtgccattaaagatgctgaagagacaggtgcagatgacgcatcacttgaaggtattcgcctaacacataaagtactgcttagcgttcttgaaaaaaatggcgtcgtggccgtgggtaatgtcggtgatacattcaatccagagattcatgaagcggtgggtattttcccagaagccgagaaagatatcatcggtcaggtgcttcaaaaaggctacattctcaacgaacgcaccttaagacctgcgatggtaatggtaggggcttaa

SEQ ID NO: 946 - DNA, 831 bp, M.catarrhalis
tcaagtaattaccatccaaacaaggacatcgttatgaataagcttaaaattggcattatgggcgcatcaggacgcatgggtcgtatgctcatcgaatcgacaatgaaccacccaaacaccgagcttggcggggcttatgtacgcagcacatcaagcttgatcggcgtggatgctggcgaattcatcggcggtaaaaaatcaggtgttgcactctcaacacttgacggctctcaagttgatgtgatgattgattttagcttacctgaagccttcgatgaagcactcaaccagtgcgttacgcacaaaattccgctcgtgatgggcgtgacaggtcttagtgatgaccaagaagccaagcttcaagatgccgccaaacacattgccattgtctatgcaggcaactattcaactggtgttaatttatctctaaacctgcttgcgacgactgcccgtgtgctgggtttggatgctgatgttgaaatcattgagcatcatcataaacataaaatcgatgcaccctcaggcaccgcattaatgatggcacaagccattaccgaagcacgaggacaaaatataaccaatgctgccatctatggtcgaaaaggtgctgccaaacgccaacgaggagatattggtattcatgcgttgcgtggtggtgagattgtgggtgagcataccgttgaatttatgatggatggtgagattatccaaattactcacaaagctcaaaatcgtgcaacttttgccacaggtgcactaagagctgcattatgggcagcccagcagcctgcaggtttgtatgatatgcaagatgtattagagctgaaatag

SEQ ID NO: 947 - DNA, 204 bp, M.catarrhalis
tgttgctttcaatcgtgccaattttgccttcacgaccgcacaggtcgcttagaaaacagggagattatcgcaaaaatacagccaaatcttcacgaccgcacaggtcgcttagaaaaatataagttatcatcaactgtgtgtagctttcttcacgaccgcacaggtcgcttagaaaatcaacgccaagctggcggacggtgttga

SEQ ID NO: 948 - DNA, 1245 bp, M.catarrhalis
gaaaatgatcaactttgtgattacaatctaatcatttactcatttttggtcattttatcgtttgagaaagacatgaatcacttgcacactttttatcatgatagccaagctcttatcaatgctgccattgagccaattgggccttggcaagacagcggtttactggataatattgcaacagcctcaaaacagttacttgaccccatcgccatcgataaaggttattaccccaccgctgagatgagtcaattggcaaaactgggggctttttcggtacatctgtcagcacaaggtggccgctttggtaatgcaatccttgcgacagcaaaaatctctgaaacttgcggtacgacagggtttttgtcatggtgtcatcaggtctgtgctttgtatcttgaccagtcagacaatcacaccttaaaatccgacatcctacaccgccacgcattgggtgaaagctttggggggacagcactgtccaatcccatgaaaacctttgctaatattgaatcgatgattctacgcgcacagcgtgtcaatggtggctatgtggtgtcaggcacgctaccgtggataagccacattgcacccaatcaatattgcggtgcaatcgctagcgtcgagcacggtggtcagattgataaagacatttttttcttattatcatttgatgaagcgcgcaaagacaactggcagctaaacccttgcccaacatttagcggtatggaaggttcaagcacttggcaaatcgccttaactgattactttgttcctgatgatagcttaatcgctgaccctgccaagcccttcattgagcgtgtgcgtggggcgtttgtactcatgcaattgggtatcggtgctggcattatccaaggggcaattcatgacatcactgcggtagaagttcagcttgggcatgtcaatcaattcttagaagaccaagcaggtacactacaaacccagcttgatgctttgattgagcgtactttggtgcttgccaaaacaccttttgaaacacacaaagactttttcttagaagtgctagacactcgcatccaaggcgctgagctgtcactgcaagccacccaagcatcactactgcatcaaggtgcaaaaggctacctgatgagtgctaacccacaaaggcgtattcgtgaagcgcacttcgtggcaattgtcacgcctgccatcaagcatttacgctacttatcccaccaactactgactgagaaatctccaaaatga

SEQ ID NO: 949 - DNA, 1482 bp, M.catarrhalis
ataaagtaccatcatataccgcctaaaattatgctatactttggagacattttatcatttaaagtcatacaaggaattagcatgagcgaacaaacttcaagcatgtggggcggtcgtttttcagaggcgacggacagttttgtcgcagaatttaccgcatcggtcaattttgataagcggatggcacgccaagatattcaaggctctatcgcccacgccaccatgctgggtatgtgtggcatcatcacccaagatgaatcttgtcaaatcattaacggtcttacccaaattcaagccgagattgatgacggtaagtttcagtggttggtagtgcttgaggatgtgcatatgaatatcgaaagccgcttgacgacacttatcggtgatgtcggtaaaaaattgcacactggtcgcagccgcaatgaccaagttgctacagacattcgcctatggctgcgtgatgagacggataatattctggtgctgcttgccaaactacaaagtggacttttggatttggcagccaaccacactaagaccatcatgcccggctttacccatcttcagaccgctcagcctgtcagctttgggcatcatgtcatggcatggtttgaaatgcttgtgcgtgacagcgaacgctttgtagatacacgccaccgaattaatcaaatgccgctaggttcggctgctttggcaggtactacctatccaattgatcgcaccatcaccgcacgcctgctcggctttgagggcatttgccaaaactcactagatgcggtgtctgaccgtgattttgccattgaatttactgccaatgcgtctatcttaatgatgcatttatcacgcatgagcgaagagctgatcttgtggatgagtgcacagtttggctttattcatattcctgatcgattttgcacaggttcatccatcatgccccaaaagaaaaaccctgatgtaccagaattggtgcgtggcaaggcagcgcgtgtctttgggcagctcaccactttgctgacactcatgaaaaatcagccactggcttataacaaagataaccaagaggataaagagccactgtttgactgcgtggacaccttaactggtagcctgcttgcctttgctgatatgttgccaaatatcatcccaaatgtggacaatatgcgtgcagcgaccatgaaaggatatgccacagcaactgatctagcagactatttggtcaaaaaaggcttaccatttcgtgatgcacatgaggtggtgggtaaagcggttgggcttggtgtctcaaaaggcgtggatcttagtgagctttcattagatgaacttcaaagttttagcccactgatagaatgtgatgtctttgattgcctaactttagaaggttcactaactgcacgcaatcacattggcggtacttcaccaaatcaagtattatcagcaattaaacggggtcgtgaacgaattatcaatcccaaaaccgcctaa

SEQ ID NO: 950 - DNA, 1230 bp, M.catarrhalis
cgacaaaaccacgcgttaattgataaggatttatccatggacaaacacacccagctcatttgcgacccccgtcaagtccccatgcaaataaatagcctacagccacctgtataccatgcatcaacgatcatctttgacaacaccaaggcactatttcaaagacactggcgtgatcgttatgattatagctacggcacgcatggcacaccgacaacttatctgctggctgatcaaatagcaaggcttgagggcggcaaatatgcacttttgacacccagtggccttgctgccatcgtgttagtcaatactgcactgcttggacaaggtgatgaggtgtgggtaactgaaaatatgtacagcccaaatcttgagcatctatacgaactacaaaaacgctacggcgtggtgattaaaatatacaacccactggatgcgacaagctttcagccaacggctgcctgtaagctgttatggcttgaggcagcaggatctgtaacgcttgaatttcctgacttacaaggactaatcaacattgccaaaaaacatcatgtttgcgttgccctagacagtacttggggtgcaggactggcttattcgccatttgatctaaatggtgtatctgtggatatttgtgtgcatgcattaaccaaatatcccagcggtggcggtgatgtgctgatggggagcatcgtgacaaatgatgaaaccttacatacaaagctacgacgcatgcatacactcttaggctttagcgtctcaggtgatgattgcgcacgagtttatcgtagcctgccaagcttagccctgcgctacgacaaacaaagcaaaaatgccatcgagcttttgacatacctaaaacatgagcctgcttttgctcaagtactccaccctgccaatcctgatactttaggtcaccaattttggcaacaaaactgtccaaatggacgatcagcgggccttgtgagcgtggtctttgataagcgttattcttggacggatatttgccgtttttgtgatacgcttcagatatttaaattgggctttagctggggcagtgcaacaagcttggtcatgctgtatgacctaagcaaaatgcgtactttaccacaggcacatctgtgcggccgctatgtggtacggttttgtattgggcttgaatcacccaaggatttgatcgatgacatcaaaacagcattaggcagcttaaattatgatgaaaaatcaaaataa

SEQ ID NO: 951 - DNA, 960 bp, M.catarrhalis
acgcttaggcaagggggtgtttttatgaacgataaagttagggtagggtgtgtatattttcacaaaatggtgatttatgatgccaatacaatttctagccctttgacctatggtttgcctgcactaacaggatttacaggcgcatttcatgccttatcacgcaccttaatggcagatgagcgatttgctgatttggcattaggtggtgtgctactggcttgttatgaatgcacgcccaaaacttatcgagcgggcagatatcatgaccatacttttaatcaaactcgtaatccactcaaaaaagatggtaagacagccccaattgtggaggaaggtaagtgtaatttggtgatgagttttgctgtggaggtattagcgtctgatttgctttcagaaaaacgcagtcaagagctgacccaatttttatcacaagccatttttaggcagcgtattgctggtggtagtgtgatgaatattgccaaaacccatcctgtgcggtattttggttttgaaagtatgcatcagatagtaccacttttaatgcctgcatttgttttgatggatgccagttctgaatttagcgaattgattgataaagcccaaagtaccgatccaaaagccacaccgcttgatgtactgcttgatgtgtgtacactacaccatctgccaaagctggatttagatggtaataccaaatggcacaccaaatccatcaaaacaggacatggctggattgtacctatgccaatgggctatcaggcaattagcgaacaatttgaggccggtaaaatggacaatgtgcgtaatcctgagtatccaagccagtatgtagaagtggtttacggtttgggcaaatgggtgtatccacatcatctaaaggacaatattgaaacagccttttggcgacaacactatgatgaaacaggtttgtatctgctgacacaaaacgagttatcataa

SEQ ID NO: 952 - DNA, 222 bp, M.catarrhalis
ctgatttgttttttacagcccttgaccgcttcttcaagcgtgagtgttatgttgtataataagttagcaccttggcgagcttgttgctgggatctaccaccgccaaaccctccaaatccaccaccaccaaaggcttgcccaaagatatcgccaaagatgtcattaaaatcaccaccgctaaagcccccgccaaaaccaccagagcccatgccttgttcataa

SEQ ID NO: 953 - DNA, 1911 bp, M.catarrhalis
attatggctaaagttattggtattgacctaggtacaaccaattcatgtgtggcagtacttgaaggtgataaagtcaaagtaattgaaaacgcagaaggtgcacgcaccacaccatcgattgtggcatttaaagatggtgaaactttggtcggtcaagcggctaagcgtcaagcggtcaccaacccaaaaaatactttatttgcaatcaaacgcctaatcggtcgtcgttttgaagataaagaagtccaaaaagacatctcacttgtaccttttaaaattgtcaaagcagataatggcgatgcttgggttgaggtcaatgataaaaaacaagcaccgccacagatcagtgctgaagttttacgcaaaatgaaaaaaaccgccgaagactatcttggcgaagctgtaaccgaagctgtcgttactgtacctgcctattttaatgatgcccagcgtcaagcaaccaaagatgcaggtaaaattgcaggtctggatgtcaaacgcatcatcaacgaaccaactgcagccgctttggcatacggtatggataaaaaaggtggtgataaaactgtggcagtttatgatttgggtggtggtacatttgatgtatcaatcatcgagattgccgatgtcgatggcgatcagcaatttgaagttttagcgaccaatggcgatacccacttgggcggcgaagattttgacttagcattgattgattatttggttgaagagtttaaaaaagaacaagatgttaacttaaaaggcgaccctttggcaatgcagcgtctaaaagaagctgccgaaaaagccaaaattgagctatcaagcagccaatcaacggaagtaaacttgccttacattactgcagatagctcaggtccaaagcacttggtggttaccatcagccgtgctaagcttgaaagcttgactgaggatatggttgctcgcacaattatcccttgcaaaactgctcttgaagatgctggcttatcagcaagcgatattgatgatgtgattttggttggtggtcaaactcgtatgccactggttcaacaaaaagttcaagaattttttggtaaagaacctcgtaaagatgtcaacccagatgaagcagttgccatgggtgctgctatccaaggtgcggtactgtctggtgataaaaaagatgttctgctacttgatgtgacgccattaactctaggtatcgaaacgatgggcggtgtgatgacaccaatcattgagaaaaacaccatgattcccaccaaaaaatcacaggtattctcaacagcagcagataatcaaccagcggtatcaatccaagtttatcaaggtgagcgtaaaatcgccaaccaaaataaactgttgggtaactttgacttaacggatattccacctgcacctcgtggtgtaccacaaattgaggttacttttgatatcaacgctgatggtatcatgaatatcagtgctaaagataaaggcacaggtaaatcacaatccattcagattaaggcagactctggtctatcagaatctgaaattgaagagatgattcgcaccgctgaggcaaatgctgccgaagatgagaagtttgctaaccttgcaaatgctcgtaatgaagcagatggtcgtattcatgctgtccaaaaagcactaaaagaagctggtgataaagttacaactgaagagactactgctgttgaatctgccatcagtacacttgaagctgctgccaaagaagatgatgctgatgacatcaaagctaaacttgaagctttagataatgcgttcttgccaatcagccaaaaaatctacgctgatgcaggtgctcaaggtgctgagccacaacaagaacaagcaaaacccgctgatgatggtgtcgttgacgctgaattcaccgaagtcaaagacaagtaa

SEQ ID NO: 954 - DNA, 1401 bp, M.catarrhalis
gaaatctccaaaatgagcgatacactttcaaattcagccaaaccaaacatggactcaaacggtaaccctaccgatggtcgtggtgcttggaagcaatttttatgtcgtgcatgcggctggatttatgatgaaaaattgggcgatcctgatggcggattgcctgctggcacgcgttttgaggacattcctgaagattgggagtgtcctttgtgcggtgttaccaagcgagattttgagccatttgtcagccgagatgaagtggtcacccccttaattggtcaccatagcgagactggcgtcatcgtcatcggtggcggcacggcaggatggacagccatcgaagcgttaagaaagctaaatgaaaacttacccatcaccttaatcacaagcgatttgggcgatcgttatatgaagccgcagctctccatcgccatcagccaaaataaaacacccgaaacactcatcaccaaaaaagctgtcgacttagcacaagctttaaatgtgactttggttgcccaaacatttgtactaagtattgatactaatgagcgtatcgtgcgtaccacgcgtggtaattttagctatcaaaaattaattctagcgacaggggcgaccccaatgctgccgccgagcctgcctgctgaatatgtatggcgtgtcaatcacattgatatgtttgccaagctccaagcaaaactcatcgccaaacccaatcaacatatcaccatcatcggtgcaggcatgatcggtacagagattgccgaagatatcgccaaagcaggtcatcaagtcacactgatcaaccgtgacagcctaccgatggcggagattttacctaccattggtggtgaacgcctgcgtgatgctctgacaggaattggtattgattatattggcaatgctcatatcacagacatcaaaccccaagatggcggctatgtgattatttataatgataaaacactctatgccgatgagattatcgcaagtacaggtcttatattagataatcgacttgccaaaggggcgggcattgattacattcgctgcggtatcgtggtcaacccaaagacgctacaaacttctcaccctgccatctatgccatcggcgactgtatcgccattgatgataagccgtgccgatttgtcgcacccttgcgtgaacaagctgccgccatcgcacatcacatcagcgatatggcacacgcaggctatcaacacaaatcgcctttaatacgcctaaaaaccaaatccatcatcatttcggcgactggtgaaatcgaacaagccaaagactggcaagtacaagaaaataccgatgacaagctgatactcacccaaagtagcgacggcgtcatcaccgccaaaattgaaatgaaaacatcgccccaagccaattaa

SEQ ID NO: 955 - DNA, 663 bp, M.catarrhalis
aattggtgcaattgctgttcaggcccaccaaatccaacgggcaatgtactgacagacggtgagatgacacacctaaaccagcttgccaaaaagcacggcatacctttaattattgataatgcctacggtgcaccgtttccaagtattatccacaccagcacaacccttgagtgggatgatgagaccatcttatgctttggcctatcaaagatcggtctgctaggcgtgcgcacgggtatcatcattgcgcatccaaagattgctaaggctgtgagcaatatgaacgccatcgttaatttgtcacctgtacgctttggggcggcgattgccacaccattatttgaaaatgatgagattatttgcctgtctgatgagctcatctccccattttataaaaaacagtcaatatttgctatccaacgtctccaagaagagtttgcagattatccggtttatatccatcagcctgaaggtgtgatttttctgtgggtgtggtttgagggcttaccgatttctacgaccacgctgtatcagattttaaagcaacaaggcacgctgattatcccaagtgagcattttttttgtgggaatgcagacggcggattatccacacgccaaagagtgtatccgcttgtcgattgcccaagacgatcacacacttga

SEQ ID NO: 956 - DNA, 966 bp, M.catarrhalis
tgggtaagcaatttaatgctaccgatcctgatgcatatttggactcatttgccatcggacacaaatccacagggagattacatggcacataaatctttatcgaccaaagccaaaggctatctattatcactgctcattgtcttgagtgtgattggcatttggcacaccgctaccttacccaaacaaatcaccgcacccaccgatcctttgcgtctagagtatcgtattttgatgggtgatatacctgaatttaccaagcctggggcgattgtcgctatccaaaaaagcgaatttccaagcccaacagagtttgctaagactgcatgggtgcatatctctgacccattttatgacaagggattgaatgataaaggcattggcatacagcttggttactccattgggcgggtgttgcttggatttttcttggcgatgattgtagcgattcctttgggttatgccatcggtatgtcacctgtgcttggcagtgctgccacgccttttgttcagatcttaaagcccatctcaccattggcgtggatgccgattgcgctttatacgattaaagactctaacgcatcaagcatttttgtgatttttatttgttctatttggccaatgcttaccaatacagcctttggtgtggcatcagtacgccgagagtggcgtaatgtcgccaagacgcttgagcttagcccactaaagaccgccaccaaaattgtcatccctgccgcagctcccaccatcgtaacaggcatgcggatttctatggggattgcttggcttgtgattgtggcagccgagatgcttgtcggtggcacagggattggctattttgtgtggaatcagtggaataatttatcgcttgccaatgtgatttttgcggtgctgctcattggtcttatgggcatgattttggatatgttgtttgcaatattacaaaaaaaggtgagttatgttgaataa

SEQ ID NO: 957 - DNA, 990 bp, M.catarrhalis
atttatcaaaaatttggatcacatatgaccatacgcaccctaaccattgccacacgccaaagcccattggcactgtggcaggcgaattttatcaaagcaaaacttgaacagctttacccatctttgtcagttgagctgcttgagatggtgacaaaaggtgataagattttggatacaccacttgccaaaattggtggtaaggggctgtttgtcaaggagcttgaacaggctttgtatgataagcgtgctgatattgcagtgcattcactcaaagatgtaccgatggtactacctgaggggctgatgcttggggcttattgtgagcgtcatgcaccgacagatgcttttgtgtctaatcattttgagcatttggatgatttgccgacaggggcaattcttggcacatccagtctacgccgtgagtgtcagctgcgtcaggcacgacctgatttggacatcaaaagtttgcgtggcaatgtcggcactcggttgggtaagcttgatgcaggagaatatgacgccattatcttggcgacaagtggtcttgagcggttgggtttacataagcggattcgtcatgagcttgatgatgaactgtctttacctgcggtgggtcaaggggcgcttgccatcgagtgccgcagcgatgatgaagcaattaagctgttgttatctccgcttaatcaccccaagacacgcctgtgtgtgttggctgagcgtgctatgaatcgtgcccttgaaggcggttgccaagtaccgattgcaggctttgctgtgattgaagatggtatgttgactctgcgtggacgagtcggctcagtggacggtaagaccttattaaaagcacaacagtcacacaagcttatgggtgaaatccaactggatgaacaagcagccgaacaacttgggatagatgtcgcacatgagttactcatgcaaggtgcggatgatattttaaaacaagtttatcaaaatgcccttaattcatga

SEQ ID NO: 958 - DNA, 558 bp, M.catarrhalis
acaaggaaaaatatggcacgcttaactgtacataccgccgaatctgccccagacaaagccaaagaacgcgttagcatggttcaaaaagccaatggctttatcccaaatcttatcggtgttttggcaaattcaccccaagcacttgagatgtatcaagaattgggcaaaatgaacagccgtaacagcctaaccgccgaagaaattgaggtagtacaaattaccgctgctgctcataatggctgtgatttttgtgtggcaggtcacaccaaagctggcaccaaacttcagatgcctgaaaatgtgctaaacgctttgcgtggtcgcaccgccatcgaagacaatgaaaaatatcaagccctagcacaatttaccatgcagctaattgaccgccgtggtaaggtttctgatgatgagcttgctgctgttaaggcagttggctatagcgatcaaaatatcctagatgtggtcatgggtgtggcattggcaactttatgcaactacgccaataatgtcgcccaaactgatatcaaccctgagctacaagcatttgcaccctaa

SEQ ID NO: 959 - DNA, 864 bp, M.catarrhalis
gttatgttgaataatcaaaccgcttcgccactcattcaggttaatgcactcaccaaacgctacggtgatggcgaaaatatttttgaaaatgtgaattttaatatccaaaaaaacgaattcatctgccttatcggtcattcaggctgcggtaaatccaccatcttaaatgccctagcagggcttgaggtagcaagctttggcgagattttgatgtatgataagccagtcacccaaccttcacttgagcgtggtgtggtgttccaaagtcatgcactactgccttggcttacggtcggtaagaacatcggttttgcacttaaagccaaaaccccaaatttatcagtcgccgagacaaaccgtcaaatcgacttttatttgggcatggttggacttgccaaagtcaaagacaaaaaaccaagccaattatcaggcggtatgaagcagcgtgtgggcattgcgcgcgcttttgcgacaaaacctgaacttttgctgatggatgagccttttggggcgcttgatgcactcacccgtggcgtcatccaagatgagcttgtcaatattgttgcagacacccatcagacggtatttatgattactcatgacattgatgaggcgattttacttgctgatcgcatttttttgatgagcaatggtccacgggcatttttggcagaaattgttgaaaataccattcccaaaccacgtcatcgtgatagtatccatcaccatcatcaatattacaaaatccgcaatcatttgcttgattttttggtacatcgcagtcgggcattgcagcagtcgcctgagcgtcccaaaagacccaaagtgattaattttaatcatgctgagtgggatgggctataa

SEQ ID NO: 960 - DNA, 807 bp, M.catarrhalis
tttctaagcgacctgtgcggtcgtgaagaattagtaatatcaccaatcgcatgtctgtgttttctaagcgacctgtgcggtcgtgaagaagagcaagcgctgtcaagacgcatcagaacatttctaagcgacctgtgcggtcgtgaagcccccaacatccgaggcggtagtatcagcatttttctaagcgacctgtgcggtcgtgaagatggagggggcagaccaccgccttctgattactttctaagcgacctgtgcggtcgtgaagttgcagctattgacagtaaaatcactactgaatttctaagcgacctgtgcggtcgtgaagaaatcacccttgaccgtatggcaggcaaaatttttctaagcgacctgtgcggtcgtgaaggattagtgaaatcaaagccatcaacgccaagctttctaagcgacctgtgcggtcgtgaagggttgcccagcgagcagtctaattggctcatatttctaagcgacctgtgcggtcgtgaaggtattgtctctaaagtaatgtttcaccccatttttctaagcgacctgtgcggtcgtgaaggaacacgcctgaatttgcgtttaaattacctttttctaagcgacctgtgcggtcgtgaagcccccaacatccgaggcggtagtatcagcatttttctaagcgacctgtgcggtcgtgaagatggagggggcagaccaccgccttctgattactttctaagcgacctgtgcggtcgtgaagtgaatggaatgttggtacaggtggtaataatgatttctaagcgacctgtgcggtcgtga

SEQ ID NO: 961 - DNA, 351 bp, M.catarrhalis
tttctaagcgacctgtgtggtcgtgaaggagaaaaatggattttcgttgccaactggagatttctaagcgacctgtgcggtcgtgaagacagcataaagcgaagtatttttgtagtgagttttctaagcgacctgtgcggtcgtgaagtggcaataggtgcattcatcctagggcagtcttttctaagcgacctgtgcggtcgtgaagacatcaacaccgtccgccagcttggcgttgattttctaagcgacctgtgcggtcgtgaagaaagctacacacagttgatgataacttatatttttctaagcgacctgtgcggtcgtgaagatttggctgtatttttgcgataa

SEQ ID NO: 962 - DNA, 891 bp, M.catarrhalis
tcactcaaagataatatcatgaaaaaacgcagtcaaaaaacagataatcaaagctttaaatcttcttctaaagaaaaactgaacaaaccacatcaccaagccaagccagccaagcccaaaaatccgtacttttatggcattcatgctgttagtatgttgattaaacgccgtcctgaagaggtgcttggtttatttattcagttgcgtgacgatgggcagatgagttcagagcatcagctgattgttcagtctgccaagcattttggtatcagtatccaaaatgctcaccgtgagcgattgaccgagctttgtggcagtcagcaacatcaaggcgtggttgctctggcacgcaccgcaccgatggcagatgagacgattctggataatttgcttatgcaagatgatgtgctgtttttggtactcgatcagattacagatgctcataatctaggtgcctgcttgcgtaccgcttgtgcgatgggtgtggatgcagttattcttcctcgacaccagtcagcaccgataacaccaactgtggctaaggtttccgttggggcttctgaggtcatccctgtgatatcggtaaccaatttggctcgaacactagaaaaaatgaaaaaatcaggtgtatttatttttggaacggcacttgataagtctgctaagccagcatttgaatgtgattttgggggtaaggttgccatcatcatgggttcagaaggtgatggcatgcgtcgattaactcaaacgatgtgtgatactttggtatatattcctatggcagaagttttggatcgtcctcaaagcctcaatgtcagtgttgccacaggaatggtgttatatgaggtgatgcgtcaaagacgagggtttgggcaaatgccgcttgtttaa

SEQ ID NO: 963 - DNA, 972 bp, M.catarrhalis
actataaaacttggagcatgtttgatggatggcttattgaaatttaccaactttgtcagtaaaacatttgccgtttgggtggtggtctttgcactgattgccacacagtttcctgatgcattcaagcagcttgtgccatggattccttatctgcttggcatcgtcatgcttggcatgggtttgaccttgactttcaaagattttggtgaagtcaccaaaaaccccaaggcggtgattgttggcgttatccttcaatatgttgtgatgccagtcattgcctttttgttggttcaagcatttaggctaccacctgatttggctatcggtgtcatcttagtcggctgctgccctggcggcacctcgtcaaatgtcatcacttttcttgccaaaggcaataccgctttatcagttgcttgcacgacactctccacactcttagcccctattttgacaccagctgtattttatttatttgccagccaatggctacaagtcgatgcaggtggtatgtttgtctctgtgctaaaaatggtacttttgccagtattcatcggtcttatcatccgctcattatttaagcaaaaagtccaaaaagttagtcaaaccatgcctttaatttctgtcattgccatcatactcattgtctcagcagtcgtggcggtgagtaaagatcgcatcattgaatctggtttgtttatcttttttgttgtcgcacttcataatggatttggctatttggtgggctatgctgctgcccaaatcttcaggctgccgctacacgacagcaaagcggtcgccattgaagtgggtatgcaaaattcaggattgggtgcagcgttggctgctgtacactttaagatgaatccattgattgcggtgccaagtgcgatttttagtgtttggcataatatttctggacccatcttagcaatgatttttagccgtatgaatgacgacaaaaccacgcgttaa

SEQ ID NO: 964 - DNA, 969 bp, M.catarrhalis
acatggatttgtattattatgaatacgctcaaaccgaccgatttgaaagcaattttacactccaaacgggcgaatttattttatcttgagcattgccgagtcatgcaaaaagatgggcgtatcttatacctgaccgaaacgaaataccaaaaccactattataatattccgatcgccaacacgacggtcattttacttggcacaggcacttctattacacaagcagcgatgcgtctgcttgctggtgctggcgtgttggttggcttttgtgggggcggtgcgacgccattattttcaggggtagaaatacagtggcttagtccacaaaatgaatatcgcccgaccgaatatgtccaaggctggctgtctttttggtttgatgataaaaaacggctcacgattgccaaagtgtttcaaaaacaacgcctagaatttacccaaaaagtttggttaaaagacaagcagctacaagaagcaggatttgatatcacagactatgatgtcgtacaactacataccgcatttacaaataaaattgagcaagtagacagcgttggtgatcttttgttggctgaagcattgatgaccaagcggttgtatcactatgcaaaaaccaagtgtgcattatcgtttgagcgggattttcatgcaagtgatgatgccaatcgttttttgaatcatggtaattatttggcgtatggtttgggagcttgtactttgtgggtgcttggcattccgcatgggtttgcggtgatgcatggtaagacacggcgtggggcgcttgtttttgatgtggcagatttagtaaaagatgccattgttctgccgtggtcatttgtttgtgcgaaacaaaattttacagaacaagaatttcgccaaaaaatcttacaaaaattcaccgagtataaggcactggattttatgtttggtcaagtcaaattggcgtcgcagtattttaaaggcgtataa

SEQ ID NO: 965 - DNA, 867 bp, M.catarrhalis
aagatgagctgtcagggtgagatcatcatgaaaggagggtatagtcaggattattatcgcttacttggcgtggctgatgatgccgatactgccactattaagcgtgcttatcgccaacacatcgcgcgtcatcaccctgaccgtcaggcaaactcagatgaggatgtggtgcatcagctaaatactgcctatgccatcttaaaagatgataaagtacgccgtcagtacgacaggcaactgccacgcattcgccaaaagcagtggttatggcagcagcgtgccaaattttatgaggtcaagcaggggtttggttatgttgccaatacagctttggtgaatcttggtaagcaacaatttaatcgcctcatcgttgatgcgcatcataccaaacacatggcacaaataacgcagcgagcagccgtgcaccttgggcgtatctggcagcgatttactgatgtatctgctaagcttggctatgatacaagctgcacgatcggtttgcatacggtatacgaaggtggcgagatattaattcattggcagggcaaacgctttaaggtggtcttgccagcggggcttagtcatggtgacatcatcaccgtgcagtgtcatgggtcgcctgtgcgtcttagaatccaaaccaagcctgtgaatatttatgttaaaggtctggatatcaattatgtgatttttttaagtcctaatcaagcagcaaatggcgatactgttgtgctaccaaagcccattggtctgacgcttacgattccaccaaatggcaaatatccgacaaaaattatgctatcaaaccaaggacttcggcaaatggcaagtgtaggagatgtgattgtgcatctaaatatcacctaa

SEQ ID NO: 966 - DNA, 672 bp, M.catarrhalis
caagccgagcgtggaaaatcagcactatgtcatggcggtcttggttcgtggtggtgtttttggtgcaagtggaaaagaatcatgaaattttatcaagaaattaccttaattccccaagcggatatttccccacatgcggtgtggagtaagctctacacccagttacatcttgcctttgttgagcaaaaagatgagcaagataaaacgatttatggtgtatcattcccacaatatcgcaccattgctgataaaaaaattgcctatttgggctgtaagctgcgagtatttgcaccgactgagcaggcattatctgcccttaatttggataaacagcttgagcatttggcggactatatccatatcagcagtattcgctccgtgccagatgatatcaaaggatatgcaaattattatcgtgccattcccaaaatgacacttgatgagcgtatcacacatcaagccaaacggcatggcgtgccttatcataaagcggcagagcgttttgagaattataaagagcaatcattggtatacccccatatccaattaaccagcaaaagtaatcatcggtcttatcctttgcacattggtaaacaggcagcggaggttctcactgatggtagatttggcacttatggccttagtcgtacaagtagtgtgcctgagttttaa

SEQ ID NO: 967 - DNA, 360 bp, M.catarrhalis
acactctttttacttgataaggttcatatgaatacaggtcttaccctcacaaataaagccgctgccaagctcgccaagctcaaacataccgaaggcaatgacgccttaatgttgcgtgtctatgtgacgggcggcggctgttcggggtttagctatgggtttgattttgccgaagaattgggcgatgatgataccacttttgataatggttcagagattttggtcgtggattctttaagctatcaatatttggtcggctcaaccattgactacaccgaaggcttagaaggctctcgctttattgtcaataacccaagtgcgaccacgacttgcggttgtggctcatcattttctatctag

SEQ ID NO: 968 - DNA, 1062 bp, M.catarrhalis
cacaaaacgagttatcataattttaatcttaatacaatgaaatggagtgatctgatgagtaaattaacaacagcaactgtcttggcttttgaacgcaatttggatatttctgatggttttatggcacaaaaaaacagccaaaatgaaaacagtgggattgttcctgtgcgtattcaagaaaagtctatccgtggcacaatcagtaatcgtttaaaaaataccattacaaatgacccagctaagcttgatgctgaaattgaaaaagccaatttacaaaaagtagattcagcatctttattagaagacaatgatactttgattgtgtcatggacatgcaaagtgctaccatttgacggcaaacctaatgtctgtaatgacccaaattatcaagccaaattattacaaacggtgcaaggctacctacaagagcatggcgtaaagacgctggcacatcgctatgcaaccaatatcgctaatgcccgctggctatggcgtaaccgtatcggttctgaaaaaattacggtcaatgtgacatgcaaactggcagatcagcagcagactttaacttttgacgccaaaagcatttctattcacaattttgatacacaaaacccagagcttatgactttggctaactggattgagcaaggcttaaccaatcaatcatttattattttaaatatcacagcagaagcggtggttggctatggtcaagaagtgtatccatcacaagaattgattttggatacgggcaaaactaagagcaaggttttgtatcatattaatgacaaagcaggcattcattctcaaaaaatcggtaatgccattcgtaccattgatacttggtatccagaagctcagtttccgattgcagttgagccatatggacaggtaaccacgatgggtacggcatttcgtcagcccagacaaaagcaggatttttattccttatttgatggctgggtattaaaagataacaagccgagcgtggaaaatcagcactatgtcatggcggtcttggttcgtggtggtgtttttggtgcaagtggaaaagaatcatga

SEQ ID NO: 969 - DNA, 1026 bp, M.catarrhalis
ttaatcattattgaactaataatttatatattctgtaggtattttatgactgtacaattttcaaaaactgattttttaccaccgctttggcttagaaatgcacacttgcagaccattttaccacgctatatcgccaaaaacacgcctgattaccatcgcacgctacttaaagactcactggcacaaagtgatgttgcgtttgattatgtgatggctgatgatcaaaaaggggctgatggcaggtataccacacccattgtggtgctgtttcatggtatggaaggctcaagccaaagtcattatgcacgcacattggcaagtcatatctctaccaaagggtggcattttgtggtggcgcattttcgctcttgtggtggtgtggcggtatcgggcaaggtgttttataatgctggagatgcggctgaattggcacattatttgcaagttttacaacagcaatttaccacaatttatgccatcggtgtatcgcttggcggtaatgccttggcaaaatatatgggtgagtatggctcggatgccattgcaaatcgtgccgtggttgtctctgcacctgtggatttggcaagtgcatctattgccatggaacgcctgcttggtcggtatatctacacgccttatctactcaatcccattatcaaaaaagcgttagataatcggctaagtagcgaggagatcgcagcgcttaagtctgccaagcgtatggctgattttgataatgcattcaccgcaccgcgtcatggttttcgctcaaaaaatgactactatcggcaagcttctgcattaccttatctacgccacattcaaaggccaaccttaatcattaccgccaaagatgatccgtttttgggcgtaacagcagagcctaccgatgtatcgtcagatgtgctactactggatactcgctatggtggacatatcggctttgttgattatgattatcaaaaaagacagtttgatttggggtttataccacgcactgcacttgatttttttggttttttataa

SEQ ID NO: 970 - DNA, 486 bp, M.catarrhalis
ggagataatatgttgaaagttgcaagcatttttgagccgatattgacaggtgatgataggcctaagctgttgcatgactatcctgtcgttcatgtgcagccaattgcatggggcgatatggacggctttaatcatgtgaataatgtggcttattatcgctatgctgaatcggctcgtattgcctacatgcgtgcgattggttttatggcagcacgagaggatttattgacgattttagcaagttcatccatacagtatcgccgtcctgtaacctatcctgatacgctactaatcggcgtgcgtattaagcacctcggtagcaccagtgttgtccaagaatatgcaatgtacagtcaagcccaacaagcgctggttgcaagcggtgaagcggtcattgtccgcacggatatgaacatggtcaagatgccgtggtcagatgaggagcgtgctttgattgaacggtttgagaaccgtcgttttgattaa

SEQ ID NO: 971 - DNA, 1422 bp, M.catarrhalis
gactttggtatcataaaaacattaccgctaaggattatcatgcacattcatattttaggtatttgtggtacttttatgggttcgttggctctgctggctcgtgatttgggtcatacagtgactggctcagatgccaatatttacccgccaatgagtacgcagcttgctgatgctggcgtggaggtttgggagggttatcacgcagaacacttgatacctacgcctgatttaatcgtcgtgggtaatgcatgtaagcgaggtatgccagccattgaatatatgttaaatgaacggttgccctacacttcaggcccgcagtttttatacgaaacagtgctcaaggatcgccatgtcttagcggttgcaggtacacatggcaaaaccacaacaaccaccatgttggcatggattttacaattctcaggcattgatacaggatttttaattggtggcgtgccgcttgtcaatacagatgatagacgcctaagcttggcgtttcagcacagctcatatttaggcaagcaattttttgtcattgaagccgatgaatatgattcagcattttttgacaaacgctcaaaatttgtacattatcggccaacgacagccattttaaataatctagaatacgatcatgctgatatttttgcagatcttgatgccatccagacccaatttcatcatatgattcgtatgataccatctaaaggtcaaatcatcatacctgcaaacactccaagcctagagacaacattagataaaggcgtttggacgaccgtggtgcgtacaagcctaaatggcgatgccgagtggcaagccaaactagatgccaacgacggttcatcattttgggtacatcacaacaacacatcagccatggttcgctggtcaatgagcggtctacacaatgtcaataatgcattgaccgccatcgctgcggcacatcatgtcggtgtgtcggttgaaatggcgtgtactgccctgtcgcattttggtggtattaagcggcgtatggagttgattggtgatgtcgatgatattttggtatttgatgattttgcacatcacccaaccgccatcagcaccacacttgatggtgctaaaaaacgcctaactcctcggcgtatttgggcaattattgaaccacgctcaaatacaatgaaacttggcagtcatcgaccacatttggcagcatcggcagccatcgcagatcaggttatttggtatgagccacaaggactgacttggggtctcaaagaagccattggttctacgcccaatcagcgtgtactagacagtatcaacgccatcattgagcatataaaaacatatgccaaagcaggcgatgcgatcatcatcatgtctaatggtgactttgaaaatattcacggacgactgctggatgcactaagccaaccttag

SEQ ID NO: 972 - DNA, 1425 bp, M.catarrhalis
tattttatcatgtcaaatatttttcgccccgacgatactgacaagccgcttaattttggttgccgctgtggtaaccatcgcagccaaagcgagtgtgatgacaagttatctttggataatcgctttgaaggcgtctctgatcacagccgtattgagcataccaatactgattttattgaagcggtggcaatcaaagctttatttccagatgagccgacccgtcgtgcgttttttaaaactgtcggtaagacaaccgctttagcagcgattgccagtgttttgcccatcgcaacgctccaagaggctgccgccattgacacgcttaagcctgaaaaaaagtcggtggatattggctttttacccattttatgcgcaacaccgctcattatggcagatccacttggttattatgcagaacaaggcatcaaagccaatttattaaaacgggcaggctgggcgttggtcagagaccagatgatgaaccgagagctggacgctgcacattttttggcaccgatgccaattgccatcaatcttggacttggctcagccaagcagaatatgaaagttgccgccatacaaaacacgaacggtcaagcactcgttatggcgcttaagcataaaaataaccgcaatcccaaaaactggaaaggtatgacttttgccattccgtttgagcacagtattcataattatctgctacgctactttttagccgagcatgggctagatcctgataaagatgtcaaactgcgtttaacgacgccacctgatatgatcgccaatctcaaagcaggtaatattgatgggttttttggtcctgagccgttcaatcagcgtgcggtttgggataaggcgggctatatccataccctaagtcgagatatttggaatggtcacccatgctgctcgtttgggacatctcaaagcttcattaatgattatccccaaacttttttggcgatgtatcgtgccatcattaaagccaatgtgatggcaaataaaccaagtattcgtaaagacttatccaaactgctctcacctgccaattatcttaatcaacctgaactggtgctacgccaatctatcatggggcgttttgctgatggtgtggacaccatccaagatgtgcctgatcgcatgggatttgatgtgatgccgtggcactcagtagcagcttggatgatgactcagatgaagcggtggggctatataacaggcaacatcaattatcaagatatcgcaaatcaggtatttatgctcacggatgccaaaaaacaaatgcaagccatgggctacacggtcaaagacgatgagccaaaaattaccgtgatgggtaagcaatttaatgctaccgatcctgatgcatatttggactcatttgccatcggacacaaatccacagggagattacatggcacataa

SEQ ID NO: 973 - DNA, 399 bp, M.catarrhalis
tggcctatcattaacccgttatcaatcagcataaggaaaattatgagtatcatccaaaaatttgacagcaatgacaccttaagcgaagtggcggttcatggcagtgtggtttatttggcaggtcaagtacctgacgatgatagccttgacatcgctgggcagtcacgccaagtctttgctaatatcgacaaggcattggctttggcaggcaccgacaaaaatcacttgctatctgctcaagtgttcatcaaaaatttggaggattttgaaggctttaataacgcttggaaagaatggatggcaggctcaacgccgccagtacgcgcaaccattcaagccaacttggtcaatccaaactggcttgctgaaattatggtcactgctgccactcaatcataa

SEQ ID NO: 974 - DNA, 1881 bp, M.catarrhalis
ggacatgccatgagccaaccgaccaacccagctttaaaccaaatcattgcccaacatgatgaagatgccaaagatttaacccgagtcttgcctgcttctaaaaaggtgtatatccaagggtctcgccctgatattgccgtaccatttcgtgaaattagcttaacagatacaccaacagggcttgcccaaggtggccttgagaaaaatgagccaattttggtttatgatacctcaggtgtttataccgaccctaatgtacaaattgacctaaataaaggtctgcctcatgtacgtcaaaactggattcttgagcgtgatgatagtgaagagcttagtggattaacctcccaatttgggcgtgagcgtcttaaagatattcgcacccaaaacattcgttttgcccatatatcaaaaccacgccgagctaaattgggtaaaaatatcactcaaatgcactatgccaagcaaggtatcattacccctgaaatggaatacatcgccattcgtgaaaatcagcgtcagcgtgaaggcattgatatgcgtcagcaccaaggacaaaactttggggcaaataatttaatacaaattaccccagaatttgtccgctctgaggttgctgcagggcgtgcgattattcctgccaatattaaccatccagaatgtgagccaatgattattgggcgtaattttttggtaaaaatcaatgccaatattggcaattctgctttaggttctagcatcgaagaagaggttgctaagatgacatgggcgacccgctggggggcagataccatcatggacttgtcgacgggtaaaaatatccacgagacacgagaatggattatccgtaattcacctgtgccgattggcacagtgccgatttatcaggcgttagaaaaagtcggtggcgtagcagaagatttaacttgggagatttttaaagacacactcatcgagcaagctgaacagggcgtggattattttaccattcatgcaggcgtgctacttcgttatgtacctctgactgccaatcgtttgacaggcattgtcagccgtggcggctctatcatggcacaatggtgcttagctcaccatcaagaaaactttttatacacacattttgatgagatttgtgagattatgaaagcttatgatgtgtcatttagtttgggtgatgggctaagacctggctgtatccaagatgctaatgatgaagcacaatttggtgagctgcacacactgggcgagcttacccaaagagcatgggcgcatgatgttcaggtcatgattgaagggcctgggcatgtacccatgcatatgattaaacaaaacatggatttgcaattggatgtgtgtaaagaagcgccattttatacgctgggacctctaacaactgatatcgcacctggctatgaccacatcaccagtgcgataggggcggcgatgattggttggtatggtacagcaatgctgtgctatgttacgccaaaagagcatttgggtctgcctaataaaaaagatgttaaagatggtatcattacctacaaaattgccgcccacgctgctgatttggcaaaaggacaccctggcgcccaagtgcgtgacaatgccctatctaaggctcgctttgagtttcgctgggaggatcagtttaacttatcgcttgatccagatacggctcgctctatgcatgatgaaaccatgcctaaagaagcccataaatcggcacatttttgttctatgtgtggccctaaattttgctccatgaagattacccaaaatgtccgtgactatgccaagggattggatgtggaaagaggactacaacaaatgaaagaaaaatataaagaagaaggcagtaagctgtatcacgaagtatga

SEQ ID NO: 975 - DNA, 336 bp, M.catarrhalis
aatcattacattggggtgctgataaagtgttatactatcttatctaataaatctgctacttcactacacggagaagccatgagcgacattttaaatcaatttattcccatcttttttgtcacctttgggatttttattttatttttcttatttatgggtgttggctattttgtcaaaaaaaagccacttaagggatcttgtggcggtgtggcgaccttaatgggtgatgaacattgccaattttgtggcaatgaccccaataaatgcgaaagtaatatcgacaagattgacgataccgctcgcaataaattaagcaagattgccaaacaagcttaa

SEQ ID NO: 976 - DNA, 1266 bp, M.catarrhalis
gaatatcgcatgaaagttttggttttgggtggcggcgtcatcggcaccacaacggcgtattatcttgccaaaaaaggcgttcaagtgaccgtcattgagcgtcaacacgcggttgcccaggagacaagttttggtaatgctgggcaaatctcaccaggctactcaacaccatgggctgcccctcaaattcccacaaaagcgattaaatggctatttcaaaaacatgcgccattagcgattcgccctgatgggtcaagctttcaaatgtcgtggctgacccaaatgctcaaaaactgtacccataaacgctataccatcaataaatcacgcatgatgcgggtggctgagtacagccgagactgttttcgtcagttgcgtcttgatactggtattgattatgaacatcgcacccaaggcacacttcagctatttcgcacccaagcacagcttgatcaggtcggcaaagacattgaagtattaaaagaatgcggcgtggattatgagctactagataaaaacagtctcagccaagctgaacctgctttggctcatgcggccgcacagctgacgggcggtctaagattgccgcacgacgaaactggcgactgtaatttattcaccaaagcactggctgagatctgcaaagatatgggcgttgaatttcgttttaataccacaattgacaaaatcactcataataaccaaaccattactggcgtcatcgctgacggtgagctcatcactgcagacagttatgtgcttgcattgggcagttattcacgggcgatggcaaagtcgctggggcttgatttacccgtatatccagttaaaggatattcattgactgtgcctattattgatgaaagccgtgcacccatttccaccgtcattgatgaaacctataaaattgccatcacacgatttaatcaacgcattcgtgtgggcggtatggcggagttaagtggctttgatttgaatttacgacaaaaacgccgtgagacacttgagatggttaccaaaagcttgtttgatggcggagatttaaaaaacgcaaccttttggacgggtcttcgacccatgacaccagacggtacgcccatcattggtcaaactgatctaaaaaatttgtatctcaatactgggcatggtaccttaggttggaccatgtcttgtggttcaggcagcctaatcagtgatatcattacccatcagacacccagcatcagccttgatggcctatcattaacccgttatcaatcagcataa

SEQ ID NO: 977 - DNA, 1956 bp, M.catarrhalis
attgtgatgatagcatttaaaaatgttgcggtgcgtcgagaagggcgactgttattcagcgatgttaattttcagctgcacaagggtcaaaaaattggcttgacgggcaataatggcacaggaaaatccacactgttcgccaccattttgggtacgcataatacagatgttggcagtattagtttgcctgagtcatggcagattgctcatatggcacaagaggtcagcgcaacagcgatgagtgcgatagactatgtgctgtcaggtgatgaagaatggtggcagctcaattggcaaatcaaccatcaaaccagcttaactgatggtcaaattgcaccaatgtatcagcgttttgaggaaattgatggctatcgtacacctgccaaagcggcgatgattttgtcaggacttggctttggtgaagctgaccacagcaagcaagtatccatgttctcagggggttggcgtatgaggcttaatttggctcggacactgatgcaccgagctgatgtgttattacttgatgaaccaaccaaccatctggatttggatgccattttttggcttgaagaatggttattaaaattcgagggattgattttattaatcagccatgaccaagcttttttagatacagtgtgcggacatattttgcacatcgagcaaggacaaatcacactgtatacgggtaattatagccaatttattcgtacacgagctgaaaggcttgctcaagaacaacaggcctttgaaaagcaacaagccgtgcgcgctcatcttgaggattatattcgtaggtttcgtgccaaagccaccaaggccaaacaagcccaaagccgcattaagcagcttgaccgtatgacacagctgtcgcctgtgatggcagaaaatggctttagttttcgtttttatgaaccgcaacacatggcatcaccgctgatttatttggataatgccaccattggctatgatggtataccaatgctaacaaagatcaatctacgcatcaccccagatgcacgattggggattttgggtgccaacggtgcgggtaaatccacactcatcaaagcattggtgggcgagttgccactcattgatggtatctacaaagtctctgaaacattacagcttggctattttaatcagcatcagatggatagtctagatgacgatgccacacccatgataatgctaaggcgtctgtcaggtcagacatctgatgccaatttgcgtgcctttttgggtggttttgggtttcaaggtgaacgcatcgatacccaaagccgcttattttcagggggtgagcgtgccagattaatgctggcattgcttgtttggcaaagacctaatgtgctgatacttgatgaaccaaccaaccatctggatctacagatgcgaaatgcacttatgttggcattgcaagattttgctggggcattgattttggtatcgcacgatcgagatttgattatgtcggtgtgtgatgagctattgttggtctttgatggtcgtgctactgagtttgtgggggatatggcggactatgctgagcatctacgccgagccaaaaaagcgcatcaagccaatcaaaaaatggacaaatccattcatcaacaatctacaaatacggcaactggtcaagagatatgcttgcatgacagcctaagtaaagaagataggcgtaagaaaaatgcccaaatccgtgaacaaacagcaccgctaagaaagcagatcgctaagcttgaggatcggcttggtaaactgagcgatacattggcgatcttagaaaatgagttgtctgatgctcgtctgtacgaagatgattataagtcagaattattggacaaactcaatcatcaaaacacactaaaatcacaaattgatgacatcgaagagcagcttttgacggcgatggctgagcttgaagtgctagaagatgagctgtcagggtga

SEQ ID NO: 978 - DNA, 1692 bp, M.catarrhalis
cagcgatcagtcactgtgccatctttttggtggcacgactgtaagctttgtacaaataattttgccaacaaagacgcttggacttataatatactcatcgtgcttttaatttggcacctcatcatcaatcaagtatctgccatgacatctacctttacactccctttttggtttaaacccagtcttgttgcagggatgcagcgtggtatcgaaaaagaaggcttaagaatgcagcctgacggctattctgccaagacctttcatcctgccaaacttggctctaagctgacacatccttatatcacgaccgattattctgaaaacctgcttgagctgattaccaagcccatgccatcaattaaacaagcacttgatatgctgcgtgatttgcatgttttagtgcatcgcagtttagaaaatgatgaactgatgtggccgttatccatgccttgtatgacctctgataccgacagtgatattccattggcggactatggctcgtcaaatatcggtaaactcaaaacgctgtaccgctcagggcttggggtacgctatggccgtaaaatgcaaacgattgcaggcttgcattataatttatccgtcggcgatgatttatttggtgtatggcaacatgccgagggtgcaaaggatttaaccgcctttaaaaatgataaatacttggcattgattcgcaattttaagcgcctgacacctttggtactgtatttgcttggtgcaagccctgcggtatgcggtacttttgtgagcggtcgccagcataatttgataccacttggtacaacttgtagctaccatcagccaaacggtacaagcctgcgtatgggtaagcttggttataccaatagcgcccaagaggatttggatattcgctataatcatttggacgaatatattaaaggcctgcaagcagccattggaacgccttatgctgattttgaagccatcggcgtggacgacgctcatggcgtacccattcagattaacaaccacattctacaaattgaaaacgaatattacagccccatccgcccgaaacaaactgccacagcttctgagacacccacgcaagcactgcaagcacgaggaatcgcttatgtagaatttcgtgccattgaccttgacccttattctgatattgggattacaagcgtaacggcgtgttttttggagattctggcattgtattgcttatttaccgactcgccttatctcatgccagaagaagaaaaacgcctaaatcaaaatattgatattgtcgtcaatcatggcagacaagcaggcatcgccattgatactgattttggtaaagaaaatctacatgattggattatccatcacttaacccaaatgcagaccatcgccgatgcgtttgatgcacatcatggcagtaaccagtaccgcactgccttgacaatgatgcaaggcaaagcaatcaatccagattttaccttatcagcacaaatcattgccgattcacaccgtgtgggtggcacctgggcgttaggtaaattactggctcaaaagcaccaaaccgaactgttatcccatacactaagtcgtgttgatgaggctgagtttgatgagcttgcacgcacctccttgattgaacaagcccagctggaagctactgatacgataggattttatgactatctaaaagcctaccgctga

SEQ ID NO: 979 - DNA, 1224 bp, M.catarrhalis
gttcatggcttgataaatgggggcatcaactccatattgaggcatatttttgtactttttatggattttgacatgagtaaagacttttatagcattctgggtgtcgatcgcacggctgatgaaaaagagattaaaaaagcatttcgtaaaattgcgatgaaataccaccctgatcgcaaccctgataatcctgaagccgaagaaaagctcaaagaagcatccaaagcctatgaaacgctcagtgatcctgaaaaacgcgcaacctatgaccgcatgggacatagtgcttatgaacaaggcatgggctctggtggttttggcgggggctttagcggtggtgattttaatgacatctttggcgatatctttgggcaagcctttggtggtggtggatttggagggtttggcggtggtagatcccagcaacaagctcgccaaggtgctaacttattatacaacataacactcacgcttgaagaagcggtcaagggctgtaaaaaacaaatcagctatcaaaccagcgtttcttgtcacacctgccatggtaaaggtgcggttaaagatagcgatgtcgttacttgtagcacctgccatggtcaaggtcaggttcggatgcaacaagggttttttgtcatgcaacaaacctgtcccgattgtcatggtacaggcaaacaaattaaaaacccttgtccagattgtcatggtcagggcaaaacagttcagcaacaaacacttgaggtctctatacctgctggcgttgatgatggcgaccgtgtacgcttagctggtaagggtgaggcaggcgaccaagggatgccaagtggtgatttgtatgttgaggttcgtgttaaaccccatgaaatttttacccgaaatggggctgatttacacatggatatcccaatctcaatgatttcagcggcgttaggtgatgaaatcgaaatcccaaccttagatggcaaagttaaaattaaagtcgctgaaggtacgcaatctggcaaacttttgcgtgtacgaggtaaaggcgttacgaccgttcaagggcgtatgcaaggtgatttaatttgtcgcattcttgtccaaacccctgtcaatttgaccagtgaacaaaaagatttgttgcgtcaattacaagggacgcttagcaccgaaaacagtagcgagcctaagaaaaagggattttttgataaaatcaaagatgatgtcaaagatttgtttgactga

SEQ ID NO: 980 - DNA, 1389 bp, M.catarrhalis
ataaaggaagttttcatcatgacaacaaacgaccttgccaaaactgcagtcagtcgatttttacaaaatcaaattgcaatcaaatcagaaaaattacaaaaacagcttaccaaagctcaagaagatggtgatgtaacgacaattggtcaacttcaatcacagattcaagaaattgagcaaagattcaagaaaagtgtttggcttgatttggcggcaaataggtggacacaatggatgacatttggcacacatatctctaaaggcattcatcttagtgccagaggtgataatgttaattttgtttttaatagacagctgcccaatactttaataggcacgcacagccttaccgatccagtactagatgccagtggtcatgcagcggcactgcctttggcgacattctttgattttgatgtggcagatggtcttaaaatacgagatttaattcttcaaaatcatgctggctttatcagctctttatctgatgatgagcgtatggcggcaaattatcatagtgcttttaaaaaagccctgcaaaataacacggataacccaagcacacatgagctcaataaacagctactttggcatatcaatgccgacaccgcttgccagcttaatgagctggactatatcaatattatcccattatatccatcagtattgactcatggggtttatttaaaaattaatcaattaagatattctgatgataataaaaaagccttagagaaccgctttaaatccaatgcactgcatacatcttatgtcagtatgccaaatttggcaatcgtacaattgggcggctcaaaaccgcaaaatatcagccagctcacaagccgacaaggcgggcgtaactatttattgccctcattgccgcccaaaataagccaagaccgtgaattttctttatctaaattttgtgaaaacttttttgatagtaaaactttaaaataccatattcaagatgattttaattatgtggttcaagttgttaaagataccagaaatacaatcgatgtgcgagataaacgcaaagatgccatagaccgcttattgcatacgatttttggcattgcccatgtattacaaaataaaccagcaggctggtcaaagacttatgcactgccacttgcccaaaaaatatggctagatccttatcgtgctgatttagacggtgaggccaagtttgctgacgaaaaaaccaagcaggaatggcaaaaaatcattttacaagattttgcgtcttggtttaatcagcagttgcgtagcacggtcaaagagctaaaatttgattttgcagatgcggaatataatgagtggcaacgagaaattgaagagatgcaaaaattttatgaacgcttaggcaagggggtgtttttatga

SEQ ID NO: 981 - DNA, 231 bp, M.catarrhalis
atgcacctattgccacttcacgaccgcacaggtcgcttagaaaactcactacaaaaatacttcgctttatgctgtcttcacgaccgcacaggtcgcttagaaatctccagttggcaacgaaaatccatttttctccttcacgaccacacaggtcgcttagaaattattggtagggtaagcgaatgtaccaagcgtcttcacgaccgcacaggtcgcttagaaatactttaa

SEQ ID NO: 982 - DNA, 3576 bp, M.catarrhalis
aagatgccattgttctgccgtggtcatttgtttgtgcgaaacaaaattttacagaacaagaatttcgccaaaaaatcttacaaaaattcaccgagtataaggcactggattttatgtttggtcaagtcaaattggcgtcgcagtattttaaaggcgtataaaatgattgtgacctttatttcccaatgtgaaaaaaaggcactgcaacgcacacgccttgtgttagatgcgtttgccaatcgcatcggtcataatacttggcagaccgtcattaccgaagatgggcttgtcatggtcaaaaaactgcttgcacgtaccgcaagcaaaaataccgccatcagctgttaccgctttcacacacgcaaacacagcgagctgttgtggattgtgggtaatcgccataaatttaatgaatatggctgggtgccagtgaaccaaacacgccgtaatattttgcacagtgaatggcaaaatgattggtactatatcagtgccatccaaatcatcgcaactttggcagcactgctacatgatttgggcaaatctacgcttggttttcagcataagctaaaacatggcagcacccaaggcgatccttatcgccacgaatggatttcgctgaaaattttgctttggctgatccaagattgtcaaactgattctcagtggttagaacgctttggacgcattgatgagtggctaaagacccaaaaattatcagcgttaaatgattatttaaaaccttgtaatttggatcatgccgatttatccaaattgccgccacttgggcagtgggtggcttggcttgttgttagccatcatcgtttgccacctttggtcaatgtatttttaaaggaacaagaacgcataagttttcaaacaaatgcctcaaccttaaaattatattttgaacgcccgctaactaagatttatgcagatttcaccgccaacgaccattgggtaaaaaatcccataacctttgaaacagctcataaagccaataaaaaattggttgatttttggcaatttgatcagtgtgtgattgacagtaacgcttggcaaagtcgcataaagcgttgggcaaacaaagccataaaagacccaactttacaagcactgtctgcacaagataagccgattgataatgctattttactgtatttatcacggctgtgtttaatggtcggtgaccataactactcttcattaaaagatggcgaccatcgccgtgttgctacaaaatcctctttaaatctacttgccaataccaaccgtaaaacaaaacaacctaagcaatttttagatgagcatttgctgggtgttgcttcctttacggcacattttgctcgctatttaccgattatcggtgagcaattaccgacattgttgtcgcatcgcctattaagcaaaaataccaatattgagcgatttgtttggcaaaattatgcctttaacatagccaaaagtgtgcaagctgatagtgatgtgcatggcttttttggggttaatatggcatctactggctgtggcaagaccattggtaatgctcgcattatgtatggcttatcagatgagaaaaaaggggcaagattcaccattgcgttagggctgcgtgtattgactttgcaaacaggcctaagtttgcgtcaggatttacagttaagtgatgaggtcttggcgattttggtgggcggcggcggtattcggcagttatttgaaatcggtgaacaacacaaaaaccaagatgactcaagtacagcttggggcagtgaatcagcagaggcgttggtagatggctttgtcgattttgcgtctgagtatcatgctgcccatcttgagctggctaagctgaatattgatactttattggctgataataaagccaaagatttactattttctccgatagtcacttgtaccattgatcatctgattggggcgagtgaatgtaagcgaggcggtggctatatcacaccaatgcttcggctgcttagtagcgatttgattttagatgaacctgatgaatttgatcataatgacttgcctgcattagcacggctggtacatttggcaggcatgtttggttcaaaggtgttgctgtcatcagcaacgctaccgcctgatttggttgctggcttatttgaaagttatttagctggacgcaaattgttcaatcaaagccaaaataaacctgcaccacaaaccgtctgtgcgtggtttgatgaacaaaaacatggcagtatggtgatatcttgtgataaggtggagacctttaggcaacagcagcaaatttttatcaaaaaacgcatcagctttttacagcagcagcccatccgccgtaaagctgaaattctgcctgtcggcatggcttatcatcaagataaaaaagctgaattttatagcacattggcacaaaatatcattgatggtgctgttcggttgcatcattgttatcatactgttgataaaaaaacgggcaaaagtgccagcattggcttggtgcggattgcaaatatcaaacagctaacacacattgcgttttatctgcaacatgctcaagtcaaccaaaatacacatatccatgtggtgtgctatcacgcacgacagcttttgattttgcgaaatcgcttggagcgtcgcttagataaagtattaaaacgcagtgagcatgacgaacagctgctttttactcatgatgacattgtgcagcagatgaccaaaagtcaggctaagcagcatatttttatggtattggcaacacctgtggcagaggtggggcgtgatcatgattatgattgggcgattgttgagccaagttcaatgcgatcaatcattcagttggctggtcgagtatggcgacatcgcccaaataaacaggtgtttgatagcaatatcttgatactcaataaaaatattcgtgcattacaaaatcaccatggacctgtatttaccaaacctggctttgaaaccaaaaaatataagcttacagaacatgacatgaccgccttaatgagcgataatcatctaagccaaattgatgctcgcccacgcatttggacagatactatcaaagatagacccgaaagcttggagcaattggaacatactttgatgcatgatttatttggggcaaataaaaccaattatatcaatgcctattggcgagaagcgggagcatctaatcggatacatactcatttgcagcaagtgtcgccatttcggcacagcatacagcaagatgaagcgtgggtgctgattcccaaccaaatcgtagatggtcagggtgatggatttagggtatatgccatggaggatattaatcaaaatggtttatcacatgccaatctgcacaaccattatattcaaatgatggattttgattatcatcacgcacaaattagcacttggctggtctgtgatgtgtacgatgaaattaggcggttacagacacatttgatggtgcgtaatttatcccatgtggcaatacaatttagcaaagtaatgctagatagtcggcaatctcaatggtatttttcaccctttttaggtatgatgtcagagcgacttgactgctag

SEQ ID NO: 983 - DNA, 225 bp, M.catarrhalis
gctttggcatttggcataaaatatggctgtttaaaaatcagagtgtgggtaagctttttaagtaaaggcttgtttgatcatttgccatcaaacaagcctttattgtcaaaccacagattgggccattttgatacaaacatggatgaaatcatcaaatgttatcttatttatacatatgttatcaataaattgttatcaagggcaggtatatccaagtttaagtga

SEQ ID NO: 984 - DNA, 549 bp, M.catarrhalis
gattatttttcaccattcactcacccaaaagagcttatcatgacgatgccaaactatcgcacactcaatattatcttgtcactcatcatggtggcaggcagtgtttatgctattggttatttacaaaattacttaatgctagacccatgccctttgtgcatttttcagcgtattgggctttggatcatgggtatattcgccttgcttgttgccatcatcaacccacgccagaaactggtgcgtttaatactttgggttggtagtatggtaggcacgctttgggggtttggggtggcagctcgtcatacttggattcactatgccccatcagcccagccacctgcctgtggtccagggcttgagtattgggtgcagaccatgcccatgtcaaaggtactcacaaccgtactaacaggcaatggtgattgcggcatgattgactggacattgatggggctatcaattcctgcacaagccatgattttattcatgatcatcgctttgattcaggtgatcattttaaagaaaatattaagtaacaaccgataa

SEQ ID NO: 985 - DNA, 1635 bp, M.catarrhalis
tcaaatcactccaaaattcatcacaatttgtcaatcattacattgacaaaagcagatttattttggtctataaaaccaattcacacaattttactgagaatagttatgagcaaaagcatccaatccaatctttcatcaaaacacagtcaatcaacaacaccgcagcattatttacgcatttggcggtggcatttttatgcagggttatttgtcataccatttttggtgattttggccggcacagggcttggcatgattatattatccaatacggttggcaaacaaggtgagcttatcagcgtatcgccacaaaacaccagtatggcagtatctcatcaagctcacatcgccacatcaaacatcgctggcggacaagtgacgcaatacatcgctccaaaagatgatcatcatgccgccgcttttttagttaaaaatcatgatacgcaagttgccaactgggttgccatagacccctacacggcccaaatcgttggcacacaaccgcaaaaatctggcttatatcacacattagacagcattcatggtgatttattgatgggtaaaacaggagatttattgcttgaaacagcggcttctttaaccattttattaatcatcactggcatttatctttggtggcaaaaacgcaaaagtgtgataaaaatgctgaccgtacaagacaccaaaacaaaacgcaacttatggcgtgaaatacacgcagttttaggcagctggactgccattgtgttgttatttttttgtatcacaggcttggcttgggctgggatttggggagaaaaaatcatgcaagcatggaatcagtttcctgctggcaaatggggcgtagaacctgtacctacctccagtttacccgttgatactgcccatgatgacgcatcataccagcaacaaaatacagcagatacaccccatcatgccacagatatctcagcacccacacacggtgacgctcttaatgatggcacaaaacaagtgccctgggtacttgaaaaaacccccatgccaagctccacgcccacatcaaacgcatggcaaatgacgcaaccagacattgattttattgataacatggctaaaaacatgggctttgtgggacgatatcaaatcaactaccccaaaacaccaacaggcgtttggagcatcagccaagattcgatgagctatgacagccccaatccaaccgctgaccgcacagtacatattgaccgttattctggcgaggtattggcagacattcgctaccatgactattcagcatttggcaagtttatggcggttggtattgcactgcatatggggacagcaggaatttttagtattttggcaaacctcttattttgcttaagcgtcattgccatttgtatcagcggtcttgtgatgtggtggcaacgcagacccgccaccaacctgcataaaaacaacaaatccgctttaccgatgggcttaatccccccagccagtcaaaaaaacattcccatttggtggggttttggtggggtgttattgttaatttcagcactctttcccatggggttgtttgccatcttggttatcgtcattttagattggctcatcatcagccgagttccattattaagtaaactattaaaataa

SEQ ID NO: 986 - DNA, 198 bp, M.catarrhalis
ttaaattcatccagacaaaaaggcaaaaaatatgcgaccaatttagtcgcacattgtacggtttcagatgatggctttagtgtgcctgctcccagttttcaccgatacctatttcaaccacgagtgggacagcaaaatcaaccgcccagcccagctttttcgctgtatcggttagggcattttgcatcgctgttttga

SEQ ID NO: 987 - DNA, 744 bp, M.catarrhalis
tatcattcgtcacggaagaccaatgcgatgacaataataaacaagatgagattaagtgtgccgtcttcaagacagtcatcagaagagagtactcagcggttgcccatatcagatttgatgagtggattaatggtgttatttttgttcattgccatcagcttaattttgcaagtgcggcaaatcgctgaagaatatcaggatacccaagagcaaatttataaagcattgttacacgaatttgcagacgatttgcccaaatggggagcaaagatagataaagatacattaaccatctcatttttgtctcctgatattttatttaaaacaggtcaatctgatttgcaggataattataaagaaattttatctgattttttcccacgctatatcaaagtcatcgaccgctataaagatagcattaacgaaatccgtatcgagggtcataccagcagcgaatgggcggcgggagtggatgctgatattgcttactttgagaacatgcggttatcacaagaccgcacccgtaccgttttacaatttgcttatgccatacctgaggtcagtcagtatcgtccatggataaagacacatttggcagcagtgggcttatcttctgccaaaaccatcaaaaatgagtctgggctagagaatgctggtgcatcaaaaagagtgacttttcgtattttgaccaatgccgatgaacaaatacaaaaaataagcaagagttcttatgaagaaaactaa

SEQ ID NO: 988 - DNA, 210 bp, M.catarrhalis
attgccttgccccaaagcagcagcttttcggtcatggtggttttaccagcgtcggggtggctgatgatggcaaatgttctgcgttggttgatttcattggttaaatgggttgtcattgcttgcctttttgtagatgatgtatacattgatgtgtacggtgagatacaaaaattaaaccagtcaaataaaatgaaaattattataccataa

SEQ ID NO: 989 - DNA, 267 bp, M.catarrhalis
attatgtctacttttgcacttttatttgatgtcatcacggcacctattaatatggcatttttgttggtcatgttagggttatttatcatagggtgggttgctgtcggtcgtgatgatggtcataaacctaggcattttatcgacagtattcccacattgctgacatccatcggcattttgggaactttttttgtattgtattggctttacttgcctttgatgatagtgatatcaaatctcatatcaatgacatcatctcgggcatga

SEQ ID NO: 990 - DNA, 369 bp, M.catarrhalis
gcaagacaaacttacatcatcacatacttatcaaaattcggagtatatatgaagttaaaagctattgctacattgggtgcattggcattattattacaagcttgtgcaacgccacacgtggttcaaaccaaaaaaattacagacaacgagctgacctgcagtcaaatcaagagcgaaattgctgaagctgaggaatttgagaagaaagcgcgtgccgaacgcaaaataactggcaaaaatgttgcagcagcagtatttttctggccagccctacttggcacatactcaaatactgaagaagcaattactgccgccaaagaacgtcaagcattattgacagatttgtattcaaagaaaaactgtcaataa

SEQ ID NO: 991 - DNA, 2664 bp, M.catarrhalis
atcaaattcgctataatagacagttatgtcaaaaagacacccatcgcctgccaacgagtcatcatgagtaatctatttcaaaatccgaccattgcccgctttatgggtaagctacctaccattaagcaattgatttttagcatttttggcattgtattgttggtatttttatttttatcgctgctgtcttatgatcagacggattcggcatggtcacatgttggcagccattcaaccattaataatgtcggtgggctacttggtgcttgggtatcagatattttgcataccttatttggttttggggcatgggtggctgtgctggtgctggcatatgagctggttcggctatggtggtcgcatgttaagctattttgggtactaagattatttgcctatgggctgttgatattatttgtcagtgccttgcttgcttatattggtgagatgacaaatgctttgcttgcaacccgtttgggcggggcgattgggtttgagctacaaaaaagcttggctggtatttttggcgggacggtaacggctctacttttgatcggaataattatcctcatctctttgttgagctttgagattcgttggcgttatctgatgggtctggtttttcattggattggcggcgataaatccacccccaaagtagacttggagcctaaaccagaaagtgcaaacagtaccatcagtaccataccagatgaaagtacaagccctgttacatcggcggtggtaagcacaccgcataatcatgaaggtgtgcttgagagctttttacgccattctggattgcgtgatgagctaatcgctgagcgtgataatgaagccagcaaacaagctgccaaagcagaagcggaaaacatttaccaagaaacgcaacaagcagctacaactgacccgatgaagtatcgtcatgataagttggatgacgcaacgcatttgggtgagctaaatgagtcgtccaaccagatcgtcattaataacaacccatcaaccgtagagcgatttaaaacaattcaaaaagttggccccaactttgatgaaaatcaggcgactgaagttaaaacaaccaaggacaccaagcctaaccaagagcagacgcatcagacacccaaaccaaaacagtcagcaacgcctgtacagtctcgtgcgatggataccttaagctatcgtttgagtttaacaccgattcctgagctggacttattagataagcccaatttatccaataaacctaaagtgagcgatgatgaactgcagcaagcttcagagcttttggagattaaacttcaagaatttaatattcaagctcaagttgtctcagccatggttggccctgtggtcacacgctttgaggttgagcttgcaccgggtgtcaaggcaagccgagtcacacgcatctctcaggatttggcacgctcgatgtccaaagcatctttgcgtgtggttgaggtgattccaggtaagccgtatattggtattgaggtacccaatcaaaagcgtgagatggtgcatttgcttgagctgttggatactaaagattatcaaagtccaaataaccaaattgccatcgctgtcggtaaagacatcagcggcaagcctgtgattgctgatttggcaaaagcaccccatatgctggtggcaggcacgacagggtcgggtaaatcggtattggtgaactcatttttattatctatgctactaaaatacacgcccgatgagcttaaacttgtactcattgacccaaaacagcttgaacttgccaactatggcgacattccgcatctattgacccctgtcatcactgatatgaaagatgcggttgctgctttgacttggtgtgtcaatgaaatggaacgccgttatcagctgatgagcaagcttcgagtgcgaaaaatcagtgaatttaataaaaaagtggaagtcgccgaagctgagggtgaaccaatttatgaccctttatggcacattaatcaaagtgtcagccaagataagccgcccaagcttaagccactgccaacgattgtgattgtggcggatgaatttgccgatatgatcatgcagcttggtaaaactgccgaagagccgattgtgcgtttggcacaaaaagcacgcgccgctggtattcatttattgcttgctacccaacgcccgacggtgaatgtggtaacaggtttgattaaggcgaatattcctgctcgtgttgcactgcgtgtcagctctaaagttgatagtcgcacaatcatcgaagaaggtggcgctgaggatatgttggggcatggcgatatgatgttcattgggccgggtaaaaatcatcctgagcgtgtgcatggtgcttatgtggatgacgatgaggtcaatcgagtctgtgatgcttggcgtgagcgtggcaagcctgactatattgatttatctgacagttattcttttgaaggtgagggtagcggtgatgcaggtggtagcgttgcaggcgatgagttatatgaggcggcagcggcttttgtggttgagactaaaaagccatccatctcatcggtgcagcgtaagtttagtatcggatacaatcgtgctgcgcgtctgcttgaccaaatggaagagcgtggactggtctcatcgatggataacagtggcaagcgtcagctgcttttgtag

SEQ ID NO: 992 - DNA, 294 bp, M.catarrhalis
tcagtattttaccgcaattttggagtagatctaatgccaaccatcgcccacagccccgatactcagcgttttgaaacgaccattgatgggcatactgcgtatctcagctatgccattattgatgataatacgctaaattatcatcatacttttgttccgccacagttaggcggtcgtggtgttggtacggcattggtgaaatacgctgttcaatatgccaatcaaaataataaaaccatcataccaagttgtagttttgtggcacattacatcaataagcagcacacaacataa

SEQ ID NO: 993 - DNA, 2925 bp, M.catarrhalis
ttttttggttataatatcaaattcttcatccaatttttaaatccaatgactgccatgacgaataccgcttacccaaatattaacagtatcccaagtcttgccaaactatccacagaccaagttgataccactcgtccgcctgtgattttggtagacggttcttattatttatttcgctgctttcatggtctaccaccgctatcaaattctcaaggattgccaaccaatgccatccgtggcgtactaaatgcactcaacaagctgattaaaaaatatcatcccacccatatggcagttgcatttgataccaaagcgcctacttttcgccacaatttgtccgaagcctataaagcacatcgtcctccgatggacgaagcattacgcatccaaattccttatattcatgagatgattgaaaaactgggcattgcactcattaagattgatggttttgaagcggatgatatcatcggcacattggcctatcaagcctgccaacaaggccatcgggtcatcatctccacaggcgataaagacatggctcagctggtgaatgattgtgtcatgcttgaagacagttttactggcaagttgaccgataacgcaggtgtgatagaaaaatttggtgtgaccagtgaacaaattgccgattatctggccttgatgggtgatgcgtctgatggtatttctggtattcctaaagttggtcaaaaaacagcggccaaattactcaatgaataccaaaatatcgatggcatcttagccaatcttgccaatatcaaaggggcagttggtaaaagcattgccgacaatcaagacagtattccactcaatcgcattttagcgaccatcgttaccaacctaaaacttaccataagctttgatgatattacgcttgaccacagccaagaaacaacaatcaagcgtgcacctgccttgtatgcactctttgaagaattagaatttaaaaaagaaatggctcaaaccgccgagctgcttaatttgccccatcagccaaccgataaagccgtatctattgatatccatgacaacaccctttcaagccaaaccccaatactacccatcaaagatatctcttatcacaccattacaacccaacaggattttaccaaactgttggataaattaaatcatacgccctactttgccattgacaccgaaaccactgatatcaattggcaacacgccaaactggttggcatttcagtgagcaccgctgattatgaaggctactacattcctgtcggccatacagcagattttgatgttttacttgataatcagttgccgattgataccgtattatcagcatttaaacccattttagaaaatccaaatatcggtaaaatcgggcaacacttaaagtatgatgcccatatttttaaaaagtatggcatcaacatatctccttggcaaatggataccatgcttgctagctatgtcatcaatgctgctgcaactcgtcatggtatggatgcactggctaagcattatttgggcgtacagaccacaacttttgaagatgttgcaggcaaaggtgccaaacagcttagttttgataaggtcgccatggatgcagcaagccagtatgcatgcgaagatgcagatattacctttcggctatttaatagatttaatcaacacatcaatcaagataaaacggctgcccaactgttataccatctagaaatgcccaccgcccaaattctaacccaaatggagcatgatggtattttaattgacactgattttttggggcaattatcaggtgaatttgataaaaaaattatggcactacaaattgaggctgaacgcattgcagatgagccgtttaatttggcaagcccaaaacagcttggtgagattttatttgacaaactgggcattgcaggcggcaaaaaaaccaaaacagggcaatacgccacttcagaagctgtattatcaaaaattgaacatccgctgattgatgtggtacttgaacatcgcagcttatcaaaactcaaaagcacctataccgatacgctggcaaacgccgctgatgagcaagggcgagtccacaccagttaccatcaagcgcttaccagcacaggtcgcctgtcatcatccgatccaaatctacaaaatatccccattcgcacagatacggggcgactgattcgtgaggcatttatcgcaccaaaaggtcgtatgattttggcagcagattattcacaaattgagcttaggctgatggctcattttagcggtgatgaaagcttgatccgtgcttttaatcataatttagatattcatacggcaaccgccgctgagattatgggcaaagatatcagcgaagttacaccaagtgagcgacgcgctgctaaggcggttaattttgggctattatatggcatgagtgcttttgggcttgccaaacagattgaggttgatcgagccgttgcccaagattatatcaagcggtattttgcacgatatcccgccattttagagtatatggagcgtaccaagacgatggcaaaacagttaggctatgtgcagaccattttaggtcgtaaactctactcacctgatatccaaagtagcaatcgtatgattaaagatgctgccgagcgtgcagccattaatgcaccattacaaggctcagctgctgagattatcaaacttgccatgattgcggtggatgaagtattacccaaagatgatgccaagttgttactacaagtgcatgatgagctggtttttgaggttgatactgacaaggcacatgatatcggcaacctgatcaaaacagcgatgcaaaatgccctaaccgatacagcgaaaaagctgggctgggcggttgattttgctgtcccactcgtggttgaaataggtatcggtgaaaactgggagcaggcacactaa

SEQ ID NO: 994 - DNA, 864 bp, M.catarrhalis
gcaagagttcttatgaagaaaactaatgtatttgatgagctgataaataacaccaaaaggatggttgatcatcttgttgaatttaagcttcagccaagaggccctcttgatttacagttagatacgaagcttgccacaccaaagggagtgcagattgatagtttatctgagctggcgactgatgaaacaggtgtgtttgcctatcatggcagaaaagtcgtgttatttattcctgaccatggctatgggaatagttttgatcaagttaaaaatggtgatttgaatgtaggtaaaaaagtacattttacccaatgtaagacacttgatgatatggctaacaatggtcggttgaatcgttatcacattaataaaaatcaaaatggcttatttgaaattgttaataatgttggcgatacgcatacaaccaagctgatgccatgtcataattgtttaaaaattcttaattataatgattatttatcaatcaaaacaccagcaatttttaggcaaaattttgactttttggcattttttaatggtgattatcagaccaaatttaccaaattgcccgaatatgtgggacaaaataagggtggttatacagaagattggtcgacaataagtcgtaattttaaaaaaagcaaagactatctttgtcaagtctgtggcgttaacttatctgggtatcagcatttggccgatgtgcatcatattgatggcgtaaaacagaataatagccaaaataatttgatgtgcctgtgtaaattatgccatgttaatcagccaaatcatgcccatatgagtatcggtgatgagatcaaaaaccagatacaacaactaagatggcagcagcgactgctgtga

SEQ ID NO: 995 - DNA, 189 bp, M.catarrhalis
attataaaataccatcagttgattgctgtggtttgtcttattttaagcaacctgcttagccaatcattaaaagatggtgtcacaaaaatcaaattaccatataaaaagcaactttcggcgatggattttaccgccgaaagcacagcattttatgcctttttggcagtcttattcattattcaatattag

SEQ ID NO: 996 - DNA, 2667 bp, M.catarrhalis
attctcagatatttagcaaatttaaataaaggcataatcatggcaacttctaaaaaaacgaccaccaaagctgaggcagcattgaccaaagccaatgctcggggcaaatccttagtgattgtggagtcgcctgcaaaagccaaaaccattaataaatatttgggtaaagattatgtggtgcgttcaagcgtgggtcatgtgcgtgatctacccgttggtggcagtgcgaccaaaaccaacaaaacccaagatgttggcttgtctcgtgaagaaaaagcccaaaaagcattagttcgccgtatgggtgttgaccctgaacatgactgggcggcggtgtatgagatattgccaaacaaaaccaaggtgattcgtgaactaaaagcacttgccaaggaggccgataaaatttatcttgccaccgatttagacagagagggtgaggcgattgcgtggcatttaaaagaagtgattggcggcagtgatgataaatacagccgtgtggtatttaatgaaattaccaaaacagccatccaaacagcctttgagcatcctgatcaattaaacattgatcgtgtcaatgcacagcaagctcgcagatttttggatcgtgtggtgggctttatggtatcaccactactttgggcaaagattgcccgaggtctgtcagcgggccgagtgcaaagtgtcgcaactcgtttggtggttgagcgtgagcgagaaattcgggcatttgtccctgttgaatattggaaaattcacaccaataacaccgcagcaggcgagacgctaaaccttgaagcggtcaaaaaaaatggtaaaacgctaaaacttggcaataaagcacaagccgatgaagttgttttggcgttaggctcatcagactttattgtgtcagcgatcgaagaaaagcccactcagtctcgtccatcagcaccctttatcacttcaacgctccagcaagccgccagtacacgacttgggtttagtgtcaaaaaaaccatgattttggcacagcgtttgtatgaagcagggcatattacttatatgcgtaccgactctacttttttgagccaagacgccctaaatttggtgcgtgaatacattacagatcattttggtgatgactatttgccccaaaaacccaatttttatggtaataaacaaaatgctcaagaggcgcatgaagcgattcggccttctcatgttttggtaaaatcctcgcagctgactggcatggagcgtgatgctcagcgtctttatgagttgatttggcggcagtttgtggcatgccaaatgatgccagcacgctatcagtcagtcaatttgatggttgccgctggcgatatagagcttaaagccaaaggacggactttggtttttgatggctatacaaaggtgcagccgcctgctaagactgatgatatcttactgcccgctgttaaagtgggtgaaaagttgcctttgattgagattttgccaacacagcatttcaccagcccgcctgctcgctacagtgaagcaagcttagtcaaagagcttgaaagcctcggtatcgggcgaccatcaacctatgcgtctattatctcaaccattcaagagcgtggctatgttaagcttgaaaataaacgcctatatgctgaaaaaatgggagatattgtgacagaaaggttggtagaaagtttccctgatttgatggattatgcctttaccgcagggcttgaagataagcttgatgaggtggcggttggcgaggaagattggaaaacggtgcttgacagattttatcatgatttcaaacaaaagcttgattatgccaaaaccaccgatggcatgcgtcctaataatccaaccaatgtgcctgatattcactgtgatttatgccatcgcccaatgcagatacgcacaggttcaacgggtgtatttttgggttgtacaggttataatctaccacccaaagaacgctgtaaaggtaccaaaaatttgatgccagtttcggcatttgagtttgatgctgatgatgattcagcagaggtcaacgccctcatggaaaaaaagcgttgcccaaaatgcaatactgcgatggatggctacattgtcgacggtgggctaaagctgcatatctgtggtaataaccctgattgcgatggtcatgtgcttgaaaaaggtgtatttgagattgggggtgcaaccagtgatacaccgaccattgattgtgataaatgcgatggtcaaatggagcttaaaacggggcgttttggtgcatattttgcttgccgaaagtgtgataatacccgaaaagtactcaaaaatggtcaggcggcccctcctcgtatgacacccattgatatgcccaagctgcgttcacaaaaatttgatgaccattatgtgctgcgtgaaggtgcagcagggctatttttggcggcatccaaatttcctaaagttcgtgaaactcgtccaccaaagctaagtgaacttcgtgagattaaagatcagcttgagccaaaattttattatttgtttgatgcaccagatacagatgatgttggtaacccaacaattttactatggagccgtaaaaatcaagagcaatatgttggttcagaaaaagacggtaaagcgacccgtttcgccttggtttggcgtgatggtgcatgggtacaagcctag

SEQ ID NO: 997 - DNA, 348 bp, M.catarrhalis
ttaatacatctgctaaagaatatgctaaacttgtgccatcatcttgcttattttggagttcatatgagtagccttaccgccgatcaggtcgcccttcaacttgacagcttaccaggatggtcgcttgatggtcatagcttggttaaaacttatcattttaaaagctttgctgatgccataagctttatggtgcgtgtggcattttatgctgaaatactagaacactaccccatttgggaaaataatcacaccagcattttggtacgcatcggtacagctgaccagcatgccgttcaaagccgtgatgtccaattagccaagcggatgcaaagtgcttttgctgcctaa

SEQ ID NO: 998 - DNA, 789 bp, M.catarrhalis
atctcgtgccaaccctgccgcacggtatgccaagctacttcacaaacgctcagggggtcaatcatgaattggaattggcaagcaattattaactattttccagatttactcgcagcatcggttacgaccattgagcttgtggtcctgtcttgtgctttgggtcttgtatttggtgtgattcttgggctatggcgactgtctccagtattgtggcttcgtgccattccagcgacttatatttttttctttcgtggcacgcctttattggttcagatttttttaatttactatggcttgggtcagtttaccgcactcaaagagtcctttctttgggatccaatttttagtcaagcatactggtgtgccatcatcgcctttaccttaaacacttcggcctatatcggtgaaatcgttcgtggtgcggtcatggctgtgcctactggggaattggaagccgccgacgccattggtatgtcaaaacagcaaaaattacaccgtgtcatcctacctcgtgcctttggtatcatgatacctgcttatagcaatgaagtgatatttatgctaaaggggagtgctttggcagcatcaattacggtggttgagctgacgcacaaggcacgagacatcatttccattacttatcttcatttggagatgttttttgccgctggtgtgatttatttggtgatcagctgggtgtttttattcatttttcgccaatttgagcaccgtgtcaatcgtcataaacgctatatcccacctgcggtaaatcctaatccaccgatttaa

SEQ ID NO: 999 - DNA, 390 bp, M.catarrhalis
gccttttgtttattgataactgtgttaaactatctgccacattccttaattctcaatgccatgcttatctgtccaatttgtcatttatcgctaaattttacaaagaaaacctaccaatgtgccaatcaacacagttttgatgttgccaaaggcggttatgtaaacttacacttagtacaacataaaaaaagtaaacatcctggtgatacgcctgctgctgtgcaagcacggcgtgcatttttatcagcggagcattatcaaccgctcaaatcagaaattttaaacatgattggaaatattcgccccaaaacgatacttgatattgggtgtggtgaaggttattatacccaagctttgggcagcatttgtgatcatgtgattggggcttga

SEQ ID NO: 1000 - DNA, 192 bp, M.catarrhalis
tctttacccaaatatttattaatggttttggcttttgcaggcgactccacaatcactaaggatttgccccgagcattggctttggtcaatgctgcctcagctttggtggtcgtttttttagaagttgccatgattatgcctttatttaaatttgctaaatatctgagaatttatccagaatccctagggtga

SEQ ID NO: 1001 - DNA, 2256 bp, M.catarrhalis
gtaataataaagcagtttatgacaacacagattgatactcgttcggtgagcgactttaccgaatacgcttacctaaattatgccatgtatgtcatcatggatagagcgttgccgcacattgctgatggactaaaacctgtccagcgacgcatcgtctatgccatgagtgagcttggattaaaacataccgccaaacccaaaaaatccgctcgtacggttggcgatgtcttgggcaaatatcacccacatggcgacagtgcctgctatgaagccatggtgctgatggcacagccgtttagttaccgctatccgctgattactggacaaggcaactggggcagtcctgatgacccaaaatcctttgccgccatgcgatataccgaagctaatatgagccgatatgccgatatactgcttggtgagattgagcaaggcacggttgattggcaagacaattttgatggctcattgtccgaacctgtcacattgcccgcccgcctgcctaatattttattaaatggcacgacaggcatcgccgtgggcatggcaacagacattccaccgcataacctacacgaggttgtcaaagcctgtattcgcttattaaaaaatccagagctgtccaccaaacagcttgtacaaacactgcctgcacctgatttaccaacaacggctgagatcatcacgcccaaaaacgacatgatcgccatgtacgaaacaggcaagggcagctataagatgcgtgccacttatcacaccgacccaaaacaaaaccaccttgttatcatcaacgccctgccttatcaagtttcaggtaataaagttgtcgagcaaatcgccaaactgatgatggataaaaaattgccttgggttaccgaaatccgtgatgaatcagataaccttaatccttgccgtattgtcattgagcttaaaaaaagcaagcttaatattgataaaatcatgagccatctatttgccaacaccgaccttgaaaccagctatcgggtcaatatgaatatgattggtatcaatggcaagcctgaggtaaaaaacctaaaaagtatcttactagaatggctatcggtacgaaaaagtgtggtgattcgccgcttgcagtatcgtttggataaaatcaatgaacgattgcacattttggcaggattactgatcgcttatctgaatattgacgagattattgacatcattcgcaccgcagaagaccccaagattgagctgatgacacgatttggactcacccaaactcaagccaatgccattttagatatcaaacttcgccagcttgccaaattagaagaaattgagctaactgccgaacacgatcgcctagaagctgagcgtctactcatcagcgagcagctaaataaccccgaaatgctcaccaagctacttattgatgagctgacagccgatgccaaaacgcatggcgatgctcgtcgctcacctgtggtacagcgagcagaatccagtagcctaaaagcagtggatttgattgccagtgagccaattactgctattttatctcaagctggctggattcgagctgccaagggtcatcatgcagaccctgccgagatgaactaccgtaccggtgatgcttatttaacacacgctttaggcaaatctaccgagcggcttattttggttgataatactggtcgcagttatgggcttgatagcatacatctaccatcagcacgcacccaaggcgaccctattaccagtcttttaaacttgcctgcgggtgccaaaattgatcaattgcttttttataatcagaccaatggtagcccaaatgtcttaatggcaagcagtttgggttatggatttatcaatcagcttgcaaacttagacactgcccaaaaatcaggcaaaagtagcattaatcttgctgatggtgtacttttgcccattgttgtcatgcaagatgatgacagtttggtcgctgtcagcttatcaaatggtaacctgcttatctttgcaagcgatgagctacccaaacttgctaagggtaaaggcaataagcttgccaacctaaaagctggcgaaaccatcactgccatcacagctttatcggatactgatgccttggtgattacagcaggtaagcgtactttaacgcttaatcctaatgatatcgccaattatattgcacatcgtgccaaccgtggcaacccattaccaaaaggttttggcaaagtctccaatatgacaaagcttaaaaaagacaccgaataa

SEQ ID NO: 1002 - DNA, 891 bp, M.catarrhalis
gatcgcatgaaaaaagatcacatgaaaattaccacacataccgatacaggctcggtcataggttcactttggatggtagtcggtgcgattggttttagcatcatgggactgctggtcaagatgacaggcacacgctttgagatgcatgaatatgagttggttttttggcgtgttgtttttgctgcaactgttttaggtctgcaagctgcactgacaaaaaaacaattttcaacacgctatccacaagcacatttttggcgttctttggctggtacaatcagcttatttatgttcttttttggtttggtgcatttgccgctggcaactgccattacctttagccacacatcagcgatatttttggcaattttttcagtcattcttctgaagcaatttcccagtcgcctaacttggtttgcactcatgttgggtttatgtggcattatgctaattttaagacccagtatccttggacatgggctattgccaacgctcattgggctgacaagtggtgccatggcaggctatgcgtatctacaggtgcgtgagttgtctttattgggcgaaccttcttggcgaattgtgttttattttgcagtacttgcaacactcatttcagcgatcgccagtacagtggtaggatggacacccatacagccccaaatgctaccttatttatttggtattggtctatttgcgatgatagggcagttatcgatgacacatgcctacaaggttgggcgtaaatttatggtatcagcattgggctacttggtggtggtactctcgatgctatatggggtcatattttttgatgaagtcttacccgtcatggcgatggttggtatcgtacttgtgattgcaagtggcattttggcaggtaaaaaataa

SEQ ID NO: 1003 - DNA, 213 bp, M.catarrhalis
gaattaaggaatgtggcagatagtttaacacagttatcaataaacaaaaggcttaagcgatgtgagatcacgacgcttaagccaaacacttattttttacctgccaaaatgccacttgcaatcacaagtacgataccaaccatcgccatgacgggtaagacttcatcaaaaaatatgaccccatatagcatcgagagtaccaccaccaagtag

SEQ ID NO: 1004 - DNA, 489 bp, M.catarrhalis
ttggggcttgatattgccaaatcagccattcagactgccgctaaagctgatgggtcaaaacaaatcacttgggtggtggcaacagggtctgtattacctgttgctgataagtctatgaatgtgtgtaccagcttttttagtccgctaccaaaagatgaaatacgccgagtgctttgtgatggtggctacttgatggtggcagttgctgcacccaatcatttgtatgatatgcgtgcagcgttatttgagacggtagttgcacatcaccccaacaaatccatacaaaggcttgcacctgaattttgtttggttgaccaggcatatatcaccgcaccaatgcacttggataatacggctcttaaaaacttaattgctatgacgccttacgcctataaggcaaaatctgagcggcgtgctgcacttgaatgctgtgagagcttttttgtacaaggtgaattttgtatatttttatttaaaaaattacaataa

SEQ ID NO: 1005 - DNA, 345 bp, M.catarrhalis
gcattttatcgacagtattcccacattgctgacatccatcggcattttgggaactttttttgtattgtattggctttacttgcctttgatgatagtgatatcaaatctcatatcaatgacatcatctcgggcatgaaaaccgcctttattactagcgtgacggggttattattatcaattatcctaaaaatttgggcatctattcatcaagataaaagcgaaaatcttgatttagacaagtggatgccagcaatatacttaaatttattgaacaccatcttacagagcaaaccaacacacaaaaaaagaccgctgttattcatgaagagttgttacaagcattaa

SEQ ID NO: 1006 - DNA, 828 bp, M.catarrhalis
ttttattgtcgccaatttttattaacccaaggaattatcatgataaaaccatttgccactttggcaactgtcgcttgtgttactttggcgggttgtaccaaagaagaaaccagcacccaaacaacagcacccgctcagccaagccaaaaaagcattgtgatcgcaactgaagccgcctacccaccatttaatgacacggatgccagcggtcagattatcggttttgatgtggatgtgatgaatgccttatgtgccgaaatgcacgctcactgtcagataattgctcaggattgggatggcttaatcccaagcttattggcaggcaaatatgacgccatcatcgcaggcatgtccatcaccccagagcgtcaagcacaagtagatttttcggactcttatttttcaaatacgatcgtttggcttgccaaaagtgatggcagctttgatcccaataatatcaccaatcaaacccttgccagtcagcgtggtactactggtgctgcctatatcaccgaaaaatatgatggtaaagatggcaatcgtgttcagctgcatgacacctacaccaatgcttatttggacacaaaagcaggacgcaatcatgcagtcatggctgaaaaagtatcggctattgactggctaaagcaagagggtaatggtgagtttggcttaatcggcgaagagattgataataacgatcacttgggtatcgccgtacgcaaaggcgacagcctaaaagctgagtttgatgcagctttagcaaaaatcaaagaaagcggtaaattggcagaaattgaaaaagctcactttcaatcagatactttttaa

SEQ ID NO: 1007 - DNA, 210 bp, M.catarrhalis
aaggtgataagaacgatgccacataatcagccttataagaccatcagacaatcacttaacacacaccaatcagttaatgtacgggttggtatgatgataaaatcagtcattgataaaatgacattataccatcaattaacaacacttaatgaaaattatgttacttatatgtcacttaaatgcagcttagccaatcatatacacgcttga

SEQ ID NO: 1008 - DNA, 417 bp, M.catarrhalis
aatgaaccaagttctcccccccccgataatttagcaaatatcaataaaaaacccagtattttgttgcgtttttggtattggctgactttaaaagtgtactatgataagcttttaaccaaaggggcagcaagttatttgaccattatctcggttcttgtttttatggctgcatttgctgagggttttgcatgggggcatttgggcagtacttttactcatgataacccatggctgggtagaattggcttgggctgctttgttggctttgcgttgctattttttgatcggcaaatgattacagccgattttttagaagataaacataaagacagctattaccatatcttcacaatattgaaaagcctcaagcgtcttctggttttgtgggtaaggtgcagggtttttggtattatttaa

SEQ ID NO: 1009 - DNA, 501 bp, M.catarrhalis
ttgtctgatggtcttataaggctgattatgtggcatcgttcttatcaccttttaaacattaagttttatccaaacgccaagcctcatcaattgtctaagcgtcaccgatcgtggtttggctgggtattggcggttttagcttggttgatgctactgatgcccatgacatcttcactgtgggtggaaaaaccaaagattggttataatatttgtattaagcttgcccccattatcaatcatatcaatcagtcgcaccaaacccatactcaccttcaccaagcacacacgcatttttcaaaaaaagacaaccaaactccccatcaacatgactgcgatatttgtctaagtgccatgtcttttgcattgccagcgggtgctttgggtttgtctggtcatattttacaattcaacagacaattgggcgctttttatcgtcagttgcgtttgcagtttttatttttcttacgcccaccaagccgtgcttctcctgattattcttaa

SEQ ID NO: 1010 - DNA, 327 bp, M.catarrhalis
gttactcaaggttatcttatgaataaatttgcccttataatcgctaccgctttaggtttatccgcctgcgttgcaccagtcagcgaccaaggtagtgcaatgatcattggcgtgcctgttggcgtgcctgttcttatcgacaaatccacccacaaccatcaagatgacaccgtccatgtctgtaaactcaaggcatttacagatacctttactgccgaaaatcagagccgtggcaaggctcgcttggcagttaagaaaaaatgtcttgccgctaaccatgaaatgttttgccgtgataacatcattgaatgtaccgaatatcactaa

SEQ ID NO: 1011 - DNA, 861 bp, M.catarrhalis
ggtagaattatcttgataattttttttatgaaactgtatagattttttctgacctttgtactaatttgcacctttttaggatttttcatgaccgattcacgccccattgctctggacttacaagacattcataaaagctatggctcacttgaggtgttaaaaggtgtgtctttgaccgcatacgatggtgatgtgatcagtattttaggctcatcaggctctggtaagtccaccttacttcgctgcatcaatctgcttgaaaagcctacctcgggaaaaatcattgtcggtcaagagacattaaaacttaaatcacataaaggcgaattggttgcagccgataataaacaacttgaaaaactacgctcaaaaattggctttgtgtttcaaaatttcaatttgtggccgcacaaaaccattttacaaaatatcatcgaaggccctacgcaagtgcttggtatctcaaaagctgacgccatcaaagatgccgaacggcttttgaccaaggttggtcttttggataaaaaagatgcctatcctgacaatctgtcaggcggtcagcgtcagcgtgtcgcaatcgctcgctcgcttgccatgcagccacaagtactgctgtttgatgaacccacctcggcactagaccctgagctggtcaatgaagtacttgctgtcatgcgtgagctggccgacgagggtcgtaccatgctcattgtcacgcacgagatgcgttttgctcgtgaagtctcaagcaaagtggtatttttacaccaaggtcgcattgaagagattggcacaccaaaagaagtatttgaccacccaaaatctgcacgcgtacgagaatttatggcatcgcaccgctaa

SEQ ID NO: 1012 - DNA, 807 bp, M.catarrhalis
gaggtgatcatgacaaccgtgttaaaatttaccacagccgcattttgtgtttctttacttgctgcttgtagcaatgagtctacgaccaataccaaaactactgctgcacctaacagctcgacctcacaaaaagaattgattatcgctactgaatctagctttaagccatttagctatcttgacaagcaaggtcaattggtcggctttgagattgatttggcaaatgcactatgcaagcagatgcaagcagattgtcaaatcgtaagccaagactgggacagtcttattccaagcttgaacgccaataagtctgatgccatcatggcgggtatgtccattaccgaagaacgcctaaatgcagtggactttagtgagccttattttgataatacgcttgttttgattggtaagaaagacaataccgccaccatcaatgacatcgctggtaaagctgttgcaacgcagcaggcaactgtttcagcggaatatcttcaaaaacattatccagacgccaacatcaaaacttatgataagcaagacaacgcttatcttgatttgaccgctgggcgtgttgaatttatgttgtctgatgtcgtgcctgctactgactggcttgccactgaagctggctctgaatttgagatcaaaggcatgcccattgatatcggtgataaagtcggtatcgctgtgcgtaaagatagcagcctaaaagcggattttgacgctgcacttgccagcctaaaaactaatggcaaatatgatgagattgttgccaaatactttaacagccaagcattaggtcaataa

SEQ ID NO: 1013 - DNA, 237 bp, M.catarrhalis
ttcaccttaatccgagtgcttaattgtgggtatcttatcactaatcttgtgattcatgagatagcatttctgcctgatgagacggtatttttacttgggggtcgctcggtactcgatgccagtgggtgcgtgcccccagtaaaccactttcactatttttggcttcttgctgtagatgctttgcataatacgccaaatcctcttctgtattataatcatcataagggttatgtttga

SEQ ID NO: 1014 - DNA, 1713 bp, M.catarrhalis
gcgactgtaatcgtgtcatcacttgatgtgatttatggtataataattttcattttatttgactggtttaatttttgtatctcaccgtacacatcaatgtatacatcatctacaaaaaggcaagcaatgacaacccatttaaccaatgaaatcaaccaacgcagaacatttgccatcatcagccaccccgacgctggtaaaaccaccatgaccgaaaagctgctgctttggggcaaggcaattcaggtagcaggcgaggtgcgtggacgcaaagccgaccgccacgccacatccgattggatgagcatggagcaagagcgtggcatctctatcaccacatcggtcatgcaatttccctataaaaatcatgtggttaatctgctagataccccaggacacgccgatttttcagaagatacctaccgcacgctgaccgctgtggactctgcccttatggtgattgacggtgctacgggcgttgaggagcggacgattaagcttatggaggtgtgtcgcatgcgtgatacgcccatcatctcatttgtcaataaacttgaccgtgagattcaaaatccgcttgccttgcttgatgagatcgaaagcgtcctaaaaatcaaatgcgtgccatttgcttatcccattggtatgggtcaggactttgtgggggtatacagttttgtggataacaagacttacttttataaaaaaggctttggttcacaaattgtagagattgagagtaaagatggctatgatcatgctgacattaaggacaggcttgggcagattttatgggatgaatttatagaaaacattgaacttgcccaaatggcgtatgaagattgggatgagcgtgaatttttggcaggtcgtcaaacgcctgtgctgtttggtacggcgttaggcaattttggtgtgaacatgattttggatgtgctgacccaatacgcaccgcccccaaaagaccatgtggcagtagagcggacggtaaaagcggacgaacctacctttacaggttttgtctttaaaatccaagccaacatggaccctaagcaccgagaccgtgtcgcctttatgcgagtatgttcgggcaaatatgagcgtggcatgaaaatgaaccatgtgcgtcttggcaaagaggtgcgagtgtcggacgctctcatgtttttggcaggcgaccgtgagacgctagatgaggcgtatgctggtgatatcattggtctgcacaatcatggcacgatacaaattggcgacagctttaccagtggcgagaccttgaattttacaggcattccgcactttgcccctgagctgtttcgccgtgtggtgctaaaagacccgatgaaatccaaacaattacaaaaaggcttacaacaactctcggaggagggggcaacccaagtgtttatgcctcaaatcaacaacgatttgattttgggggcggtgggcgtgctacaatttgaggtggtggcacacagattattagaagaatataaagtgcaatgcacctttgaaccgattagcattgcaacggtgcgatgggtttactctgatgataaagtcgcttttgaaaaatttaagaaaaaagcccacgaccagctgtcggtagacggcggtggttacctgacttatcttgctcccagccgtgtcaatttacaactcatgcaagagcgatatccagaggttgagtttcgggcaacaagggagcattag

SEQ ID NO: 1015 - DNA, 1119 bp, M.catarrhalis
ggaagactgatgacactacataccattattttagctgctggtaaaggcacacgcatgaaatccaaccgacccaaagttttacaaaccttggcaggcaagactttggttcagcatgttttggatacttgtacacaaattcaagcagatggtacgattttggtttatggctttggcggtgagatggtcaaagaggcactatctacccatacagttatatttgccgaacaaacacagcagttaggcacaggtcatgcggtcaagatggcattaccccatctgccaaaagaaggtaaaagcctgattttatatggcgatgtacctttaactcaggccgaaaccttacaaaaccttgttaaagccaataccagcggtatctcaatgctgactttaacagttgaacagccgtttggtttgggtcggattgtccgaaatcagggtaaagttgttgccatcgttgaggaaaaagatgccgacacacaacaaaaattaatcacagagattaacagtggcatctattgtgtggataatgcgttgcttcataaatatctacccatactgaacaataacaatgctcaaggcgaatattatttgacagatattatcaaattggctgttgatgatggcgttgaaattgtaaccattgaacctaagtttgcctttgaaattgaaggcgtgaatgatcgtattcagcttgccaatcttgagcgagattttcaatcacaccaaattcatcaattacaaatcgctggcgtacagtttgccgacccaaatcgtgtcgatattcgtggcaaattgacctgcgatcgagatgtttttattgatattaatacagtatttgtcggtgatgtccatctgggcatgggcgtgcagattgatgcaggcaatgtcattacaaatagtcatattggcaaccaaacacacattaaacccaactgtgtcattgatgatagtatgattggtcaaaatgttagcattggaccatttgcccatataagaccaaaaaccatactatcagatgatgttaaaattggtaattttgtagaaactaagaaaacgaccgtaggtgttggcagtaagattaatcatctaagctatgctggcgatagcttagatgattaa

SEQ ID NO: 1016 - DNA, 606 bp, M.catarrhalis
gatgatatgatgtcactatcaagcgaaagtatcgctgttattgttgtgcttgttgttgctggttttttggtgggcaattttatggcagctcgccccaatgccaatcaaatgcgagtggcagattttcggctgatggcgcgtcattctggtatttttcctaagcttatcacttgtccaaattggcttaaagataggtatgatacgctcaaacccaccaaaaaagatgcgtatgccagagcagatagcatgccttgggttgctcagtacacagtcatcatagaagaccttaggctaccaatggctcaatatcatgtcatggcagattgttggcatctgataccgcagcagttttatacgccaaagatgctgacacaagtacgccgccttgatgagcagcccatacatctgcctgaacatatcaaggctcaagttctgggactgtcaatgaaagcaaatcatatctcgctttactggttggatgataaataccaacacagccaaaaggcttataagctggataaaataaaagctcaatccgacttaaacgacatcaaaacccagctgatggcttgggcaaaattgattgatggtggcaaatcgccctga

SEQ ID NO: 1017 - DNA, 732 bp, M.catarrhalis
ggtactagcgtgtttgacttacaaggctacggcccaattttattgcaaggtacaattctgaccataaagcttgggcttgccagtttggtatttggtctgttattcggtttgcttggtgcacttgccaagctttctggcgtttggatattacaaaaaattgccgatgcctatacaacaatcgtccgtggcatacctgagcttttgatggtttttttcatcttctttggcggtagtatcattttagtcaccattgcaaagcaaatgggctatacaggacgcattgatgtgagtcaattttgggcaggcgttactgccctatctatcatgtttggtgcttatgcgaccgaagtttttcgcatggcaattcaagacattcccaaaggacaatgggagtctgcccaaagcatcggtatgacgccaacacagacattgacacgcattattctacctcaaatgtggatggtggcactacctggtcttggcaacttaactttggtactacttaaagatacagccttggtttcgttgattggtttacaagatttaatgtattttgcacagcgtgcagcacaatccacccaaaaaccttttacattttatttagctgctgcttttatctatttggctttgacttcggtgattacactttttatcatgtggtgtgaatctcgtgccaaccctgccgcacggtatgccaagctacttcacaaacgctcagggggtcaatcatga

SEQ ID NO: 1018 - DNA, 1038 bp, M.catarrhalis
tttagacaagtggatgccagcaatatacttaaatttattgaacaccatcttacagagcaaaccaacacacaaaaaaagaccgctgttattcatgaagagttgttacaagcattaaccacgcatcatgaatatgtcaaacaaaataatcagcaatttgctgctaatttgtgggataaacttgagaaaactgcccaaattctgaccaaatctgccaccgaagaggtgattttggcactcaatcagcttatcaaagactttaatcatcagctaaccgaacagtttggtgaaaactttaagcagttaaatcatgccgtctttgagttgattcaatggcaagaaaattataaacaacagcttgaacaaatgcaggttcagtatcaaaatcataccaatgctgttgcagcaacacaacaagccattgacaatattcatgataatttatcacatattgcacatcatgctcagagcattccagattctatggaaaggcttgccgttgctattgagttgagccatacgcaaattgatactttgtatgatcacttggctgcttttgctgatatgaaagataaggcagttgctgctctaccgagcttaagtgagcaaatcgataccatgcttcagggcatggatgatgccagccaaaagctgaccgaacagtttcatcagattcatcaatctatcaaagcacagcctagcatcatgcaaagcaccactcaagagctaaaaaacacactggagcggctggttggtcaacttgagattgatatcaaaaatatcacagaaaagcacgccggcagtatcaaagagcagatgaatcagttatcaaatatcgctgcccaaaccttagaggacatcagtgacagcatagagggtcaaattaataattttaataccgctgaagccaaaaaaattgagtcagatttgcagcaaatgggtagcgccttaattagtatgacaagccaatttaccaaagattataaagagttggtcaatcatatgaataatatcattcgtcacggaagaccaatgcgatga

SEQ ID NO: 1019 - DNA, 1692 bp, M.catarrhalis
agacagctattaccatatcttcacaatattgaaaagcctcaagcgtcttctggttttgtgggtaaggtgcagggtttttggtattatttaagaagccttaaaatttatctattcttggtgtgccgtttggctattattcttggctctttgtatgttaccgcaccatttttaacacaaattttatttaaaaccgatattgaacaaaaacaatttgaacaatacgaacagagtattgagtctgccaaaaatgaaatcatcggtaaaattgatgatgaaattcgtgccaaaaaagagaaaattaatagcctgcgtgtcaaattggataccgaaattagtggtgggcgtggtacaggtcgaggcaaaggccctattgcccaaaatttggaaaatgaaatccttgagcataaagcagaattagagacactcatcaaagatcgtaatgacaaagaaaagaaaattgaggatgtcatcattgggtataatgacaagacattagatgaaggtgtattaacagcacttgggattaaggttgccaaagacagtccattatttcgtgaacgagccattgagcagttagaaaaagactccgcctatcaaaaagttaaacaagcagtggattttttcttactgggtttgggcttaattttgattttaggtaagttttttcagaccaaatctgtacagctttatttttcagaaattctacaagaaaaatggctaaaatacgagcgaggggtttttgatgaatatttaaaccctaccgagcgaagcagtagccttttacctaccacaacagcatttcctgctgaatttgaagccatgatggtcaggtataataacaatatttctgaatatgagtctcaagaaagacaaaaacgagataaagaaaaatcagaccatatggctcagcaagcttattttttggggcgtgccaaagaatataaagactcacatgcagagtttcataaccgtgcgtataatcaagaagtgacagacttggcattggcagaaatagatgcacaagagcgggcttatttggcaaagtatggtaaaaattattataaatggagtcatgaaaaacaggcgttaagtgatgagctgcaagccatcgataaagaatacaaaagcaagcagaatggtcgtcaggaatatgaagaagaacggcttgctaagcttgaacaagtccaaagggatttggatattttaaaggttaaagttgtaggatcagagcatgattatacgctagagggaacaaaaacctatgagcatatccaaaagtctattgcttatcataagcagcaaatcaaagcgttggaagatgcacatttagagtatgatgaaaatttggttaaattggcaaaacagatgacctatttgacccaagagattgaggggctaaaccttaaacttaaaccttattatgataagctggcagagtttgaacagtatcgtgaggtaatttatcaaaaacgccttgattatatgtctgatcatatcaaacataacccttatgatgattataatacagaagaggatttggcgtattatgcaaagcatctacagcaagaagccaaaaatagtgaaagtggtttactgggggcacgcacccactggcatcgagtaccgagcgacccccaagtaaaaataccgtctcatcaggcagaaatgctatctcatgaatcacaagattag

SEQ ID NO: 1020 - DNA, 801 bp, M.catarrhalis
attgtgaaatttaaaacatttggacttatggcagccattgttggtacatttagtatctcagcttgtagcggtcaaaacgaacaaagcacaaaagccagtggtgacaccttgcgtattgcgaccgaaggcacttatgcaccatttaactacaccaatccagatggcagtttgggcggctttgatgtggatatcgccaatgcgttatgcaacaaaatgcaaaccgaatgccaaatcattgcccaagattgggacggtattataccagcattaaaaacaggtaagtttgatgccattgttgcagcaatgtcagtcacccctgagcgtagtgagcaggtggattttagcgagccttattttgtcaactctttggtatttttggcaaaaaaaggttcaaattttgatccgagcagcaccgatgccatcaataatgccaaaattgttgctcagcgttcaaccatctcaagtcaatggttaacccaaacttatccaaacagcaagccacagctgtacgatacgctggacaatgcttttattgatttaggtaatgagcgtgctgatgctatgatttctgacaaactgccagcattaacttggcttagctcggacttgggtcaaaattttgagatcaaaggtggggacattaatatcaatgataaagtctccattgctgtcgataaaggcaataccgcactattacaaaaattcaatgaggctttggctgcaatcaaggctgatggcacctataaacaaattgtcattaagcactttggtgaagcaggtatgccaactaatattgaataa

SEQ ID NO: 1021 - DNA, 237 bp, M.catarrhalis
tttatgggttcactttctattacgcactggttaattttacttgtggttgtggttatcatatttggcaccagcaaattaaaaaatgctggcaaagacttgggcagtgcggtaaaaggatttaaagaagctgtcaaagaagaagaaaagccaaagattaccaataatgatggcaaagtcatcattgccgaagaagttaaagtcgaaaaacccaaagataatcgctcagctgacttatga

SEQ ID NO: 1022 - DNA, 1392 bp, M.catarrhalis
ccgcttacatcagacaatgacgctgctgtatatcaatctaggcaaataaagatacaggctaaactttatttgccattggtatggttagttgggggtatggcaaatgacgataaaacaaccaatcgccgacaatttttaacaaaagtgggtgttggttctgtcgctgttggtattggtacaattggattggcgggatgtcaacaaggtcatgaaagtaaatctgacaggcaaaccgagcatacgcccaaacccaacagcccgcctaatcccaagcaggcaggtgaacaaaataccaatgtcaagcactgcttggcagataatcagtatgatttttatggtaaacatcaagcgggtatcatcacgccagcacagcgtagcatctattttttggtcttggatttgcatacagataagttggatgacatcaaggaggtttttaaacaatggacacagtatgccgccagattaaccaagggcgataatatcgctccttatggctcaaatccgcatgtgccaccagttgatacaggcgaggctgatagccttggagcatatggcttgactttaacttttggtgtcagcccatcgtttttacaaaaattaaacttaactgataaaaaaccgcctgaatttagcgatttgcccaaattccccagagaccaaatccgcccagaatattcagggggcgatatttgtatccaagcctgcagtgatgatccacaagtcagttttcacgccgttcgccaattggtacgccaagcccgctcaagcgttagtatgcgatggagtcagtcgggatttttgggttttgattcaggcaatcaaaccgctcgtaacttattcgcctttaaagatggcacagccaatagcaacacgcttgatcatgccgataaacatgtttggattcaacagccagactggttaaaagatggtacttatttggtcgttcggcgtatccaaatgcacctagaaacatgggatagaaccagtttaaacggacaagatgaaacctttggccgtcatcgagatagtggtgcgccgattggtcaaagtgatgaatttgcccatctggatatcaccgctaaagatgatgaaggtaattttatcattcctgagatttcacatgcaggacttgctaaacgcagcggattgcagttgcttcgccgttcttattcttatgccagtggcattgatccaaaaacaggtcaatttgatgcagggctgctgtttatttcatttcaaaaatcgcccatgcaattcaccgccattcaaagttcacttgggcgggtagataaaatgaatgagtacatcactcacattggtagtgggctatttgcctgttttggtggggtaaaacaaggcgaatatttggggcaaaaattgtttgaataa

SEQ ID NO: 1023 - DNA, 1677 bp, M.catarrhalis
ttgatgccacccatgaccgccgtcctgccatcacttgcccccctaatcttacaacatcagctgatgacagaagatgccttatcaaaagctgccactgatgccaaaaatttgcaacgctcatttgttcagcatttggtcgcaagcggactcattgatgccgccaagcttttgcacatccaaagtttaagctacaacttacccatttatgagccgcccagtcagcttagccaagtcgttgaaacaggcctagaccctgcattatttattaaatatcgaatgctacctttaagctgtgataagcacacgctgaccttagctatgagcgatgccaccgataaagatgccattggggccatgcgttttcatgcacgccgtcagatccgacctatgctggttgaagaagataagctatctgccttattagatagactatatttagatacagatacttttgaggatacccaaaaaatagggccaaactcccaagctacaacagatgacgcccccaccgtaggctttgtcaataagttattcaccgatgccatccgcctaaaagcatccgatattcattttgagccttatgatgccagttatcgcattcgctttcgtattgatggggtaatgcaagtgatacacaatccacccaaatcaatggccgctcagattgcctcttatatcaaagtcatggcaaatttggatatcgctgagcgtcgccgtgctcaagatggacgcttaaaatttgatgctcaagatgggcaatcggtggactttcgtgtcagcacactgcctactttacatggtgaaaaggtcgtacttaggctactggactctgctcaggcactcattgggctagatgcacttggcatggacgatgctcaaaaacagttatttattcatgcactatcacgccctcaaggcatgattttggtcacaggtcctacaggatcaggtaagacagtttcgctgtacacagctttgatgcgtcttaatcagcctgaaattaatattttaagctgtgaagatcctgttgagattaacttagctggtattaatcaagtcaatattaatcctaaagtacagctggattttgccgatgcactcagagcatttttacgccaagaccctgatgtcattatggttggggaaattcgtgatactgacaccgcccaaatcgccacaaccgccgctcaaacggggcatttggtgttatcaacgctgcacaccaattcagccagtgataccatcacgcgtatgcacagtatgggcgtgccatcttttcatttggcaagcagcttaagcctaatcatcgcccaaagattagctcgccgactgtgtgatgaatgcaaaaaacccatcaccattcccgatgaggcattacgcttggcagggtttagcgatcaagatatcgccaaacaaccaacactgtacgcacctgtcggatgccataaatgtaaaaatggccacaaaggacgcattggcatctttgaggtattacccatcacgccgcccatggccgaattgattttaacgcaggcatctgccgccaaaattgatgctttggcacgcacccaaggccatgacaatcttagacaagcaggcatcaaaaaagtactcaccggccaaattagcctcactgagatgcaccgtgtcacctctgaatcatggctaaatcactaa

SEQ ID NO: 1024 - DNA, 825 bp, M.catarrhalis
tcgccgtcgccgtctaccgcctgcaccctacttgccaaatcatattgccgaccccttattaaatcaacccaaccgccgcccatgaagtcacccaatccacccacagacgatgtctcattgatgtcacattttatcgaacttcgtggacgatttatccgcatctttttggcagttttggttgtatttttggcgttggttggctttagccgtgaactgtatgacttaatctcaaatcctttggtcgctctactgcccaatgaatcaagcttaattgccaccgatgtcgcctctggttttttggcacccattcgtttgacattttttaccgcactatttatcacagtaccttttattttaatgcagatttggggttttatctcacctggtctttatcatcacgaaaagcgtaccgccttgcccttattattttcatccattgctttattttatcttggtgtgacatttgcttattttatcgtattagtgcctgcactgaaattttttgttgtatttgctcccgacaatgtgctaccaatgaccgatatcgacagttacctaaactttgtgataaaactccttttggtatttggcgtgatgtttgaaattcctgtggtaacgctgattttggttttgatgcgtcttgtcagcattgcaagtttgacaaataaacgccgctacattatcgtgggctgttttgctgtcgccgccgtgattacaccgcctgatggtgccagtatgctcatgcttgccattccgatgtgtttactgtttgaacttgggcttatcatggcaaaattgttagtcaaaacacccaaagcaccatag

SEQ ID NO: 1025 - DNA, 333 bp, M.catarrhalis
cacgaatttacccgttactcaggagtactatttaagaaagggtactgcttaaagagcaatccgccgaatgctatcggcggatttttgatgaatatccaagctgtcttaaatgacagcccccatcacgatttaggcttagtcactggcggcttgccagactcaatgacgcctttggtgacaatcacttctgcgatatcggtcatgctaggtagctcatacatcgtatccatcagtgcattttcaatgatagaacgcaagccacgagcacccgtttttcgctcttgggcacgcttggcgatggcggtcagtgcttcaggctcaaaggttaattga

SEQ ID NO: 1026 - DNA, 648 bp, M.catarrhalis
ggtctgattactgcccctgtcagtggtataatcagtgccaaaaatgcgcaagttggtgcagtggtatcaggcaccccgctatttagcatcatcatagatggcatgcttgagtggcaagccgccgtgccacctgctgatgccgccaatatccatgtgggccaaacggcgtctgttgagattgcaggtcggcaggtgataggaggggttgctcgcctaagccctgttaccaatgatagccgagatatcaccgtccatgtgcgtctgctaagagacagtggtgccagtgctggcatgtatcaatctggcgagtttttatttgatgcccaaagatacaatgccattccgcttagtgcgttgatgggtttagatggctatgattatgtttggcaattaataccaaacatcggtgacgatggtcggacatatcaccaagtcaagcgtcggcagattaccatcatcacccaacaagacaatcaagttgcaatagatgatttaccgcaaagtgacttgattgttgcaaccagtgccagctttttagatgatgatttggtcattgtcgtaaccatcaacgggcaagatgtggatcataatcaaaccagtaaagcaccaaaacctgctttaaaccccagtcatggtaacacacgctaa

SEQ ID NO: 1027 - DNA, 1098 bp, M.catarrhalis
tgctacgccaccatctaccgctccaagttggttacgccaaacgctaataaaactcgtcctgtcgtggctttggtgcttggtgggggtggcatgcgtgggtttgcccatatcggtgcgatcaagtcccttgaggcacatggcatccgtcctgatatggtggtcggtaccagtgctggggcgctggtgggtgcagtgtatgccagtggtaagacaccatctgagatgatcgctcttgccgatactgtcaaagaaacggatttgattgaaattacgccctcacagcagggcttgattgacggaacacgcctgcgtcactatgtcaatgagcaagtcaaccatcgccccatcgaagcttttcccatacgctatgcggcggtagcaacacagatgcacaccaatacggcagtaacttttagaactggggaggcggggttggccgttcaagcttcatctagcgtcccaaaattattcattccaccacgcattcccaaaataggcggcaaaaaatatgtagatggctcacaggtggcgttattaccgacacgcatcgccaaaagtctgggtgctgatattatcatcgctgtcgatgtcatgggtgaaaaacaagcatcacccaattcaaacgctctgcctactcaaggcagcagtatcaacatccaacgcaatcatgcaggtattagtgccacatggggcgataaaaccatgactgcgccagtcaatcttgataagctcaatcaaactgccagaggcttgcctattgacataccattgggtgatttgcttggtgttatcatgcagtctattcctactaacaccaatatttctctaccaaaacagctacctaccaagacctctgagtttgctcggtggtttggtaatttgggtgccaatttgaccgccgaacctgaagatatccgtgctgccgatgtgctaatccgtcccaagatgacaggtgctgctgtctttgacagcactgaccgcacacgactgatcaatgaaggcagattggcaacagatgcccaaatccctgccatcaaaaaagccatcaaagacgctcacacacgaaaacgcacccaaattcaaacagcccaatcataa

SEQ ID NO: 1028 - DNA, 357 bp, M.catarrhalis
ggaaataacacacgattcaccaaaaatcctgggcagtcattgacgacaattggagttttgcccattttttgtgccaatgcaaccgttgttgcaatggcgatatcgctggtcttctcgccacgaatcacctcaactaacggcatgcgatgtactgggttaaaaaagtgcatacccacaaagttttcggggcgttttagggcattcgccaagcgagtgatagaaatcgttgaggtatttgaggccaaaatggcatcttgttttaccaagccctccacctcagacaataccgcttctttgattgtaggattttcaacgaccgcctcaatcacaatatcaacttcaccaaaatcgccatag

SEQ ID NO: 1029 - DNA, 204 bp, M.catarrhalis
tcaaaaataactatgaactatatcatatctttggtgcgtagatggttgacaaatgcgattttatgtcatgattgtgtagagattttacaaatattcacaaacattcttcaatttaaagggattggtatgacttattttgggtataaatttggatgtgaattggttgagattggcttaactatgatggctaatgccaaaaagtga

SEQ ID NO: 1030 - DNA, 3960 bp, M.catarrhalis
caaagggtaaccaccatgatgagcaccatcgcaggcttggagtttttgacagattttcaagcacaaaaattagccgaccaactcaaacaaaaagctgggctaaatatttataccttgagcagtcagcaagtttatgtgtttgatacaccgctgtcagaatctgaccatcaaaaggcgattgatttattaaaccaaggtcaaacgcccagcctaaagaccgctgatgatacacaaattcaagtggtggttgcacctcgttttgggacaatcagcccttgggcatctaaagcaacagatatttttaataactgtggtgtcactattgggcgagttgagcgtgtcattgtgtatacacttacaggcgagaatttgcccaagcgtttgcctgccatcgctgaatcaattttacatgaccgtatgacccaaagccttgtctatgagctatcggatgtgtcggttttgtttgttgatggcgaacctgcccacttgagcgtggttgatattttgggcatgggtaaagatgctttagtacaagcaaatgctgaatatggttttgcattatccgaccaagatatgacatatttggtggaaaatttcaccaagttgggtcgtaacccaacagatgttgagttgatgatgtttgctcaagccaattcagaacattgccgtcataaaatctttaatgctgaatggacggtagatggcgaggtgcagcctaagtctttatttaagatgattcgtaacacgcatgaacaaaatccagagggtatcttatcggcttataaagataatgccgctgtcatggagggttttgtggcagagcgtttttatcccaccaaaacgaccgaaggcaatgcccaatatgggtttcatcaagagcaaattgacatcttgatgaaggttgaaacccataatcacccaaccgccattgccccatttgcaggtgcagcaacgggtgcaggtggtgagattcgtgatgagggtgcaacaggtcgtggcggtaagcctaaagcaggtttgacaggatttagtgtttcgcatttacatctaccgacgatgcctgaaaaatgggaaacaacagggcaggtatcggccgtcagttatggcaagccttctcgtatggcatcggcactggatattatgattgaagggccgttgggtggtgcagcatttgccaatgagttcggtcgccctaatttaaatggttattttcgtacctttcagctagatatctctgatcatcaagatggtagccaaatgcgtggttatcacaagcctattatgattgcaggtggctatggtaacatcaagcgtgacttggttcaaaaaaatgccatccaagagggggatttgttgattgtattgggtggacctgccatgcagattggtttgggtggcggtgctgccagttcggttgatagtggtaaacttgatgagggcttagattttgcttctgtacagcgtgataatgctgagatggaacgccgttgtcaagaggtgattgatacctgctgggcgatgaccaaagatggtatggatgccaacccaatcatctcaatccatgatgtcggtgctggcggattgtccaacgccatgccagagctggtcgatgatcatgaacttggggcacatctgaatttacgcaaagtcccttcgcttgaggcaggtatgtcacccatggcaatttggtcaaatgaagcacaagagcgttatgtgcttgccattcgccctgaaagtgaggcactgtttgacagcatttgtagccgtgagcgttgcccttatgccattttaggcacagcaaccacagtgcgtcaactgatcgttgatgatagcttgcttccagagcgtcctgtggatatgccgatgcaggttttattgggcggcacccccaaaatgaagcgaagctttaatcgtaccgaattcgcccttaagcccttggatacagcttcggtgaatatcaaagacagcattaaagatgtgttgcgtcatcccacagttgccagcaagtcttttttaatctctatcggcgaccgctcgattacaggtatggttacccaagatcaatatgttggtcgttatcaggtgcctgtcgcagattgtgcggttactagtaccgccttaaatgctatcacaggtgaggccatggcaatgggtgagcgtgcacctgttgcactcatcaacccagcagcttctgcacgcttagcagtcgctgaagcggtgacgaatattgcctcagcccgcattgataaaatcagcgacattactttgtctgctaactggatggccgcttgtggcgatgaaaaagaagatgcggcattatttgatgcggttcatgcggtgggcgaagagctatgcccagcacttggtattgccattccagtgggcaaagacagcttatcgatgaaagcagtttggagcgaagatggtgttgaaaaatcagttacctcaccgatgagtctgattattacagcctttgcccctgttcaagatgtgtcaggtacactcaccgccgccttaaataataccgattcggcattgtatcgcattgacttgtcatcaggtaaattgcgtttgggtggctcaattttggcgcaaacattaaatcagctgggctgtgattgtccagatttggagcgaccagaggatttggccaatttctttgcttttattcaggcggcagcaaaagcaggcgtcattcaagcttatcatgacattggtgatggtggtttaattgcttcggtggcagagatgcagtttgccagtcgtatggcgattacccttgcacttagtgatgaaaatttgctcggtcagttatttgctgaggagctgggtgctgtggttcaagtattgcctgatgatgtgccagcatttgttgatttggccaaaacgcatggcgttagtgagtttgtcagcttaattggtcaagccaaaacaaccccagcaggcggtgctggtcttgatgtgttaagcattaccacaccaagtcagacattgtcttttactcgtagcgagcttcaaaaacagtggacaaaagttagccatgccatccaaagtttgcgtgataatccaatctgtgccgatcaagagtttgctttaattgatgatattaatcatcatggcttgattgccgatgctaattatgatttggatttggcggtagaagctccctatgtcaatagccgtactacccagccaaaagttgccatcttgcgtgagcagggcgttaatggacatctagagatgggtgcaggttttgtgcgtgcaggttttgatgccatcgatgtgcatatgagcgatctgatgagtgggcgaattaacctgcgtgattttgagggtttggtggcatgtggcggttttagttatggtgatgtgctgggtgcaggttctggctgggcaaactcaatattatttcatgatgaactgcggatgcagtttgccagattcttccatcgccccgaaacttttgccctaggcgtctgtaatggctgccagatgatgagccagctaaaagacttgatggttggtgctgagagtttccctcgttttattgccaataaatctgctcgttttgaggcgcgcacagtgaatgtacggattgagcgtaccaaatctgtattactcaaagggatgcaagacagcatcctgcctgtcgctattgcccacggtgagggctatgctaatttagatgataaatcgatggcagatctaacttatcatggtcaaatcgcacttcgctatgttgatagccaaggcaatccaactgagcattatccactaaaccccaatggctcaccacagggtattacgggcatttgtagtaatgatggccgtgttactttaatgatgccacatcctgagcgtactctacgcaccgtaaatcattcttggaaaccccacgaatggaccaatgatggtgcatggatgcgattattccgtaatgcacgcgcatttttgcgttaa

SEQ ID NO: 1031 - DNA, 816 bp, M.catarrhalis
atacccatgactatcaatacacactggcttgatacactcaagtttaatgagcaaggactcattcccgccatcgcacaagaccgccaaacaggtcaggtcatgatggtcgcttggcaaaataaaatggcgttagaacaaaccttaaaaaccaaagaagccgtttatttttcacgctctcgtggtaagctttggcataaaggcgaaacctcagggcatacgcaaattgttcatgatatttataccgattgtgatcatgatgtcatcatcttatctatcacgcaaattggtgggattgcctgtcacacagggcgtcgttcctgcttttttaaaaaactcgatgatcagggcaactggcaaattaccaaccatgtcatcaaagaccctgatcaaatttatggtaacaaccaacaaacagccaccaaaaataatgctagcaatatcacagcgaccataacccaatcttcatctgatgtgcttagccgtcttgatgcaaccttaaatgagcgtaaaaatgccaataaagacaactcttatgtggcaagtttataccataaagggctcaataaaatcttagaaaaagtgggtgaagaagcggttgaaagcatcattgcggccaaagagcttgagcgtgccaaaaataccaacgaaaactgtgataagctggcacatgatttggtttatgaagtggcagatacttggtttcatcaaatggttgccttatccaaattgggcttatctgctcaagatgtcattgatgagctggcttaccgctttggtatctcaggcatcgaagaaaaaaacagtcgtacaaaatag

SEQ ID NO: 1032 - DNA, 1230 bp, M.catarrhalis
tttaaaatgaccataacaaacaaccaagagacaaaatttcccgtgctttgggtgatgatgctgggcgtgatgattgccatcggacctttatcgattgatatgtatttgccagcttttccgagtatggcagaagattttggcgtcaatgtcggtacgattgccaaatctgtgccagcgtattttttgggattggtgtttgggcagctgttttatggaccatttagcgaccgtattgggcgagtacgcccattatacttgggcatgagcatttttatcatcgcatcaatcatctgtgcaacaaccaataacgaatatgcgctatttattgcaagaaccttacaagcacttggtgcctgtgtgacgacagtcgtcacacgagccgccattcgtgatacgctcaatccagtgcagtcagcccgtgcttttagtttgatggtgcttgtgatgggtgttgcaccgattttggcaccaagtttgggtgcattaatcttaaaagtagcagattggcatggcatattttggtttttggcaagttttggggtgctaaatttattattaaccaaatgcttcttaaaagaaaccctaaagcctgaaaaccgcaatactcgcccgatgtctgaaagctttgggcaatattttggtttgatgaaagaccatacttttatgttgcctgcggtcgcatcagggctgcttcaaggtgcgttttttatttatttgtcaatttcaagcgagctgtttatggtgaattatcggctgacagagcatcaatttgccatcgcttttggggtgaatgcgtttgggtttattgcattgacgcaggtgaaccaatttttaaccaagcgttttcatttggtgaatctactacgcacaggggcagtcattcagttggcggcagctggtgtcttattgatattggggcttatttttggcggtaaagcaagtttttattgggtatttgtcagtctgtttatttgtattgcaggacttggtttgacacagccaaatgcaactgccattgctttggcgtttcaaaaaaagcgtgcaggcttggcaagtgcattacaaggcgcattgcagttttcggtaggtatttttggcggtctgctgattggtttatttgagttagatcctgttacccgccttggtatcacgaccagcattttggtagtggtgggtacttttttggtattttatatcaatccaaagcttgatttatctcgcctagactga

SEQ ID NO: 1033 - DNA, 714 bp, M.catarrhalis
aattgtgcgacctgcgcggtcccttccagccccgtggtgaagacacaaactgagaataccatgagcataaaacacaatccttattatgaccagctgaccgatgctttatatgcccctaacaatgcactggtacctatggtcatcgaacagtcaggtcgtggcgaacgatcgtttgatattttttcacgcctattgcgtgagcgagtcattttcttgacaggtcaagttgaagacaatatggcaaacctaattgtcgcccagctgctgtttttggaggcggataatccagaaaaagacattcatttatatatcaattcacctggcggtgttgtcacggcaggcatggcaatttatgatacaatgaactttatcaaaccccatgtttcaacgatttgcatgggtcaagccgcttcaatgggttcatttttattgtcggcaggagaaaaaggtaagcgttacgcattggcaaactcccgtgtgatgattcatcagccattggggggatttcgtggtcaggcctctgatattgagattcatgctcgagaaatcattgagctaaaagccaaattaaaccgtttattggcagaacatacaggccaaccgattgaaaagcttgagcgtgataccgaccgtgaccattttatgagtgctgagcaggcgcgtgattatggtttggtggatgtcgtacttgataagcgaccaaaaaatctataa

SEQ ID NO: 1034 - DNA, 384 bp, M.catarrhalis
catgtcgatgcctgccatgattgggctgatttactcatgggtattgccaccaaaaactccattttattggtggattatgccatcattgctcaagatgaacaaggcttaagctgctttgatgtgctcattgatgcgtgtcgcaagcgtgctcagcccatcatcatgacgaccatcgccatgggtgcagggatgttgcctttggtgatcggattaggcggggttgactcgacatttagccgcccaatggcatcagcggtgattggtggcttagtcacctcaacattattaagtttggtggtgattcctgtgttttatgcgttgatggacgatttgggaaactggttaaaaaagccatttaacaaacgccatcggcagataacttaa

SEQ ID NO: 1035 - DNA, 618 bp, M.catarrhalis
aggctgtattttagcggtgattgtggtatttatctttttaagagattggcgagccacttttgtggcagccacggcattgccattgtctattattccaacttttttatcatgtatttgtttggttttagcttaaacatgatttcgctgttggcattgactttggtgattggtgttttggtggatgatgcaattgtggagattgaaaatattgttcgccatcttaatatgggcaaatcccccatgcaagctgccattgaggcggctgatgagattgggcttgcggtcgttgcaacaacttttacgctgattgcggtatttttgccaacggcatttatgagcggggttgtggggcagttttttagccaatttggttggacggcggttattgcaatttttatttcactgttggttgcccgcctgctgacaccgatgatggcagcgtatattttacgcccatccattcatacccaaaaacctgctggtaaattgatgacagtttatcttcagatagtgttggacgctaaagcatcgcaccatgacagtcgcctttgtatcgggattttttattgcctcgctgatgttggcatcttttttgccatcggcatttattccacctga

SEQ ID NO: 1036 - DNA, 1347 bp, M.catarrhalis
ctctttggagcattcatgaattctgtcagcacctatcagaacactcctgcactcacacctgtgcattggtttcgtaattctgccccgtacattaacacccatcgtggcaaaacctttgtggttatgtttggtgatgaggcggtcgctcgtgacaattttagtacgctgattcatgattttgcactactacacagcttgggcatcaaattggtgcttgtgcatggtgtacgcccacaagtggaaaaaaatttacaaaatcgcaagcttatctcaaacctacatgagaatgtgcgtgtaacaccgtatgaatctatgcctgccatcttggaggcagtcggctcaattcgtctacaaatcgaagctcggctgtcgatggggcttgctaactccccaatgtacggatctcgtattgatgccacttcgggtaattttgtcaccgctcgcccttacggcatcagagatggtatggattatcagatgacaggtgaggtacgctcaattgatgtcgatgccattcgccataatttggataatgaccatattgtcctactaggaccgacaggtttttcggttacgggcgaaatttttaatctattggcagaagatgtagcactgaccacagccattgccctgcaagctgataaactgattttcttaggtgagcaggatggtatcatcggccaagatggtcgcttgttgcatgaacttatccccaatgaagtcgatcgcttactgcgagattgtgatgatcatgaagagatttcgcactttttacgctgtgctgccagtgcgtgccgccaaggcgtacaccgcactcatatcatctcttatgccaaagacggtgcattgattgaagagctgttcacgcgtgatgggtcaggcaccttgattagccatgacccttatgaagagatccgccatgcaacggtaaacgatgtcatcggtctgcttgagctacttaaacctctcgaagaacaaggcgtcttggtacgccatagccaagagcgtctagagcaggagattgagttttataatgtgattgagcgtgatggcaccattttgggctgtgccgcactttatccactagatgcccaatcagcagaagtggcaagtcttgccattcatcctgattatcgcaaaagcagccgtggtgctgatttattggcttttttagagcagcaagcacgaagccatggacgccatcagttatacgctttgacaactcataccgcccattggtttattgagcaagggtttagcgaggtatcggtagatgagctgccaaaagcccgtcaacgcaagtatgatcatagtcgtaattcaaaagtgcttaaaaaattattataa

SEQ ID NO: 1037 - DNA, 756 bp, M.catarrhalis
ttagccaatttgagagccaaaatcatgatgataaaacccatactgtggcagattccagtgccaagtgatgagacgatacaaggtcttgatgccaaaatcaaaaccttacatgctcgcttatcagatatccatgccaagcaccatactgtcaagtttgccagtagtttgcaggccgaggatatggtcatcaccgatgcactggcaaatagccatttaagtactgaaatatttattttacagacaggtaggctaaacgccgaaacacttaagctcatcgacatcgtcaaggcatgctatcttacaataaattttaaaacttatgagccgcacccgcacgctgtggcagactatgtggcaaatcatggcttaaacgctttttacgaaagtggtgatctacgcaaattgtgctgctttattcgtaaagttgagcctttaaatcgtgctttggtcgatgctgatgcttggctgacagggcaacgccgtgagcagtcagtcactcgcaccgagctgaatttggcagaaacagatttggcgcgtggtattgccaaatacaatccaatttttgattggcaagagacggatgtatgggcatatattttgaccaaaaatataccgtttaatgagctgtatcaccaaggctatccttccattggctgtgagccttgtaccatgcctgtcaagcaaggcgaggatatccgtgcaggacgctggtggtgggagcataaagataataaagagtgcggtttacacaaatga

SEQ ID NO: 1038 - DNA, 195 bp, M.catarrhalis
agattgggttatggtcgctgtgatattgctagcattatttttggtggctgtttgttggttgttaccataaatttgatcagggtctttgatgacatggttggtaatttgccagttgccctgatcatcgagttttttaaaaaagcaggaacgacgccctgtgtgacaggcaatcccaccaatttgcgtgatagataa

SEQ ID NO: 1039 - DNA, 681 bp, M.catarrhalis
atacttggctaccggaatctaaagattatgtcaatgtttgatgactatagcttggcattatttgccgattgtacacgcttgactgacagccaaatcatccataaatggatacagcattgggcatataccatgcctgagctaagcgaagagcaagtcaaagatgtggtgagaggatttcagatacagcggctgcctgcaagaagctattggcaagtggcagggcaggtacaagatcacattggcgtcatcttggcaggactgtgtaagcttgaatatcagtccgaccaaggcagtgtggtcaatgtgcattttatgcaagaaggtgatggtattggtgaatatcacgcatttcttggcgatgaggtttgccgatatagcctacagaccattgaacctagcatcatcatcgccataagcttggcacattatgaatactgctgtcagcgttatccgattttttatcgttatattggccaaaatctgacccaagtcttggcacaaaacatcgctcgtatcgacagcctgcttatcaccgatgggcagactcgttatgttagatttattgaaacaaatcccaaattggcggccagaatttcggtgtctgatttgagttcttatttgggtatgtcacgccaaatgcttacacgcatccgcaaaaaactgggccatcgccgtgcataa

SEQ ID NO: 1040 - DNA, 582 bp, M.catarrhalis
tatgaacgatatgatgatatgtttggagagattatcatgcaccctttggcacaatcggtattagaattttggttttcaaaagacgctcagccagtgtggtttgctaaatcttttgagtttgatcaaaagattagtcagcagtttggcaaggtgctagagtcggcgacagctggcgaatgtgcagattggcgttgtgatattttgggtcggttggctgagattattgtgcttgatcagttttcacgcaatattcatcgagatacaccaaaagcttttgagaatgatggtatggcgttggtattatcccaagaagcgatcgtattaccagagtttgagtctttagccttagatgagcgtaagtttatgctcatgccgtatatgcattcagaatctaagctgattcataaaaaagccatgacgctgtttgagcaattcaccgatgcaacaaccgtggcgtatgagcgtcggcataaagaaattattgatgaatttggacgctatccgcatcgcaatgcgatacttgggcgagtatccactatacaagagcaagcattcttaaacaagccgaacagctcattttaa

SEQ ID NO: 1041 - DNA, 1368 bp, M.catarrhalis
  unsure (1279): Identity of nucleotide sequences at the above locations are unknown.
tatatgtttcatccacctaatgacactatgaggagtatggcaatgggtgaatataaaaaacattggtgggggcttgtcattacactgattatcgccttcatcttattaggttggggcggttttgagatttaccgtaccaccccgcccattcctgataagtttgttgactcatcaggtcaaactttaatcacaaaacaagacattttagacggtcaatctgcttggcaatcaacaggtggtatgcagttgggttcagtctatggccacggtgcgtatcaagcccctgactggacagccgattggttgcatcgtgagctggtcgcatggcttaacatcaaagcccaagccgatcatggcaaggcgtttgatgagctgaccagcattgaaaaaatgggcttacaacaacagctcaaagaagagtaccgtggcagtagcatggggtcggacaacacagtgatgttatccgacactcgcatagcagcgattaaccaagttgcaccttattacattgatttatatggcgatactccagagcttgccagctctcgtgaaagttttgccatgaaaaataacacattgcctgatttgacggctcgtcaaaatctggctcatttttatttttggacagcgtggacatcgtccgccaaccgcccaggaacggttgccacttataccaacaactggccgcatgaacctttaattgataatgtgcctaccgctgaaaatgtgatgtggtccattgccagtgtggtgttcttattggcaggcattggtcttttgatttggggttgggcattcttgcacaaacaagaagaagatgacattaaagtaaccgtaccaaaacaagacccattaagcttaattgagctgacaccctcacaaaaagccttagccaaatacgcctttttggtggtggcgttgtttgtggtgcagatattcttagggggctttgtggctcactataccattgaaggtcaagacttctatggcattcctgtgtctgattttatcccttattctttggctcgtacttggcatattcaatctgccttgttctggattgccaccgcctttttggcaatcggtttgtttgttacgcccatcattcatggcggtaaagaccccaaatatcaaaagcttggggtggatttgttatgggtggcgttaatcattgtggtggttggctcatacattggtcaataccttgccattgctcacatcatgcctgctcatcttaacttttggtttggtcatcaaggctatgaatttattgatttangggcgtttttggccaatcctaaaatgggttggggtgttgttctggctggtcttgatgttgcgtggtgtactggctggcttttaaagtga

SEQ ID NO: 1042 - DNA, 393 bp, M.catarrhalis
aaggacaatcagatgagccatctaaatacccatgcaccgctaagatttatcaccgcaggtagcgttgatgacggcaaaagcaccctgatcggtcgcctactttatgacagtaaggcactactgaccgatcaactttacaatctaaataataccaaaaccgcaggcgatgccattgatttttcggtactgaccgatgggcttttggcggagcgtgagcaaggcatcaccatcgatgtggcgtatcgctacttttcgacagccaagcgtaaattcatcattgccgacacgccagggcatgagcagtattcacgcaatatgggtactggtgcctcacccgctcatgcagcggtggtactcattgatgcatcacagattgattttgggacaacctga

SEQ ID NO: 1043 - DNA, 2184 bp, M.catarrhalis
aaatctgaccaaaatggtcggatttttgcttttttaacagaattattttacaatcatgattgcgtttcattattcatggataaatttatgaccaagcccgtcatgaccattcatttgcctgtgactgcactgtctggtgtgggtcaggcactggctgggcgattggccgagcttggtattcatcgtatttttgatatgcttttgcacctgccacgagattatgaagatcgtagccgtgtcattgctatcaaggatgtcagtcatggtatgagtgtgttggtggcgggtgttgtgacttgggttgaaaagaatcgcacaggattatcggtgaccttagaagatgccacaggggagattacgcttcggttttttcatacttatccaagtttattaaccacaatgatggtgggggcaaaaatcaccgtatttggtgagataaaggttagtcgctacggcacacagatgtctcatcctgactatcatctgacaggcacaaaaaagtttgaatctgggcttttgcccatttatcccaccatcaaaggcatcaatcaaaataaacttaggcagctggtgcgtctggcactgacagctgttcagcaagatggcattcatggcttatcagaaacacagctaaaagcagcaggcgttgagttgacgggcgatctattgccagcattaaaagcggttcacctgccagagatacatgctgatatttttagccaaactgctttactggcaggacttaaagatcgtactcaccctgcctgtcgccgtattatcatcgaagagctggtggcacatcaggtcagttttttgtttcggcgtaatcatatttatcagtataaagcacccaaatgcgacccaattagcccgcttgccaagcaactggtggcaggtctaccctttgagctgaccgccgcccaaaagcgagtcattgatgaggcggtgtctgatatggcgacatcacgccccatgctcagacttatccaaggcgatgtcggtgctggtaagacactggtggctgcgatgacagcatgctatgccttagatagtggttggcaggtggcagttatggcaccaacagaaatcttagcagagcaacatttaataaattttcaaaagtggtttgaacctttggggattggggtcgggtggcttgcgggcaaacaaaccgccaaagagcgtacagcagcactagatgccatcagaaaaaatcaggtgcaaattgtggttggtacccatgcactgttttcagatacggttgtttttgccaaattggggcttgtcatcatcgatgagcagcaccgatttggggtagagcagcgtctgcgtttaaccaataaaggcgtgtcaggtggagcaccgcatcagctggcgatgaccgccacgcccattccaaggacacttgctatgagtatgtacggtgatatggatgttagtattattgatgaattaccgcccaagcgtacgccaatcaccacagtgacgattaaccgagatcgacgagacgaggtgattgagcgtatacaaaataactgccaagctggcaagcaagcgtattgggtgtgtccactggttgaggagtcgtcggctttggatgtgcagtcagcccagctgacttatgaggatttaagcgatcggcttgatattcgtacagggcttatacatggcaagatgaaagctgccgacaaacaggcggtgatgcaagcttttaaggcaggcgatatagatttactcatcgccacaaccgtgatcgaggtgggtgtggatgtgcccaatgcgtcattgatggtgatcgaaaatgccgaacgcttaggattgtcccagttgcatcagctaagagggcgtgttgggcgtggatctgccaaaagcttttgtgtgttactgtatcagctgccattatcaccaacaggcattgagcgacttaatgtactcaaagacagcaccgatggctttgtcattgcccaaaaggatttggagctaagaggtgcaggtgagcttttgggtaaacgccaaactggagacatgggttattatttggcggatattgtgcgtgatgaggcactgcttgaggcagcaggtgacattgcatgccaattaatcaaaacttctgataaactgccaacagcattggcaatcatgaatacttggctaccggaatctaaagattatgtcaatgtttga

SEQ ID NO: 1044 - DNA, 2175 bp, M.catarrhalis
ctaacatcacaaggggtatttatgatttatcaaggaaaaaatattcaggtcgatttttttgaccaaacacaaggtatcgtgcagtttcattttaatgccactgatgaaagcgttaataaatttgatcgcaaaaccactcaagaatatcaagaagcggtaacagtacttgaaaaccgtgatgatattcaaggcttaattgtcacttcaggtaaatcggtgtttattgctggtgcggacattactgagtttaccgaatattttagtcgctctaaagatgaaattgaggcatggcttttggatatcaatcatatttttaatcgctttgaggatttgcccttcccaaaagtggcggcgattaatggtgcagcgttaggcggtggctgtgagatggctttggtatgcgattaccgtgtggcgggtatttctgcccaaattggtttgcctgaaactaagcttggtatttttccaggttttggcggttcagtgcgtctaccacgcctgattggcattgataacgcccttgaggccattgcgacaggtaaggcttatcgacctgatgaagcacttaaattgggattggttgatgcggtggtggctgatgagctgcttgagcaggcagcggctgatttggtcaaaaaatgcttattaggcaagtttgattggcaggcgaagcgtcaagaaaaacaagtaccagttaagctcaatcagctggagcaggcaatggcatttaattcggctaagggtgtcatttttgccaaagccaatccaaaacattatcctgcggtggcgattgcccttgagaccatcgaaaaacacgccaatttaaaccgtgatgatgcgattgcccttgaagccaaaggttttacaaaagctgcaacaaccccacaagcggccgccttggtcggcttatttttaaatgaccaaacagttaaaaaacttgccaaaaagcacagtcaaaatgcacaaaccatcaagcaagcagctgtacttggtgcaggtatcatgggtggcggtatcgcttatcaggcagcggtcaagggcttgccaattattatgaaagacattcaagccaagcagttagaccttggcatgaatgaagctggtaaactgttatcaaaagaggttttgcgtggtaaatcaacgccagctaagatggctcaaaccttaagccacattcgcccaaccttaaactatggcgattttggtgaagttgatattgtgattgaggcggtcgttgaaaatcctacaatcaaagaagcggtattgtctgaggtggagggcttggtaaaacaagatgccattttggcctcaaatacctcaacgatttctatcactcgcttggcgaatgccctaaaacgccccgaaaactttgtgggtatgcacttttttaacccagtacatcgcatgccgttagttgaggtgattcgtggcgagaagaccagcgatatcgccattgcaacaacggttgcattggcacaaaaaatgggcaaaactccaattgtcgtcaatgactgcccaggatttttggtgaatcgtgtgttatttccttattttggtgcgttcgatttgctggtcaaagaaggtgccgattttgttagtattgataagaccatggaaaaatttggctggccgatgggtcctgcgtatcttttggatgttgtgggtatggatacaggcgtgcatgctgccaaggtgatggcagagggtttccctgatcgtatgaagccagattataaaggtgcaacgcagctgatgtttgagcatgagcgtttgggtcaaaaaaatggtgttggtttttatcaatatgaaactgataagcgtggcaaacctaaaaaaattgccgatagtaccacttatgagctgttaaacttggttcaaactggcgatcagacttttgatgagcaagaaatcatcgaccgcatgatgattgcattttgcaatgaaaccgtacgctgcttggaagataatatcgttgcaagccctgctgaagctgatatggcgatgattatgggcgtaggtttcccaccatttcgtggcggcccttgccgatatatcgaccaaatcggtgtcgcaaactatgttgcattgtgcgataagtacgcatatttaggtaaggcatatgaagcacctgccaaattgcgtgatatggctcaaaatggcgagactttttactaa

SEQ ID NO: 1045 - DNA, 1803 bp, M.catarrhalis
attttgactaaccaaaaaattaatcaccagcgaccgtttaacccattttttatgtcagtcaagcatcggctttgctttggtttttatatgacatataacctgactaaatcacccatgactccatcaaaaccttctcaagattctgccaattatttatttttggttctgccacgctttgcactactttgggtctgtgtggcactgattcccgtttcaattttatttcacatttggtggcttttgtttattgctacctgtttgacttgtcttggcgtgtataatatcagccaaaagcgtcatgcaattttgcgtaactatcccatcagtgggcatattcgctttttgtttgaaaattttcgcccagaggtacgccagtattttatcgagggtgaccgagaagaagtaccattttcacgcatgcagcgttcaatcgtatatcagcgtgctaaggatgttgatagtactaccgcttttggtagtctaaatgacttgaccaaacctggcacagattggtttttacattctggtcgtagccatacaattaaaaatcatgattttcgggtgcgtgttggtaatgaacgctgtcgacaaccatatgatttatcggtctttaacatctcagcaatgagctttggggcattgtccgcagcagcgattgaatcattaaataaaggtgctaaagaaggtgggtttgcacatgacacaggtgaggggagtattagcccttatcatcaaaaacacggcggtgatttgatttggcaattagggacggcctattttggttgtcgtgatgacaaggggcgatttaaccccgaggcatttcgtcaaagggcggtcttgtcgcaagttaagatgattgagattaaattatcacaaggtgctaagcctggtaaaggtggcgtcttgcctgcctcaaaaattaccactgaaattgcattgactcgtgatattccgatgggtatcgattgtatttcgccgcctacccacccagagtttagtacacccactgagcttgtgcatttttggcaacgcctgcgtgagctatctggtggaaaacctgtcggctttaagctttgtatcggtatgccgtgggagtttatggcaattgttaaagccatgattaaagaagataattaccctgattttattgtcattgatggagctgaaggcggaacaggtgcagcacccatcgagtttatggattcggttgggatgcctttggtggacgcactgatttttgtccaaaatacgctggttggtgcaggtatccgtgacaaaatcaaggtaggcgtgagtggtaaggtgatttcaggatttgatattgcaagattgatgagtttgggtgctgattggtgcaattcagcgcgtgggtttatgtttgctgtaggctgtattcaatctcgttcatgccatacaaataaatgcccaacaggggttgccacccaagaccctgcacgccaaaaagccattgatattcctgataaatctcgccgtgtatctaattttcataaaaataccctaaaggcattggctgagattgttggttgtgcaggtctatctcacccaaccgaactaaaaccacatcacattgtacgccgacaaccagatggctggattaagctattatctgagcattatcaattcatcgaaacaggttcgttgttaacgggtgattgtggtcgccgtgtgttagatgatatgtggaagcttgccgatccaaacagctttcaggcgatgacgattgcagataagattgttggtgctgaaaataaacgcaaccgcacgatagaaagtctgtattaa

SEQ ID NO: 1046 - DNA, 1023 bp, M.catarrhalis
tcgttttataagaatatactttatagtgtattgataatcattattattcatattataatgattatctatcgtttatctgtcattgattatcttaatcatgttaagataaattatttgggactcattgggcaacttgtcatacaaactttttctaaatacgccttactttctgccagtattttgacattgactttagtcgcttgccaaaaaccagcagataaacccaccgaacctgtgcagcctgcccaaacacaggatggtcatgagcattacaaaacagatgatgataccatggtggatttgagtgccgaaacggctgaatataagcattgggtagaaggtcagatggagattttattggagcagacacaaaaatttgttgctctgcttgatgcaggtcagcttgaggaagccaaagccttatatccgcatgctcgtataccatttgaacggtcagagccgattgctgaaatttttggcgaccttgatccacgcattgataaccatgaagctgacttagaagcaggtgaggtttggtcaggctttcatgccattgaaaaaatcttatggacaaaaaatactatcgaaggcaccaaagaacttggccagcagctgattgctgatattaaagaattaaaagataaaatcccaactgctgaggtaacgggtaatttgatggtagagggtgcagtggatttactcaacgagatttcaaccacgaaaatcacaggcgaagaagagattttctcaaaaactgacctatatgactttaaggctaatattgaaggggcacaaaaaatctttgaaattttaaccccaaaactacaagctaaaaatcctgatttggttaccgaattaacagaaaaattccaagttgtcaatgatttacttgtcactcaccaagttggtcaacatgattacaaaccttataatgagctaagtgccgatgaaaccaaagctttagccgaagcggtcaataaattgggtgagccattggcacaaatgggcgtggtactacagtaa

SEQ ID NO: 1047 - DNA, 987 bp, M.catarrhalis
ttctgggataatcacatgcaaaagacacacttatttaataatcctgttcgcctacttgcaccgatggaagggctgaccgatccgttaatgcgtcgtgtcctaacccaaattgcgtatgatttgggttcaccttatgattgggctgtcagtgaatttattcgagttacgcactacccgctgcctgctcatgttttttataaatatgtcccagagctacacaccaaaggctgcactgccagcggcacgcctgtacatgtacagcttttgggcaacaaccctgaaaccatggcagccagtgctttggtggcggttagcttggggactaaagccattgaccttaactttggttgtcctgccaaaaccgtgaacaatcataaaggcggctcggttttacttgaagaacccaaaacactatacaccatcattcgtacggtgcgtgacgcaataccaactcaaattccagtttctgctaaaattcgccttggttatactgataccagtcaatcagctgagattggccatgcggtggcggatgctcgtgcagattggctaacggttcatgcacgcaccaaagtcgatggctataagccacctgcttactgggaaaaaattgcaccttttaatgacttaggattacccatcattgctaatggtgagatttggaatgctgagcatgccagacgctgcatcgctcaatcacaaacccatcatctcatgctcgggcgtggagcggtcactcgccctgacttaacagccatcatcgcaggtaagtctgatttgggttgggcagacctatgtcagcatcaactaagctttattaatgatatcactgataaccaaaacggtcttattggacgctataaacagtggcttgcgatgctcaccaaaggctacactcaagcacatcagctatggcaagcggtcaaaaaactcaaaaataaaagtgatattgagcaattaattatccaaagtactcatcaccattga

SEQ ID NO: 1048 - DNA, 462 bp, M.catarrhalis
ctgttcatcaaaattacaagtcatcacctgctcgacccctttggcaatggattatatttttttggggtgggtattatcgttggtgtactcattgggcgatttatgttatcaccaaatcaagagacaccgtccaagcaagctgcccaaaaccaaaacgcagcagtgatggcggtggaagcggtacatcccacatcgataacaatcaaaaatcgcctgtcagctaatggcatcgtggctgcagttgaaacggcggaggttagtagtcagatcagcggtgtcgccattgagcgggtgcttgttgaagttggtgaatttgtcaaagcagggcaagtgcttgcaacacttgatacacgaacctttgagcaacagttgtcttctgctgaagctgagcttgccacagcggttgctgcacaagaaaaagcggctgccgatttggcacgcaccgagccattgatgcggtga

SEQ ID NO: 1049 - DNA, 942 bp, M.catarrhalis
  unsure (67): Identity of nucleotide sequences at the above locations are unknown.
ttttgggacaacctgaagtttgggcttttaccacaaactaagcggcattcagccatcttaaagcatntacgctgctctcatattatcgtggcgattaataagatggatttattgaattttgatgaaaataaatttaacaccgtcgtgcgtgcttataaaaaattggcggcacagctggatttacaagatgtcaaatttgtgcctgtttctgccctaaatggtgataatatcgtccataagagccaaaatacactatggtatcaaggtggtacattacttgagatattggagagtttgcctgtgggggaagcggttttgacggatacggcagcgtttcatttgccagtgcagtatgtgttgcgtgctgatggcgacaaaaaagatgattttcgtggctatcaaggtcgtatcgaatcaggcagcgtttcggttggtgataaagtgcgtgttgagccatcaggtcgtatcagtcatatccaagagattatcagccccaatggtgtcgtcagccgagcatctgtgggcgaacaaatcaccatcacgctcaccgatgacatcgatatctctcgtggtgacagcatcatctcggcagtatctcagaccctgccgaccaagcgtctgcgtgccacattatgttggtttgatgagcgtgccttaaatcctgctcgtaaatatttattaaaacacaccacccaaaccgtttttgccaaggttgatgagattcatcatatatgggatgtgcatactttgtcaaattttgctgatcaatcaaccctgaatatgaatgatattggtgaggtgagtatgagtttacaaaagccaattttggcaacctcttacgcccaaaacaccgccacaggctcatttattttgattgatgaggcaacttatcataccgtggcaggcggaatgattttggcaaaagagacccaagatttttaa

SEQ ID NO: 1050 - DNA, 1233 bp, M.catarrhalis
tatggctcaaaatggcgagactttttactaattattgctccaattatccaaggaaaaacaatgacaactctaagtccaaaagatgtagtaatcgttgatggtgtgcgtacggcaatgggtaaaaccaaaaatggtatgtttcgccatgtgcgtgccgatgatttgtcagccaagctgattcaggcactgattgtacgcaatgacattgatccaagcgagcttgaagatgtgatttggggatgcgtgaaccaaacacttgaacaaggctggaatattgctcgttatgcagccttattggcaggcgtaccaaaaactgtggcagctcagactgtgaaccgtttgtgtggttcatccatgcaggcgttacataccgctgccgctcagattatgaccaatcaaggcgatatgtttatcatcggtggtgtggagcatatggggcatgtgtcaatgatgcatggcgttgacccaaacccaaaggcgtctaaacactatgccaaagcatcaaatatgatgggtctgaccgccgagatgctaggtcggttaaacggtatcacccgtgaagagcaagatacctttggggtgcattcgcataaaaaagcatgggcagccacccaagcaggccgttttgataatgaaattgttggcgtagaaggacatgattctgaaggtaatctgcagttatgcactgtcgatgaggtgattcgtcctgatgctaatttagaggcattccaagcacttagacctgtatttgaccccaaaaatggtacagttactgcaggcacagcctcggcactgtcagatggtgcttcagcaatgcttatcatgtcagcccaaaaagccaaagatttggggttaaaacctcgtgcacgcatccgtggcatggcggtggcaggatgtgatgctgcaatcatgggttacggtcctgtgcctgctacccaaaaatccttaaagcgtgctggtcttaatctgtctgatatccaaaccattgagctaaatgaagcgtttgctgctcaaggtctatcggtactcaaaggcttggatttacttgacaagcaagatatcgtcaatcataatggtggtgcaattgcgttgggtcatccgcttggctgctctggcgctcgtatcacaaccacgctgttaaatgtcatggagcaacaagatactcagctggggcttgcgaccatgtgtattggcttaggtcagggtatctcaaccatcattgagcgtatctaa

SEQ ID NO: 1051 - DNA, 432 bp, M.catarrhalis
gaattaaatgacctacaaatcaccacaccaacaggaacagcggtgcgattgggtagtttggcggttattgaagatacccatgctgatatgacatcattagcaaagcttgacggtgaagaggtggtggcatttagtatcatacgctcaaaaggtgcaagtgagacctccgtggtggccgcagttgatgatgccttggctgacttacaggctcaaatgactgacctgaaaatcgaaaaaatcgttgattatgctgcgtccatcgaagaaagctatcaagcaacaatgcgtatgttgattgaaggctgtattttagcggtgattgtggtatttatctttttaagagattggcgagccacttttgtggcagccacggcattgccattgtctattattccaacttttttatcatgtatttgtttggttttagcttaa

SEQ ID NO: 1052 - DNA, 405 bp, M.catarrhalis
gcacttgacgatgtgcgttcagctgtcagcgaagttcaagggcaattacctgctgctgccaatccgcccatcatctcaaaagtctctacagcagggtttcctgtggcgacatattcggttgctgtgcagggcatgagcgataccaaattatcatggtttgtcgatgatacgattaccaaacaattatcaaatatcgctggggtgggaagtgtcagccgtattggtggcgttgagcggcagattttgatacagcctaagatggatatgatgacaagcttatccatgcccatcaaccagctggctcggcagatttatgccaaatggcaagatgcttcaggtggtgaagcaaagattggcaatcagattcagacaatacgcatactaggtttaggtcaatgggtttag

SEQ ID NO: 1053 - DNA, 597 bp, M.catarrhalis
ccaacacaggataaatttatgaaaatttctgctactttttctttgagtgtaatggctttggcgttgtctgcatgtgcaacagcaccaacacaaaccccgccagtggtgaccgaaacgactgctgttgtgcctagcgtttctgacgagacgccatcagtttcaccctcatcacccagaacgacaccaaccgtggtaaccagtgaagatatcaatgccatcatgaatgcctttattgtacgcagggataatgcccaagaaacacttgagcctgtaactgctcaaagtagtattaaggcaggcgatcttattgaatatcaggtgctacttaccaatgatggtaacaatcgtgtgcgtgatatgcgtgtggctttaagcttgccgcaaggagcagagttcacgggcgtggtatcaccaagtgttggcacgcaagcaagtgcagatggttcacgctttgtctttatgccaattcgcaccacagcagctgacggctctgttcaaaatttgccgtttagtcaatatcaagtattacgctggaatatccaagaccttggtatcggtgcaacagcggttgttaaatatcgtgcggttatcaaataa

SEQ ID NO: 1054 - DNA, 1278 bp, M.catarrhalis
tgttggacgctaaagcatcgcaccatgacagtcgcctttgtatcgggattttttattgcctcgctgatgttggcatcttttttgccatcggcatttattccacctgatgagatgaaccaaacccaagttagcattgagctgacacctgatgcaacctttgatgatacgctgcgtatcgcccaaatggcggtcaataaagtcaaagcagtcaagggggttgaaagcgtcttattaacagtaggttcatcacacagctcaggcgacccaagtagtatgcgtagtggatcggtcaataccgcaaagcttgatgttaagctttctgaccgcactttacgcgcaagcaaagtggacatcgaatcccaaatcaatcaagcacttttgaccgtaccagcggcacgctttaatgttggtatgtcagcaggtggcggtgaggcgggctatgttttttcgatcacaggtgctgatgcaaaaaaacttgatgccaccgctcatgagatcatcagacaaatccgtgtcttaccgatggtggcaagtgtgattaataacaatgcctttcccagacctgagctgtcagttattcctaatgagctgagcatggcggataaaggcgtcacaacggcagacttggtaaatacattgcgtgttgctacccaaggtgattatgataatgccttaccaaagcttagcctagatactcgtcaagtgcctattgtaactcgcttaagccatgaagataagcaaagtttaactactttatccaatctttatgtaccaagctcaaaggcggtgcctgttcagataaaagatgtcgcatctttaaaattcaccacaggtgaggcaagtattagccgtctagaccgtgagcgtgccataaaaatcacagtattgtctaccaaagatgcctctttgggcgatctgattgatcgtgtcaaatccacccaaattatgcaaaacctccctgagggcatccatctgattgatgaggggcaagctgaggatatggctgagctatttactggcttgatacttgcgatggcggttgggatattttgtatttttgcggtgctgatgctgttgtttcatcgttttttacagcctttaacgattttgatggctttaccgttatctgttggcggtgcatttattgggctaattgttacaggtagtagcatgtcgatgcctgccatgattgggctgatttactcatgggtattgccaccaaaaactccattttattggtggattatgccatcattgctcaagatgaacaaggcttaa

SEQ ID NO: 1055 - DNA, 435 bp, M.catarrhalis
atatttcggcttattctatcaaaaatcctttggttgccattttttaccttgatgatgattttgggaatttatggatttttacaaatgaaaattcagcaatttcctgatattgacctaccgggggtggtaacaaccattactttggcgggagcatcgcctgaccagcttgaaaatgatgttgctaaaaaagttgaaaataaacttgccaatattgagggcgttaaaagcattcgcaccacactacaaacaggtgcggtaaccatttttacggtctttgagcttgaaaaaccgaatgatgagcacttgacgatgtgcgttcagctgtcagcgaagttcaagggcaattacctgctgctgccaatccgcccatcatctcaaaagtctctacagcagggtttcctgtggcgacatattcggttgctgtgcagggcatga

SEQ ID NO: 1056 - DNA, 222 bp, M.catarrhalis
aggcggataagaaccggtgggtcatctttggtgctttgggggttgggggggcctaatttaatgcttaagcttattcctacgggaacattaccccgattggcatcatgggaaaactgccgttggtgggtgggtcctttattgggaaaaaagggttttttgaaaaacttgcccaccgcgtccaatggctttgattttttattaaaactaggttggtggaacaaa

SEQ ID NO: 1057 - DNA, 540 bp, M.catarrhalis
cttatgattggtaatcttggtttttttgaattaaccttatttggtatcattgctttgattgttctaggtcctgataagctgcctgtcgctgcacgcacacttgggcgatggtatggcatgtttcaccgtgccagccaaaagcttcaaactgaaattactaatgaactacaattacttgaaacccagcaaatgctcaaaaaagagcttgatgagattcgccagtctgaagcacgcataaaagcccaaatgaatgcactagagcggtcacttgatcgcaccaagacccaacaacaaaatacccaaaaaaatcagccagccaaagagctgcccaatcatgatgattttggtattcaggtagaatgtgatgatgataaaaacctccaagaaacccacgctatcagagcagcactcacactgccgatgataaaccattggtttttgatgagtagctatgatcgccgtcgccgtctaccgcctgcaccctacttgccaaatcatattgccgaccccttattaaatcaacccaaccgccgcccatga

SEQ ID NO: 1058 - DNA, 795 bp, M.catarrhalis
tatgagcatgggggcataatggccttaatatcattggcgtctatgcccaactggatatggtacaccctaattgctctactgggtgcaggggtgggcggctatcttatccatctgatatataccctaccttatcgaatgatgcttgaatggcaggcagaaatgatacaggtgattaatcccatcatcctagacgatgcccaagataagcttttgacaggctttgggtcatcttatcatcaaaaagttgcacctgcctatttatacgccattatgatgccacttagtgccttgcttagcatcagtacactggctatccaaggcatatcaatcattggtgctttgtcggtgatctttgtgtggtttggtcttgggctggcaggcatcgactatcgagtgcaactactgcccgatcgtcttgtgctgccacttggcatgattggcttgatggcaaatggctttggggttttgaccacgcctgtagatgccatctttggagcggtcgttggttttttggtactttggctaatcaatgccttgtatcgtttggcacgccgacaagatggcatggggcttggggatgccaaacttttgtccgcttgcggggcatggcttggtatatggcagctgcctataattgtgtttatcgctgcggcgttgggtgtggtggcaggcatcatcatccaaagacaccaaggtaaggcatctgcgtttgcttttggaccatatcttattatggcagcttgggtggtgttgctctttggcgagtacatacaggcgtatattggcatcagataa

SEQ ID NO: 1059 - DNA, 1536 bp, M.catarrhalis
ctaagctgtggtataataagcacttttacccatccattcatccacgccatgatgtataacgaccaccaaaaaccaacccccaccaaagagcagttggcagcacttgatatggcaaaaactggacaatcctttaaaattgttgcctatgctggtgcaggtaaaactacgacacttaagctcatcagcgaaaatttgcgtggtcgtgggctatatttggcatttaataaagccattgctcatgatgcacaaaataaatttccgcccaacattcgttgccaaacttttcattcgctggcttttcgccatgtcaatcgtgatgtgactgccaaaattagcctgcctaggcttacgccatctcgcttagccaatgaacttggactgcgtgccatcagcaccgagcgggtcattgatggcattaaaaagccagtgacgctcacgcctgccaagcttgctaatatcgtcagtgaagccatcacgaccttttgtaagacctcttctgcgtatcctgcaccacggcatatcaccgcaccaaattggatgagtgatactgatgctaagatgttgcaacaaaccttatatcctgcttttgaacagcgttggctgcaatccattgacccacgccatcaagcaggcatcagtcatgatatttatctaaaattgtggacgctgtctaatcccatcattcctgctgatttcattttatttgacgaagctcaagatgccgaccctttaatgatgggtgctttgattcgccaagataaacaaaccatctatgttggcgatgctcatcaacaaatctatgaatggcgtggtgctctaaacgccatgaaacgcctgccctatccacagacactattgacgcagtcgtttcgttttggtgaaccgattgccagaattgccaatgtgtttttaaaagcactcaatgaaaacattcccttaaagggcaatcccaatcaatcttcaatcttagctaaaagtttggttcatggtgcaaaagatgccatcttatgccgcacaaatgccactgccatgagccatttgcttgatggtctaaagcttgggcataaggttgctctacaggctgatagtcatcgaattttaagattttgtcaaggtgctgacagccttagaaatggcaaatctgcctctggcatccctgaacttgcctactttaatcactggcaggaagttcaagaatttagtgaaactggtgagggtggggatttaaaaacttgggtgaagctcatcgaagaacatggcacgaccaccatcaccaaggcgattaatagcctgaccatgccaagtcatgccgactatgtcgtctcaactgcccacaaatctaaaggccttgaatggaatcgtgtacaaatcagcgatgattttttatatgacatcaactcattggctgttaaaattacgcctgaagagttacgcctattgtatgtggcttgtacacgaggcaaaaacctgttagacattcatcacatcagcgatctgttgcatgctctacaacacaaaaagttgattctgggataa

SEQ ID NO: 1060 - DNA, 318 bp, M.catarrhalis
gcagttacaggctcaagtgtttcttgggcattatccctgcgtacaataaaggcattcatgatggcattgatatcttcactggttaccacggttggtgtcgttctgggtgatgagggtgaaactgatggcgtctcgtcagaaacgctaggcacaacagcagtcgtttcggtcaccactggcggggtttgtgttggtgctgttgcacatgcagacaacgccaaagccattacactcaaagaaaaagtagcagaaattttcataaatttatcctgtgttggtcaagttttatgtgcccataagcatagcacagctgattga

SEQ ID NO: 1061 - DNA, 201 bp, M.catarrhalis
gagggtattatgaaacttaaaaccaaacgcggtgccgtcaagcgtttcaaaaaaaccggcaacggcttcaagcgtaagcaagcattcaagcgtcacattttgaccaaaaaatctccaaagcgtatccgtcaattgcgtggttgcgtcatggttcatgcatcagatgtagcttcaatccgtcgtatgtgcccatacatctaa

SEQ ID NO: 1062 - DNA, 753 bp, M.catarrhalis
ttaccgattatgccaaacaaatcccccaataaagccccagcctatctacgcatcaaaactgccattttggataatatccatgcaggtatttgggcttctggcgttgcgattcctgctgaaattacgcttgctgaagattttggtgtatcacgcatgacagtcaatcgagccatcaaagagcttgaagctgagcgtgttttagagcgtcgtcaaggctcaggtacttatgtagctcagcaaaagtataataatgcccatattgaggttcgtaatatcgccaaagatatccgtgagcgatttcatcactatcacgctcaagtcatcacacaaaagacgcttgattttatggcattaaatcagcctgacaaccattggttaaatacgctgttttttcacaatcagcctgcttacactgataaactataccaagtttgcatcgcacactatggcgatgacttgcccattcaatatgaagaacgctgggttaatgcctctgttattgctgattttatcaaccaagattttaacatcgttaataccagcgattatttgattgaccatgtgcctcttgaatatggtgattatcaaatccatgccaaacttgcatccgacaccatttgtcagatactacaaatacccatcaatgagcccacattgttacacactcgacaaaccaaatcacaaggcaagcttgtcacttttgtgaatatgtggcaccctgccagtcggttttcttttagtgggacgctatag

SEQ ID NO: 1063 - DNA, 1326 bp, M.catarrhalis
ggggctgttatgacaaccaaagagataccaagttgctcattttgtggcaagaaaaaaaccgaagttcaaaagctcatcgcaggcaatgacgctaatatttgtaatgaatgcatcgctgtttgtggggatttattgggagattggtcaaaaccaaccaaatcttctggcagatcgtctgatcaatcagctgacaccagccaccaatcagatgtccagctgagcattgaaacagatagcgataaagatgaatggcttaataaagttctgccaaaaccaaaagagctgcgagcacacttagatgattatgttattggtcaagatgttgctaaaaaggcactggctgtggcggtttataatcactacaaacgcctgaaggttgctaatgataaaaaagatacggatggcgttgagttatccaaatcaaatatcttgcttatcggaccgacaggttcgggtaagacgctactggcacagacacttgccaagatgttggatgtcccatttgccatggcagatgcaacgacgctgaccgaggcaggttatgtgggcgaagatgttgaaaatattgttcaaaaactgctgcaagcgtcagactatgatgtccaaaaagccgaaaaaggcatcatttatattgatgagattgataaaatttctcgcaaaagcgaaaatccatcaatcacgcgtgatgtttcaggtgagggcgtgcagcaagcactgcttaagctcattgaggggacggtggcaaatattccaccccaaggcggtcgcaagcacccacgccaagagatgattcaggtagataccagcaatattttgatgattgtgggcggggcatttgctggactggataaagtgattcgccagcgtaccgaaaaaacaggtatcggttttcatgctgatgttaaagctcaagatgaatcaagcatcaccgaactatttcgtgaggtagaagctgaagatttgattaaatttggtctgattccagaattgatcggccgtctgccagtgattgcaagcttagaggaacttgacgaagctgccttggtgcaaattctcaccgaacctaaaaatgcactggtcaagcaatatcagtatctttttgatatggaaggtgttcaattaacctttgagcctgaagcactgaccgccatcgccaagcgtgcccaagagcgaaaaacgggtgctcgtggcttgcgttctatcattgaaaatgcactgatggatacgatgtatgagctacctagcatgaccgatatcgcagaagtgattgtcaccaaaggcgtcattgagtctggcaagccgccagtgactaagcctaaatcgtga

SEQ ID NO: 1064 - DNA, 933 bp, M.catarrhalis
gtaattatcatgacagcaactattctacaaaacgagcatttagattggcttgaagcagaatctatttatattatccgagaagtgatcgctgagtgccgtaatcctgctctgctattttcaggaggtaaagattcagttgtgctacttgcactggcacgcaaggcattcgccatcaaaggtcgtgatgtggcactgccatttcctttggtgcatattgatacagggcataattatcctgaggtgattgagtttcgtgatgcacaggtcaaaacgcttaatctgcgtttggttgtcggtcatgtcgaagactctatcgccaaaggtacggtcgtgctgcgtaaagaaactgactcaagaaacggtgctcaagcggtcaccttgcttgaaaccatcgaggcgtatcagtttgatgccttgatgggtggtgctcgtcgagacgaagaaaaggcgcgtgctaaagagcggattttttcatttcgtgatgagtttggtcaatgggatcccaaagctcagcgtcctgagctgtggtctttgtataatgccaagcaccatcaaggagagaatatgcgtgtatttccgatttcaaactggacggaacttgacatttggcaatatatcgcacgagaaaatcttgagttgccttcgatttattatgctcatgagcgagaagtggtcgaaaaaggtggacttttggtgcctgttacgccattgaccccaaaagctgatggcgatgtcagtgaaattcgttcggtgcgttttcgtactgtgggtgatatctcatgcacctgccctgtggcaagtcttgctgccacgcccaaagagattatccaagagactgctgtggttgagatttcagaacgcagtgccactcgccttgatgatcaagtcagtgaagcggcgatggaagtacgcaaaaaacaaggttatttttaa

SEQ ID NO: 1065 - DNA, 366 bp, M.catarrhalis
gagaataacatggctcgtgtaaaacgtggtgtacaagcaaaccgccgtcataaaaaagttctagcccgtgcaaagggttactatggtgcacgctctcgtgtgtatcgagtcgctgtacaggctgtcatgaaagctggtcaatacgcataccgtgaccgccgtaataagaagcgttctttccgccgtttgtggattgctcgtatcaacgctggtgctcgtctaaatggtctaagctacagccgcttgattaatggtcttaaaaaggcaaatgttgaaattgaccgtcgcattttggccgatatcgccatgcatgatgcggctgcctttactgccattaccgaaaaagcaaaagctgctttggcataa

SEQ ID NO: 1066 - DNA, 645 bp, M.catarrhalis
ggagagatgatgttcatattgggtttgacgggtggcattggtagtggaaaaagtgctgtcagcgactatcttggtaagcaaggcatcacagtggtcgatgctgacatcatcgctcatcgcctaacatcggatggtagcccacttttgattaccttaaaaaaagcactgggagattgggtgcttgatcatcacgggagatatgatcgtgcagcagtacgggcgcgggtatttagtgattcacagactttagatcagctcaatgccatcatacaccctgccattcatcaagccatcttagatgaacttggctgttcacagtctgcttatacgatactttcggtgccacttttatttgaggggcgacacaaatcccccaatctgctggcactttgtgatcatgtgcttgtcgtagatgccagtagtaagattcaaagacagcgtgttgccaagcgtgatggtcataatcccactcaaatccaagccatcatcgatcaacaaatcagccgagaacagcgactggacttggctcaaaaaatcggtgcagacatcttagtcaatgataaaacgcttgatgaactccaccaaacccttgatacgcttcatcaaaaatatctggcaatggcagcacaacatggcttaaaatga

SEQ ID NO: 1067 - DNA, 1143 bp, M.catarrhalis
ggttttattgtatttgttatgacacagccaacctattacgacattttgggcatatctttatccgccgataccgaaatcattgatgccgcttatcacgctttaaccaaaaaatataaacataatcccaatgccgctcatcgtcttgtgcaaattcgccaagcctatgaaaccttatcagatcccatcaagcgagcagactatgactcatggctacaaatgaatgcaaggtttagccgcacgacgccgcccaactttggcacacaaactacccattcgcccatacagacaaccgatgattatcgcccacatgagccgcccaaacccaaaaaatcatcactgacaagctggctagttgggctattgatagcgatgattgctgtggtgattttggcatattttttggtatcatcagcaggattttttgggcatcgtgacgagcctgtcactcccttaaatcatgacacgcctaacagcagtattcccaaattggttgccattgagccgatgataccattcacacctgatgaaatcacgccagaacaacgagcctcatacgaacacgcacatgctgcttatttggcggcggtaaatcgcattaatgccgtttggaataatctgcccaaaaccattcaagatgaactgcgtgatgaacaacgctccatcaatagcacacgagaagaggtttgtaaggcacaagctgccagccaatacagccacccaatggacatagacacggcacgctatcagtgcgaagtacccagacttgatgagcgtaccgaaactttgcgtatttatgcagccaatgttgccgatcagccaacgctattttatgaccccagctatcccaatcagccgacctatagtgatcacagcaatcatttagagggctatacgcccagtgaagcacatgccttatacgatgatgctgttgcccatattaacgccgtttgggatgagttatctgacgagacgcaatcactgctgcgtgacgaacagcgagccatcaatgccgaccgtgaacgacactgccaagtcaatgcccaaaatacctataacaaccgtcatgatcaaacggtcgcacgctatttatgcgaagtggcactgctgtatgagcgtgccgaagagctggcgttgtatgattga

SEQ ID NO: 1068 - DNA, 1272 bp, M.catarrhalis
atcgcatttttaatgaaaaaattaaataaacctttggctaatcaaggcatgacaaataagaccttgtctaaatcgcccaaaatgctcatgtttgattatcatgccaaatcttatgatggtaaaacggtcagcggtcaaatcagtgccaataacatgagcttggcaaaggcacggctacgcaaacaaggcttttatcatatccatctgactgccaagcaagcgcggtggcactttgagcgtcccattgctaataagcagattttgcttagtcttcgtaccttggcaacactcttaacatcaggtgtcgttttgaccgacgcactagatatcgctgctaagaccacaacgaacggccgcttatcaaacaagctcatccaaatcaagcagtgcatcgagcaaggagagaatttcacccaagccattgccagtcatccagagtttggcagtttagcactggcgctcattgatgctggcgaaaaatctggtacgcttgatattatgcttgagcgagccgctgagcatgctgaacaacaagcacttcgccaatctcagcttaatcaagcgttgcgttatcctgccgccatcgcactgacttcacttatcgtcagcaccgtgatgcttttaaaagtcgtgccaagctttgcagcaagctttggcaatatgggcaatgagctaccaaccatcacgctgtgggtgctgtcactgtcacaatggttgtcggcaaatttttggcagctactattggtggcgataacgagcattggactgtttatttatttttataaaaccaatacacgcctaaggctttggtgtgccaacactgcttttggtttgcccatttttggcaaactcatccaagcggttggtagcgcgcgttttgctcagacattatccaccacatttagctcaggcgtgcctttggcacagagtattgttttggcggggcgagcctgtcatcatgtgctattttttgatgccagtgaacagattgcaaaagctgtcaaaactggcacgccgttgggtcaagccatggcagacaccaagctgttttcgcccatgagtgtgcagatggtaacggtgggcgaagcctcaggcaggctgtctgagatgcttgatcaaattgccaaacaccatgataaagaggtcaaagataaaattgatgctttgattggcatgattgagcctgccatcatcattgttatgggtgtgctcatcggtgggcttgtactggcgatgtacttaccaatatttaatatgagcatgggggcataa

SEQ ID NO: 1069 - DNA, 1302 bp, M.catarrhalis
agtgtgaaatttgccctgataggaatacttatggaaattactttaaatggctactatacgctgattttagcgacgctggtattattactggggcgtcttttggtcaagaaaattaagtttttgggggattttaatattcctgagccggttgcaggcggtttaattgcagcggtgattgtctattgcctaaattggttttttgggtatagctttatttttcaaaaagagttacaaacagcatgtatgttgatgttttttgcatccatcggtttatcggcagattttggacgcttaaaagcaggcggtaagccattaattatctttttatttgtggtatcaggatttattttacttcaagacgcagttggcgtcggcttagccagtgccttgggcctagatcctttgctgggcttggttgcaggttcagtatctttgacagggggtcacggtacagcaggtgcttggggttatacttttgaggataaatatggtgttgttggtgcaaccaccttaggcattgcgtgtgcaacctatggcttggtggcagggggtgttatcggtgggcctgtggctaagcgtttgaccaacaagcttggcattaaaccaacagcccatgcagtcagcccatctaagatggagcaattggcaaatgaccagtcattatacaacaccacgcacaaccttgatgatgatactgcacataaacaaatgtttgagcgacctgataatattcgcttgattacagcaagctcagccatcgaaactttggcattatttgctgcgtgtttggcatttgcagacattatgacaggtgttgcaaaagatacttggtttgagctaccgacctttgtttgggcgttatttggcggtgtcgtcattcgtaatattttaaccactttctttaattttgatatgtttgatcgtgccatcgatgtatttggtaatgcagcgttatcactgtttttggcgatggctttattatcactcaaactgtgggagttgactggtttggcaggccctgtcttgattatcttggcagcacaaactttggcgatgattggctatgcgtattttattacttttcgtacgatgggcaaagattatgatgctgctgttttggcggcgggtcattgtggatttggtcttggtgcaacaccgaccgccattgccaatatgcaagccatcaccgatcgctatatcccatcacataaggcatttttgattgtgccgatggtgggtgctttttttgtggatcttgtgaatgcaaccattttacaagcttttcttcgtgtgtttggttga

SEQ ID NO: 1070 - DNA, 828 bp, M.catarrhalis
cagcctttatccgagcgtgaactcatcacgcaacgccgaaaaattggcatgatttttcagcactttaatcttttgcactctcgtacgacttttgaaaacattgccctaccgcttgaattatcaggcacccccaaagcagtgattgccagtaaagtgggcgctctgcttgagctggttggcttaagcgataaaaaagacgtttaccctgccaatctgtcaggcggacaaaaacagcgtgttgccattgcacgagctttggcatctgatccaaaggttcttttgtgcgatgaagcgacttctgcacttgatcctgcaaccacccaatctatcttaactttgcttaagaagattaatgaagagcttggcattaccatgttattaatcacacatgagatggatgtggtgaagcgtatttgcgataaggtggcagtgatggataaaggcgtgctgatcgaacaaggcacagtcggtgaaatttttgccaatcctcaaaccccacttgccaaatccttcattcattcaacatttcatatcggtctgccaaacagctatcttagccaactaaaatccgagcctgctttgggattgtcgcctgtgatttgttttgaatttacgggcaattcagtggatatgccattattttcgcttgcttcaaaacaatttgatgtagattttaatattttaacctcacagatggactatgcaggcgacataaaatttggctttaccattgccgagcttatcggtgaaggcacctcggtcatgcaagcaatagaatttttaaccacccatcgggtcaatattgagattatcggctatgtggaatga

SEQ ID NO: 1071 - DNA, 354 bp, M.catarrhalis
acatataattttattttgcaaggtcattttatgaattttggtaaaatttttggtatttgtgcactggcatctggcatcgcattggcaggctgcagcaatcaatcaaacgaaccagctgccatatctgatacagctgcacagactatcaaggttggcgtcatggcaagtcctgagcaagctgtggcagaggtagcaggtcaagtcgccaaagaaaaatacaacctgaccgttgaattggttgagtttaatgactatgccatgccaaactcagccgtctcaaaaggtgaacttgacgccaatgccatgcagcacaaaccctatcttgaaaaagacagccaagataaaggcctaaat

SEQ ID NO: 1072 - DNA, 300 bp, M.catarrhalis
tatagggtttacttcattgatcaaggcaatttacgattgtccacacactccttctcgcccatgatcaccctcttaggcgttagcaaacattttgttattgaaaaagagggtaaaacgacgagttttactgcggtacagccaaccgatttgaccatccaaagtggtgaaatctatggcatcattggtgcttcaggtgctggtaaatccaccttaatccgctgcgtcaatctgcttgagcgaccaagtgaaggctctgttgtgatcgatgatgtggatttgacagcctttatccgagcgtga

SEQ ID NO: 1073 - DNA, 288 bp, M.catarrhalis
ggattggcaaaaatttcaccgactgtgccttgttcgatcagcacgcctttatccatcactgccaccttatcgcaaatacgcttcaccacatccatctcatgtgtgattaataacatggtaatgccaagctcttcattaatcttcttaagcaaagttaagatagattgggtggttgcaggatcaagtgcagaagtcgcttcatcgcacaaaagaacctttggatcagatgccaaagctcgtgcaatggcaacacgctgtttttgtccgcctgacagattggcagggtaa

SEQ ID NO: 1074 - DNA, 723 bp, M.catarrhalis
ccacccatcgggtcaatattgagattatcggctatgtggaatgagattgtcacaaaatttgtcagtgaaatgcacccaagaatgtgggaaatggttgcccaatctacttgggaaaccatctatatggggcttgctgccactgccatcgctgttttagttgggctaccgatgggatttttggcatttttaaccgataaagggcgtatccttgaaaatcgcagtgcatttgtaattttggatgttattattaatattggtcgctccgttccttttattattttgctcattattctcatgccagtcacacgatttttggtgggaacaacccttggcacaacagccgccatcgtccctttgagtgtggcagcaattccattttttgcacgcttgagtgccaatgccttattagaagtacccacaggactgaccgaagctgccaaatctatgggtgcaacgcattggcaggttgtcagcaaatactattttgctgagagcctgcccattttgattaatgcggtcacattgaccttggtgtctttgattggttattctgcaatggcaggtgtggttggcggtggtggcttgggcagcttggcgattaactatggtgagcatcgcaacatggtatatgtcaagtggatttcaaccatcatcattgttgccattgtgatgatttttcaaaaagctggcgatgtcttggcagccaaagttgatcaccgatag

SEQ ID NO: 1075 - DNA, 396 bp, M.catarrhalis
agatcctgtatccaaataatgttacattccggggtcctgggagttaagacttcaacatacgaattgtggggggatgtgattcagcccataacagttaagctatcacagatacttctgaggtccgtggaaggagagagtgtgggtactcatgacttcccagagtcccagcaatgctacccagagcaggtctgtgcaagggagggcagccatctgcttttccacggtctggagtccccttctttctttcatcaggactccgagtcctctgccccatggacccctcttcccaaacttctctctggtcaggacttacactctggagcctacaggtggagcctggggtggaattccacttcctccacttatcagctgtgtgtctttgggcctcttatttaa

SEQ ID NO: 1076 - DNA, 1104 bp, M.catarrhalis
attggtgcggctccttccagccccgtggtgaagacgaatttaaaggataagccaaccgtcattttagatggcgtttcgatcacctctttagctgaccaaaatacagagtttggcgttaatcattcaaaaacagtcagtggcatcacagtttcaaaagagcaactacaacaacgagcaaccaccctaggcgatgccttggcaggtgagcttggcgttcattctaaccattttgggggcggtgcctcagcccccatcattcgtgggcaggagggtaaacgcctgaaaatcctacaaaacggttcagaggttgtggacatgtctgggttatcgccagaccatgccatagcggtggacaccacactggcaaaacaggtggagattgtgcgaggctctggtgccttgttgtacgcctctggcaactcagcaggcgtggtcaatgtcgttgatgacaaaatacccagcaaattgcccagcaaattacaaggtgatgcgacggtgcgtcttagcagtgccaaccgtgaaaaattaatcaccgccagtgccgaagccccactgggagagcatgtggtagtgcgtgttgcagggctgtccaaacaagcagcagattataaaacgccacgctttgaccgccatgtctttaacgaagaatctgaatacgatgatactcagccagaattcatctataaagacaccttaaagcatctgccagacagccatgccaaatcaaacgcaggaacgcttggcgtgtcatgggttggcaatcaaggctttttgggggcatcggtgagcttacgccgagacaaatatggcctgcccaaccattcacatgaatatgaagaatgtagcgtgcatggcatttctcagtccgccttacaatacaagccatatttgcgtttgtatccttttttgatggaaaatgatgacttagagtttgacaatgcagggcttgaatgccatacacatgatgaccacgaccacgagcacgaccatgctcatgaccacgatcacgaccacgagcacgaccatggcaaaccttggattgatttgaaaatgaagcgttatgatgtgcaaggggcaaatcaatgcgccgtttgctggcattga

SEQ ID NO: 1077 - DNA, 369 bp, M.catarrhalis
agcgttatgatgtgcaaggggcaaatcaatgcgccgtttgctggcattgataaaatccgagccagcatgggcaaagtggattatcatcatgatgagatagatgggggtgagaagaccagcttttttgataatcaagccaatgtgtggcgtctggaagcctcacatacccccattcataccccgatgggcaagtttagcggggtgtttggggtaggttatctcacctcaaaaaacagcggacttgtgccaccctcgtatgaagatggcaataaacaagacacccaaaacatcttgcacaataataaaaccaaaacaggcagtgtgttttggtttgaagaatacaaaacccatgacaagcttgaccgttga

SEQ ID NO: 1078 - DNA, 183 bp, M.catarrhalis
gaagtgagagcaggaaaagacgaagaaaagaccgtaagcggaggagaaaagagaaataggaatttagagagagagaaagcgatgaaaggaaataagagacgagcagagaaaaaaggcgctgcgagcaagagtacatataatatcagaaggcgtgtttgggacgctttcgtcagacacatatga

SEQ ID NO: 1079 - DNA, 1038 bp, M.catarrhalis
ggtgaagacaaaatccattatgccatgaaagcaagtcccgccaccgaagtggtcaaatatttggctgatttgggctcaaattttgattgtgcatcgatttatgaacttgaccgtgtcttagattgtggtgttacagctgaccgtatctcctatggtaataccatcaaaaaagcagtgcatattaagtatgcctataataagggtattgatttatacgcaactgattctaaagctgatctaattaatatcgctaataatgcccctggctcaaaggtatttgtccgtattttagtgcatggtgctgacacggccgaatggccgttatcacgcaaatttggttgccaccctgatatggcagttgatttacttgttcaggcaaaaaatttgggtcttgtgccttatggtatctcatttcatgtcggcagccaacaaaaagatgtcgcagcgtgggatgatgcgttagcaaaagttaaatatatgtttgactggatgaaatatgaagagggtattaagcttcagatgattaatttgggcggtggttttccaaccaactatatcagtgaggtgaacccaatctcggtctatgctgaagagattcatcgatatttatctgaagattttgatgaagatgaaatgcctgagattatcttagagccaggccgttccatggtgggagatagtggcgttttagtttcggaggttgtgctaattagccgaaaatcacgcactgatttgacccgctgggtatatacagatgttggtttatttcaaggtttgatcgaaacgttgggcgaggcaattaagtatcctgtttatacaccaaaaatggaaaccacagctgagcaaggcacggtaattttggcaggtccaacctgcgatagtacagatattatgtatgaagatgcagcctataaattgcctcaaaatcttgaaattggcgataaattatactggctgacgacaggtgcctataccaactcttattcatcggttgaatttaatggctttccacccttgaaggtcaaatatattgaataa

SEQ ID NO: 1080 - DNA, 450 bp, M.catarrhalis
tggatgatttggctaattgccttaaatagcgatacaccgatcaatatgcttggtggtgcaaatcctgcgaattttccaaataaattagccgcataccatgcagcgtatcaacaaattgctacccacggttcctgcatttgtaagtatgagcattttccctttctccgtaaggttttagatattttattcacgtccctgtctgaaatttatccaccgcactctgagatgtggcatcgaccgctgactcatatgtgtctgacgaaagcgtcccaaacacgccttctgatattatatgtactcttgctcgcagcgccttttttctctgctcgtctcttatttcctttcatcgctttctctctctctaaattcctatttctcttttctcctccgcttacggtcttttcttcgtcttttcctgctctcacttcttatgattcatttagctttccc

SEQ ID NO: 1081 - DNA, 210 bp, M.catarrhalis
caggtgcatccatggcgtttgtgcttggtggtaaaaaccattgatggtcgtgaacttgcccgtgggggatttttaaggggggcgcttaacggcttaatcaaggctggcacccgttttaccatcttttgccacattgaattgaatttaaaggctgactttacccatgccaataattggggggaaaaggtcatccagggcttggccctttga

SEQ ID NO: 1082 - DNA, 1026 bp, M.catarrhalis
aaagagacaaccatgaacgcctaccgtctatctgatattgcccaatcttatggcaaagcccccaaagacatcaaagtcatcgttggcatgtctggcggtgtggacagctcggtatcggctgttttgttacaacaagcaggctttcatgttgaaggcttgtttatgaaaaactgggaagaagatgatggcagtgaatactgcaccgccatgactgatttggctgatgcccaagcggtggcggataaaatcggcatcaaattacacaccgctaactttgccatggaatattgggacaatgtttttgaacattttttggcagaataccaagcaggacgcacgccaaaccctgatattttatgcaacaaagaaattaaatttaaagcctttttggattatgcgtctgggccacaatttggacttggggcggattttatcgctacaggacattacgcacgccgtggttttagccaagatggcaaggcccagttgctgcgtggtttggacgccaataaagaccaaagttattttttacacgctgtggggggcgacaaaatcgccaagacacttttccccatcggtgaacttgaaaaaccacaagtgcgagccattgcccaaaaatatgaccttatcaccgccaacaaaaaggactccacagggatttgctttattggtgaacgcaagtttaaggattttttacaacagtatttacccgctcaaaaaggtgatatctacaccgatgatggtataaaaattggcacacatgatggcttgatgtattacaccatcggacagcgtggcggcattggtattggtggtgtggcaaatcgccccgaagagccgtggtttgtgttacacaaagacctgacaaataaccgtctcatcgtcggacaggggcatgaccacgccatgttacaatctgacgagcttaccgcttataaactggattggggaattgccccccctgttcagatttttggcaagcaaggttttagatgcaccgcccaaaacccgctatcgccagagtga

SEQ ID NO: 1083 - DNA, 750 bp, M.catarrhalis
tgggacaaatgcaaagatttattgattttattgttattttttgttaaaattataagccatttatcaaaattcatcataccaatgcttcatcaaaacccaccaaaatattcatttaaccatcaaaaaatcatcatcattgctttggcttatgttggcgtcatcacaggcgctggtctatcttctggtcaagagatatttcaatattttgcaagctttggcaaaatgggcatgataggcgttgtgattttaggggttttgcatgccatttttgggggcattattttggcgttaggctcgttttatcgtgccaatgaacacagccaagtccttgataatattgcaggtccttgggtaacaaaattacttgattggtcattgattgtcagtggttttaccttaggctttgtcatgattgctggtgctggtgctaatttaaatcaagaatttggggcacccacatggcttgggacagccctttgttcgttattggtgattggcattagcatgctaaactttgaaaaagtcaccgctgtaatcggtatctttacacccattgtggtatttatcatcttcgctttgacactctacacctttgttggtaaaagctacgattgggattaccttgaccgcattgcgttatcagaacctcaaatttttcccaatgcatggctgtctttaatcaactattacgctttgggtattatgacaggtgcatccatggcgtttgtgcttggtggtaaaaaccattga

SEQ ID NO: 1084 - DNA, 327 bp, M.catarrhalis
caaataaccgtctcatcgtcggacaggggcatgaccacgccatgttacaatctgacgagcttaccgcttataaactggattggggaattgccccccctgttcagatttttggcaagcaaggttttagatgcaccgcccaaaacccgctatcgccagagtgaccaagattgtaccgtctttgcccttgatgagacaggtgatacagtcaaagtggtgtttggtgatgcccagcgtgcggtaacacaaggtcaatcggtcgtgttttatgatggcgacatttgcttagggggtggggtgattgatgggacaaatgcaaagatttattga

SEQ ID NO: 1085 - DNA, 603 bp, M.catarrhalis
acggtaggcgttcatggttgtctctttttatcagattgtggtaaacttgtgccattatatgggggttggccagtcatttacaaggcattgtccacaacaaatcaaaaaggctttatgatgataaaaatcggtcaaggcatagatgtgcattcattcacacagggtgattttgtgatgcttggcggtgtacgcattccccacagccatggcataaaggctcattcagatggcgatgtactgctacatgctttatcagatgcccttttgggagcgttggctttgggtgatattgggcagcattttcctgatacagatgatgcttatcaaggtgctgatagcaaagttttgctaaaacatgtttatgcgttggtgcaagcaaaaggctacatgcttggcaacgctgacatgacggtcatttgtgaattaccgaagctatcaccgcacaaccttgccatgcgtgagtgcattgcaggcgtgttgggtgtcagtgtagactgtgtgagtatcaaggcaaccaccaacgaaaaaatgggctggatagggcgtggtgagggcatttgggcaagtgcaacggtgctgtttattaaaaaccatgcttattaa

SEQ ID NO: 1086 - DNA, 201 bp, M.catarrhalis
aaatatcatttggcggtggccttgtcaattgtattccatactggcaaagcatgggaacctttgaccggtaaatattatcttcgaagggtatggtttaatttggaaccttgcctggtttggaccttaaatcccccgggtggaaacacagggaaagattgggtattcacaattctggcaccggaatttaagaattttgattaa

SEQ ID NO: 1087 - DNA, 1101 bp, M.catarrhalis
atgaatatgagtaacatgactgattttaccgtttcaacggatgcaccttggtataaaacctatcaagaacatggtcttgattttaactttgatttgcctgacaatatcaattcactcatggatatttttgatcaggcatttgcacgcttcggtaatcaagttgcgtttacttgcatggataaatctatcacctatcgacaactggataactatagtcgtcaaatggcggcatatttacaatcgctaggcttggtcaaaggtgataaagtagcggtcatgatgccaaatattttgcaatatccgattgcgatgattgcgattgtgcgtgctggattgacattggtgaatgtcaaccctttgtatacctcgaatgagcttgaacatcagctcaatgactcagaagctaaagcgttatttattgtagaaaattttgctcatacttttgaaaaagtggttaataaaggtcaagttcgccatgtaattgttgcatctttgggcgatatgcttggcttaaaaggctttttggtcaatgcagtggtgcgtcatgttaaaaaaatggtgcctgaatggaatatccctggtcatgtatcatttaaagacgcactcaacaaagtgccgataggtaactacaatcgccctaatttggctttggatgatattgctgtattgcagtatacaggcggtacaacaggcgtggcaaaaggtgcgatgctcacccatcgtaatcttgcttcaaatgttgagcagtgtgcgccatttcttagcttggtattttctaaagacaatctatctggtcagtatatcgcagttgccttaccgctttaccatattttttcattcacagcgtgtggtttgttggggatgaagatgggttttagtatgttattaattaccaacccaagagattttccagcactgtgtaaagattatgccaaatataagcctgcattttttcctgcggggaaaactttatttaatggtttggtgcatcatgaaggattttcggtcacttggacccatagtaatttaaaaatatcatttggcggtggccttgtcaattgtattccatactggcaaagcatgggaacctttgaccggtaa

SEQ ID NO: 1088 - DNA, 207 bp, M.catarrhalis
atcccccgggtggaaacacagggaaagattgggtattcacaattctggcaccggaatttaagaattttgattaatgaagccaacaatttttccaatggtgaagcttgggaatattttgcccaaaaggccaacaaaaattggtcggctcagggaattccctttataaaaacccaaagggttttaccaaacaagggttttttccaccca

SEQ ID NO: 1089 - DNA, 426 bp, M.catarrhalis
gaaatgatcgctgcactgtttgctgataccaatatcaagcttaccatcatcttgatggtcatcgcctgtctattaccttttgtgtgtgccgctcttgccaaatatttgggtggttataacataaaagacaatcaaacacctcgtgagtttttggcaaatactcacggagccgccgcaagactcaatcacgctcagaccaatagctttgaaagtctgccaattttcttagcctctgtactcattgcactttatacttttgtgcctgttagtatcatcaatatactggcaacaggttatcttatctttcgcatctgttttattatgagctatgcaaccaatttatccatcttgcgttcagtgacatggatgttttcattgagctgttgtatcatgctttttattttggcatatcaaatgggtatttaa

SEQ ID NO: 1090 - DNA, 1239 bp, M.catarrhalis
aaggatattcttatgactttatcattaaataaagaaaaaatccgctttttgttacttgagggtgttcatgaaaatgcactaaaagtactcaatgaagcaggctataccaatattgaatacatcagttcagcacttgatgaggctgagttgatagaaaaaattaaagatgcacattttattggcatccgctcacgcactcagctgacacgcaaggtgcttgaagccgccgaaaagctgatctgtatcggctgttattgtattggaaccaatcaagtggatttagatgcagcgcttgaattgggtgttcctgtttttaatgcaccttattcaaatacgcgttctgtggcagaacttgtacttgctgagacgattatgctcatgcgtggtattcctgaaaaaaatgcagtggttcatcgtggtggctggaataagtctgccaaagacagctatgaggtacgaggcaaaaccatgggcattgttggctatggctccatcggttcgcagttatctgtactggctgaaagtttgggtatgaaagtaatctatcatgatgcgatgaccaagcttcccttgggcaatgccacacaagtaggtagtttggaggaattgttgtcaaaagcggatgttgttaccttgcatgtacccgattcaagcagtacacgcaatatcatgactgccaaagcatttgaacagatgaaagatgggtcttttttcatcaacgcttctcgtggcagctgtgtggacattgatgcattggcggcagcacttgagagcaaaaaaattcttggtgcagcaattgatgtttttccaaaagagccaaaatcagcagatgaagagtttgaatcaccattgcgtgcctttgataatgtgattttgacaccacatgttggcggttcaacgcaagaagctcaagcgaatatcggcttggaagtggctgaaaaatttgtacgctattctgatcaaggcgatacaaccagtgctgtcaactttccaaatgtctctattccgtttactgatggcacgcatcgcttattgcacattcaccgcaatgtcccaggcgtattgtcacaaatcaatgcatcatttgccgatgcaggcatcaatattattgcacagtctttaatgaccaagggcgatgttggttatttggttatggatgtggatgataatgattctgaccgagcattaaagcgtttgcgtgctgtaccagaaaccatccgagtcagagtattgttttaa

SEQ ID NO: 1091 - DNA, 3663 bp, M.catarrhalis
aatacgactcttttttatcatctgtcttggtttttcatgcgcctaaaatctttaaaactggctgggtttaaatcctttgccaatcctacgacatttacttttcgacacgatattactgcgattgttggaccaaatggttgtggcaaatccaatgtcatcgatgcaattcgttgggtgcttggtgagacctctgccaaacagctgcgtggcggggcgatgagcgatgttatttttgcaggtgttgaagggcgagctgcgaagagtttggcaagtgttgagctgatttttgaacatacgcaagacgaaacccacggcattcgccatgaattaaatctatatcaagagctgtcactacgccgtcaagtcactaaagaaggtaaatcggattattttatcaatggtcagcgagtgcgtcgccgtgatgtggtggatgtatttttgggaactgggcttggtgcgcgtagctatgcggtgattgagcagggtatgattgggcggattgttgagtcaagccccatgcagcttcgagaatttattgaagaaggtgcgggcgtatctcgctatcaggcacgccgtgctgagaccgaaaaaaaacttggcgaaacccaagataatcttaaaaggctttcagatttacaaggtgagctaaaaaaacagcacaaaacgctcattcgtcaagcacagtctgccaaacagtaccaagccttaaatgatgaattaaaaacgcttcaaaaagaagagttaatcagacgcttatttgaagcgtggcatcatcacgaacaaaaaaagattgagcagggtaaatcaggtgaggtgcttgccaagctagacgctaaagccaatcaagtacgccgtgagcttgacctactgtctgcgcgtgttgccgaggctcagtggctaaaagatgacgccaaagacaactatcacaatgcacagatggcagagcagaccgcacagcataatttttatacagtcaatagccaaattacccaaaatgatgaaaaaattgctcgcctacaggctcagcatcaagaagctttgaccaagataaatcaggcacaagacgagcttttacaaattaaccaatcgctagatgtcattacgcctaaagtagaagcgatgacgcatgagattacccatgccaagcaagctcaaagtgaggtgcagttgacttggcagtcgcaccgagatgagctaagtagcctaatgcaagaaaaaaataatcttgaaaatctcaagaaattggcacaatctcagcgtcagcgtttggagattggattaaataaatggcaagttcgttatgatgagcttatcactgccaaaaatctatttagcgatactattgaagtgcaaaatcagctgtctgctgataccttaaaagctgtggcactcagacaaaagcttgaacatcttaatgatgatgagatgctaaaatcacttgtagacgagctgactcaagcagtgcaaacatcccaaatccatgtacaaagccaagaaaaacgccatgccagtttgatgggtgaatatgaaattttgcacaaactggtacacactaaaataccgtctcataaaattacgacgccgcctgatgctgatacatcaatagccttaaatgcactgccaagtctaaaagaaagtttggtactaacagaaatgggtttggactatgcagatgttttggatcagtttttgggattttggttgaatgcccgtctaagcgatgagctgccaacggctgttttgggtcatgtgatggatgataatgattatatgatcttaaaatcaggtaaaacaagcgacacggacatgactgctttggcagtctctgccaatgagaggatatctcaactaccaacatcaatacaacagcaactggtgcgttttgatcgactgtttagcatgcctacgcttgagttatttggtcgctgttatttatatgtgggcgatgagccgctcacagacttggacacaaatgtaccatttggtatgataattatgacaaaagctggttggctggtgggcagttttggtatgttacacctttcaaaacttggtgataccagcagtcagtttttaagtgatcggaaaaaacaccttgagcgactcgaggtgctagaagatgaactaaacacacttgaagattcgcttgaaaaagaccaaaagcagctcaagcaagtactgacaaggcttcaaagcagtaaaattgagcttgaagaaatcactgcccaaaaaaatgtggtcacccagcagctgcaccagttagaacaaggcttgaccatactaacggccaaacttgattctgaaaaagcacgccgtgagagtattgacagtcagctcaagcgactggatgatgaaaatagcagtattaaaaatgagctacaagagcttaatatgcagattgagacctgtgattttggcttaagggagcttgagcctaaagttgagcaagcaaatcaagccatggcggtgcagacggtgcgtatcgacgaagctgttgctaagcttaaaacccaaaatgatacatatcaggctttacaaatcaaacttggcacactgacgcaagcaaaaacccatgccgagcgtttgcttgagatggcaaaacatagtgcatcacaaactcaagcggacattgagacaaccaaaagcacgcagcaggaactcagtcaaaagctaccagtgcttgaagaggcgtttaaagctgccaaagcggtaagtcatgagcttaagattgctagtgatgaatatgagttggcagccaaagcacagcaaattgcccaaagtcaattgcaagaaacgctgactgaggcacataccaaatttgccaccgctcaagcaactttggcacagatcagtgcagatacagcggttggtgaaagccgtgttcaagacattggcggtgagcttatgcgtctggatgaatcgtttaatttagcgtctaaactggcagattttcggacaaatcctaatcaaaatttcaccgataattcagcaaggcaaaatcaaatcaaaagtaaaattgctgagcttggtgcggtgaatttggcagctgcagctgagcttgccgagcttgaggcgcgtgtttcgcccatggatgagcaaatcaatgacatcacccaaagcatgaaaaagcttcaagatgccattcgtgcgattgacgaaaaaaccaaaacactgtttttgacagcacttgaggcggtaaataaagagctaaatgcactattttcaaaggtttttggtggtggtcaagcaagcttaactttgatggcagatgatgacttgcccaaatcggacaaatggcgagcagggcttgtgctgatggctcaaccaaagggtaagaaaaactcaagacttgctgtgctttcaggtggcgaaaaaaccttgacagcattgagtttgatttttgctatttttaagcagcaccctgcgcctttttgtgtacttgatgaggttgatgcaccgcttgatgatgccaatgtcgccagatttacagggttgattagagaattggctgatgatgttcagtttatttttattagtcataataagcttgccatgcaaatcgctgatgagttaaaaggcattaccatgccaaccgctggtatctcaagtttggtgacagttgatttacaagaagcccaaaaatatttagaagtcaatgactga

SEQ ID NO: 1092 - DNA, 912 bp, M.catarrhalis
atttttgttcaattaaaacttaaggtaattgacatgactcaagtttctgcaaagctagtaaaagagctgcgtgaccgtactggtcttggcatgatggagtgcaaaaaagcacttgaagaagcaggcggtgatatcgaacttgcgattgataatctgcgtaaatcaggtcaagcaaaagctgccaaaaaagcaggtaatatcgctgctgatggtgcgattatcattgcccaaggtgaaggtaaagcgttgctactagaagtaaactgccaaactgatttcgttgctaaagatgaaaacttcactgcatttgccaataaagttgccaagcttgcacttgaaaacaacaccacagatgtggcagcgattgcccagctaccatacggtgatggctcaacagttgaagaagcgcgtgtggcattggttcaaaaaatcggtgagaatattcaagttcgccgtgctgaagtgattgaaggtgctaaccttgccgcttatcgccacggtctgcgtattggtgttgttgtctcaattgaaggcggttctgaagaagtgggtaaagcggttgccatgcaagtggcagcattcaatccgttggctgtgaatgaagctgatgtaccagtagatatcctagcccgtgaaaaagacattatcgaagctaaagccaaagaatctggcaagccagaggcagtgattgagaagatgatcactggtggtctacaaaagtatctcaatgaagtgactttggttaaccaaccttatgtcatggataacgataaaaaagttggtgatgttctaaaatcagaaaatgccactgtggttagcttcaagcgcctagaagttggtgaaggcattgagaaaaagcaagaggacttcgctgctgaagttgctgctgctcaagccgctgccaaagcttaa

SEQ ID NO: 1093 - DNA, 837 bp, M.catarrhalis
cccaaacttttaggattttttatgtcagataaaaacccaactcaaatcttaatgcgtgacttgctagaagcaggtgctcacttcggtcaccaaactcgtttttggaatccaaaaatgagccagtacatctttggtgctcgtaatcgcattcatattattaaccttgagcataccgttaagcaatttaacgaagcactaactttcgtgaataaacaagcagcggctcgcaacaagattttatttgttggtactaagcgtgcagcgggtgcggtaatccgtgaacaagcacagcgtgcaggcatgccttatgttgaccatcgttggttgggcggtatgctaacaaactggaaaacacttcgccagtcaatcactcgtctaaaagagctagaaaagcaagctgaagatggtacatttgcaaaattgactaagcgtgaagcacttgagcgtacccgccaaatggaaaagctagagcgtgctttgggtggtatcaaagagatgggcggtttgcctgatgcgttgtttgttgttgatgttgaccacgaagccatcgccatcaaagaagccaaaaaccttggtattcctgtgattggtattgtagataccaactcaaacccagacaatgttgactatgtcattgccgccaatgacgatgcaattcgtgccattagcttatatgtaacagcgatggctgatgcgatcattgcaggtaaagagtacgctaaaacccaaggtcatgctgatgcagctgatgctgataagcaagccaaccgtgaaaatgcaaccgcacctgttgaagataaagttgaccaagctggtcaagtggttaacaactactaa

SEQ ID NO: 1094 - DNA, 762 bp, M.catarrhalis
aaattttttaaatcaatctttttaaatagaaaaaataatcagaggcaaaatgagatggtgctgtggcttgatttgggcaatactcggttaaaatattggctgattaacaatggtcaaattatcttatcagatgctaaagaacatctaaaagcccccaatgaacttttattgggtttgcttggtgtgtttacacaatttgagccaaattttgtaggaatatccagtgtattgggcgaaaaaattaaccatgccatcaccaaaactttaaaagagcttggtgtgccttttgaatttgccaaggtgaatcatcgccacccaatgctttgtagtcgctatgagccatcacaattgggtgtggatagatggttacagatgcttggtgcagtaaatggtcataaacaatgtgtggttggttgtggtacggcattaacgattgatatgattgatgaaggtgaacatttgggcggttatattttgcccaatgtttatatgcagcgtcatgcgttatatgcaggaacacagcaaattgatgttaaacaagggcgatttgatgggttaagtcttggtacgaccaccgatgacgctgtaaatcatggggtcttatttggggtggtgggtgctgtcgccagtgtgcaagccaattatccaaattttgagatgatcttgacaggtggcggtgcacaaatgctaagaccacatctaaaacatattcaggtagacgaagagctgttattaaagggactgcaaagatatttttgttaa

SEQ ID NO: 1095 - DNA, 1125 bp, M.catarrhalis
tatgcccataaatattatgtttggtcttatttgaatgtgttggaggattttgtggcaaaaggtattatcatggcagatattgcaggtcaatcattagatggcagcgatattgaattattatccaatccagaaatcggtggcattattttatttgcacgcaatgtcaaatcacccgctcaagtgcgaacactgaccgattcaatacgccaaatcaacccccaactactgatcggtgttgaccaagaaggcggaagggttgctcgctttaaagaaggattttcatcgttgcctgccatgggtaaactgggtcaattatacgataaatcgcccaaagatgcgttatctttagcttatgattgtggctatctgatggcctgcgaggttttggcggtcggtgttgattttagctttgcaccagtgcttgatattgatggcaaaagccttgtcattggcgatcgtgcttttcatgcaaatccagatgccatcataacattatcaaggcaattcatggacggtatgaaaaatgctggtatggcaaccacaggcaagcatttcccaggtcatggctctattgcccctgactcgcacattgctgatgccattgatgaacgctcatttgatgagataatggattatgatacccaaacctttatcaaaactttagataaacttgatgcactcatgcctgcccatgtggtttttagccaagttgatgacaaacctgcaggattttctaaaatctggattcaagatattgtccgcaatcagcttggatttgatggcgtgattttttcagatgatttatgcatgcaagcggcacacattgtaggcggtatagatgcgcgtgtggttgctgccattgaagctggctgtgatatggcactggtttgcaatcatcgtcaaaatgcattacttgccattgaaactgccaaaaagctgaaagatacgccccagcatcgcttgataaagatggcgggcaacattccaacatggcaaggtagcctagaagcaacctgtcatcaatttcctttatggcaggcggctaaacatcgtatacaagccgcattttttcaagaaaatcatgaaaccttagccaaagacccaacagtttatagcgtatgttga

SEQ ID NO: 1096 - DNA, 543 bp, M.catarrhalis
caaggtatcaatgctgggtatctcctatatattaagagtttgattatgattgatgcagacggatttcgtccaaatgtcggcatcatcttggtaaatgcacacgggcaacttttgtgggcaaagcgtatcggtcatgacagttggcagtttcctcaaggcggtatcagtcatggcgaaacaccactagatgcgatgtatcgtgaactgtatgaagaagtggggctgcatcctgagcatgtcaaagtgctggcagtcacccgtgattggttgcgttatcgcttgcctaagcgttatttgcgtacagggcaggagcctttgtgcattggacaaaaacaaaaatggtttttgttatatctggatgaagctaataccaaatacattcgttttgatgtgggcgtacctgaatttgacgactggcaatgggtgagttattggtttcctttgacgggtgttgtaccgtttaaaagaaatgtatatcagcgggcattgcttgagctgattgatgctgtacccagacgaaagtctttggtggcaaatatgtaa

SEQ ID NO: 1097 - DNA, 2964 bp, M.catarrhalis
ccaccaacccttaaagttgttgaaaaactttttgaatcaatgttttttagccaagagcggtacgacttgtctaatgtgggtggtatgaagtttacccgtcgattgggtcgtgagttcattgataccgatgatatggatgtgcaacgcgaacaaggtgttttatccaatcaagatatcgttgatgtcttaaaagagttgatcgagatcagtaatggtcgtggcgaggtggatgatattgaccacttgggtaatcgccgtattcgctatgtgggtgaaatgactgaaaaccagttccgtatcggtttggcacgcgttgagcgtgctgttaaagaacgcttaaccacagccgattctgataatttgtctcctcaggacttgattaactcaaaacctgtggcagcatctattaaagaattttttggctcaagtcagctatcgcagtttatggatcaaaataacccattatctgagattacccataaacgccgtgtatcagcattgggtccaggtggtttgacgcgtgagcgtgcaggctttgaggttcgtgatgtccatacgacccactatggccgtgtgtgtccaattgaaacccctgaaggtccaaacattggtttgattaactctttagcgacttttgccaaaacaaataattttggcttcttggagacaccgtacagacgcgtcgttgatgggcgtgtgactgacgaaattgaatatgtttctgccatcgaagaagtaggcatggtaatcgcacaagccgactcaccaatgaatgacaagggtgagctgaccgaagagatggttagtgttcgtcacgatggtgaatttgtgcgtatgagcgccgataaagttactcatatggatgtttcaccgcgtcaggtggtatcggtagcagcaggtctaattccattcttggagcatgatgatgcaaaccgtgccttgatgggttcaaacatgcagcgtcaggcagttccaacactgcgtagtgataagccacttgtaggtacgggtatggaacgccatgtggcgcgtgactcgggcgtgtgtgtggtcgctaagcgtggtggtgtgattgaagaggttgatgccagtcgtatcattgtgcgtgtcaatgaggatgaaatgactgcaggtgaagcgggtattgatatttataatttgattaaatacacccgttccaaccagaatacctgtattaaccagcgtgttatcgtcaatgaaggcgatgaaattgagcgtggcgatatcttggcagatggcccatcgactgatcttggcgagcttgcacttggtcaaaatatgcgcgtggcattcatgccttggaatggctataactttgaagactcaattttactttctgagcgagtgggtcaagaagaccgtttcaccacgattcacattcaagagttaacttgtgtggctcgtgataccaagcttggaccagaagaaattacaggcgatattccaaatgtcggtgaggctgcattggcaaatcttgatgaagcgggtattgtgtatatcggtgctgaggtcgatgctggtgatattttggttggtaaagtaacaccaaaaggtgaaagtcagctgaccccagaagaaaaactacttcgtgcgatttttggcgaaaaagcggcggatgttaaagatacctctttgcgtgtaccatcatcaaccaaaggcacggtcattgatgtgcaagtctttacccgtgatggtcttgaaaaagacagccgtgccaaatctattgaaaaagccatgcttgatgattaccgtaaagatttaaaagaagaactggtgatttttgaagcagctgcaaaaggtcgtattttaagcttacttgatggtaaaaaagtcagcggtggtgcaggctttaaagcaggtgcgattctaagcactaaagacatcgaaaatttgccactagaaagcttgctagatatccagcctgctgaagaggaagtttcagagcgtttgggtcagattgctgaattcttaagtgataagcaaaaagatatcgataataaatttaccgagaaaaaacgcaaattaactcaaggtgatgacttagcacatggcgttcagaagattgttaaggtgtatttggcggttaagcgtcgtatccagccaggtgacaagatggcaggtcgtcatggtaacaaaggggttgtatcacgcatcatgccagttgaggatatgccatatgatgaaaatggtaatcctgtagatatcgtactaaacccattgggcgtaccatctcgtatgaatatcggtcaggtgctagagacccatttgggtatggcagccaaaggtttgggtgataagattaatgccatgttgcgttcgcaagttgctgtgagtgagcttcgtgaattcttagataagatttataaccaagtcggtggtgagcaagtagatttagacagcttgtctgatgaagatttattggcactgtgtcagaacctaaaagatggtgtcccaatgggtacggccgtttttgatggtgccaaagaaactcaaatcaaagagctgttaagtttggccgacctatcaaccacaggtcagcaaacactttatgatggcagaacaggtaagaaatttgatcgtcctgttacggttggctacatgtatatgcttaagctaaaccacttagtcgatgataaaatgcacgcccgttcaactggctcttattcactggtaacacagcaacctcttggcggtaaagcacaatttggtggtcagcgttttggtgagatggaggtttgggcgctagaagcttatggtgcaacttacactctacaagagatgctgacggtgaagtcggacgatgttgagggtcgtacacgcatgtataagaatattgtcgatggcgagcagtatatgaatcctggcatgccagagtcgttcaatgtcttaaccaaagagattcgctcgctgggtattaatattgacttaaaagaaaagaagtaa

SEQ ID NO: 1098 - DNA, 426 bp, M.catarrhalis
aaagagtttgatatggcacaattagacgcagaactgatttgggaagatggcgtacattttattggtacttcaccatcagggcataccatacatcttgacggtaataaaaccgctggtgcaagtccgatggagctgattttattagggcttggtggttgtgccagttatgatgttgtcaccatcatgaaaaaatctcgtcaagacatcacggatgtccgttgccaaatgcatgcccacagagccgatactatccctgcagtatttaccgatattcacttgcattttgtggtaactggcagcgatatcaaagaatcgcagcttgccaaagccattgagctgtctgccgaaaaatactgttcagcctcacgcatgttatcatcaggtggggtgaatatcactcatgattatgagattattgagaaatga

SEQ ID NO: 1099 - DNA, 201 bp, M.catarrhalis
tatggtggcgagaggcaggatcgaactgccgacacacggattttcaatccgttgctctaccgactgagctatcacgccgaattgatgcgtattaaaacaaaatttcatcaacttgtcaagaaaaatatttccaaaattgcattttgtatcaaattatcaggtttatgcactgatacaaacaagagattacataatatttaa

SEQ ID NO: 1100 - DNA, 1410 bp, M.catarrhalis
ctgtttgactgtttgcacatgataaaaatgaggaaaacaatgaccaaacattatgactatcttgccattggtggcggttcaggtggtattgcatcgattaatcgtgctgcccaatatggcaaaaaatgtgccattattgaagccaatttgattggtggtacttgtgttaatgttggatgtgtacccaaaaaagtcatgtggtatgctgcccaaatcgccgatgccattcataaatatgcaccagactatggatttaaaggcaatattgatgagtttaattttggtcaattaattcaatcacgccaagcgtatattgagcgtattcaccgatcttatcgtatggtatttgaaagaaatggcgttgaattgattcaaggatttgcccgttttattgataaaaataccgttgaggtggcttatgatgatggcacaaccgagcaaatcagtgctgaccacatcgtcatcgcaacgggcgggcaaacagtcagacctgatattatcggtcaggagttgggtattgactcagacggattttttgcactcgatgagatgccaaagcgtgtggctatcattggtgcaggttatgtcgcagttgaggtggcaggtgtcatgaacagtttgggtgctcaaacgcatctgatgattcgtggcaatcagccactgcgttcatttgatgatgatatcgttgaggtgttggttaatgtcatgcaaaatgatggcattcaaatacacacaggcgtcaatacacaacaaattatccaaaatgaggataaaacgctgacggttgaatttaatgatggacaaaacctcaccgttgactgtgtgatttgggcggtaggtcgcaagcctgcaacagatcagcttaatcttgatgccgttggtattaaaaccaataccaaaggccaaatcatcactgataaatttcaaaataccaatattgaaggcatttatgctgttggggatatcgttgcaaatggtgttgagctgacgcctgtagcggtggcatcaggacgacgattatctgaaagactgtttaacaacaagccagatgagcatttggagttaaacttggtgccgacggtaattttcagccatccaccgattgggactgtgggcttaagtgaagcgtcagcaattgcacaatatggtgctgataatatcaaagtttatacctcgaactttacgccgatgtacagtgcggtaacatcacatcgtgagccatgtcgaatgaagcttgtctgcttaggagaggagcaaaaaatcattggactacacggtattggttttggcatggatgagatgattcaagggtttgcggttgcgatgaaaatgggtgcaactaagcaagattttgatgataccattgccattcatccaacggctgccgaagaatttgtcacgatgcgttaa

SEQ ID NO: 1101 - DNA, 4269 bp, M.catarrhalis
agattacgacgaatacaacggagaaaccttttgaaagatttattagatatcatgaaaggccctgctgacaatggcgtcaaagaatttgatagcattcaaatttctttagcgtcacctgaggcaatcaaatcttggtcgcatggtgaggtcaaaaagccagaaaccattaactaccgcacctttaaacctgagcgtgatggtctattctgtgccaaaatttttggtcctgtcaaagactttgagtgtttgtgcggcaaatataaacgccgtaaatttcaaggcatcatttgtgagcgttgcggtgttgaagtgactgcggctaaggttcgccgtgagcgtatgggtcatattgagcttgcctctccagttgcgcatatttggtttttaaaatcgctacctagccgtatcggtcttcttttggatatcactttgcgtgatattgagcgtgtgctttattttgaaagctatatcgtgaccgatcctggtatgaccagtcttgaaaaatatcagctgttggatgatgaagagtattttaatgcacttgaacaatatggcgatgagttcattgccaagatgggtgctgaagctgttcaagatttactgcgtgatattgatgtggatggcgaaattgatgagcttcgtactgcaattccacaaactggctctgaaaccaaactgaaaaaaatgtccaagcgcttgcagttacttgagtctttccgtgactcaaataacaagcctgagtggatggtgatgactgtgttgcctgtgttgccaccagatttacgccctttggtaccgcttgaaggtggtcgttttgccacatcagacttgaacgatttgtatcgccgtgtgattaaccgtaataatcgtttaaaacgcctgcttgagctgaatgcacctgatatcattgtgcgtaacgaaaagcgtatgctacaagaagcagttgatgcactactggataatggtcgccgtggccgtgctattacagggtctaacaagcgtccattaaaatcgcttgctgatatgattaaaggcaagcaaggtcgtttccgtcaaaacctacttggtaagcgtgtggactattctggacgctcggtgattgtggttggtcctactttgcgtctgcatcagtgtggtttaccaaagaaaatggcacttgagctgttcaagccgtttacctatgccaaattgctgcaaaatggcattgcaagtaccattaaagccgccaaaaaaatggttgagcgtgaagagccagccgtttgggatatgcttgcgatggtcattcgtgaacatcctgtcctactaaaccgtgcaccaacacttcaccgcttgggtctgcaagcgtttgagcctgtgttaattgagggtaaagcaattcagttgcacccactggtgtgtgctgcgtttaacgccgactttgacggtgaccaaatggcagttcatgtaccgctgactttagaagctcagcttgaggctcgtgctttgatgatgtcaaccaacaacatcttgtcgcctgcaaatggtgagccgatcatcgtgccttctcaagatgttgtgcttggtttgtattatattagccgtggcggtgtgaatgccaaaggcgaaggcatggtatttagtacggtgaatgaagctctaagagcaattggttcagatgatttatctgtgaatgccaagattaaagttcgtgtcgctgagacaattttggatgaaaaaacaggtgaaaaaatcagtcataccagtatccaagataccgtagctggtcgtttgctaatttggaatatcatgccagaaggcatggcgtttagtgagtgtaacacggagatgaccaagaaaaatatctctaagctgttaaactcatgctatcgtaagctgggtgttaaagaatcggtaatgtttgctgaccatctgatgtatttgggttttgcacaagcgactttatcgggcatttcgattggtatggaagatatggttattccaccaaccaaaaagcagatcgtggatacagctgatgctgaagtgcgagatattgaacaacaatttgagcaaggctttgtcactgcaggtgagcgttataacaaagttgttgatatttgggcgcgtacttcagataaaattgcaaatgcgatgatggataacttgtctaaagacgatgtgatcaacgcagacggtgagaccgaaacgcaaaagtcattcaactcaatttatatgatggccgactcaggtgctcgtggtagtgccacgcagattcgtcagcttgcaggtatgcgtggtctgatggctaagccagatggctcaattattgaaacaccaattaaagctaatttccgtgaaggcttgacggtacttcaatactttatctcaacgcacggtgcccgtaaaggcttggcagataccgccttaaaaacagcaaactcaggttatctaacacgccgtttggttgatgtcgcacaagacttggtcatcacccaagatgattgtggtacagatgcaggtcagcgaatgacacctgtgattgttggtggtgaaattgttgaacgcttgggtgatcgtgtgcttggtcgtgttgctgccaaagatgtcgtgaatgcagatggcgatgtggttgtaccatcgggcgctttgattgatgaaagattggttgaaaagttagatgccaatgcgattgatgaagtgtatgtacgctcagtcattacttgtgaagccacccaaggcgtctgtgctaagtgttatggtcgtgatttggctcgtggccatttggtcaatattggcgaatctgttggggtgatggcggcacagtcgattggtgagccaggtactcagctgaccatgcgtactttccatgtcggtggtgctgcttctgctgcttctgttgataacagtgtctcagttggtaatgcaggttcggttcgttttcacaatatgaaaactgttcagcatgccgatggtcatttggttgttgtctctcgttcggcagagattggcgtggctgatgatcaaggtcgtgagcgtgagcgttataaagtgccttatggctcaagcgtcttggtgcgtgatgcagatgctgttgaagcagggcaggtaatcgccaaatgggatccacatacccatccaattattacagaattctcaggtaccgcacgctttagtgacattaccgatggcatgacagcaacggttaaggtagatgagatgacgggggtgagatcatttgaaatcttgaccagcaaagaccgtccaagtattgctaaggatttgcgtcctgcgattattcttgataccgatgaaggtaaagaagtggtttatttcctaccgaacgaaaccatcattcgtgtatctgaaggcgagcatgtcacggcaggttcggtgcttggtcgtgtaccacaagcaacctcaggtactaaagatattaccggtggtctgccacgagttgccgacttgtttgaggcacgccgtccaaaagatcatgccattatggctgagatgagcggtgtggtcagttttggtaaagaaaccaaaggcaaaaaccgctttatcatcaccaatgaagatggtgatgtgcatgaagagctgattccgaaatggcgtcaaatcaatgtctttgaaggagagaccgttgagcgtggtgaggtggtttctgatggacctcaaaatccgcatgatattttacgcctaaaaggtgagaccgcattggcaaattatattgtcaatgaagtgcaagaagtttatcgcctacaaggggtaaaaatcaacgacaagcacattgaagtcatcgttcgtcagatgttgcgtaaagttgaggttgtcgatggtggtgattcaagctactttaaaggcgaccaagcagaatactcaaaaattcgtacgctcaatgctgaattgatcgctaataataagtttcctgttcaatacgagcgtcagcttttgggtattactaaagcaagtttggcaaccgaaagctttatttcagcagcgtccttccaagaaacgacccgtgtcttgaccgccgctgcagtgatgggtaaggtggatgatttgtctggcttgaaagaaaatgtggttgtgggtcgcttaattccagcaggtacgggtttggcatatcatcaatctcgccaaagaaaagctcaaaatgctggtaaccaaactgcccaagtggatgagttattatcagtcataacagctgaaccgcctacaacttcagaagataatttgagtattgaagacaactttgccaaagcattcgctgatgagctgggttctcaagagtaa

SEQ ID NO: 1102 - DNA, 930 bp, M.catarrhalis
cgcacttttattatctttgtcgtaaattgtcatctgatgaatgttaaccaaagcaactttgaccaactgtggcaaaccatccaaaaccatcatgaacatcatgccagcatcttaagcacaaatactgagctaaaaaatactgtgatacggggcgaaaaatcgcacagcctgttacatctgatgacagctgaccaccaaagtttgggtcgtggacaacatggtcgttcttgggtgagtagtcaaggcgcggtttttttatcgttatatgtaccaatgcaaagtcaaacgcaggattttggtatcaatcaattatctggtttaatctctttgctggtgggtttttatttgataaaaatgccaatcataacacagatgaatcaaatccgacagacgatgaatttgccgaaaattggggttaaatgggcaaatgacttgggggtttttgatgaagattcccaaagattttggaaattggcaggggttttgatagagccgatttttgttgctaaaaatgaccatcgcagcttggtaggattggtttttggtgtgggcatgaatgttcaacacgcaccaatcattcaaagcggtacttatcaagcgaccagtctaaatatgctttggtatccatcattgggggcattgccatcagctcaagatttatatcaacccatttgccaagccatttgtcgggcaatttttcatcatcatcaattgatgacatctcaaaaaacagcaactggttttatcaatcaattcaatcagatgcatctattaacagatcgacaggtagaaatatttacccaaaatgatgatacgggtaatcgtttatcaggaaagtgccttggtgttgatgaacgaggggcgttattggtacaaaatgagcaaggcatacaaacaatctttgctggtacggccaagatgatgacttga

SEQ ID NO: 1103 - DNA, 2184 bp, M.catarrhalis
gatacagacatgtcaaaacaacaatatcttttatcgggcgtggcaagtgccatggcttttgcattatttgcaagcagtgtggcatcatttgctcaagcatctgaccgcactgcatttatacaaaagccagagcaaagggtgaccgcacgacaagtggcgatattgcttgatcgagcacattataacgaccaaagacttgatgaaagcatgagccaagttattttgcagcaatattttgataagcttgaccctaaccgtacgctattgttacaatccgatgtggatgaatttattagcaaatatggtaaaacttatgcagcttatttaatacgtggtgatttgacgcctggtattgagatttttgagcgttttcgtacgcgttcttttgagtattttaaagctgccaaagcacacttagcaacagatattgatttatataccaataaaagcattatattagatcgtgaaaaagcaccacggtttcggagcaaaaaggagcaacttgagtattggaaaaaccaaacgacattgtcattaattaccattatgattaatcaagacagcgacaaagcaaaagatcaggtttatttacaaaatcctgagttggctcgaggtcaagatttggtcaaggctgaaagtcgcactcctaaagagattttattaaatcgtatcaaacgccaagaagaacagcttgaacgacttaaaaatgatgaggtgatggagtcgatacttgatgcggcagccatcgcatatgatccacacagtaattattacgctcccattcaagcacaggatatacaaatccaaaatagtctacagcttgagggcattggtgtttctattcgacccgatcgcaaaaatcctgattacacacgcattatcagtttggttgatggcggtcctgctgccaaatcaggtcagatattggcaaatgatttgattatcggtatagcccaatctgatggtgaaatggtggatacgataggctatagcaccagagaaattgttgctttaatccgtggtactcgtggtactgaggtaaccgtcaaggtcaagcagccaaatacaccagattcgcaggccagaacggttactttggtgcgtgatatcattcgacaagaagaatcaggcgtgcagtatcgagtgattgacatgccttatgatggtagtataaaaaaagttggtgtgattgagattccaagcttttatctgaattttaaagcacgccgtgagggtattgatgccagtcagtaccgcagtgtcagccatgatacccaaaaagctttacaagcgttaaccgaccaaggtatcgatggcttggtggttgatttgcgaaataatcccggtggttcacttgatgaagttgccaaaatgcttgccatgttcatcaaggaaggtcctttggtgcaaattcgtgataatcgtggtaatgtgcaagtttttgaagatacagacggtgggcatcaattctatgatggaaaattgtctgtactcattaatcttggttcggcatcggccagcgagatttttgcagccgccattcaagattatgggctaggtttggtggtaggtagcacaaccactggcaaaggcacggctcagactcagcgagatgatttggcattaggttcgatgactttgacgcagcgtaaattttatcgtgtgaatggtggcagtacccaaaccaagggtgttgtaccagatgttgaattggtaaatatttatgaaggtatcgaatttggtgagcgtgaatataaaaatccattgccttgggataccattaactcaaccaattatcacgctgaaggtaaatattcgccaagcctgttaagctcactcaataagcaatccaaagcccgccaagcaagtgacccacagtttaggtatttatctgaactaaatgccattcgcacgcttgatgatgataaaaaaccgactgagattaatttacaaaaacgccgtgccagacttgatatgattgaaaaacgcaccttggctgctgaaaatgcacgcaggcaagccacaggcgaggcaccatttgtagattggtcaacttatcaggccaatttggaggcattggctgaagagcggagcgctatgaaagaaaatgagcgtccaaagttgcccgaaagcgaggtttatgtgtttgaggcagcacgcttgatgtttgatgctgagcgataa

SEQ ID NO: 1104 - DNA, 252 bp, M.catarrhalis
cttctaagaatacaagaaaataccgtgttttttcacccaaactggttaatacaaatttattggacacatgccagtcattatcaggagaatcctatgtttcgctgggcaattatttttgcaattatcgccattatcgcaagctttttaggatttggtaatattgcagggttaagcaaagagtttgcttatattttcttaattatcgctgttgtcttatttgtgatcggctttgtgggtggtcgccgtagataa

SEQ ID NO: 1105 - DNA, 804 bp, M.catarrhalis
atgtcgatgatttatatctggtttgcagcagctggtatcattgctgggctgtgtgcagggctatttggtgtgggtggtggcatggtgattgtgcctgcactgatttggattttggcagcatatggtatgccaactgatatcgtacctcatgttgctgttggtacagcattagcaaccatcatcttaacttctatcagctcgatgactgcacaccataagcgtggcggtgtacgctgggagatttttaagaatatgtcaaaaggcttagtacttggcagcttatttggtgcttgggttgcaacgctgattagcggtgcggcattacaagcaattttaggggctggggctatcttagtggcgatcaaaatgctgtttttccccaatcaagaaagactagacataccaccaccgcctgcttataaacaagggtttgctggcgttgtcatcggtattttatccgccatctttggtatcggcggcggtagcttaactgtgccttatttaagccaaaatggtgttcccatgcgacaagccgtcggtacatcagccgcctgtggcttgcccattgctttggcaggagcatttggttttatttggtttgggcatcaagttggtactgccaatattgatggtttgatcggatttgtgcatattggagcatttattacaatcagtattttaagttttatcatggcaaaagttggtgccaagttggctcacgctctacccgctcaaactcttaagcgtgcttttggcgtactgttgatgattgtaggcgtacggctaattattggcggactttaa

SEQ ID NO: 1106 - DNA, 2748 bp, M.catarrhalis
cttagttgtcccatcaatttaacccataaatacaaaatatccgctgcctttagccaaggattttatatgaaaaccatgcaatcaaatgaagtacgccaagcctttattgacttttttgtctcaaaacagcatacccatgttccctcatcaagtctcattccgcacaatgaccccacgctgctgtttaccaatgcaggcatgaatcagtttaaagacacttttttggggttagaaaaacgcgactatgtgcgtgctgtgtcatcacaaaagtgcgtgcgtgctggcggtaagcataacgaccttgataatgtgggctacaccgctcgccatcatactttttttgagatgctgggcaattttagttttggtgattattttaaaaaggacgccattgcctttgcgtgggaatttttaactgatgaaaaatggcttgccctgccaaaagaccgtctttatgtgactgtttatcacaccgatgatgaagcctttgatatttggcacaaagacatcggtctgccccaagagcgtatcattgccattggcgataataaaggcggggcgtaccagtccgataacttttggatgatgggggatacaggcccttgcggcccttgcacagagattttttatgaccatggtgagcatatttggggtggtctgcccggcacgcctgacgaagatggcgaccgctatattgagatttggaactgcgtctttatgcagtttaaccgccaaaaagatggcacaatgcagccgctgcccaagccgtcggttgatacaggcatggggcttgaacgcatcagtgccatcatgcaaggggtgcatggcaattatgagaccgatatttttaccaagctgatgacaaaggcggtcaacatcattggcttaccaaccgataccgacattcaaaatgagccatctttgaaggtgcttgctgaccacattcgttcggtggcgtttttgattgctgatggggttatcccaagcaatgaaggtcgtggctatgtgttgcgtcgcatcattcgccgtgcggtgcgtcatggcaacaaacttggggcaaccgatgcattcttttatcagctggttcacccacttgctgacatcatgggcgatgcctacccccaactgcgtcatgaacagcacaaaattgaacaagcgattttaaaagaagaagaacaatttgccaaaacattatcgcaagggctaaaactgctgtcgcaagaattggacagcttacagcaaggcgatgccttagcgggtgaaacggtgtttaaattatatgacacctatggctttcctgcggatttgaccgctgatatcgtgcgtgaaaaaggcatcaccattgatgaggcgggctttgagctgagcatggcagagcaacgcacaagggcgcgtgaagcaggcaaatttgccatggattatcacgcactcattcaagtagacagtgccaccgaatttttaggctatgaacggcttgataatgacagcaccgtgattcatctttatcaagatggcaaggctgttgatacactggcagaaggtgatgagggtgtgttaatccttgataaaaccccattttatgccgaaagtggcggacaggtgggtgagcttggcgaaatcagcaccgaatctggcgtatttgatgtgttagacacccaaaaatcaggacaagccatcattcatcatggggtggtgaaaatggggcatattaacaacaatcagtcagcgaccgcccaagtggcaagtcaggtgcgtgcgtccagtgccaaaaaccactctgccactcatttgctacacgccgctttacgcaccatattgggcgatggggttagccaaaaaggctcaatggtgagcagcgatttgcttcgttttgatttttcatatgacaaaccattgaccgaacaaaacatcagccaaattgaaatcatggtaaaccaacaaatattggccaacacccctgcccatgttgagattttggacattgacagtgccaaaaacaaaggggcgatgatgctctttggcgaaaaatacggcgatacggtgcgtgtgctgtccatgggtacaaccgataaagatggcaaaccattttctattgaactgtgtggcggtctgcatgtgactcgtacaggagatattgggctgtttaaaatcataagcgaacaaggcatttcagcaggtgttcgccgtatagaagccgtcacaggcatgggagcggttaattatgtgcaacaaggcgataagcaattaaaccaacttgccaatcagtttaaagccaaacgccatgaaatcgcccagcgtgtggcacagttgagcgacaaaaaccgtcatctggaaaaacaaattgaacggctaaaccaaaaatttgccagcctacacgccaattcattgatggacaacctaaaaaatatccatggtcaaaaagtgctgattgccaccgtcaatggcatggataataaagcattacgcaccttatcagacgacatgaagtcaaaactggccgatggcattgtgatactggcaagcatctatacggcagacggtgaagacaaaatcgccatgaccgcaagcgtgggcaaacacttaacaggcaaaatcaaagcaggcaacatcatcaagcacctaagcgaaaacttaggtggcaaaggtggcggcaaaccagactttgcccaagggggtgcaaccgacgtggcgaacctgccaaagctgatgactggcttgacagattggattggggagaaattgggttaa

SEQ ID NO: 1107 - DNA, 1467 bp, M.catarrhalis
agccaaacagcacacattgaacaacattcacaacccaatattaaacaaccccaaaataaacttaggaaatttaagactatgccgttatctgcccttaccgccctatccccacttgatggtcgctatgcttctaaatgcgatgctttgcgtccgtatctgtccgaatttggacttatccacgctcgggttactgttgaaatccgttggttgcaagcccttgccaatcacccacaggtgatagaaattcagccattttctgccaaaaccaaccaacgccttgatgaaattgtgcaaaattttagcgaagaaaacgccctgcgtatcaaagagattgaacgcaccaccaaccacgatgtcaaggcggtggagtactttttaaaagagcaaatcgctgatattgacgagcttaaaaatgcgggcgagtttatccattttgcctgcaccagcgaagacatcaacaacttatcacatgccttaatgttaaaggcaagtcgtgatgtgctggcaagcagcatgcaacaactcattgacgccatcgccacgcttgcccaaacgcacgccaatcaacccatgctctcacgcacacacggtcaaaccgccagccccaccacattgggcaaagaaatggcaaatgttgcctatcgcctacaccgccaattaacccaatttaatcatgtggaattattaggaaaaataaacggtgcggttggtaattataacgcccatttatccgcttatcccaacattgactgggcagaccatgcccaaaaattcgttaccagtcttggtttaacattcaatccatacaccacccaaattgaaccacatgattatatggcggagttatttgatgccctgcgtcgatttaacacgattttaatcgactttaaccgtgatgtgtggggctatatttcgcttggttactttaaacaaaaacttaaagatggcgaggtgggttcatcaaccatgccccacaaggtcaatccgattgactttgaaaactctgaaggcaaccttggtttggcaaatgcggtcttggctcatttgggcgaaaaattgcccatttcacgctggcaacgagatttaaccgactcaaccgtccttcgcaacatgggcgtgggctttgcccaaagtttgattgcctttgatgcctgcttaaaaggcattggcaaattagagataaacgccaatcgtcttaatgaagatttgcacaatgcacaagaagtgcttgccgaacccatccaaaccgtcatgcgtcgctataatatagaaaaaccatatgaaaaattaaaaaccttaacccgtggacaagccatgacctgtgagatgatgctggattttattcatggtgatgagctaaacgccgtgccagcaagtgagaaaaaacgcttggcggacttgacccccgccacctatattggcaatgctgatattcaagcaaaaaatattaaagattattttaaataa

SEQ ID NO: 1108 - DNA, 222 bp, M.catarrhalis
agcgtaattaattttaaaaaatattcgcttgccaatcttatcaaaagccagccaaaaaaaatcaccgcaagtttactaagcggtgatttttatataagagattatcatgaattatttaaaataatctttaatattttttgcttgaatatcagcattgccaatataggtggcgggggtcaagtccgccaagcgttttttctcacttgctggcacggcgtttag

SEQ ID NO: 1109 - DNA, 468 bp, M.catarrhalis
tttgggtcaaattggcaaataaagggcttgaacccaagcagtatgacaaaatttgctttgggcatgttattggcagcagcagggtttggcttgatgattgtggcggccaaccatgtggtgaaccaacccggtacattggtatcacccatgtggctggtgggcagtttgctcctattgacactgggtgaattggcacttagccctgttggcttatcatcaatgacaaagcttgctcctgagcgaatgcagggacaaatcatgggcttgttttttgcgtcgattgcggtgggtaatctggtggcggcgttttttggtggctatgtcaccgctgataccattaatgacttacccaacttatttgccaccatggcgatatttttggtggtgagtgcggtgatgctgttaattttgtctcatcccatcgaaaaaatgctcaaggactcagaaacacttaagcgggcggaataa

SEQ ID NO: 1110 - DNA, 1359 bp, M.catarrhalis
tttacaaatcgcctatttgatgaaataatgctttttttggataaattcaatttaaataaggacatacacagtatgacgcaaaatatcaaccatttggaaggcgatacgccaataaagccccataaagacagtggttttatgggacacccaaaacccttgcaaccactattttttactgagatgtgggagcgtttttcttattatagcattcgtcctttgttagtgctgtttatggtggcaaccattcaaagtggcgggtttggctttgatgatgttactgcttctgccatttatggtatttttgctggggcaatgtatttaatggcagtgccaggtggttggcttgcggataactggcttgggcaagaacgggcattgtggtggggcagtttaatcattgccttgggtcatttgtgcattgcgttatctgccatggtgggtgcgtcggtgttttttttggggttgatgttcattgtcatcggttcagggttgtttaaaacctgtatttcggtgatggtgggggcattatatcctgacggtgatggccgtcgtgatgctgggtttacgctattttatatgggtattaacattggggcgttgtttgcgtctttaattgtggggatttttaaagaacaaggcatgtggcatgtcggctttggggtcggtggttttggcatgttggtggctttattgttgtaccgcttttatgcacatgccagcctaaaaaaatacgctcaagaaaataacatcacccctgtgtgggagtaccccagtggtcaggttgccaatgtggggcggtgggtttttgcggtggtggcggtgcttaccgtggtggttgggttaattatgatgggcatcatgccatttaatccacaagtggttgctgaatacatgacttatctgattgcaggaacgattgttttgtattttttgtatcgctttattagcccaagtttaagcaaaaatgaaaaagttcgtttgttgatttgttttttactcatcattggttcgaccttattttggtcaagctttgagcagcagcccacttcttttaacttatttgccgatcgttataccgatttgaatgtgatgggctttaacattccaagcctctggtttcaatctttaaatccattttttatcttattgcttgcccccattgtcagtgtgatttgggtcaaattggcaaataaagggcttgaacccaagcagtatgacaaaatttgctttgggcatgttattggcagcagcagggtttggcttgatgattgtggcggccaaccatgtggtgaaccaacccggtacattggtatcacccatgtggctggtgggcagtttgctcctattgacactgggtga

SEQ ID NO: 1111 - DNA, 855 bp, M.catarrhalis
attaaaatcagtgatgatcgttatttgatttataaggtatcattcatggcattaatcgtacaaaaatatggcgggacttcgatgggaaacatcactcgcatcaaaaatgtcgcccagcgtgtcaagcgttggtatgataatgggcatcaggttgtggtggtggtatctgccatgagtggtgaaaccaaccgcttaatcggtttggctcgtgagatcagctctgacccggaccctcgtgaatatgatcagatggtctgtacaggtgaacaagtttccatctctttgcttgccatggcattgcaatcacttggtgttgatgccaaatcgatgacaggtgatcaggtcgctattcatactgatgatactcatactaaagcacgcattcaaagtattgataccgattctattctaagcgagcttaatgcaggtcgtgtcattgtagttgctggctttcaagggattgatgaacatggtgatgtgaccactttagggcgtggtgggtcagatacaactggcgttgctttagcagcagcccttaaggcagatgaatgccaaatctatacagatgtggacggtgtgtacaccactgacccacgagtaacacccaaagccaaaaaactctccaaaatcacttttgaagaaatgttagaaatggcatctcttggttcaaaagtgctacaaatccgctcggtagaatttgctggtaaatatcaagtgccacttcgtgtcttatccagttttgacgagggtgatgatggaatatttgatgataaatttaaacaaactgtcggtacgctaattaccgctgatgaaggagatgatatggaacgcgctgtaatctcaggcattgcgtct

SEQ ID NO: 1112 - DNA, 321 bp, M.catarrhalis
ggcacttgcagagttaaaaggtttggcaatgaagtacataaccatgttcaagccatacaccttggatttaatgaaatacacaaaactggacttttgaccaataatacgattatcgccacccaacaaactttagaagaaaatcgtgcagattttcgtactcagcttggcacacaattaagaaatgagcgtataggacaagttatgcgtaaaatattggcttataacttctgctttgtgagtaataaacagttaggcaatcccccatttcagtttgagttacttatttcaagtttccagttgagagcggggtgtaaaaaataa

SEQ ID NO: 1113 - DNA, 288 bp, M.catarrhalis
gccatgcccattgacgaatttatcatcaatcgtcttaaaaatgctcgtggcgatattgaaacggtgattgatcggttgtttgggcggtttaatatgcaaaagcttagagccagagatttatggcatttgtctcacagatttatgcgtaaaatattggcttataacttctgctttgtgattaatacacagttaggcaatccccatttcagtttgagttgcttatttcaagttgagagtggggttatagaaggaaattctttatttaaggaaaggtttaaaattttataa

SEQ ID NO: 1114 - DNA, 186 bp, M.catarrhalis
aatggagaagtcatgccagcaaccttaggccagttatcaagtgatattgaaaccattgatatcttaaaattaactgtagaagctcataaggcacttgcagagttaaaaggtttggcaatgaagtacataaccatgttcaagccatacaccttggatttaatgaaatacacaaaactggacttttga

SEQ ID NO: 1115 - DNA, 249 bp, M.catarrhalis
atagggtattccacaaaaactatggggttttatatgaatataccattatttagtgcgattttttcaattgcgtttacagtgattattggcgtgttgatgattgttgcttttgttactgggtttgataaaggtatgcatatcattggtgctgtagttattggtgcggtgattagtttgcctgtagcactctttgttaccaaaagacttgctcagctgacaagtggttcaaataaagcacctaaagcgtaa

SEQ ID NO: 1116 - DNA, 399 bp, M.catarrhalis
atattagattctgaccttaaccagcgaataatgaggggaaaaaggttcaccaagggttgggaacctttagtgagtttaagcaattgtgaccaatattttttaaaaaggcaatcagtttttatactcgctggccaaagcgtttttcagggtaataacaacaaggcatttaaatggaaattgatgggcttggttttggaagcatttattttaaccttgcagggttttaaaaacttggtttcaatctggttccccaccattgactacattggtatgttacttcttgtcggggtgttgttggcatggataaaaacccataaaaagattaaacccgagcgtatcaatcgccgccatatttatgctttgatgcaaaaaaaattagacgattcacaaagtttttaa

SEQ ID NO: 1117 - DNA, 186 bp, M.catarrhalis
aatggccgattaactggctttgacgcagtcaagcaacacttgattggtatcaccagttacgacagccttgttaccatcaatggtgagtatggttttttggttatcagcaaatccatgattgctggtgtattgatttttattactgggatcttgattaaaatcatactcaatgccatcatgatttag

SEQ ID NO: 1118 - DNA, 1251 bp, M.catarrhalis
tatcaacgattaaatactcaaaaaattaagcgagaaattaccatggctgatttaagtaaaattaccgaaattgaagatttgcgtcgtatcgctgagcgtaaagtaccacgaatgttctatgattatgtggattcaggttcatggacacaaaccacttaccgtaataatgaaacggactttgatcgcattaagttacgtcagcgtgtccttgttgatatggataatcgatcgcttgccacacaaatgattggtcaagatgtcagtatgcctgtggcaatcgcaccgactggatttactggcatgatgtgggcagatggagagattcatgcagcacgtgccgctgagaaatttggtattccattttcactatctaccatgtcaatttgctcgatcgaagatgttgccgaaaataccaccaaaccattttggtttcagctgtatgtcatgcgtgataaagaatttatggaaaatctaatcaagcgtgccaaggctgcaaattgttcagcactgattttaacggcggatttacaagtcttaggtcagcgtcataaagacattaaaaatggactatcagcacccccaaaaccgacactaaaaaatatcttaaacttaatgaccaagcctgaatggtgctacaatatgcttggcacaaaacgccatactttcagaaatatcgcaggtcatgccaaaaatgtgtctgatctatccagtttatcagcttggacagcagagcaatttgaccctggtcttagctgggatgatgtggcacgcattaaagatatgtggggcggtcctttgattttaaagggcattatggaacctgaagatgccatcatggcagcacgctttggtgctgatgcgatggtaatttcaaaccatgggggtcgtcagcttgatggtgcgccaagctctattgcttctttgactgactgcgtacaggcatctcaagctgaaaattctaactgtgaagtttggctagatagtggtattcgctcgggtcaagatgtgctaaaagccatcgccttgggggcaaaaggtacgatgattgggcgttcatttttgtacggcttgggtgcttatggtgaagatggtgtgcgtcgtgcgctggagattatctataaagaatgtgatgtcacgatggcattttgtggtcataccaatatcagtacggtaaattctgatattttggtcaagggtacttatgagcatctcaaagccaatcagccacacatcacgccaattcgctggtaa

SEQ ID NO: 1119 - DNA, 531 bp, M.catarrhalis
gcatctttatcaccgcctttggcttttttatttaagtttgtaatggcacgagtgaccgcctccaaatccgctaaagcaagctctgtattgatggtttcaatatcagataacggattgacctgcccatcaacatggataacattgtcatcatcaaaacagcgtaccacatgggcgatggcgtcagtttcacggatattggctaaaaattggttgcccataccctcgcctttagaagcgcctgccacaagacctgcaatatctacaaactccatactggttggaatggtgcgttcaggattgacaatagctgccagtgcttttaagcgtgggtctgggacagggacaatgccagtatttgggtctttggtacaaaacggaaaattctcagcagcgatacctgctttggtgagtgcattaaataaggtggatttaccaacatttggcaagccgacaataccacaattaaaacccataataaattctcgtatgttgtgtgaaattttgtcattataccaaaatttatcaaattaa

SEQ ID NO: 1120 - DNA, 1305 bp, M.catarrhalis
caggggttttttgtgccaaagcatagcgccaccaattttaacaccgaacaccaaatggatacaaaacacattcagcaaaattggcttttacctgatggtgtggctgatgtactatttactgatgctcaaaaacaagaaagcctgcgtgatgccttgctatttgtgctgaccgcacacggttatcgcttggtgtcgccgccattaattgagtataccgaaagtctgctaaataatgccgatgaagacctaaaacgccaaactttcaaatttatcgatcagctcaatggtcgtttaatgggtttgcgtgccgatattacgccacaaattctacgcattgatagcaaatatggtcaaggcatcagccgttactgttatgttgggcaggttgtcaaaaccctaccgactggtctgtttggcttgcgtacgccgcttcaattgggtgccgagatttttgggatagatgatatctgtgccgagcttgagttgattgatctactggtcgcattggcagatgaggtcggactagaccgacagatgctgcatgtggatattgggcatgtcgctatttttgatcgcttgtgtcagttgcatggcgtttcaaacaaagatgctgatgagctgattggcatttaccataaaaaagccatgccagaacttaccaaatggtgccaaaatatgggcaacagcttaaacagcccaagcgatgcaactgattttttggtattggttaagcatacattaagcagtgatcggacgccaaatgccgaggctttattgaataagctgtccgataaagctcgccaagataatcaaatcatccaagcggcaaatgagcttgctactttggcggcacatatcagagcggtgggtatgagtgtgagtattgatgtgactgaattgtcaggatatcattatcacactggcgtggtatttaatgcctatttgggtaatagaaccacacagactcaagctttggtacgaggcggacgctttaatggcacctcaactcaaagcgtggcaaggggtgcaactggttttagtatggatattaatcgcttgcttgaatttgtagagcttgaagaagataccgtgattttggtggattatcacgatttacaaaatgctgatgcagacacaaaagctgatttggccacacaaattaaaaccttacaatctgaaggctgtattgtcattaagcccttgactgtagatgataagcctgaccagattgatggtattttgcattgggacaccgatcaagataagccgatttgggcggtgcgattagttggtgatgagtactaa

SEQ ID NO: 1121 - DNA, 861 bp, M.catarrhalis
ataacaagtccaaataccaaggatgatgacaagcttatgacaacaaacacccccagtatccttcaaaaaatcatcgcaaccaaacaccaagagattgcagtcgccaaagccatcaaaacgaccaatgagcttttaaagtcggcagctcaccacatgcctcgaggttttgctaatgcactaagagcggttgatacaacaactgatattggtgtgattgcagaagtaaaaaaagcctcgccttccaaaggtatcatttgtcaagatttcaaccccgtgacaacagcacaagcctatgaaaaggctggtgcaacctgtttatccgtactcacagaccgtgattattttcaaggtcatgatgactatcttattaaagcccgcaaggctgttcgcttacctgtactccgtaaagatttcatggttgatgaataccaaattattgaatcggctgcgatgggggcggattgtattttacttatcatggcttgtttagatgctgataccgccttacacttacatcaaacagcaactgacttgggtctggatgtattgattgaaattcacaccgatgatgagctaacccaagcactaaatttacccaaatcagctcacaatatctacggcattaataatcgcaatttaaatacctttcaggtagatttagaaaatagcattcgcttatcccaacgactatttgccaatcttgggcaagatgcccttgtggttagcgaaagcggtattcatcatgccaccgatattcaccgaatgcaacaaaatcatattcaccattttttgattggtgaacaatttatgaaaactgataacgcaggtggtgcattatcacagttattaaagacaatttaa

SEQ ID NO: 1122 - DNA, 597 bp, M.catarrhalis
atgctcaccccaaaactggataaactcatcaaagagctacaagtcttaccaagtgtaggacaaaaatcagctcagcgaatggcactacagcttttgaccaaaaaacgcacccaaggattatctttggcggctgcacttgagactgcgatgcacgacattaaagaatgcttgcagtgtcactcctttagtgatgatgagatttgcccaatttgcttagatcatcgccgtgatgatgggctactgtgtgttgttgagaatgcatcagatgtcatggcgattgagcaaagtggtgcttatcgtggcaagtattttgtacttggtgggcatttatcgcccatcgatggtatcaatgccaatgatttgcatattgatcagttgattcatcgcatcaggcatgaagcgatccatgaggtgatcttagccactggtgccacggttgaaggacaaaccacggctttttttattcatgatgccatctgtacccatgtacccaaaattacccgtcttgctcagggcattcctatgggcggtgaacttggatatgtggacagcatcacactacatcaagcactacaaaatcgcagtaatatatcgtag

SEQ ID NO: 1123 - DNA, 465 bp, M.catarrhalis
atatgggctttgttttggcaattgctgaggataaagtaccatcaacgggtgaacctgatccatatatgcatattttttttggatgcaggcggtggtaatatcttagcattttttgagcttccaaccaagcctgcgatgggacgagatgaaaatacgcccatatggactcaacatttagcactcaaagttgatagcgaagagaccttaagcgccaccaagcaaaagctgattgatgcaggcttggaagttttgggacctgtaaatcatacgctgtttaagagcatttatttttttgacccaaatggtcatcgtgttgagcttgcctgcgatatcacaaccgatcagatgaaccgtgctttagataaagtaaaatgggatatgctcaatgaatgggcacaaacaaaaaagcacccaaacacgcacaatgggtacatgatggcacagagccgcctgatgtgtgattga

SEQ ID NO: 1124 - DNA, 672 bp, M.catarrhalis
gattcatttacccaactaatattaacgatgaaacaagagattttactgatcgatgcgcctgcaggtgtgctagaggtagatgccatttggcagtcgggggagcgacagaccaaagatggcttggcgattctttgccatcccaatcctgtccaaggcggcacgatgaataataaagtggttagcaccatgtaccgattttgtcgtgatggtggtatggatgtgctacggtttaactttcgtggtgttgggcgttcaactggtcaaacaggcacgggcgatggtgagcttgaagatgcattgacagtactgcgttatgctttaaagcatacaaaagcacgcaaactttggctgggaggctttagttttggtggatatactgctacacgcttagcaagtctgatgacggataatgaagagttttttgatgtgaatttgcataatttagcactcatcgcaccttcggtgatgcgtgttggcatggcatctttacgctggcaagctgaccatacttttatgatttatggcgatcaagatgaactggtcagccctgagcatttggcacagtttgccgaagaaagggaaattcccactaccgtgctttcaacaggacattttttccatggcaaattggttgagcttgggcagagtttacaaaaacacaccaaaatttaa

SEQ ID NO: 1125 - DNA, 183 bp, M.catarrhalis
atgtctatcactcaaggtgtgcatcatgtggcatatcgttgcaaggatgccaaagaaacggttgcatggtatcaaaagcatctgaatatgggctttgttttggcaattgctgaggataaagtaccatcaacgggtgaacctgatccatatatgcatattttttttggatgcaggcggtggtaa

SEQ ID NO: 1126 - DNA, 861 bp, M.catarrhalis
atcatgatcaccatatcaaataatccagcaccatcaaaaacagctgatgtacgcatctttgatacaccagtactaaatttgcctgaagatttatatatcccgccacaggcatttgcgatttggcttgaacagtttgcaggacctttagattttttattgtacttagtcaaaaaaaataattttgacttaactgaaactgctatcttgccaattaccgagcaatatttaagctatatcagtgagttggatgaagcgtattttgagcttgcgggtgattatttattaatggcaagtacactgattgccattaaatctgagttgttattgccccaatctaaagttgatgatgatgagattagccctaaggctagattaatccgaaggcttgaggagtatgctcaaatcaaagaagctgctcggcgtatcgatggtctgcttcgtctagaaagagatgtttttttagcatttaccagtatgccaagtcccgaagccatgcaaaagcagctgcccaagtattcgccagagcttttggtcgaaagcttaattcatatgaaaattcgccctgaagctattacccatactgttcaagcggacagcgtgccattatctcagcgtatcgccagcattacacgcttgataagcgaaaaaggcgttagtacctttgccgaactgattgataaatctcaaggcaaaataggcattgtggtgagttttgtggctgtacttgagctgatgaaacgaggtttaatcggatttgatgaagccaattctggtaagcttaatccaaccaaaaatgatacttatcatgataaccaaaatgggcaagatttaacaaaacaaagcttacattggctacattaa

SEQ ID NO: 1127 - DNA, 1356 bp, M.catarrhalis
caggaagacactatgattaaaaaacttctcattgcaaaccgtggcgagattgctctacgcatcgtgcgtgcgtgcaagcaattgggcattgcgacagtaggcgtttactctactgctgataaagacttgatgcacttacgctttgttgatgaagcggtatgtatcggtaatgcgccttccgctcacagttatttggatattaatgccctactggcagcagctgagattaccgcagctgatgccattcatcctggatatgggtttttgtcagaaaatgctgaatttgctgaacgggttgaagaggcaggcttaacttttgttggcccgcacccagagcacattcgattaatgggcaataaagtttctgcaatcaatgccatgaaagaagctggcgtaccaacggtaccaggttctatcggtgcaatcactttaggtaatgctgaagagcaagctcgtgaaattggctttccattgattgtcaaagctgcagctggtggcggtggtcgtggcatgcgagttgttgagcgttttgaagaactgttaatccaagttcaagcagccaaaaccgaagctcaaaatgcctttggtgatgatacggtctacatggagcgttttttaaaaaatcctcgccatgttgaggtacaggtgttgggtgatggtaatggtaatgctttgcatttatttgaccgagactgttcattgcaacgcaggcatcaaaaagtactcgaagaagcacctgctccagatattcctgatgaggttcgtacgccaattttagaagcatgcgttcatgcctgtaaaaaaatcggttatcgtggtgcaggcacctttgaatttttatacgaaaatggtgaatttttctttattgagatgaatacccgtgtacaagttgagcaccccgtaaccgagatgattacaggcatcgatatcgtggtcgaacaattaaaaatcgccgcagggtatggattatcctatcatcaagatgaaattacgattcgaggtcatgccatcgaatgccgtattaatgctgaagacccaaaaacttttatgccatcacctggtcaaattcagcgtttattcactccaagtggttcagggattcgctttgattcacatctttatcaaggctataccattccaagctactatgactctttaatcggtaagctcatatgccatgcccaaactcgccgacaagctattgctaagacattgcacgctttagatgagctggttattgagggcatcaaaaccaatattcctttacatcgagatgtcatcttgcaagatgaggcattttgtgaagaggcacaaaatattcattatcttgaaggtcatatgctaaaaacgcaatga

SEQ ID NO: 1128 - DNA, 717 bp, M.catarrhalis
actatgacaaccaaacccaaattaaccacgaccaaaacggctaacacgccgccctcacgctccatgaatgccaacaagcgtttggtattttttcaaaaacttgccaagcatatcaaagaacctgtcaccgaacttcactatacttcagaatttgagctactgattgctgtcatgctatcagctcaagccaccgataaaagtgtcaatattgccaccgataaattatttaaagttgccaacacccccaaagctattttggatttgggattagataacctaaaaagttatattagctctattggactgtataactctaaagctgccaatgtcatcaaaacctgccaagacctcatcaccaaacacaatggccaagtaccccgcactcgagatgaattagaagctttagcaggcgtgggcagaaagaccgccaatgtggtgctaaataccgcgtttggtgagcctgtcatggcagtagatacacatatttttcgtgtgggtaatcggacaggattggccacaggtaaaaccgtccttgctgttgaaaaagccttaatgaagcgtattcctgccaagtttttggtggatgcacatcattatttgatattacatgggcgttatacttgtacagcacgccagcccaaatgtggtgcttgtgtggtatttgatgaatgtatgttcaaagacaaagagcaatgggcgttaaaagatttaagttag

SEQ ID NO: 1129 - DNA, 420 bp, M.catarrhalis
tcaattatgactataccaactcttgaggttccaaaatttaccatcattcatgcggcttgtgatggactgccaaccatttgggtgcaaaatgatgatgatctgtacgcactgattgatgagattgatgctagcgatgtggtcgcacttgatactgaatttatcaaacgaacaacctattacccaattttggcactgatacaaatcaatactggcaatgccatttatctaattgacgcacctaagctggatttgaccgaattttggcaagcacttgctgaggtaccaacaatggtatggtacgcatgcggcgaagatttgggaattttttatttactggccaaatgcccaccactgaccaatatttttgatgtacaaattggggtagcttatttatcaggtaaattgcaagcttggttatag

SEQ ID NO: 1130 - DNA, 1560 bp, M.catarrhalis
atgaaaccagcttcttatgatgtgatcattgttggtagcggattggctgccattaccacagcgttatctttgccaaaagattgccaagttttattaatgtgcaaaggtgaaattgcggatacatcaagccgctttgcccaaggtggtatcgctgcggtgatagcaccaaccgacagcgttcaggagcatgtgacagatacgctcattgcaggtgcagggctgtgcgatcccaacacaaccgagcaaatcattcatcaaggtgcagatgcgattgcttggcttagttctttggcagtgccttttagtacaaccaaagagggtttacacctaaccaaagaaggtggacacaatagacgccgcatttgccatgtcgctgatcatacaggtcaatcagtcatggcgtgcctttgggcaaacatgcagactcgcccaaatatccatgtgcttgagcggtgttttgtgacagacattttgactgagcttgatgtaaagacaaaaaaagtgcattgtaaaggtgtggtatgtctcatcaatcaacaatccaaaaaatatgatgccgataaagtagtgcttgccactggcggcttagggcagatttatcaatataccacagcaccagaggtgtgtactggtgatggtattgctatggcatatcgagcaggttgccgcattgtgaatgctgaatttgttcaatttcacccaacaggttttgatgatgctatggctcaaacagcactgatctcagaagcggttagaggcgagggtgggcggctcattaatgctcaaggcgaacgctttatgtcaaattatgatgagcgtctagagcttgcacccagagatgttgtcgcaagaagcattatcaaggaggcccagcgtaccgctcagggcgtatttttggatatcagccatcaatcagatgaatttatcaagcagcattttccaaaaatttatcaatcttgcttagccaaaggcgtggatataaccaagcagccaattcctgtaacgccagtacagcattatttttgtgggggtgttttgacagatgtcagcgggcgaagtgatgtggtgggtttgtattgtttgggtgagatggcatatacagggctgcatggtgctaatcggttggctagtaattcattgctggagtgtttggtgatgggtcaaaatgctgccaaatctttgcaagaacctttggcgaaatggtcaaatcgtgatgtactgcctaattggtcggttcaaacgcatcaaaaggatattaatctggcatcaagtataccattggatgtcgctcagattaagcagctgatgcagcaacatcttggggtaatgcgcaggcaagaggatgtggcaaaaacggtagagcttttggcagggggtttggctgatttgtccacccagaatctcactacccaaagccaaattcaaaagcttaatctcaccatgtgcgcttatttggtcgcaaaagcaagcttagatcgcccgcatagcattggctgtcattattgggtagaaaatgagccaaatctgatagcaccaaatcgactgccaaaagttgtatga

SEQ ID NO: 1131 - DNA, 926 bp, M.catarrhalis
ttacgccagcgcggatctcttccagccccgtggtgaagaccaatgagcttttgagcgatcctgagatgaaagaaatggcacttgatgaaattgaggtggcgcgtgcaaacattgagacgctcgaggagaggcttaatgtgatgatgctgcctaaagatcctaatgataaagcgacggcatttttggagattcgtgcaggcacgggcggtgatgaagcggcaattttttcgggtgatttgtttcgtatgtatcaaaaatatacacaatcccaaggttggcaagtagaggtattgtctgccaatgaaggagagcatggcggctataaagaaatcatcgcgcgtgtatctggtatcggtgtttatggcagattgaaatttgaaagtggtgctcatcgtgtccagcgagttccagccaccgaatctcaagggcgtgtacatacctcagcgtgtacagttgcggtgatgccagaggttgagattgatgatacggttgagattaacccaagtgatttgcggattgatacctatcgctcaagtggtgcaggggggcagcatgtcaatacaactgactcagcagtccgcatcacacatatcccaacaggggtggtggctgaatgccaacaagaacgctctcagcatgccaataaagaaaaagcgatgaaaatgctggtagctcgcattcaacaagccaaagttcaagcccaaattgatgcaacaagcgatatgcgacgcaatttggtcggttcaggcgatcgttcagagagaattcgtacttataatttcccccaaggacgcatgacagaccaccgcattaacctaactttatataagcttgatgccatcatggaaggggatttgactgagcttttagacagcttattgcgtgaacatcatgctgatttgatggcaagtgtgggagcagagtaa

SEQ ID NO: 1132 - DNA, 288 bp, M.catarrhalis
atagctatggcaaaaaaacgcagacttggggtcaaatacggtttggatacactcttaagcggcacaaaggtgagtcgccaagttgttgatgtgattgatgatgccaaaatggtgatggcagatgataatcaacctaacgataagccgcaagcggtatcaagcaccgctgagtctgataccactcatcaaagtgctgatgataaggcggtgagtgttttggataacttacccaaatatcaacaaaaacagatcgctttgttttggcagtttggtttggctgagccgtga

SEQ ID NO: 1133 - DNA, 363 bp, M.catarrhalis
ttaattatttacatcttaggaagattgcctatgaatattcaagcattaatgcaacaagcccaagccatgcaaaaacaagttgaaaaaaatgttgaagctgccaaagcaagtcttgcaaccaaggaagtgcaaggcgaagcaggcaatggcttggtcaaagttaccatgacaggtcgccatgtcgttaagcgtttagccattgacccaagtctaatggatgatgagcctgacatgatagaagatttggtagctgccgcaattaatgatgcggtgcgtcaagcagatgaactgtatgaagaggtgatggctggtgcgacaactggcatgggtctgccacctagtatgaaaggcttgtttggctaa

SEQ ID NO: 1134 - DNA, 609 bp, M.catarrhalis
ctatttttatatactcattttttaaataatcatgaatctgttatgacacaacataccacctctgattttttgcaagctcacaagcaagctgaaactttcagccgatatattgaagttttactacatgccagcgaaacaccgctgaccgataaagatttaaaaaaacatctgatgatcggttcaaatgaacttcaagatgccttggccattctgcaagaacggctgtcttatggtgtattgacactcaataagactgccagcggttatcgcttgcaaatcaaagacagctacagtagcctaattcagcaggtttttcctgagcggctagaaaatctaagtcaagccttgcttgaaaccttaagcatcattgcttatcagcaacctgtcacacgatcagacattgagcaggtgcgtggcgtggcagtctctagcaatattttgcgacaattatttgataaaggctggattgtcgaaaatgggcataaggacactttaggtcgccctgcactactgcacaccacccaagcatttttggatgcgtttgggctagatagcttagatagattgccaccactgcctgaccttgaccacctaaaaatcagacaatga

SEQ ID NO: 1135 - DNA, 618 bp, M.catarrhalis
attcagcgatatgaatttttaataaaaattaaggataaaataatgacaaatgagattttaaatattattcaccagcgccgcagtatcggcaacctatctttgcccatgccaaacgatgctgagctaaaatcggtattagaggctgcgatggtagcaccagatcataaacagttaaagccatggcgattttgggtattgacaggagagacactgattgaatttggtcaagtgttgttatcagcagctgagcatgaagcggcatcatgtggtgagatattagatgaagttgcgatcaaaaaaatactgaatatgccgcttagagcacccatgattattgtgattgcaaccgaatatcagtatcataaaaaagtaccaccatttgaacaattgctcagtgcaggagcagtcgcccaaaatatgttgcttgcacttgagtctttgggctatcgcagtgtgtggcgtacaggtcctttgtgtaatacgcctgaggtaaaagattattttggtgtgacaaaacaaaataccatttgtggcttgatttatacaggttcaagtagtgttcagatgccagatcgtgagactgtggatttatctgactatgttgaatatcgccaataa

SEQ ID NO: 1136 - DNA, 2499 bp, M.catarrhalis
atccagcatcattttaaaaatataaggaatactaaaatgacaaccccaaatacaacttatgacaatgccaataatcatcataatttacaacaactgcccttaattgctgttcgtgatgtcatcatttttccacagacacaagtcgccttatttatcggtcgtgagcagtccatcaaagccattgaacttgcccaaaaatcacatgagggtaaactgattgcggttgcccaaaaagattcactgtctgaacagattgatattgaagatttacatcgctacggaacactttgccgaattgtcagtaccatgccacatgactccgatgataaatgcttaaaggtgttgattgagggtcttgagcgtgttgaaatcggtcgcatccaaaatgccaatgatgatactgatgatagctttatcgctgagttcacggctgccaatgttgacctcaatcttagccaagaagaagctgatgctcaaaagtcggtgctacttgagctatttagtgactatgctgaaagtacgctgagaaattcgcgtgagctgatccgtgttgccagcggttttgataatttgcttgagctgatttactttgtcgtgacacgcacacagctacctcttgataaaaagcaagctttgcttgaatcgggtgatgctgctgaatactttaaggtgctaagcgaatatttcactaacactaaaaccgagcatagcatcgaaagtcagctacaagacactgttcgaaagcaaatggaaaacaaccaacgcgagtatttcttaaatgaaaaaatgaaagccatcaaatcagaactatccgatttaaatgatggtgccgatgatgacgatgttgagcttgaaaatcgcttaaaagaagctgatttgcccgatgatgtccgaaaaaaggccgaaagtgaatttaaaaagctcaaacaaatgccagcatcatcatcagaggcatcggtggtacgaggttatgttgagtggattttagacacgccatggaacaaagccagtaaagttagcattaatcttgataaagccaaacaaacactggataaagatcattatgggctagatgatgtcaaagaccgcattttggaatatttggcagtacaatctcgagtgaagcagcttaaagggcctattttatgtttagttggccctcctggggtgggtaaaacttccttgggcgagagcattgctcgtgccacaggtcgtaagtttgtgcgtatggcattaggcggcgtgcgtgatgaagctgaaattcgtgggcatcgccgtacttatatcggtgcgatgcccggcaaaattgtacaatcacttgccaaagttgaggttaaaaatccgctatttttactcgatgaaattgataagatggcacaagattttcgaggagaccctgcttctgccttacttgaggtcttagatccttcccaaaataaatcctttaatgatcattatttggatttagatttggacttatcgcaagtgatgtttatttgtactgccaacagcatgaacattccgcctgcattgcttgaccgtatggaggtcattcgcttacctggctacactgaagatgaaaaaatggccattgccaataattatctaaccccaaaagctttagaacaaaacggcctaaaacccaatgagcttgatattactgatgatgcattaaccagtattatccgccattataccaaagaagcaggcgttcgtaatcttgagcgtgagattaataagattagccgaaaagcggtacgctcccaaatcgaaaaatatggcgtcaaacccaaaaaaggtgttaatatcgatagcttaaccatcaccgatgataatatttcagattatttgggcgtcaagccatatgattatggtttggctgaaaaagaccctgagattggacgcattacaggtttggcgtggacttcggttggtggtgagcttttgaccatcgaatctgcaaccatgcagggcaaaggcgagcttgtctttacagggtcgctcggtgatgtcatgaaagagtccattcgtgctgccatgagtgttgtgcgtgccaatggtgagcgatttgggattacttatgaaaaatttaaaaataccgatttgcatatccacatgcctgaaggtgcaaccccaaaagatggcccatcagcaggtattgccctaactactgccatcgtctctgccatgacaggcatcgccattcgtgctgatattgccatgacaggtgaggttactttgcgtggtaaagtattacgcatcggtggattaaaagaaaagctcttggcggcacatcgtggcggcatcaagcatgtcttgatacccaaatccaatgagcgtgatttgatcgagattcctgacaatgtcaaagaaggtcttgtcattcaatctgttgaaaccattgatgaggtgctggcggtagctttggttgagccaattcgcccacttcctccacaagcggtcactcacaagaccagtagcgatactgtacgcagctaa

SEQ ID NO: 1137 - DNA, 990 bp, M.catarrhalis
gttatgaatcaatcaaaacccaaaaacaactccgccatcaacgaacaaaacgcaaccaacaaacctgctggcgaaaaactacaaaaactgcttgccagattgggtttgggttcacgccgtgggcttgaagagatcatcaaatcaggtcgcatttccattaatggtaaagtcgccacattaggcgatagggttatcttaaccgacgaaatccgcattgacggccgtcaagtacgcctgaaagccgagcgtgaaaagcgtcgccgtgtcattgcttattataaacctgaaggggaaatctgttcagcctctgaccctcaaggacgcccgaccgtttttgaccgtttaccaaaactcactaacgatcgctgggtgatggtgggtcgcttggacatcaattcatcaggtcttttgctgtttacaaatgatggtgagcttgcacatcgcctgatgcacccttctagtgggataatcagagagtatgctgtacgagttttaggcgaggttacaccacaaattgccagtcaactcaccgctggtgtagagcttgaagatggcgttgccaaatttgatgacatcaaagaaggtggcggtattggtgtcaataaatggtatcatgtgaccatcaaagagggtcgaaaacgagaagttcgccgtatgtttgaaagccaaacactcaaagtatctcgcttgattcgtacacgctatggcaccgtaattttgcccaaagaattgcgtacaggtcgttttattgagcttgatgccagtgatattggcaagctggttgattctgttggtctgcgtcagcgtcaaggtacagggctaaatcacgctaccaaagaaaaacaagcacgcattcacaaaaaacctttaaaatctcgtgagatacgccgtcaaaagcacgaagcccacgagcgacgagaagaacgcaaaaaacacacaccaaaacatcgtacacccaatcttagccgtaccaaatttaccaaaatttaa

SEQ ID NO: 1138 - DNA, 594 bp, M.catarrhalis
ccaaacagtcaattgccaatgaagaaaaaaccgaattacaaggggctgtcgatgcccaatgaaatcaagctgggttttgatgatgatttaacaaacactgtccaatctttgtattttgatattgatttaaacaagattgttgagacaactttatccatcatgacccaaaaattacatcatgggatcgattttgtttattttcctgatgccatacagatttggcatatgcccaaatctgtcagcatttatgtggttaaccatgcccaaggccgtgctgtaaacttagcggccagaggtaaagattatgccaccaatgtgctttcttatccaagtgagctacccactgagatgaccacattactcggagagattgagcttggtgagctggtgttgtgccacgaagttgttcttaatgaagcagatgaacaaaacaaaagttttgagtcgcatttgacacatctgattatacatggtttattgcatctacttggttttgatcatgaaattagtgatgctgatgctgaccaaatggagggttttgagattgaaatcttagcacagcttggtattgataatccttatcttgagccttaa

SEQ ID NO: 1139 - DNA, 264 bp, M.catarrhalis
tctatccgccaacccttgtcaaacaagtttatgcaattttatggtacgctattttatcttagcaattttaatcactttgctagattgctagagttgaaaacctatttgttgggttgttatcatcaaataccaaaagaactcatacaacttttggcagtcgatttggtgctatcagatttggctcattttctacccaataatgacagccaatgctatgcgggcgatctaagcttgcttttgcgaccaaataagcgcacatggtga

SEQ ID NO: 1140 - DNA, 573 bp, M.catarrhalis
tatatgacacagcttactttcgccgagcgtctcaaagaagatactcgcaacatacacgacagcgtcgatgagacggtcatgtcagttagaccttttgacagtgtcgaaaattatattaagtttttaaatctacaatctgtttttcataaaattgttgaccccatttataaagacccagcattgaaccaatccattgaaaacttagcatcaatgacgcgttatgatgccgttttaaatgatttaaaagacctagaacaacagccaaatacctttaaggcaaaattaccagcaccaatgggtgccaaagccatcggctggctttattgtgccgaaggttctaatattggtgcagcctttttatttaaagacgcaaaagaaaaattaggctttgatgaaaattttggtgcaagccatttagatgcgcatcctgatgggcgtggtaagcattggaaggcatttcgtgaatctttaaaccagctcaatcttagtaaagatgagcaagatacagccattcaaggggcaacagaagcctttgaattttataaagtggcacttaagcagatttttgggtaa

SEQ ID NO: 1141 - DNA, 1479 bp, M.catarrhalis
atttcatttaagatacaaatgtgtaagacttttgtactgttctataaagaagtatggacagttttacatattgtaaggactgactttttggagaaagtgatgagcttaaaatttggatacaaagcgctgagtttggcggtattttcaaccctaaccgcaaccgcagcacaagcagcaggcctggatcgctcagggcaagatgtgactgcttttttacaagatggcacttatgccgaaaccgtttatacttatattgatgccaatgttaccggtaaagataccgcaggcaaagatacaggtgatattgccgaagcttatgattttttccgttacggtgttaaagcagacatcaacgacacctttagcatcggtgtgctatatgacgagccatttggtgcagcggttcaatatgacggtaatagtaattttgtggcagataaaaatgcaacagcaacaatttttgcccaagctatcaatcaggctacaaaagcacaattaaacgatagccttgcttataaatcaattaagccagttttagacagtgttaaatcacctcagcgtgctttggcagtagcatcaatcgtagaaaccaattcagcacaagccaaacccattgctgaccgattaagagcagcggctgcacatgcagaagcaactgacggtcaaaagactaatgtcgaaattcgcaccaacaacctaaccatgttagtcggtgccaaattgggtgctaataaaaatttccaaatctatggcggtcctgtggctcaaagagttaagggcgaagtgcatttgcgtggtcctgcttatcaagtcatgacaggttatgatgccaaaattgcaacagatactcaattgggctgggcggcaggtttggcattttataaacccgaaattgccctaaaagccgctttgacctatcgctctgagattgagcatgactctgaaattgccgaaaccattcctgttacgggctatgcgggtaaaaaggattttaaagttactttgcctgactcatggaacttagattttcaaactggtgtgaatccaacaacgctattaactgccaaagtacgctatgtaccatggtctgattttgacattcgcccaacacagtatacagaaaccacaaaacttcgttatccacagggtttaccaatcatcagctatgacaaagaccaatggtcggctgaagttggtttgggtaagcgtgttagcgatcgtttggctgtttcaggtgcggtaggttgggatagtggtgcaggtaaccctgcaagtagcttaggtcctatcaaaggctattattcattgggcttaggtgcgcggtataatgttacacctgaatggtcgctgtctttgggtggtaaatactttaaatttggagatgctcaagcacagctaccaaccaaagataaagtaggtaactttgatagtaatgatggctatgccttgggcgttaagcttgcttatcacgccaaataa

SEQ ID NO: 1142 - DNA, 1035 bp, M.catarrhalis
ttgatttgttttgacaaaaataaaggagtttttatgaaattagcaacactaaaacaaggcggaccagatggcagtttggttgtggttagccgtgacttaagccaatatcgtaaagttgaggatattgcaccaacgctgcaagctgctttagatgattgggaagtggtatcgcccaagctacaagcggtctatcaggatttaaatgacaaccgtaatggattgccttttgatcaaacacaatgccattcgcccttaccaagagcataccaatgggcagatggttcggcttatttaaatcatgttgaattggttcgcaaagcacggaattcagaggtacccgaatctttttatgatgatccattgatgtatcaaggcggttctgatggctttattgggccacgagatgacattgtggcatcagaggcatggggtattgacatggaggcggaagttgcggttattacaggtaaagttagtttgggtagcacatcaaaacaagctgccgaacaaatccgattggtgatgctggtgaatgatgtttctttaagaaatcttatcccatcggagcttgccaagggatttggcttttttcaaagtaagcctgcttctgcatttagcccagttgctgtgacacctgatgaaataacagcttgggataatcaagctgccaaattgtacctacccattcaagtccatctaaacggtgagctttttggccgccctaatgctggtgaggatatgacctttggatttgggcaattgattgcccgtgctgccaaaactcgtcatttggcagtaggcactatcattggttcaggcactgtgtcaaataagcaagacagcctttgggggtcgagcgttgagcatggtggagtgggctattgttgtttggcagagcttcgtatgtatgaggcgattgaaggcaaacagcaaacgccgtttatgcaagatggtgatgtggtacggattgaaatgtttgatgaaacaggtgaaagtatttttggcacaattgaaaataccgtaaaagcaatataa

SEQ ID NO: 1143 - DNA, 804 bp, M.catarrhalis
gataagcataaaaatacaccaattcaatttttaaggatagctatgcaaaaaattcatctgattattccagctcgttatcaatccacccgtctaccaggcaagcctttattgcttttgcacgatcaaccgatgattctatggacagcaaaaaaagccttaaaagcaagttttgtagacaccgtctgtgtggccaccgatgacgatagagtctatcagacttgcgccgatgtaggcatacatgtcgtcatgactgacagcactcacccatctggaacggataggttggctcaagttgcaacggatttgggctttgatgatgatgatattattgtcaatatgcaaggtgatgaacctttggtaccaacggtgctacttgagcaagtgacgcagctgttgattgataatccagattgtgcgatggcaactttatgtgagccaatctatcatcaagaagaattttttcgcccctcagtggtcaaagtggtgatgaatcaggcaaagcatgccttatattttagtcgtgcaccaattccttatgaccgtgatggcttgttggatatgcctaatcatgcatttcgtcacttaggtttatatgcgtatcgtgtgcgtatgcttaagcagttcacaaactggactcaaggggtgcttgaaaaattagaaagtctagagcagcttcgggtacttgaaaatggtgagcgtatcgccatagatgttgccaaagttgcattgccagctggggtggacacacaagaggatttggacagactaaatgctatgcctatggatgagtttttaaagttttag

SEQ ID NO: 1144 - DNA, 780 bp, M.catarrhalis
gataaggataaattcatgaaaacgccattatttgcattgcctgatgccctactaatacccacagtccaagcagcacttttagaggatttggggcggcgtggtgatgttacctcggctgctgtcatcgccaaaaatagcaccgcaaatcttgccatcgtaagccgtgatacaggcattttggcaggcatggatttggcaaggttggcttttgaatgtattgataaaacaatcaactttagcccaaatgcctcagatggggatactatcaaatcaggtcaagtgttggcttatgtatcgggcaatacccaagccttattacaagctgaaagaacagcactaaattttttgacacatctaagcggtatcgccagcatgaccgccaaagcagtcgcccaaatatcacacacacaagccaaaattacctgcacacgcaaaaccacaccacttttaagaaatctacaaaaatacgctgtgcgagcaggtggtggctgcaatcatcgaatggggctagatgatgcgatcttaattaaggataatcacttgatttattcaggtacgcttaaacaagccatcgccaacgccaaagcagctgcaggtcatcttatccccattgaggttgaagtggataccatcgcacaacttgaagaagccttgaaggctggcgcggactttgttttgcttgataatatggataacgataccctaaagccacgccgtatcactttgccaagggcagagcaaaaacagaggcatcaggtggcattacctttgaacgactaa

SEQ ID NO: 1145 - DNA, 1152 bp, M.catarrhalis
cagattgacaatctaaattcacgacaggcagtcctacactggaaaaataaaccaaatattatgacaaagatcatcaccaccgatgatattgccatcatgaccgatgatgatatcttggctattttgaccaaagcccttagccacttgctaaaaaatattgaattaacccatgatgagatgcgtcaagtcatgctcatcatcatgcaaggtcgttgccctgatgcgttgatgggagccattttgatcgctttgcggcaaaaaggtgagtctatagatgaaattaccacttgtgctaaaacaatgattgagcttgccgataccattgatatttgcaatcccaatgcagttgatattgttggtactggtggcgatggttcaaacttatttaatgtatcaacagcatctgcttttgtggcagcggcggcaggtgttaccattgccaaacacggtaatcgtggtgtatcaacaagctctggctcttcagatgtgctaagcttggcgggcgtgcgtttggatattaataaaactcagacagtcaaagccattaatacgcttggcattggatttttatttgcacccaatcatcaccctgcaatgcgtcatgctgttggtgtccgccgattgctcaaagttcgtacgatcttcaatattttaggcccactgaccaaccctgctaaggttagccgtgctgtggtcggtgtttttagccctgaactgtgtgagccattggcatatgtttttgctaaacttggtcttacccatgtcatggtcgtgcattctcaagatggcttagatgagtttagtcttgccacgggcacacatgtcgctgagcttaaagatggtaaggtacatacttatctttgtcagcctgaagatgttggtattgtctcaagaactttatatggtctgactgtcaatgattcaaaacaaagtcttgaaatcatcaaaaatgcactgggcggcacagcaaatgatgatatcagcctaaaggcacgagcgatgattgccatcaacgcaggtgctgctatttatgtggcaggccatgccaaaacacatgccgaaggcgttgccattgccaagcaaattatgacaagtcgccaagctttagataagctaaatgcatttgcaaactttacccagcactgtgaataa

SEQ ID NO: 1146 - DNA, 660 bp, M.catarrhalis
tcatcacaaaatttgcgattttttggggattttatgacacagcataatacacaaaccgatcacaccccaaatccaaacgacctgacccaccctgccaaatccgccaccatatctgatcttaatcctatcattcatcaagatgagctgtttgatgagtcagacatgatcaaagtcaccaacgaccctgagcatacccctgaaagtgctgaaactttccacgacactcaagacagctatatctatggcgatgccgatgccacagacgaagataccattgagacaatgacagtctacgatcctgatgccgaccgcttagaagatattgagcaatctggggataatgaaactgtcatctgttatgcttactctcgtaaaacaggcgcacccattgagcctttagcaatcgaggatgtcagtcgtacgcttactaataataatcaatttatctggcttggactatacgatcccagtcttgaaaccgttcaagaggttcaagatgcatttgacttacatgagcttgccttagaagatgcctttgctgatcaccaacgcccaaaggttgaaagctacggtaatgataccatctttgtggttgtgcgtactgctaagcttgaggataaccaaattcgctatggggcaaccgccatttttatggggtaa

SEQ ID NO: 1147 - DNA, 186 bp, M.catarrhalis
accctgaaaaattctatcgcagataatgtttcagaaggctctgaccatgtcgatgttggtggaaaaactacgcacattttaagctatttgcaagattttttttcacgccaaatcgtgctcgcccccctgttaaagcactatcaggcggtgaaaaagcacgcgttttattggccaaattattgctaa

SEQ ID NO: 1148 - DNA, 234 bp, M.catarrhalis
aagttcacgaatttttttgatgtccatcagtattaccttgataaaaataagaatgttaatattacgccagtcaaaaggctatccacgcctttagcgagcaaaacttaccaccgattaagcaaacagccaagatggtttaaaaattatctttatatagtgtacattcgttttattttattgcaagtgtttttttgtcatattttggtacaatttggcaaactgatgtctgtttag

SEQ ID NO: 1149 - DNA, 192 bp, M.catarrhalis
aaatgcaagaaaatccaaactcagcaattaatgattaagggatattatgccataaatataaaattagcccaacttggcaaacaaattgggcgatattttgatatcttaaagcttgcacgcaccacctgcacagccatcgtccaagtcgccttgggcatcatcagcaccatcacgcgtattatgataatataa

SEQ ID NO: 1150 - DNA, 945 bp, M.catarrhalis
ttgttaaaggaatattttatcatgagcgtacgccattttcgtaatcttttagatatgacgcctgccgagcttgaggctatcatcagtcgtgcaagcaagctgcgtcaaatgcagcagtgtggcgagatttatcgtccgtttgtggggcgtacgcttggcatgatttttgaaaaatcctcaactcgcacacgcatctcttttgaggctggtatgggtcaatttggtggtcatgccatctttttatcgccaaaagatacacagcttggtcgaggcgagcctatcgaagactccgccaaggtgatttcaagtatggttgatatcatcatgattcgcacttttgagcatgacaagctggatttattttgcaagcattcgtctgtacctgtgattaatgcgttgactgatgattttcatccgtgccagttgcttgctgatatgcagacctttcatgaacatcgaggcagcatcaaaggcaaaactgtcacttgggtcggtgatggtaataatatgtgtgcctcttatattttggcagctcatcaattcggctttcagttgcgtgtgacagcaccatatggatttgagccgaatcctaagctcatcgaagagtatagccactgcgtcacttatgttgaagaccctcaagaggctgccaaaggggcacatctgattacaactgatgtatgggcgagtatgggtcaagaatctgaacaaatgacgcgtgcacgccgatttgctccttatcaggttagccctgccatgcttgataaggctgatcctgatgttttgttcatgcactgcttgcctgcccatcgtggcgaagaaatcagctttgatctgttgaacgatccccgttctgtggtttgggatgaagccgaaaaccgactgcacgcccaaaaagcactgatggaatttcttcttaaagataaaattaatttaagttcataa

SEQ ID NO: 1151 - DNA, 1131 bp, M.catarrhalis
tgcaaaaaggagcatgtgatgcacaaaaatacccagcaagcgtttgattatgaagcgcctttatcaaatatgccaacgacatcatgtcgcatcaagcaagcatgggcaaagattccgcctgagctaccaaaagacgcactgacccaataccaacgcaatattaaggatctgcttatccaaaaagatgcggtgattattgcacattattatgttgatcctgacattcaagatttggcattggcgacaggtggctgtgttggggattcgcttgagatggctaagtttggggcggcgcatgatgccaagaccttattggtcgcaggggttcgttttatgggtgagagtgccaaaatattaagtccgcacaaaactgtcttaatgcctgatttacaggctgaatgttcgttggatttgggttgtccaattgaggaatttagtgcattttgtgatgcacaccctgatagaacagtggttgtctatgccaataccagtgccgctgtcaaagcgcgtgctgattgggtggtaacttcgtcggtcgcacttgaaattgtcagtcatttacatgccaaaggggaaaagatcatttggggtcctgatcgtcatttgggcgagtacattcgccaaaaaacaggggcggatatgattttatggcaaggatcttgcattgtgcataatgaatttaaatcaatagagcttgagcagcttaagagtaaacatcctgaagcgatcactttagtacatccagagtcccctgccagtgtggtcgctcaaggagatgtggtcggttctaccagtaagctattacaagctgccattcatcgtcccgaaaaaactttcatcgttgcaaccgatttggggattttgcatgaaatgaaaaagcatgcaccacaaaaaactttcattgcagcaccgacagcgggcaatagtgcaacttgtaaaagctgtgcattttgcccttggatggctatgaatggtgtccaaggggtttatcaagcacttaaatatggcacaggtgaaattcagctgactgagtctttgatgaatgatgcacgccatgcgttggataaaatgattgaattttcaaaaacattgcccaagaaaccagcggttcatggtttgggagttgcataa

SEQ ID NO: 1152 - DNA, 435 bp, M.catarrhalis
caccaattactatcaacattaatgataattattaatttggaaaatacaaccatgattcgtacacttttgggtggtaaaatccaccgtgctactgttactgaagctaatctaaattatgtgggtagcatcaccattgatgtggatttgttagatgctgctggtatcttagtgaatgaaaaagtcagcatcgtcaataataataatggtgagagatttgaaacttataccatcgcaggcgagcgtggtagtggcgtggtgtgcctaaatggtgcagctgctcgtaaagtacaaccaggcgatgttgtgattattatgaattatgtgatgatgcaggatattgatgcccaaaatcataagcccaatgttgttttggttgatgccaacaatcacattacccaaatcatgcactatgaacctgccaataccatttggtaa

SEQ ID NO: 1153 - DNA, 747 bp, M.catarrhalis
cgagacttttgtcttatgaacaagagacttatgctgctaatgatgtccgctacttatttaaaattatatgaagttgtacgcaccgaattggcagctcgtggcattttaaattgcgtccttgaagacagcaatcactatgctcgagaactgcacaccattcaaaatcaacccgatgagatgctgtatctagacttattagcaccgatttataatcgccgtcaattgggagtacttcagcagctcaccatttggcgtgaagcattggcaagagcaaccaatgaacccagaagctttattatcagcaaacaggcacttagggaaattgtccaagacatgcctgatagtatcaagcttttggctcgtactaccatcaaccgagctgtgctaagacgctatggtaacgaaattgtacgcatcatttgccaagtcaaaaatatgcctgatggcaatctgcctgcattaccgccaccgacttatcatagtaaatccaaaccctttaaaaatgacttaaatgatatcatcaatgcctacagtcaaagccactacattccccctaatttattattaaaaaaccgttggatgaatgacttattggtcttggttgcttatgatggcttaattgaagaattaccgcttgaattgcttggttatcgtcaaagtttaatcacaaacaatattttaccagcattaagaccctataaagaacatattttagaagttttaaatacacctgaatataaccattga

SEQ ID NO: 1154 - DNA, 225 bp, M.catarrhalis
aacagggtttggtgccgaatcgcctgggcaaacccaaattttgattttcgtcatactggtcgttttatgcagcatagccatcgccgagtactagccacggcactcgccagattgcgtgccaagataaaataccgccctgttatttttgaattgatggcagatgagtttacattatttcagcttcaaaaaagcgtcgaagcccttatcaggtcaagaactgcataa

SEQ ID NO: 1155 - DNA, 1071 bp, M.catarrhalis
cttattaattgcagactggaaattttcatgattaaaaagcgtggattgggtatgaatcgtgggctagatgtgctgcttggcaacatctcagcagaaaaaaaaatcatcgcaggtgcccagtctttggtggcaagtgccgccagtgaacagaccgaaactaagcctacagcctcaaccaagactaccaaaatcaataaagctaaagcagataaaaaagcaggtaacaacaataacccagctttggaagctggcatgggtgagaaagtagcacttgttcaaatcgccaccaatcgcctgcaatcaggcaaatatcagccacggcgtgatatgaacgaagcggcactcaatgagctatcactgtccatcaaacaacatggcgtgatgcagccgatcgtcattcgcccacttttgtcagatgagagcaagtccagcgatacggtaacgcacgagattatcgctggtgagcgtcgatggcgagcggcaaaattggtggggcttgagaccattcctgccattgagcgggttttgtctgatgaggttgcgattgctttggcgttgattgagaatattcagcgtgaggacttaaatgtcttagagcaagcagcggcattgcaacaatttcatactgagtttggtatgagtcatgcaatgattgcatccgtggttggtaaagcacgcaccactgtttcaaatttaatgcgattaaatcacctacacgatcaagtcaagcaatatatgatagatggtgtgatggatatgggacacgctcgtacccttttatcactctcccaagagcaacagcccattatcgccaaaaaaattgttgatggcggcatgacagtgcgagatgctgaaaggctggtcaaatcaattttagatcccaatcctaagcttatcgttcagccaaatcatgaagttttggcactttctcagcagatatcggatgcactgggtgctaaggttaaattaaagcaaggcaaagatggcaagggcagtgtggagattttcttttatgaccatgatgagtttggcgagctggtcaatagactatgccaaatatcagattattga

SEQ ID NO: 1156 - DNA, 375 bp, M.catarrhalis
agtctttgttgttctaagatggcttctacatcaatctcgggctcaggctcaggctcaggtaatggctcaggtaatggctcaggttcaggaatgggttcgggcggctcaataacctcaggcgtagcgacctctggctctacaacaggctctggtgtaacaacaggttcgcctggtggttcgggcgattcaaggtcattaagtgcgatgggttcaggcactggttctttgataaattcaatctctaaaggcggtgtgacaggtggcggtgtgattggttttatagtcatattcgccaatccaaaacctaccaatccatgcaagacagctgcgatagagatagccaacactttgatttttttggaattatccacttaa

SEQ ID NO: 1157 - DNA, 1032 bp, M.catarrhalis
tccatgagttgccatcatcagcataagcagacacccaaacacgccatatccattaagcatatgccaagcttgacagatactcataaacaaagtagccaagctgagccaaaatcgtttgaatgggcgtttttacatcccaaatattggggagtttggctggcttttgcgttgattttaccgctgcgttggcagttttggatcggcaagcgccttggcattttggtacattacttagctaaaagccgagttcaagacactctaaccaacctgcagcttaccttcccaaatcaaccaaaatcaaaacacaaggccaccgcacggcaagtatttattaatcaaggtattggtatttttgaaagtttatgtgcatggtttcgccctaatgtctttaaacgcacttttagcatttctggtttacagcatttgattgatgcccaaaaacaaaataaagcggtgattttacttggtggacatcgcacgacgcttgatttgggcggtcggttatgtacacagttttttgcggcggactgcgtgtatcgcccacaaaacaaccctttgcttgaatggtttatctataatgcacgccgctgtatctttgatgagcaaatctcaaatcgtgatatgaaaaaactcatcactcggctcaaacaaggtcggataatttggtattcacctgatcaagattttggtcttgagcatggcgtgatggcgaccttttttggtgtgcctgcagcaacgattaccgctcagcgtcgtcttattaagctgggtgataaagccaatcctcctgtcatcatcatgatggatatgctcagacaaacgcccgattatatcgcaaaaggtcaccgtccacattatcacatcagcctaagcgctgcgttaaaaaattatcccagcgatgacgaaaccgccgatgctgaacgcatcaatcgactgattgagcaaaatattcaaaaagatttaacccagtggatgtggtttcatcgccgctttaaaactcaagccgatgacaccaattactatcaacattaa

SEQ ID NO: 1158 - DNA, 474 bp, M.catarrhalis
ccttttgactggcgtaatattaacattcttatttttatcaaggtaatactgatggacatcaaaaaaattcgtgaacttttagatctgatggaagaaaaagatctgttaaatttggaatatggttatgatgacaaatacatcagccttactcgtaatactgccgtgcagacagtcgctaccacccaagttgtttcagcagcaccgtcagctacaactcctgctgtcgtcaagccaagtggtcagcttgaaacttcgcccatggttggcgtcttttattcagcacccagccctaatgatcctccttttgtcaaagtaggtcaaaaagttgaggctggtgatacgcttggtatcatcgaagccatgaaaatcatgaatcccttagaagccacccaaagcggtattattgaagaaatcttggttaagaatgccgaagtggtcgaatttggtcagcctgtcattcgctacaaagcctaa

SEQ ID NO: 1159 - DNA, 1344 bp, M.catarrhalis
aaggatgcatgccgtatgaagctgcgcaaaccgaatgtcaaaaaccaaaaagtacaaaaaattgtcgatgctgccagcgtcggtattgatgatgcggtaagcgctatcaaagaatcgggtctgccaaataaaccattgatttctagcatcgctgagctgactggactaaaaaagaaaaaatcagctcaactggttgaatcaatgcaggcaacagagcagatcgcatcggatattcatcagatgagttttgcctttttgggcggtggaagttttggaactgccatggcaaatttggcggctaaaaacggttgtgatgcgacattgtgggtacgagataagcgcactgtcaagtctctgcataaaactcgaatcaataaaaaatatttgccaaatcataagcttgatgagcgtttgaaatttagtcacgatctgaaaacagcagtggcaggcgtggatgtgatttttgttgcagtacccagctcggcatttcgagagatgctgaccaatattaagccctttattacacaccaagctgtggtttcactgactaaaggcatggaaaaagagacttttgcgatgatgagtgatatcatccaagaggtgttgcctgaggtgaattttggtgtcatgagtggaccaaacttagcggtagaaattatggataatatgcctaccgcaacagtcattgcctcagcatcagaaccgcttagaaaagctgttcaaaccgctttacatagtgcattttttcgtgtttttgccagtagtgacattaaaggcgtggagcttggcggcgcactaaaaaatatctatgccatcgccatgggtatggcggcagcgtatgatgtgggtgagaataccaaagccatgctattgactcgtgcattagccgaaatgagtcgttttggtgtggcggttggtgctgatcctttgacttttttaggtctgtctggtgtgggggatttatatgctacctgcagttcggtgctaagccgtaactatcgcatcggctatatgcttggtcagggcataagtcttgaacacgccatcaaaaaattaggtcagaccgctgaaggtgtcaatacaattcttcaagtgcattctcgtgccaaagcactgggtatttatatgcccatcactcatgcactgcatgcggtattatatgagaataaatctgcacttggtgttgcacttaatttgatggaaacaggctttagaagtgatgtggaatttgttttgccgcatgatgaaagcaatgtacgcttgagccatgagtttagtgaggtgctaaagaccagtgccaatgctaagcccaaagatgaaattcaatccagtgatatgccttag

SEQ ID NO: 1160 - DNA, 702 bp, M.catarrhalis
ccatgtcgatgttggtggaaaaactacgcacattttaagctatttgcaagattttttttcacgccaaatcgtgctcgcccccctgttaaagcactatcaggcggtgaaaaagcacgcgttttattggccaaattattgctaaaacctgccaatgttttggtgcttgatgagcctaccaatgatttggatatggcaacacttgagcttttagaagattttgtggtcaattttaaaggcacggtattactcatcagccatgaccgtgcttttatggataatgttgttacccaaacttgggtatttgatactgataagtacggcgacggtatcgttttggaatatgttggcggttatgaagactatgtacaacagcatgaaagatggcttgctcatcacgccacagacaataaacctaaggcgacaaaacccgctgaacccatccaaatcaaaccacctcaatcaggcgttgcccaaaaacgcaaactcagctataaagagcagcgtgaacttgaagatttgcctaatgaaattgctgcacttgaacaagagcaggcacagcttgccaaaaagattgaagatggttcatggtttaataccgatttggcggcagcaacgaaggctggtgagcgattggtagagattgatgagcttttgatgatgaagcttgagcgatgggatgagcttgaaaatatgacccaataa

SEQ ID NO: 1161 - DNA, 243 bp, M.catarrhalis
gttgatatttttatgcctgatgtcttatttaccaaagattttaccttaattgatctacaaacacgcatcagctttttggaggatacttgtgatgagcttagtaaaattattgctcgccaagaccgtgatttaagagatttgcaagatcagttaaaactgatgtaccaacatatccaagccaagcaagacgatgtaggcattgctacatttgatttattggctgatagaccgccacattattaa

SEQ ID NO: 1162 - DNA, 348 bp, M.catarrhalis
agaagaaaaagcagagttttttggagggcatggggcatgagtgaagcaagtcttgaccgtgtcattcgtgcaggctatgaattatttaacctacaaacttactttacgcaaggcgtcaaaaaggtgcgtgcttggacagtacctgtcggagcaaccgctccagaagctgttggcgtgattcatactgactttgagcgtggctttattcgtgctgaagttatcggctatgatgattttattgaatacggcggtgaaaaaggtgccgctgccgctggtaagtctcgtttagaaggcaaaacctatattgttcaagatggcgatgtgatgcattttagatttaatgtataa

SEQ ID NO: 1163 - DNA, 231 bp, M.catarrhalis
tggcagatgagtttacattatttcagcttcaaaaaagcgtcgaagcccttatcaggtcaagaactgcataaacaaaattttcgcaggcaagttcagcagcaaaacctgatagaagccattgaaggcaggtttgctcatgagcgtggtcggcctgcacagctttaccgatttaaagacacggtgctgcttgagcgtttgttatctaacactcgcctgcccgtgagcaaatga

SEQ ID NO: 1164 - DNA, 1851 bp, M.catarrhalis
atcttgattggtttacctttcttcttagacagacgcttaagccatttttggcatacggctgctgttggcttaaaattatgcaaacaaggagtgagcatgcttacctttttggcgatagtgccgattattattgtctttttattattggtggtgatgcgactacccgctaaatatgccatgagcttggcgtaccttgcaacggctgctttgtcatattttgtttggcaaaccagcggtaaccaagttgctgctgcaaccatccatggcgtactgactgcggtgaatgttttattcatcgttttttctgccattttgattttaaataccttaaaatacagcggtgcaattaatgccattcgtcaaggctttatggatatctctgcagaccgccgagttcaaatgattatcgtggcatggctatttggctgtttaatcgaaggctcaacaggctggggtacgccttcggcggtggcagcaccgctcctgcttgcgttggggtttcctgcgatggcgtgtgtgatggcagttttaatcattcagtccacacctgtatcttatggtgccgttggtacgccacttttgattggtgtcaattcaggtcttgaaaataaagacgaccttgctcaagcactggcaaatattggtatggatttacctgcctatattttcaatatctcaggcaatgtgggcatgattcatggtatggtcggatttttaattccgttaatattgtgcggatttttgacactattttttggtcaaaaacgctcatttaccgaaggtctaaaagtggcgccctttgcgatttttgcaggcttggcgtttaccattccttatgccttgaccgctaagtttatcggccctgagctgccatctattgtgggagcggtcgttggtttatccttggttattcctgctgccaagcgtgggtttttaaccccaaaacaaacctttgactttggtccacgagaaagctgggagaaagaatgggtcagtgaatttaccatcaccgattcaaccagcgatgtcgccccaaaattttcggtcatacgtgcgttttcaccctatctactcatcattaccattttaatcatcacacggacgattgcaccattaaaggcatggctcaccagtgatgcggtttctatcgtttttgccaacattttgggcacaaatatcaccaataaaacccagttgctttattctcctggtggcgtgcttttattggtgtcaattttgtgtatttttatttttggcatgaaaggcaatatggtcaaaaaaagctggtcagagtcaggcaaaaccatgctcgctgctgcacctgcgttactattttcggtgccgatggtgcaggtatttatcaattcaggcacatcgccagatgctgctgtacagattcttgccatgccaaaagtattggccacctcagcagcacaagcatttgagggcatgtggcctttggtttcaccttggattggcagtcttggcgcgtttattgctggctctaacacggtttctaacatgatgttttcgcattttcaatgggggacagcaacccaaatcggcttaggtgttatggatgccgctaaagttgtttccttgcaagcggtgggcggtgcagcgggcaatatgatatcggttcataatgttgttgcggcatgtgctgttgttggtttggtcaatcgtgaaggttatgtcattcgtaaaactttaattgccatgtcctattatgtgattcaagcaggtttaattggtatggcgattatatttaacccaacttattgggtgggtgctgtcatctggccaatattgttcttatttatcatgagcaaggtgggtaataaagcctag

SEQ ID NO: 1165 - DNA, 993 bp, M.catarrhalis
aatccacatggacgatacgccatgaacgagcaagaacagttaccctactttgctccattacttccttggcaaagacaggcttggcagcagctgacaggtcaattcattgagcagcgtatgccacatggcttacttgctgcaggtcaaaaaggcatcggtaagcgtgagtttgtttggcgatttgtggcgtatttactgtgtttggaaaaaaaccaatatggtgcgtgtggtcactgtcagagctgtcaatggttgcgtgctggaacgcatcctgatttattggtgctaccgcagggtgatagcatcaaaattgatgatattcgtttgctccaagaatacagtcaaaccaaagggcatggggtaaaagtcattgtgcttgatggggcagatacactgacactgggtgctgccaacgcatttttaaagacgcttgaagagcctcgagatggggtatttttgatactcattaccgaccatccttctaggcttttacccaccatcaaaagccgtgtacagacaatgcctttatcttatatagataaagtagaggcgattgattatctgagtgaatttatgtcacctgagctatcaaagcttttattagatatcagcgatggggcggtcttgcaggctaagagcttatcttctgccaaatggtttgatcagcgtacactttggttaaaaacctacaccgctctacaattatccaagcgtaccgccagtgccgctagtagttactggcaaaaaaccttaactttggctgaatttatcacgttatcaagagtcatgttaatggatttatggcgtgtgttcttggggataccaagcttacatcaagatatagatgtggtagcgttgttggctcaagttcagcttgactcttcaaaacttgaatcattactaagctgtattgatgatacgcagacagcttacgcccaaaatgtgcaagagactttgggctttgaccgcattttaattgagatggcaaaatga

SEQ ID NO: 1166 - DNA, 1044 bp, M.catarrhalis
ggaatgaatggtttaatcgaaaaaggtgtgcctgtgcgtgagcgtttgcgaatctcacctgcatgttcgtttatcatgccttatcataccgcacttgaccaagctcgtgaaatcaaacgaggcagtggcaaaattggcacaacaggtcgtggtattgggcctgcttatgaagataaagtctcacgccgtgcgctcaaagttgctgatttattccgtgcagatttaccagaaaaactagaaaacttacttgaatatcataactttgcacttaccgaatattataaggtagacgccattgattttgataccacgctcaaactgtgccaagaatgggcatctgatcttaaggatttggtcattgatgtgaccgatgcactagagatccgtcgccaaaatggcgaaaatttgatgtttgagggtgctcaagggacgctacttgatattgaccatggtacttacccatttgttaccagctcaaatacaacagcaggcggcgtatctacaggtacaggcttaggacctttatatttagactatgtgttaggtattaccaaagcttataccactcgtgtcggctcaggaccattcccaacagagctgtttgatgatgttggtgctcacttagcaaaagttgggcatgaatttggtgcaacaacaggccgagctcgccgctgtggttggtttgatgcggtcagcttacgccgtgcggttgtattaaactcaatgagcggaatttgtttgactaagcttgatgttttagatggcttagatgagattaatatttgcaccagctatgaagtaccagaaggtgaatgtgctggtgcttatgatgctgaatattatgaaaaagtggtaccaaaatatgaaaccctaccaggttggagcgaatcgacgattggtgtgaccaactttgattcactgcctgccaatgctcaagtatatatcaaacgcatcgaggcgcttgtcggttgccctgttgatatcatctcaacaggccctgatcgtgatgaaaccattgtgttgcgtgacccttatgatgcttaa

SEQ ID NO: 1167 - DNA, 243 bp, M.catarrhalis
gttttggtcgggtctgtaggctgggtggaatgctgccacgatacccaagaacgccaagacggcttaagccggggttcaattatgtgggggtttacctccttattgtggtcagaagagcaggtactactacgctatgaattattgtatgaaacagggtttggtgccgaatcgcctgggcaaacccaaattttgattttcgtcatactggtcgttttatgcagcatagccatcgccgagtactag

SEQ ID NO: 1168 - DNA, 558 bp, M.catarrhalis
ggtgaatttatggattttggattttattggtcgcatactgatgcggtgagtaagacactgttttttgtcttgttggctttatcaatgatatcttgggttgtgggcatcatgcgtgtgattaactctcggcgtcgcacagcaaatattgttgatgagctaactgcccaaattaatatccaaaacttgggtgatttgccatttgaccaacgcaagatggcaacagagcaaaaactgctccaacaaatcgctcgtcatcgttatgaacttgaaaaaggtctgcccgttcttggcacaacagcttccatcgcaccttttattgggttgtttggtacggtttgggggatttttcatgcccttcacagcatcggtgcaacaggtcaagcgggcttggcacaagtggcagggcctgtgggtgaggcattgattatgacaggtttgggtctagcagttgcaatacctgcggttattttttataacattgccacacgcatcaacaagcaagcgattcatctggcaactgatacagcccatcaaattctatctaagattgtacaataa

SEQ ID NO: 1169 - DNA, 1113 bp, M.catarrhalis
caaggatttattatgtcaaatcaaacgccactagagcgttatcaggctgctttggcgactggcgattttagtgaagatgccgttcagctggcggcggtgacttatatggataatttgtatcatgaaattatcaaatcacaagacagctcaggtggtgggtggttttcaagcctatttaaatccaaaccagtcatgccaaaaggtctgtatatgtggggcggggtagggcgtggtaagacttggatgatggacatgttttatgaaagcctgccaatcaagcgtaagatgcgaatgcattttcaccactttatgcagcgtgttcagcgagaattagtggcacttcaagggcaggctgacccccttaaaaaagttgccgatatcattcatcaagaagctgttgtcatctgctttgatgaattttttgtgtcaaatgtatcagatgcaatgattttgggcgatttatttagcatgttgtttgatcgtggcattacattggtggcaacttccaacattgaaccatcaagtctatacaaaaatgggattcatcgtgatagatttttgcctgccatcgctcaagttgaaaaacatacgacggtcatgaatattgatgctggtattgattatcgtctcaggcttttaaagcaggccaaactatacagctcgcctttgaccgatgacaccaaagattggctgtcagagcgatttgacaccttggcaggcggtcagaccatcagcacatcgccgattgtgattggcggccgcaatattgatatcattaagcgtacagaaaccatgctactggctgattttcgggcgctttgcatgcagcctcgttcagcagcagatttcattgaaattgccaatgattttgataccgttatggtggataatgtacctgcactaaatgatacgcttatggatccgacacgccgctttatttatttggtggatgaattttatgaccgtcgtgtcaaattactgatacgagccgaacaatctattttgacactttatcagggtgaaaagttggcatttgagattgagcggacacggtcacgcctgcttgaaatgcagtcagaggaatacttggcagaagaacatcgcttggattaa

SEQ ID NO: 1170 - DNA, 795 bp, M.catarrhalis
ggttttattatggaaataattgcaattgccaatcaaaaagggggtgttggcaagactacaacaacagtcaatttggcagcagcgttggcgataattgccaaaaaaagggtgctactgattgatttggactcccaaggcaatgccaccaccagtgttggtctggataaaaatgccttagaatatacaatggcagatgtgctacttgatggcgtgtctttacaagatgccatcttatctaccgatattggcttggatgtcattggtgccaaccgagatttggcaggtattgatgtatcacttgcaggcgtggcagacgcgccttttttacttaagcaggcgatggcagatgccaagatggcaggcaagcttgagtatgattatatcgtgatggattgtgcaccaagtcttagcatgattacggtgaatgccttttcggcaactgatggcgtgattattccgatgcagtgcgagtattatgcgcttgaaggtgtggcagatttgattgcgacgattgataagctaaaatccatcaatgaatctttgcatattcgtggtgtggtgcgtactttatttgattatcgtaacacattggcacaagatgtttctggtgagcttgaacgccattttggtgatttggtgtatcaaaccagtattccaagaaatgtgcgtttggcagaagcgcccagctttgggcaatcaatttttacttatgaaaaatcatccaaaggtgcaatcgcttatcataaacttatgaatgaagtgattgcacaaacgaaagccaaatcaaacggatag

SEQ ID NO: 1171 - DNA, 198 bp, M.catarrhalis
ggatatattatgggtaagaatgttgtcgtgctgggtagtcagtggggtgatgaaggcaaaggcaaaattgtggatttgctgaccgaaaaagccacagcggtcgcccgctttcaaggtgggcataatgcaggtcatacattggttggtggcggtgaaaaaacccgttctgcatcttattccatcaggtattttgcgtga

SEQ ID NO: 1172 - DNA, 651 bp, M.catarrhalis
ccattgattatacacatgaattatcaagataaatttgcacgcattgtcgtctattgtggttcaaactttggcgatacacctgcttattatcatgccgcccaaagcttaggtaaaactttggcagagcatgacatcaccttggtttatggtggtggcaatgttggcttgatgggcacgattgcagacagcatcatcgcacatggtggaaaaagtattggtattattcccagatttttgaaggataaagaagtcgctcatcatggcctaagcgagctcatcaccacagaagatatggcaagtcgtccactaaagatgatatccttagcagatgcttttattgctcttcctggtggtattggtacctacgaagagcttttcgaggtcatgtcactggcacaattgcgtcagcacgccaagccgattggtgttcttaatgttgatgggttttttaacccttttcttaaattgcttgaacagacagcaaaagcaggctttatgcccgtttcaaatattaatttgatttgtgtggccgacaacatccccacactactgacaaaaatggcaacttaccggtttaccgaatctcaaaaatgggtcaagcccagttggatggatgagacatcggcttatactgtacccaaattcacctaa

SEQ ID NO: 1173 - DNA, 762 bp, M.catarrhalis
tatacagttattcactcaacctttaagtttatcactggacgaactatgagcatcgcaagaacaaccaaccgtgaacaaaaaaagcgtcaaactcgccaagcattttttaatgccgtgcttgatttatgtatgagcggtcaaggttatagctcagttagcttacgtcaggtaacacgagaggttggtgttgtgccaaccgccttttatcgccattttgatgacatggaaagtcttggtaaagcattggttgaagatgaacttggtggtgcacttgccacgctcagagagcatatgcaacttgggcgtaaacgcagttttgaccgccaaattgccaaaagtgttcagctcttttttaaggcagtcgatgcccagcctcgctattggcaatttatcgccagtgaacggtttggtggctcagaagcggttcgccgtgccatcaatgaacaaatcaatacctttgccaaaattatgagtgctgatttggtattacagcctgcttttgagcatatcaatagctatgaccgttatttattagcagaaacgggtgtgaatttgtctttttcatggattattgagtggctggatttgacgcatatgccgatttttttggatgaagaagaacgattatcaacttgtgagctggacaccaaaaaacagcaaatgttgcaccgctgtacacgccaaatgcaaatggtgctgtatggtgcttataactggaaatccagcgaagaaactttattggatgaacctgccaatatataa

SEQ ID NO: 1174 - DNA, 483 bp, M.catarrhalis
aggataactatgaaccaaaaattacttttagcttctgtggtggcagctttgactttgaccgcttgtagcaagcctgccgatgagtccagccaagcaaatccctcagctgagcaagttgccaatcctgccacaccagatagtacagcagagcatgcaaccatgcaagacgagcatactcacgcacatgagcatcatgatgaccatgcaggtcatatgcacatccacactgatggcgatgcgtatcaatgtggcgatcagacagttcatattgtcgttcataatcatgaaggtgaaattgaagctcacctaaatcatgatggcattgagtatgattttaatcaagatcccagtaataaaaatcaatacaccagcaatcatggatttgctgataaccaaaaaaccatactcaccattgatggtaacaaggctgtcgtaactggtgataccaatcaagtgttgcttgactgcgtcaaagccagttaa

SEQ ID NO: 1175 - DNA, 441 bp, M.catarrhalis
ggaaaaactatggctatcgaacgcactttatctatcatcaagccagacgcagttggcaaaaaccatatcggcgatatcatcgctcgttttgaaaaagcagggcttaagccagttgccatgaaatataagcacctatctcaagctgatgcagaaggtttttatgctgaacacaaagagcgtggcttctttggtgatttggtgtcttttatgacatcaggtcctgtcgttgtgtcagtgcttgaaggtgaaaacgctgttttagcccaccgtgaaatcttgggtgcaaccaatccacaagaagcggcacaaggcaccattcgtgcagattttgctgtcagcatcgatgaaaatgcagcacacggttctgactctgtggcatctgccgaacgagaaatcgcttacttctttggtgatgacgaagtttatccacgcactcgctaa

SEQ ID NO: 1176 - DNA, 660 bp, M.catarrhalis
aatcaaaatatctatttaaatcaaggatttattaaaatgatactgatgattgataattattgtagttttacttataatattgttcaatattttggagaactacagcaagaaatgaccgtttggcgaaatgatgaaaccactttggatcaaatcatcaagcttgcacctcgagcgattgttttgggtccaggtccttgcagtccaaacgaagcaggcgtaacacttgagattttagataaactctcaggaaaaattccaattttgggcatctgtttaggtcatcaagccatcggacaagcgtttggcggtcaggtggtgcgtgcaggtgaggcaatgcatgggcgactatcatctgtacaccataccaatcaaggtgtttttgctgatattccaaactcttttaatgccacacgctatcattctttggtgattgacaaggcaagcctacctgattgtttagaggtcaccgcttggacagctcatgctgatggtcgtatgcaagaaattatgggcgtacgccataaatcgcttgatgttgaaggtgtgcaatttcaccctgaatctattttgagcgaatatggttatcaattattgaataactttttaaagcgttgtgggttggccaagcttgaaaatagtcacttacccaaagttgtctga

SEQ ID NO: 1177 - DNA, 1248 bp, M.catarrhalis
ttttactgtatcacttttcatcttatggctttaattcacttaaaaaatattcatttagcctttggcacagcaccgattttagatggcgttcattttaccctaaaacccaatgaacgcgtttgtttgattggtcgaaatggcgaaggcaaatccaccttatttaagctgattatgcgtcaaatacatgctgatgatggtgaggtactcatcaaagatggtacaaaaattgccatgctggcacaagatgtgccaaatgagtcggccagcgtccttgacgtggtgatggagggtgatgacaaagttgcccaagccttaaaaaactatcatcaagccagtgcaaaatgcgccatgggcgacaatgaagcctgtgatgtcatgagcggtcttcagcaaaccttagacgctctgaacggttgggacttggagcggggtgcgcgtgcattgattgacagcatggggcttgatgccgatgcttgcttatcaacattatcagggggtcgtaaacgccgtgttttgttagcacaggctttggtaacaaatcctgatgtgctacttttagacgagccaaccaaccatttagatattgaaagcatcacttggcttgaaaaatttttattgaatgaacgattaaccgttcttttcatctcgcatgataggaagtttattgatacacttgccacttatatcatcgagcttgaccgtggtcaactctctggctatgatgtgacgcaaggtgtgggtggctatgcacgctaccaagagttaaaagcgcttgaacttgccagtgaagaaaaatcatttgccgaatttgataaaaagcttgcccaagaagaagtttggattcgccaaggtattaaagcacgccgcacccgtaacgaaggtcgtgtccgtgccttaaaagccatgcgtgaagagcgaaaagcacgccgtgatgtgttgggtactgtccaaattagccaaaacaatagcgaaaaatctggaaaaattgtttgtgaagtcaatcacttaactttagaatacgacaataaaaccttagttaaggatttttcaacgctgcttgttcgtggtgataaagttggtatcattggcaaaaatggcgttggtaaaacaaccttaattaaaagcattttgggtttggatgattcagcgattcagtcaggttcagttaagcttggcaccaatctaaatattgctttttttgaccaactcaaagacgacctagaccctgaaaaattctatcgcagataa

SEQ ID NO: 1178 - DNA, 393 bp, M.catarrhalis
attatgagtatacattcatcaaccaatactccccaacaaactgacggcttggtcgatcttgtaacggttttggctgctgttactgatcataaagctcgtatcttaacggtcagcggcggtgataagttgcccagcggtcagctgacacccattcatcattcactacaagctggtgttaaagactgggtacgcacccaaaccgctcagccaatgggttatgtggaacagctgtatacttttgtagatggtgagcgtaaaaacgcacaaggtatgcccgttttgtatgtcagctaccttgggttggttaaagaagcgactgcccacagtcttaatcctgatgccacttggcaagattggaatgattattttccatgggaagatcgggcgtattag

SEQ ID NO: 1179 - DNA, 1077 bp, M.catarrhalis
aataagagtattattatgaacacaaccaaaaaacgcatcctaacaggtatcaccaccactggcattccccatttaggtaattatgttggatccattcgccccgccattgccgaggctcatcgtgcctttgagaatcatgatggagatgcgtttttctttttggcagattatcatggtattattaaatgttttgaccctgatgaaattcatcgctctactcgagcgattgccgccacttggttggcatgtggtcttgatcctgaaaaagttattttttatcgtcaatcggacattcctgagattcctgaattggcatggatactcaattgctcatgtgccaaggggctgatgaatcgtgcccatgcttataaagccgccgtcgatatgaatttaagtaaagaagataccgatcctgattatggcatcagcatgggattatttggctatcctgtcttgatggcggccgatattttgatgtttaatgccacccatgtccctgtgggtaaagatcaaattcagcatattgaaatggcaagagacattgcaggatcgtttaattttaaatacaaacccttatttgtcgagccttttgccgttgtcgacgaaaacacaccgctactgactggtttggatggacgaaaaatgtcaaaaagttatggtaacaccattccactttttggtgatggcaaccctcacattgaccctgaaaaagcgcttaaaaaggcagtcatgcagattgtcaccaattctcaaccacccgaagagccaaaagaccccgagcattgcaccatttttgaaatctacaaagcctttggtacgcctgaagagattgaagcattggcaacacattatcgtcgtggtattggctggggtgaagctaaagagattttatttaataaaatcaatcatgaaattgccccttatcgtgagcgttatttacatctaatgaataatccaaaagagcttgaagaaattttacaaatgggtgctactaaggctcggcgtgttgcccaaaagcagctggataaaactcgccgtgccattggcatcaagccacttgccaagcttaaatcatga

SEQ ID NO: 1180 - DNA, 1053 bp, M.catarrhalis
gtgggtatcttgtccttattaatcctgatattaagtacgactatgacccaaaaagttcgcaatacgccaaaatctattctcaataatagccagactaggtctcaaatcaatccaaaagaagatacattaggtactatcttgcccaaacaagctgccactttgaccaccaaaagtatgcaaaaaacacccaaatctcaggttgtcgctgttaagccaaatgacattgtaccatccaagtcaatctatcaaactgccaatcaagtgcttcgtgtcgtttctattaatgtcaatggcttgcgtgcggctgaaaaaaaaggattctttgagtggctggctgtcagcaatgccgatgtggtctgtatccaagaatcacgcatcactcatgaacaatggacggataaatttcgcccaaagggctggcatacgcatctatttgctgcccaaaaagcaggctatgcaggagttgctatttatagccgcctaccttttgtgtcggtggtagatggcttgggttttgatcttgccgacagtcaggggcgatttatctgcgcacagtttgatttatccgcccaaggcatcgaccatccagtgtatattgcttctttatacctaccttctggctcatcaggcgaagaagctcaagccagaaaagatctttttttagaaaaataccgccacattcttaaacagtggcgagatgagaataaatcactcatcgtctgtggtgattataatattgtgcataaacgcattgacatcaaaaactggtcgggtaatcaaaaagcatctggctgcctgccccatgaacgggcgtggcttgaccatatttatgacgaacttggctatgttgatacattcagagtggttcgtaaggatgctgatatttattcctggtggtcaaatcgtggtcaagcccgtgccaaaaatgtggggtggcgtatcgattatcacgcctgctcacctgattggaaaaaacgcaccttgaacgcttgggtctataaagattcttggtttagcgaccatgcacctgttattattgattatcaattataa

SEQ ID NO: 1181 - DNA, 669 bp, M.catarrhalis
aatttcatcatcagcgttcgccggggggcatcaatttctacaccccctgttcgtgaacattgccaccgccgacctgaaaaattgcgtttgggtccaatttttgtactacatgcaattttagactttattgttgataactatttaccaatcactgaccgattgggcaattatttgcgtgagcaagaacgcaatatcttttcacatgagtttagcaaatccaccctaaaaagtttatatgaactaaaatctcaactggtgcatatgcgagcggtgattttgcctgttcaagatgtgtgtaacttttttattaatcataaaaaaaatgaattggtctctgcttttcctgttgccgccaaaccttattttcgtgatgtcaatgaccatcttttacgctcaattgatgccgtcaatggcctaaatgaaatgctctctgtggcaatggatacctatatggcgatggtgacaatggggcaaaatgatgttgtccgaaaattggcggcttgggctggtatcgctgccgtaccgacggcggttgctggtatttatggcatgaactttgattatatgcctgagctacatattcgatatgcttattttgttgttgttggtgcggtcatgttggtttgtttgtttttatacaccaaatttagaaaagcaggttggttataa

SEQ ID NO: 1182 - DNA, 1071 bp, M.catarrhalis
tcatcagacattaaaattagcagggcaatggtcatgaagaagcttgagttggcattgacgcaggcgtggcaaaaaaatgcagcttggctaaagctgttaacacctctatcggggctatatggtatggttatgcatgctagaaaatctttgtatcactcaggtaaatgcccaatttatcgggcggctgtacctgttcttgttattggtaatatcactgttggtggcagtggcaaaacgccattcattattgctttgactaaaattttacgcaaacaaggtatcagtgtcgctgtcatcagccgaggttatggtggtgacagcacacaaatgcccaaattggtcacgccaacaagtacgcccaatgaagtgggtgatgaaccttgcttaattgcccaaagtctgtattctgatggattttttttacctatggcagttgcgccaaatcgtggtcaagccattgatttattactaaaaaattttcctgagacgacactgattatcagtgatgatgggctacagcattatgcactgcaccgtgatgaagagtggattgtggttgatgttgccagaggttttggtaatggtaagcttctgccacagggttttttaagagaacccattgaccgattacaagacgctttggtcctttatcatgataaagatatgaccaaatatcctaaaaaagcgatggcaatgagcctaaaagtagggcaaattgagccactgatgggcaatcataaaagccctgtgccatctgtaggtacatatgttcatgcggtcagcggtattgggcaccctaagcggttttttgacactttatcggatcaggggtttttggttattccgcatccttttggagatcatcatgattttagacttgaggatttggtggatttgatcaatcatcccatcattgtcaccagtaaagatgcggtaaaattgcgtcatttggcgacacaaactacccatgatatttttaatcatatttgggtgctgcctgtggagatggtattatctgatggcattattgagcagattaatcatttaattgttaagtataaattaaattaa

SEQ ID NO: 1183 - DNA, 651 bp, M.catarrhalis
aagatatgcatcatgaaagccttatttgactatattccactcattatattttttgttctttataaaacgaccgaaccaacagacagcacgcatccgattttacaactcattgggtcggcaggtacggataataaccacattttagtggcaacatttgggctgattgccgcaactgtaattatatatgggtatttattcatcagccaaagatttcacctagaaaagcagcagtggtttgtgttactgatgacggtggtttttggtggaatcaccttagcacttagcgacgcattttatatcatgctaaaagcagtgttaattaatggtgcatttgcactggggctactcatctccccattatttagcaaagataaaagccccatcatcaaacgcttgtttgagcctgtatttcacctaacgcatcaaggttggcagtatcttaatttggcttgggtgagtatgtttactgtgatggcaggtttacatacattttttgcattcatttttgcagaggggaaatactggggcgaatttaccgcttttggtgatatgattgtcatgtttatatttttgggtgtgatgtttttttgcctaagaaaaaatatcaaaaaggacattactgagaattctaaaaaatcacttaataaatag

SEQ ID NO: 1184 - DNA, 651 bp, M.catarrhalis
  unsure (607): Identity of nucleotide sequences at the above locations are unknown.
tctttgagcatcactcgcaccatccaaaccaatctaaacacgcatgaattacgcactttgcttggcgaatataacaaacacatcaaatacattcaggaacgacttgaggtccaaatcactcagcgacaagatcagtttattattacaggtgagcttgatttggttgagcgaaccgaaattatcatcaacaaactggtggagcttgctggcgaacagcataatatcagtggagaagagcttcatttaattattcaatcaagcttatctcgtgattatgattatgctaacactcaaggtaagcaccatgatcatagtggcaactcaaaagataaaagcgatactaatgtcgctttgcgtacacgcaaaggcaagatcataccaagaggctacaatcagcaagagtacacaaaaaaaatcttgatttcagatgtatcttttggtgttgggccagcgggtacaggcaagacctatttggcggtggcatgtgcggtagatatgcttgagcgtggagagattgaacggattttactggttaggccagccgttgaggcaggtgagaaattgggatttttaccgggtgatttgacccaaaaaattgacccttatntgcgtcctttgtatgatgcactgtatgagatgcttgggctttga

SEQ ID NO: 1185 - DNA, 1398 bp, M.catarrhalis
tttatcataatatttttaaaaaattttatgaatttttttgggtataatacagaatttaattttgataggtatgatttgggggtgatgatgaatgctgttttgcttgccgtcattgtgatggttggcttatcgcttgtacgggtacatgtggtactaagcttggtggttggggcacttgttggcggtttgatggcgggtatgtcggtcgctgatacgctgacttcttttcaagatggtattaaaaatggtgcacaaattgctttatcttatgccatgcttggtgcttttgcgatggcaattgcccattcaggattgccacagatattggcagataagctgattgctcggttgcagtacgctgatggcacaggtgggcttaagtttttgttattttttatcttaattattatggcaatcatgtctcaaaacattgtgccgattcatattgcctttattcccctaatcgtgccgccactgttatcggtgatgaatcgcttgcatctggatcgccgtgcgatcacatgtattttaacttttggtttggtcaatacatacatgtttattccttatggatttggcgatatttttttgaatcaaattatccttaaaaatatcaatgaagcaggcatgataaccaacaacatctcaatgatgcaaactatgatgatccctgctttgggtatgctgattggacttttgattgccatttttgtcacgtatcgtaaaccgcgtcattatcaagaaaaagtcgtggcggtcagttatgcgtctattcaagtcggtacgcttaatatcgtcgtggcaatggcggcaattgttgcggcatttgtcgcacagctaatgacagattctttattgattggctcactcgtgggttttgcgatatttatggcaacaggtattgttaaatggcgtgatgccaatgaggtttttaatgatggcattaaaatgatggcgatgattggctttatcatgatttgtgctcaaggttttgcagaggtgatgaaagccacagggcagattaatgcgttggtagatggggcggtggttctttttggtgataacaaaatgcttgcggcagtatcgatgctgcttgttggtttggtggtgacacttggcattggttcatcattttcgaccgtccccatcattgcgaccatttatgtaccactgtgtatggcaatgggctttagtgtacctgcgacagtggctttgattgcaacagcaggcgtattaggcgatgctggctcacctgcatcagattctacattaggtcccaccatggggctgaatgcagacggccagcatgaccatattcatgattctgtgattccaacttttatccactataatattccattgattatttttggttggattgccgcgatggtgctttag

SEQ ID NO: 1186 - DNA, 426 bp, M.catarrhalis
gattgtacaataaaggagggtctgatggcttttgagttgggtgatcatgacaataacggcatgaatgagatgaaccttattccgctgattgacatcatgttggttttgatgattatttttttggtaacagcgaccgtgctaaacccaagtgtgccgcttgatttaccaaaaacttcggcatcggtgaatgatgcaccgcctgaggtcttacaaattagcattgatgaggcagggggcatttattgggaccgtgaagcactgaccttagatgagctgagccaacgcttcaccgagcaggttaatgcaggcaaaaacccccaaattaatttgcgtgctgataaagagggtaaatacgataccgtcgcacaggttttggctgaggcatcaaaagcaggattgggcaaaatcgcttttgtcagcgaatag

SEQ ID NO: 1187 - DNA, 2487 bp, M.catarrhalis
tctgctaaaataccctttttaaccaacccactgcgttttttgggcatttcgttcatattttactattttgcacaaaggatagcagacgaagctgattttgattttatgaaagataatgcatatcatcgtttaaaaaacaactaccgattacaagcttgcgacttaaaacgctacaccgatcccaatcatctgcccaaatctagccgtctgcatctgcccaaacctgatattgcatttggtcaaagccgtgccatcaaagccttaaacaccgcattagacatacacgccaatggctatcatgtgtttgcagtcggtgaaaatgggttgggcaagcgtacactcgtcacacgccttttggctgagcgtgccaagcatatgccaacaccgaatgattgggtatatgtacatcattttgaagacatacgccgacccattgccattgattttcctgctggtatggcaattatttttcagcaaaaagtccataaactttggcaaaatgccaaaaaaaagctggtcgccaaactgcttggagatactcaccaaaaccacattgaactgataaaatcagccatacccctacaacaaaacaaacgatttgacgctattaatgctgatgccaaacaacataatttggtactaaagaccacaggtgatgggcgtgtgcattttgtggcaattgatgacagcaaacctatagataccaaaaagctcgcccagcttcaaaaacagcttttagaggcacaaattgagcttagtgagcttgaagacagcacgcatgaggcacttgatgagctacatcaaagtactgccaaaaaagtacttgaacccatgtttaacgctgtgatggcaaactttgagaaccacccaaaagccatccgtcatctcatggcgattcaagatgatatggtcaaaaacattacccatatcatcaatgaagatgatgacaattttatcgccaccagtttatcacaagtaccaagccgatatgtcgtcaatatcttggtcagccatcagccatcagctggtgcgccgattgtatttgaagatttgccaacacatctaaacttacttgggcatattgaatataccaccgagcttggtactgtcttaacagatgttagcatgattcgagctggtgcattacacaaagcaaatggcggctatcttttattagaagcccaaagcctacttgaacatccctatgcatggcaaggtttaaagcgtgctttgcaatcaaaacaaatcaaaatctcaagtcttgaacagatgctcactttgacaggcagcctatcgcttgagcccgatagcgtggcattggatgtcaaagtcatcttacttggtgaagctgatttatattatgaattgctagaatttgaacctgaatttaattcggtctttaaagttcgtgccgattttcatgatgacattcaacgagatgactgtagtgaatatggcatggtattaaaaatggtggatatgattaaaagccatcagttgcccaattttgataataccgcatttgctgtaattattgatgaattatccaagcttagcgatgataaaaataagctggacttacacgccgatcgcttgtcaggattattggttgaatctgcacgaatcgctacccttgaaaataacaaaatagtcaccgccaagcatgtacaaaccgcacttgatgacatcactgaacgaaaggggtatttaaaggatttgtattggcaggagattttaaacggtcagcaaattatctgcaccaaaggctgggcggttgggcaaatcaacgcattaaccatcatcagctatgctgatagtgaatttgggctacctgcacgcttgaccgctttgattcagcccaactttggtcaaggtgagattttagacattgaacgagatgttgagcttggtggtagcttacacgccaaaggcatgctcatcatgtccagttttctgcgtgccttatttagcgaatttcatgaattaaatttcagtgcgtctttagcatttgagcaaagctatgggcaaattgatggcgatagtgcaacccttgccgaagcgtgtgcccttttatcggctttagccaatattcccattgcccaaaatcttgccatcacaggttcaatgaatcaattagggcaagctcaagcggtcggtggtgtgaatgcaaaaattgctggattttttgatgcttgccgtgataaagggcttgatggcaatcaaggggtcatattaccacgcgctaatattgcccaactgatgctgcgtgatgacatcgtacaggctgttaaagatgaacaatttcatatttatgccatcgaccacattaccgacgcccttgcccttttgtcaggcatgctcattgatgataaaaataagcatggcgagtataagcgtaatacattgtttggcaaaatcgtcaaacgccttgaaagctgggtacaagatgataaagacgacaaagacaaccgaacagctaaaaactaa

SEQ ID NO: 1188 - DNA, 1149 bp, M.catarrhalis
tttatgggaatttatttaacggcaaccggtctttataaacctgcttatcaaattagcaatgatgagttggtggctgcatttaatacttatgttgataattataatgccgaacacgctaaggcaatcgcagcaggtgataaggtggcccttcagcactcatcaagcgaattcatcgaaaaggcatctggtatcaaatctcgttatgtgattgataaaaaaggaattttagatcccaaaatcatggcgcctatttttcctgctcgcaaacttggcgaggagttgtcagtgatggcagagatgggtttagcagcactcaaagatgctttggatcgtgccaagctgacggctgatgacctagatggtattatttgtgcatcatcaaatttccagcgttgctatcctgccatcgccatcgagattcaacatgccatcggtatgcagcatggctttgcttatgatatgaatgtggcttgtagtgcggcgacttttggcattgcccaagcggtaggtagcatcaaagcagggcttggcaaaaaaatcgctgtgctaaatgttgaaattacctcagcgcatcttaattggcgtaatcgtgatagccactttatttttggtgatgtggcggctgcgacgattgttgaggagttgtcaaccccaaaaggttatgaaattcttgacagtaagctatacacacaattttctgccaatattaaaaatgagtacggttttatggatcgtagcgagtttttggcagcagatacacaaatgtatgcagacatcaaagagccagttactgataagcttttcttacaagaagggcgtaaggtattccgtgaagtttgccccaaagtttcagaaatcattaccatacatttgaccgaaaataacttatcagccgatcaaattaagcgtatgtggctacatcaagccaatattaatatgattgatttgattttgcgtacggtcgttggaaaagatgcggataaatccattgcacctgttgtcattgcagaatatggcaataccagttcagcaagccctgtggtagcgttccatgagactcaagacggtgttgaaagcgaagatctatgcgtaatgtgttcttttggtgctggttattcaattggatcggtattactcaaaaaagtataa

SEQ ID NO: 1189 - DNA, 1863 bp, M.catarrhalis
ggaataacgatggctgaagctggtatggcaagcgagctgattaaagttgtgacactgcttggagctgccgtaatcgcagtacccctttttcgtaaaattgggttagggtctgttcttggttatttggctggtggtctgataattgggccatttggcttagggatatttaccgacccacagaccatcattcacaccgctgaacttggtgtggtgatgtttttattcattatcggtcttgaaatgcacccatcgcatttgtggagtcttagacgacaaatctttgggcttgggtctttgcaggtattaggtgcaaccgccttaatgatgttggtactcaagatatttggggtatcatggcaagtggcatttgtgggggcatcagggtttgtgctaacctcaacggcaattgtcatgcaaactttgggcgaaaataatggattgtctaccgccaaaggtcaaagcatggtatccatcttattatttgaagacttgctgattgttccgctgttagccattgtggcttttttatcgcctgtggtgcataccagtgaaacaccagcttggcaagcgattgctgtggcattgggttcattactggcattgttgatcgttgggcgtgtactgattaatccattatttacgatacttgccaaaactggtgtacgagagattatgacagctgcagcgttattggtcgtgctaggatcggcactactgatggagcttggcggtctgtcgatggcgatgggtgcattcgttgcaggtgtgctgttatctgaatccagctttcgacatcaacttgaagcagatattgagccttttcgtggtcttttactgggcttgttcttcttaggcgtcggtatggcacttgatttatccatcgtgaccaaaaactggcaacttatcagtcttggcatcatcgcactcatgctcaccaaaggtctttggatttattttgtggcccgtatgaccaaagctgggcatgccatcgctattgagcgtgcagtcatgatggcacaaggtggtgagtttgcctttgtgctattttcagcaacagggacgcattcggtcatatccgccgatacacatgctaatttaacagcaatcgttgtgatgtccatggtacttacgccgctatttttagtgattcatcaaaaatacaccgccaaaaacacatcgccagcgtctgtaagagacagtgatgccattgatgaagaaaatcctatcattatcttaggacatggcagatacgggcaagttgtcaatggcatgatgaccgcatgtggttatcagaccacattgattgatagtgatgctgaccatgtagatggtttgtcaaacttggggattcagacttattatggcaatgccacacgatttgatttgcttgatatggcaggcatcgccaaagccaaactggttttaatcgctatcgatcatcccaaagaggcactgtccatcgtacgccatctacgccacacctacaacgatttgccaatcgtggctcgtgcttatgatcgcattcatgcctaccaattgcacaaagcaggtgccagtgcggtaattcgtgagacttttgattcagcggtacgcagtgcccgtacagggcttgagcttttggggatggatagcgagattgctgaacgcatcgcacatctgtatcatcaccgagatcgagatggtgtggcagctgctgccgaaacatacgacccaaacatcagccgctataaaaatacgcatatgattagcatgctcaatcatcatcgtgcacataccaagatgatgattgaaaaaatcttgcgtggcgaagaagtcaaatggcaaccaaagcgtggtacttatttaggccaagaaaatcaatag

SEQ ID NO: 1190 - DNA, 2310 bp, M.catarrhalis
tcaaaaactgtattcaaaacttttggagccataatgacgcacattgatacaattaaagtcaccaagagagatggtcgccttgaacccattaatcttgataaaattcaccgagtcattgcttgggctgctgaagacttaaataatgtgtctgtttctcaagttgagctaaaatctcatattcaattttatgaggggattcgcacccgtgacattcacgaaaccatcatcaaagccgccgctgacctgatttcggtagaaacgccagattatcagtatttggcagctcgtttggcaatttttcacctgcgtaagattgcttatggaaagtttgaaccaccgcatctgtatgctcatgttaagcatcttaccgaacaaggtaaatatgatcagcacattttggcagattacagtattgatgagtttaatgagctcaatgattatgtggatcataaccgtgatatgaacctagcatatgctgctgttgagcaaatgatgggtaagtatttggtacaagaccgtgtgaccaaacgggtttatgaaagtccgcaatttttatatgtgttggtgggcatgtgtttatttgcaggctatgataaagcacaacgccttgactatatcaagcgtttttatgatgccacctcaaatttttacatctccttacccacaccgattatgtcaggggtgcgtacaccgacacgccaatttagctcgtgcgttttggttgaatgtggcgataatcttgatagcattaatgccacaacatcagcaattgtgcgttatgtctcacagcgtgctggtattggtgtcaatgctggtgctatccgtgcgcttggcagcccaattcgtggtggcgaagcacagcacacaggctgcattccattttttaaaatgttccaagctgctgttaaatcatgttctcaaggcggtgttcgtggcggtgcagcaactttattctacccaatttggcatttagaagttgaaagcttattggtgctaaaaaataatcgtggtgttgaagataaccgagtgcgtcatatggattatggcgtacagattaataaaaccatgtacgccagattaattaaaggcactgacattactttattttcaccctcagatgtcccagggctttatgaagcattctttgccgatcaagaaactttcgagcgattatatacccaatatgaagccgatgaaaatattcgtaaacgcaaagtacctgcccgtgatttatttagcctaatgctgcaagaaagagcaagcacaggccgtatttatattcaaaatgttgaccactgcaacacacatagcccctttgatccgacggtcgcaccgattcgccaatctaatttgtgcatggagattgccctgccaacagcacctttggataacatcaatgatgaaaaaggtgagattgcactgtgtactttatcagcgattaatttaggtaagattgaaaaattatccgatatcgaagagcctgctgagctgatcgtgcgtgcgcttgatgcgttgcttgattatcaagattatcctgtaattgccgccaaaaaaggcagtactaatcgtcgcactttgggcgttggcgtgattaattatgcgtattatttggcaaaaaatggaactcgttactccgatgcagcggcgcttggtttaacccatcgcacttttgaggcactgcaatattatttgctcaaagcatcaaacaaactcgccaaagaacaaagtgcttgcccttggtttgatcaaaccaaatacagccaaggcattttgcctattgatacttataaaaaggatttggacagcatttgtaccgaacctttgcatcttgattgggaaagtctacgcacaaatatcaaagcctacggtttgcgtaactctaccctatccgccttgatgccatcagagaccagctctcagattgccaacgcaaccaacggcattgagccgcctcgtggtttggtatccatcaaagcgtctaaagatggtattttaaagcaagttgtgcctgagattgaacgcttggcaagtcaatatgaactgctttggaatattcctgataataatggctatctgcgtttggttggaatcatgcaaaaattcattgatcagtccatctctgccaacaccaattatgaccccactaaatttgaaggtggtaaagtcccgatgaaagtgctgattcaagatctgctaaccgcttataaatttggtgtcaaaactttatattatcataatacgcgtgatggtgctgatgatgcccaaggcgacttggacgatggctgtgcaggtggtgcgtgcaagctttaa

SEQ ID NO: 1191 - DNA, 246 bp, M.catarrhalis
gataggtgcttatatttcatggcaactggcttaagccctgctttttcaaaacgagcgatgatatcgccgatatggtttttgccaactgcgtctggcttgatgatagataaagtgcgttcgatagccatagtttttccttatgctagattaagtgacagtaaaatcgtgattgattataacaatttttctaacaacttgcatctttttaaatcagtttatggtgaaatttttaccgctggcttatga

SEQ ID NO: 1192 - DNA, 1086 bp, M.catarrhalis
cgtatattttttttaggatttattatgacattaattaagcctttaagcttagtaatgataagcttactaagcatcggcattgcccatgccaatactgatggcgatattatctcaggcgaggtcatcgtcccaacccaaaccgatgatactgtcattaacagtatcgagcaagggggtaagcgtacaacaatacacaatttggacgaatacgctcgtcgtgtcaatgagtcgctatggacacaagacatgaaagtcaatactgccatgaccgtaaaaatgcaagtattgcttgactggaatcacgcctcccctggccctattgatggtggttggggcatgaattcaaaaaaagcattaatgaattttcaaaaaatcaaggggcttgagccaacgggtaaaatgaaccaagctacttgggatgcgttgaaccaaaatattgcgaccaatcaacctgttttggtcagttataccattaccgaagctgatgctaaaggtccttataaaaccctacccaatgatgcagaatctcgttcaaagttaaaagctttaggctatgaaagtattcaagagatgcttggtgaaaggtttcatatggatgtggcatacctaaaaaaactcaacccaaataaacgctttgttgctggcgaaagcattacggttattaatactggcaagccatttgaaggcgttgttactcgtgtggttgctgatcgtaaagataagattttatatgcttatcatgaagaccagcttgtcgccacttacccaacaactgttggcggtgaggcaagtacaacaccaggcggtaagtacaaaatcatcaataaagttaaaatgccaacttataaggccaccgtcaatcgtgatgatgaagacaacaaagtctattatttaccaccaggaccaaacagtcctgtcggtgtggtttggatgggattaaataaacccagctatggtattcatggttcgcccataccagagggcattagtcgtcaatcgtcgctgggctgcattcgcctgaccaattgggatgtgctagaattggtcgctgtcatcgaaaatggtgcgacggttgagattcgttaa

SEQ ID NO: 1193 - DNA, 606 bp, M.catarrhalis
gtttttaaagttttaggagtggcgatgaccatagtttattttattcgccatgctgaacccaattatgccaatcgtgatgagtttagccgagacttgaccccaaaaggcattgcccaaagcgagcggttgcttgatgtgtttaggggtattgatattgatgtgtttttttcaagcccttacaaaccggcggtggatacgatttatccgcttgccaacagtcgcaaaaaaaacattcatctaaaagagaagctttgtgaaaggcggattggcacttgggtggataattttgatgaatttagccaaaagcagtggcaagattttggatttcatctaaaaaatggtgaaagtttgcaccgtgtccagcaacgaaacattgctatgttgcatgaaattttgataaattatcccaatcagacgattgtcatcggcacgcacggtacggcattatctaccatcattaagtattatcaggcggattttggttatcaggattttaatgccaataagcacaaatttccgtggataatggcatttgaatttgacggtattatgctaaaacgctaccacgaaattagccatgaaatccacatggacgatacgccatga

SEQ ID NO: 1194 - DNA, 498 bp, M.catarrhalis
atgatgaaagttatttttgtacgacatgggcaagcagccccgtattgtgaagatgatgcagggcgagatcttaccgactttgggcgtctgcaagtacagcagacagcacagtatcttgccaagcattatcagcttgatctcattatcgcaagcccctataatcgtgccgatcagactgctaagattttgttatcttgggcgatgactttgggtcaaaatccaagttttatgagcttaaacagtattacgcccgatgataatcctatgattgctatcgatgaccttgaagatatcgtgcgtacaaagttcggtgaagatctggatgataaatgtgttgcggtggtctgccatatgccgattgtagcgtctatggttgccaggcttgagaatttaagcccagcctcatttgagttggcagaagcacggattttacaaatgccagttttggcacaaggtttggcaacgacccaagatgtgtttatccccaaccaatcttaa

SEQ ID NO: 1195 - DNA, 261 bp, M.catarrhalis
gtgagcttattaagtgattatttattaagtaactatttattaagtgattttttagaattctcagtaatgtcctttttgatattttttcttaggcaaaaaaacatcacacccaaaaatataaacatgacaatcatatcaccaaaagcggtaaattcgccccagtatttcccctctgcaaaaatgaatgcaaaaaatgtatgtaaacctgccatcacagtaaacatactcacccaagccaaattaagatactgccaaccttga

SEQ ID NO: 1196 - DNA, 705 bp, M.catarrhalis
ttggttaaattgattaagaacgatgatatgacgcccaaattttccaaaatctcccataaatttcaacgcttcgccactgccattgatgaggcagcccaatcgcttggattgacgattaccgatgtgcaaaatatgcagattttacggtatttagacggccttttattgtggggtaaagcgtacaatctaaccgctatcacagaccctgatgaggctttggtgaagcatatttttgattgtatggcgattatacccatgctgccgtttgtcacgcaaccaaacaaatctttgctagatattggtacaggtgcaggattgccatcggtaattttggcaattttaaagcctgattggcacattgatgctcttgatagcaatcaaaaaaaaatccgctttattcgccagattagcagtgagattggcttaaaaaatatcatgccaattgcttctagaattgagcatcatcatgcccaaaaagcaggtgcgtacgatgtgattacctcacgggcatttgcgtcactgactgattttgttagccttgctacaccatgtttggcggatacaggtgttttgtatgccatgaaaggtaaaaatccgaccgctgaggagatggcagatttgcaagcttggcacatagatattgagcccatctgcgtacccaaattagatgacgatcgatgtgtggtttacctaacaaagcagtaa

SEQ ID NO: 1197 - DNA, 840 bp, M.catarrhalis
tttgataaattttggtataatgacaaaatttcacacaacatacgagaatttattatgggttttaattgtggtattgtcggcttgccaaatgttggtaaatccaccttatttaatgcactcaccaaagcaggtatcgctgctgagaattttccgttttgtaccaaagacccaaatactggcattgtccctgtcccagacccacgcttaaaagcactggcagctattgtcaatcctgaacgcaccattccaaccagtatggagtttgtagatattgcaggtcttgtggcaggcgcttctaaaggcgagggtatgggcaaccaatttttagccaatatccgtgaaactgacgccatcgcccatgtggtacgctgttttgatgatgacaatgttatccatgttgatgggcaggtcaatccgttatctgatattgaaaccatcaatacagagcttgctttagcggatttggaggcggtcactcgtgccattacaaacttaaataaaaaagccaaaggcggtgataaagatgctcaagctgctctaggggtcttccaaaaaattgaacctttacttgctgatggcaagcctgcgcggttggcggacttagatgccgatgaaaaaaagctgattaaaagctatggtcttatcaccttaaaacccgtcatgtatattgcgaatgtggcagaagatggatttgacaataatccacatttagatgcggtgcgtgaatttgctaacaatgaagacgccatcgtggttgccttatgtaatcaaattgaagctgaaatcgcccagcttgatgaagaagaaaaagcagagttttttggagggcatggggcatga

SEQ ID NO: 1198 - DNA, 516 bp, M.catarrhalis
  unsure (21): Identity of nucleotide sequences at the above locations are unknown.
cccaaaaaattgacccttatntgcgtcctttgtatgatgcactgtatgagatgcttgggctttgaaaaagttggtaagctgcttgagcgtcaagtgattgaagttgcaccgcttgcttatatgcgtggacgaacactgaataactcatttgtcattcttgacgaggcacaaaataccacgccagaacaaatgaaaatgttcttaacgcgtttgggctttggttcaagagcggtgattacaggcgatatgacgcaagttgatttgcctcgtggtcacaaatctggcttggctcaagctttacaaattttatccaaaattgatgaaattcatatcactcgctttgatagtaacgatgtggtacgccatcatttggttcaaaaaattgttcaagcttatgatcaatttgatgaggtgcaacaggcggcagccgccgaaagaagagcactgcatctgaccaaacagtcaattgccaatgaagaaaaaaccgaattacaaggggctgtcgatgcccaatga

SEQ ID NO: 1199 - DNA, 387 bp, M.catarrhalis
ttaaatgaattaatctacaattggggatttatgatgaaaaaattactagcagttgccgtcttgggcggattattatcggcttgcaccagcacatctacgaccgcacctgtcattacacgcactgatggcattcacgaaacaacaggtttgggtgtaaccaaaaccaaggcacaagagtctgccttggcagctgccaaaaagcaatgtggtatccaatcgcccattgtggtatctgataagatgacttataatggtattcttaatgaacacacagggcgcatgattgagcaaggtgtgagtgttgcgggtgctatttttggtcaatcagcaccaaaacttagccgtgatgatgattttgaatatgccataaaatttcgctgccaataa

SEQ ID NO: 1200 - DNA, 969 bp, M.catarrhalis
gtggataattccaaaaaaatcaaagtgttggctatctctatcgcagctgtcttgcatggattggtaggttttggattggcgaatatgactataaaaccaatcacaccgccacctgtcacaccgcctttagagattgaatttatcaaagaaccagtgcctgaacccatcgcacttaatgaccttgaatcgcccgaaccaccaggcgaacctgttgttacaccagagcctgttgtagagccagaggtcgctacgcctgaggttattgagccgcccgaacccattcctgaacctgagccattacctgagccattacctgagcctgagcctgagcccgagattgatgtagaagccatcttagaacaacaaagacttcaagaggcttgggttgctcagcaacaacaattggccaaaattcaagaacaagagcgacttgaacaagaacgccttgaaaatgaacgcagggaacaagaacgacttgaacaagaacgcttagaaaacgcaaggcgtgagcaggagcgacttgacaacgaacgcagagccagagaacaagcacagaaagaagcccaagtggctgctgcaaggcgagcggctgcccaagcggcggctaatgctgccaaaaaagcaggcaatcatgggggcggtcagcctggccagaatcagaccgtggaaggtggtattaatatcagtaatgccagctggaaaaccaagcccagagtgaataatttttgttcagcaagaagtgatattgacaccacgcttcaagtgagtttccgtgttgatgctgagggtaaaatctccaatgtcaatttaaatggctcaacaggcgatgccaaattagaccgacagattatccgtcaaataggtcgtggtcgcctgcatccatttagagaaggtaacatcacgcgtgttggcactgcaatttatccgattacgctaaaattacaaaaagatgagtcttgtaccaactaa

SEQ ID NO: 1201 - DNA, 1131 bp, M.catarrhalis
agctcaatgtccattttggggcaaccgatgctcataagcttatcaatgccgtcatggataagattgccaaaaatgtgcgtcagccagaggtgcaagctgataaataaaaacacggattgctctttttatccgctaagttttgtccatcaacccatcatgtccgaattttccctaatccatacccattttaagcacctaaccgccccccaccaacataccgtgttgggcattggtgatgactgtgccatcagcaacattcccccaaacagtcagctggtcagctgtgtggatacgctggtggcaggacggcattttgtccatgagaccagcccccacgccatcgcttacaaatcggtggcggtcaatctgtccgaccttgccagcatgggagcgacgccttatgccattttggtgggcttatctttaccaaagttcatggcaaatgacaacttttgtcaggcatttgcagagggtttggcggctgcttgcacaccgtttgggatagagctgattgggggagacaccacaagctcacccattttaacgatttcagtaacggcacttggatttgtgccacatgggcaggcaatcacacgccaaggggcatgcgtgggcgatgtggtgtgtgtcagtggtacggtggggctggcaagccttgctttgcatgggattttggacgatttacatggagacggacacgccaaccgaccgccaaagagcttgcctgaaaaattacgccaagccatgcaataccccgccccacaagtggcacttggcaggcagctcatcggctttgcaaatagcatgatagacatctcggacggtttggggcaggatttggggcatatcttaaccgcttcaaatgtcggtgcggtgattgaccttgatgccatacccagtgatgccttgcttgatgccttgccccatgcccaaaaatggcaacatcaaatcaatgggggcgatgattatcagttgtgcttgaccatgacaaaagcaaattttaaacaatttaatcaatcatatccaaacagcatttttgccattggtgaaattgtggcacaagaagggttaacattgatttttaatcatcaaaaagtggatttaacagtacaagggtgggagcatttttaa

SEQ ID NO: 1202 - DNA, 813 bp, M.catarrhalis
ccgtttttacctttgtttattgattgtttaaggaaaatcatgttagccaaacgcctaattccttgcttggatatcgaaaatggccgtgttgttaaaggtgtcaattttatcgacattaaagacgcaggcgaccctgttgaggttgccaaacgctacaatgaccaaggtgctgatgaaattacctttttggatattaccgcaagctcagatgggcgagatactacctatgagatggttgagaaaattgctcgtaccatttttattccgctgacggtcggtggcggtgtacgcaagcttgaagacattcgcaatttattaaatgcaggtgcggataaagttggcatcaattctgctgccatcaccaatcctgatttcgtcaatgatgctgccagccgttttggtaatcagtgcatcgttgtatcaattgatgccaaacgagtaggcgacatcgatggacagccccgttgggagatttttacccatggcggacgcaaggccacaggcattgatgcggtgcaatgggcggtagagatggccaagcggggtgcaggcgagcttttggtaaccagcatggacggtgatggcacacgccaaggctacgatttattattaacacgcaccatcagtgatttggtgaatatccctgtcatcgcctcaggtggtgtgggcaatttacagcatctggcagatggtatcttaacaggtaaggctgatgcggtattggctgccagcatttttcactttggtgattataccattaaacaagccaaagaatttatggcaaaccaaggcattaccattcgcccaatttag

SEQ ID NO: 1203 - DNA, 498 bp, M.catarrhalis
attatgacaacttataccgaacaaaaaaatgccgtaacccatattgatggtgcgttacatgaaaatgccaatttgcgtattgggattgccgttggtcgctttaatggctttttggttgaaagtttggtagagggggctttggatgctctgctgcgtcatggcgtgctgggtgagaacatcacggttgtgcgtgtaccgggggcatttgagttgcccttgaccaccaaacgcatggcggtcacgggcaattatgacgccattgtcgtgcttggggcgattatccgtggggcgacaccgcattttgatatcgtggcaagtgagtccgccaaaggtttaagccatgtggctttgcatcatgacattcctgtcattaatggcattttgaccaccgaaaacattgaacaaaccattgaacgagctggcacaaaagcaggcaataagggttatgaggccgccatgactgccattgaaatggtcagtgtcttaaaggctctttaa

SEQ ID NO: 1204 - DNA, 852 bp, M.catarrhalis
aagatgaatttctctatttttgatgtatttatgttggtttatctaaaagaattggaaaataacactgaccttttagaaaatttaggtaaagtggtttttcatcttgatgaagccaattcagataaacaagccaagtctatcatcaaagattttatgttacgcaacccaattgtatcaacagattgtaatttagaaattcatcaagaaactcagatttttaaatacccatcaatgaagtttattcacataagacaggtttatttacaagatgaattgaccgaaccacttaaaaaattgataaaatctaaaaaatcaaattcggtttataccaatccagatatttttatagaattatccaatgggaaagaaacagagttttttagtgtagaattaaaatctactaagaaaaatgaaataccgggatcaagtgtgcaacaaatcaacccttatgaatgggttatttttatcaaacaaggaaaaccaattgaaattaccacaggattttacttgaatagcattaccgaaaaagtacaattcccagatagaagcccaagaccacaagtttcttttaatacattaaaaaattggaataagaagaattttatttctgaaaacaactcacttatttttaaaataactcaatctgaatgggataataaaaatcaactgattagaaactggaaaataacactcgttgaacaatggttaaaggtggtgttggataaaaatttaactttaaccagtcgctcaccttggtttaatgaaacattaatcatgtatactgataaattattagcccactatgaacaattatcaaaaattgataaagaaaagttaagagataaagtcttc

SEQ ID NO: 1205 - DNA, 954 bp, M.catarrhalis
catcatggtcaaaaatcccgacttgatgaaacgcttggcaagttatcattgggcaaaggtgaaataatcatgtgtcaactgcttggaatgaatgccaatacacccactgacattggatttagctttacagggtttagaaagcgtggcggacttaccgactatcatgaagatggctttggcattgtcttttttgagcggacagcattgggtgatattgggcttcgtcagtttcatgatgataaacccagccatttatcgcctgtggctgatttggtgaatcattatcccattgaagcgatgaatgtgattgcccatattcgcaaggcaaccacagggggtcatggactggccaatattcatccttttgtgcgagaagtttggggagaacaatgggcatttgcccataatgggcagatgagcgatggctttattcgtcgcacccaaaggctgatgactaatggtaatgcagaacattatgcacctgttggcaccacagacagtgagcttgcgttttgttatctcttaaaccgcctaaaagcaacctttaaaacacgcccaacctataagatgtggtttgcttttttgcgggcacagtgcatattttggcaggcaaatggcctgtttaatagcttaattcaaaatggcaatgggcaatgggcgtatgcaggcagtttgttattttatttgacacgcaaagcgccttttggtgaggcgacgctgtctgatggcgagatgacggtgaattttagtgatgtaactactgataaagataaggtcacgattttggtaaccattccgttgactgacaatgagcaatggcagcaattagcggtggatgaatgtatcgtttttcacgatggtgagatggtgttcaaagacaccccaagcaaaaaaacttatctaagcattgaagaaggcataaagctggcatgcagtgtgggagctagcgtatga

SEQ ID NO: 1206 - DNA, 606 bp, M.catarrhalis
gataacgataaaataggaaaagcaatgaccagccacaaacctgacattcgtcaagcaaacccttgcccgccttgccctgccaccgccacggcttgggagaaggcgatttattggcttggggttgggcttggcacaggtttgcctaaaaaagcccccggcacttggggaacagtgggcgggcttatgattgctttgcccatgcttttgttgggattttgggggtttttggcggttgtggcggttggctgcttggttggcagttatgtgtgtggcaaaacttcaaagctgatgggcgtacatgatgacccacacattgtctttgatgagtgggtgggcatgtggatttcgcttttgccaagtgtgtggtcgcttgctcaaacacaaaatgcagctaaaactggcttagagtattgccacccaagcactgcgttattattcattgtcccttttgttttatttcgcttttttgatatcatgaagccccctccgattaaatgggtggacaaaaatgtctctggtggatttgggatattgattgatgatgtgttggcaggggtgatggcggtaattttcattttcatgcttagttggtttatgttttactaa

SEQ ID NO: 1207 - DNA, 591 bp, M.catarrhalis
actgtgtccaaaaggcggtgcaaaatgactgatgccgccaaagcacaagatgacaagcaacaaatcaaatccaaaaaacgagttgccgattttggcgaagtgtttaccgccgagcgagaagtaaacgcaatgctaaatctattgccagagacgatttggcacaacatcaccgctacttttttggagccttcgtgtggcaatggcaattttttggcagagattttaagccgaaaattaaatgccgttcttgaactattatccaccaaaaaaatcaaaaagaaacaccaagcctttaattacggcttttatgccattggggcggtttcatcaatttatggcatagaaatattgcccgataattgtcatgaatgccgtgagcgattattaaatttatttaccgaacattatcaaacgcattttaaagaaaccgacccaaatatcatcaagatcgttaagtatttgctgggtcaaaatatcgtgggtggcgatgctttaacgctaaaagatttaaatggaaatcccattgtatttagtgaatggaagttcatcagcgaaacgcttatccaaaggcgtgattatatggtcatctaa

SEQ ID NO: 1208 - DNA, 1962 bp, M.catarrhalis
agcatgaccaaacaaagaaaaaatccaaaaactggctcagcgacgacagcagcgtctttacaccgtccaaaggcgtctgccaagacttttgggattttaaccaaaaaacgcatcaaaaaatctggcgctaatttggctggtggcaagcaagatgcttggcgatatttgatcattggggggttgatgctgtgtatatttatggcgatttttgcacgcgcattttatctacagatcgtcaatccgcagttttttattgataaaggtgatgagttgattacgggcaaacgcattgaacctgcgtatcgaggtgtcatcacagatcgtgaaggtgcacctttggctgccaatgcaccattatatacggtattttttgatccttatgcctatgccgaagaatattatcgcttggacaatgaaataaaaaccaccaaaagtgaaaccgccaaacaaaaagcactcaaaaaactcaaagaaatggacttggttaggttggcagcggcggcaaattatccgcttgaaaaacttgaagcggctgttgggattgatcatacacttgacacctctaatagccaaaaagtcaaagaagctttaccaaaaggtgcaagctcacgccgtttggtgctattaaaccgtgtatcacctgaagttgccaaatccgtcacagatttggggttatttgccattggtcgtgagcagtattttcaacgctactatttacaagctgaacccaatgcacagcttttgggttatatggctcagtcaagtgacgagactcaaggcggctatattgggcgtgcaggcattgaggctaaatataatgagcgtttggcgggcaaagatggcaaggtacagattttgcgtggtactggtcggcagcccattcaagagattgagcaaattgaaccgcttattgaaggcgaaaacattcgcttaacaattgactcacgattgcagtatgtgctttataaagagcttgagcaggttgggcgtttgcagtcggcgcgttcaagctcaggcatggtggttgatgttaagacgggcgaagtgttggcgatggggtcatggccatcttttaattctaataatttgtccgaacgagatggtgctaacgaaagaaaccgccccgtgcttgatgtgtttgagccaggttcggtgatgaaaccgttcacagtggccgccgcacttgaatctggcaaatacaccacaaattctgtgattgatacaagcccaggcagtatgtcggtaggtggatatacgatccgagatagtggtaattatggcgtcatcacgctagataaactgatccaaaaatccagtaatgttgcctcaacaaaaattgcgttaaatttaccgactgatgccatcgctaatatgcagcttaaatttggctttggccgcaagacggcactggatttccctgctgaggcatcgggacgagttagcattccaaaagagcgtgagctggcacgccgtgcaacactaagttatggctatggtcagcaagtgacattggcacagttggcccaagcttatgcagcacttggcaatcgggggctgatgcagccattaaaacttgttaaagatcaaaaaacgcccgaacctacccaagtcattcatgcaggtcatgccgaagccattgtgcgtatgatggagcttgtgacaggaccaggtggcacaggtcaagccgctgccatcaatggctaccgtgtggcgggtaaaacaggtaccagtcggcgtaccaatccacaaggtggttattataccgatcagcatcgtgcgatttttgtgggcttggcacctgcgtcagatccacgctttgtggtgtcaattttggttgaagatccacgccgccaatcgtatgcaggccaagtatcagcacccgtattccaccaagtgatgaaagaggcactgcgcttatataatgtgccttatgataagcctttacgggttttagcaccctaa

SEQ ID NO: 1209 - DNA, 1506 bp, M.catarrhalis
aaagtaataaaaggcaatcgcatgacaaattcaagtgcatatttttggaaccaagataacctaaaacaagccacacaggggcagtggcatcacagtgataaggctgagattgacgctcgtcgtattgtgactgatacacgccaaatccaagcaggcgatgtttttttggcaatcaaaggtgagcgatttgatgcgcatgattttatccaaaatgcgtatcagcaaggtgcatctgcggcgattgttgagcgtgttgttgattgcgatatgccacagcttttggtggcagatactaagcttgctttggggaatttgggtaagtttcggcgagacgctcaccctgatttgacggtcattgccttgactggttctagtggcaagacgacgaccaaagagatgattggtgctattttaagtcaaattgcaccgacgctcatcacgcgtggcaatttaaataatgatcttggcgtgccgatgatgttgcttgagctgactgatgagcatcgttttttggtgatagagcttggggcaaatcatttgggtgagattgcttatacagcgtcaatggtacgtcctgatgtggcgttgatactaaatatcggtacagcgcatttgggtgagtttggtggtcgggctaatattgcgtgtgccaaatcagagatttattcggcactgaccagtcagggcgtggcaattttaccgttttcagatgacttttatccagagcttttaaagcaagcgtctcaatttacaaagctgcatttatcgtttggtgagcgtgccgtgccgattgagcaagcggggcttgaagcgacggatcaagctatgcttaaagccgaaggtatcagctcggtgctgatgatgggggatttatttgctgatgatatcgaaacttttgccacgcacagcacatttactctaaataccaatattgatattgatcaaattgacagcttgcctgttcatctaccgttcattggtgagcataatgtggcgaatgcgttggcggcagcttcggcgacttttgcactgggcgtaccacttgaacaaatcgccaaagggcttctgcgtgcgatgccacctaagggtcgtttgatgcgtctgtcaatggatggatatcacattattgatgatacttataatgccaacccaacttccatgctcgctgcagcaaaagtgcttgaagctgaattagacactaagatattggtgcttggtgatatctttgagttaggagatgcggcagatgatgagcataccaaactggggcatcagttggctttacttgagattgatcatgtatttactttgggcaatcacatggcacacactgccgctgccatcaatgaacaaaaacccattgccagacattatacagataagccaagtcttttaaaggatttgtgtcagttattgtcacatggttctgccaccgtgttatttaaagggtctcgtggcatggcaatggagagcctgattgctgatttgaccgcttgtaaccattaa

SEQ ID NO: 1210 - DNA, 678 bp, M.catarrhalis
attatggcaaattttcatacacatctcaccgctggtgttattggcagtaccatcatcgccgcttttggtttttattttgaattatatggcttaacgacagcggtgctttgtttggctgttgggacattaggcagcctgttgcctgatattgatcttgaccactcaaagcctgcttctcaaggctttttaatcgcctcattggtcgtctcgacactaatcaccattttatacgccaaccgctatcatgctgacaggcttttgattgactctttgattttgtggatgggtgcgtttttattactcaggcttggcttatttggcacttttagtcgcctaacagtccatcgtggtatggtgcattctgtgccttatatggcaatgtttgggctactattggtatgtggggcgttttatggactaaaattgacggcatttgtcagctggctatttggtgctgccttattcatgggtgcgctgattcatttgatcttggatgaaatttatggcgtcaatatttatggcttaaggctcaaaaaatcagctggtactgcctttaaattttttgagataaaaaaaccgtttggttatatttttttatatgtcattattttggttttaatttatgttgcaccatcatcagccgattttatccgagcattgggtcgttttggcacataa

SEQ ID NO: 1211 - DNA, 900 bp, M.catarrhalis
cgtatgaaagatatcaaaggcatcgctcaagctgagctggacttttggccaagttttcagcaaatcaaccaagccatgcctcatctgatgccctatgctgatattcatcgagcctttggtgaaacctatcaaggggggcatttgtcagtatggataaatgattattttcaattatctaatatttatccctgtctacaggtggcaaatacaccgcttcaattcactgctcaagatgatttgccacatggcacagcatacgaaatgtacattcatcaaaccgccaaaattcccacgcgtgacaatctgcatgattggtttggggcgtgcgtttggtcagtatttccaaaaaccaaatccatgctaaatgccaagcatattgcgcattttgctcatcaaaacacaagcaatggtcgaaatcgtgtgcgtgataccattacagtttttgatgaaaatggggcaatttttgtggtcagcgaagacaccattggcactcagattggtgatgccttggtgacatttgattggcaaaattgtttggtgaatacacgccaatattggtaccatctgttacagccagatacgcacgccaaagtatttgtctttgggcatgcgctgcttgagcaactgatttcaccttataaatccttatgtgcccacacgcttatcgtgcatgtacccaaagcgttttttgagctatcgcagcctgagcaattaaagcgtatcgacgagatattatgcaatcaattaaatgattttttggtggagggtgtgacaccaaagcatttgcatccattgccaattttaggtgtaccacatttttgggataatgccgatccaagcttttatcaagatgcgtttgtttttcgtgcaggtcggcaaaagcaggcaaaaaccacatag

SEQ ID NO: 1212 - DNA, 198 bp, M.catarrhalis
caggtaaggctgatgcggtattggctgccagcatttttcactttggtgattataccattaaacaagccaaagaatttatggcaaaccaaggcattaccattcgcccaatttagcccattggtctacagtcatttacctaagcttttattgattaatgttaattttatcgcatcataccaatcaaacaaactatcttaa

SEQ ID NO: 1213 - DNA, 606 bp, M.catarrhalis
agctttatagggataacgactatgaatgtacaaagatgcgtcatcggcaattggaaattaaacccagcaaccaagtcggcggcacatgagctggcacagggcttgagtggtatagcctgtgatgcggtcagggttggctgtacaccaagttttacccatgtatcgactgtggcaggtgtcttggcaggtacaccgatttgggtgggtgctcaagatatttgtgcatatacccaaagtacgggggcgtatacgggtgatgtgtctgctgagcagctgagtgatttgggcgtaggctttgtcattattgggcattctgagcgtcgcaactattatcgtgaagatcacagcttattggttgagaaaatgaagcatgcatttgctgcagatttgagcgttgtgttttgtattggtgagaccaaagagcaatatccagacaatcagaccttatcagtacttgatgatcagttatcggtattaccaacctttcgtgtgcccacgggcaagcttatcattgcttatgaacctaatttgggcgattggcacaagtcttaccacccagcacttaagaagtcttcgcaacccatgcgcatattaagtcaatcttaa

SEQ ID NO: 1214 - DNA, 1026 bp, M.catarrhalis
ttttattttatgttggggttgcccatgtctgtttatactcacttatctgatgatgaattttttgccttttgtgggttgtttggggtagcatttaaaaaagccgcccccatcacccaaggcatcaaaaattctaactggttcatccaaactgacagtgatgaagatggtgagtttagccatgtttttactttatatgaagagcgtgtacctgatgatatcattaaaatggcaaccatcatgcacacactcaaagacaggctaccgattgctgcaccgcttatcaagatgaccgccaagggcaatcatattggtgaggactgtgtgatgcgttatgaaaataaagccatcttaatcgtcccaaagttatcaggcagtcatcctgtgctgacagatgttgccatgtgccatgaaatgggtaaagctttggcgactttgcatgacgctttaacaaccttgcagccaagtgaagattatggcgtaccactgtatgactggacaagggtcaaagagcgtgaaaccgcctatatgcctaccgatgaggctcgtctcatgaacgatatctggacagcctatgccaatttacctgatgacttgcccaaaggcttgtgccatttggacatgtttgcagataatacgctgtgggattttacgggcgatacaccaaagctgacaggactgcttgattttaccgaggtatctgttgagcattatctgatggacattgccatcaccatcaacgatttttgtaccacatggggcaatgccaatgacggcgagagcgtgaattttaacacgaacaaaatgactgcttttatagacggctatgcgagtgtccgccccttaacggacaacgaaaaaaccgccttgcctgtgatgcttgcctatagtgccaccattttttggcttttgcgactaaatgtcattcaccataaccgtgaacaaggacgcacaggcgataacatcatggtcaaaaatcccgacttgatgaaacgcttggcaagttatcattgggcaaaggtgaaataa

SEQ ID NO: 1215 - DNA, 552 bp, M.catarrhalis
tgcagtattattttaaggccgaatatgaccacccccaacccccaaaatgaccaatttgacatcaacgaaactggctataaaaccagccataccgccgtacgcaaggctcgccgttttgctgtgcagggtctgtatgaatggctgatgactgattaccgctttgccaaacaaagacgagatttgttagggggtaatgagccacataccatcgccgcccgaactcgtgccgataatgccatgcacaccgtacatttgggctattatcatgaacttatgcgtaatatccctgcccaaattgatgaattagaatccctgattgtcagccaacttgacagagagttatccaaacttgacattatcgaacacgccattttactcattggcacttatgagcttaaacatagcctgcatatcccctacaaagtggtgttagatgaagcaatgaagctcaatgtccattttggggcaaccgatgctcataagcttatcaatgccgtcatggataagattgccaaaaatgtgcgtcagccagaggtgcaagctgataaataa

SEQ ID NO: 1216 - DNA, 1509 bp, M.catarrhalis
cgatttgttatcatagcacaaacaattcgttttcctaagttagagaaaatcatgacacgacctgtacgcacccgaatcgcaccaagcccaactggctttcctcatgtaggcaccgcttatattgcactgtttaacttagtattcgccaaatccatgggtggtgaatttattttacgcatcgaagataccgaccaagtccgttctactaagcaatctgaacaaatgattctagatgcactaaaatgggctggattatcttgggcagaaggtccggatgtgggcggcccgcatgcgccttatcgtcaatctgaacgtgccgatatttataaaaaatacgccgagcagctgttagatgatggacatgcatttcgctgtttttgcacacccgaagaacttgatgccatgcgagaagcacagatggcagcaggtttgcccgttaaatacgatggtcgctatgccaatttatcacgagaagaatcagatgcgttggtcgcccaaggcaaaccatttgtgattcgtatgcgtgtaccatcaaacggcgtttgtaccatcaaagatatgctgcgtggtgaagttgtcattccttgggaacaggtagatatgcaggttttgctaaaaactgacggtctgccgacttaccatcttgccaatgtggttgatgaccatttgatgcaaatcacccatgttttgcgtggtgaagagtggttgccctcagcacccaagcatcagctgttatatgaatattttggctggcaaatgccagagctttgtcatatgccactacttagaaaccccgataaatctaagctgtctaagcgtaaaaatccaacctccattacctactatcgagatgcaggcatactccctgaggcattgatgaattatctgggtcgcatgggttacagtttgccaaatgaacaagaaaaattcaccctagatgagatgattcaaagctttgatatccagcgtatttccttgggcggtcctgtctttgatattgaaaagctatactggctcaacggtgaatatctgcggacattatccgttgacgacctaaaaaataaaatcttggcatgggcaagcgatgacactaaactcaccgccatcgctcgtgccattcagccacgcattaatttattatccgatgcaatcaactgggcaggtttttattttcaaaatttacccgccatcactgccgaagattttgcctacaaaagcctagataatgagcagatattagaaattttatatttggcgacttggcaattagaaaacttgcccatttggagcgaagagaatatttaccaaacccttaaaggcttggcggcacattttgacattaaattaaaagattttatgcagccattttttgtggcgattgcaggctcgacctcaagcacacctgtgatgaattccatgcacatcatcggcacagatatgactttggcacgcttccggcacgcttgtaagatacttgttgaattggccaagaaaaactccaaaaattag

SEQ ID NO: 1217 - DNA, 363 bp, M.catarrhalis
gtggcgattttcatgagcaacactcctttgatgacaacactcaactcaagcatgacttgggttttgcgtttggtgttggcggttttggttgtgatgatttttgcaaccgctttgggcatcgtcacccaaacccaagagcgacacgaagcctatattgaattacaaaaacgcagtcgtgaattaaatgagctaagaattgaagagcaaaggttgatgattgagcagcaaacattcagtgccacgccgcaagttgctcagcgtgccgtcagtgagcttggaatgttttttccgaccaatgaaaaccgccgtgtcattacgccgagtgctaagcctgactctgagccaagccaaaatagcgagtaa

SEQ ID NO: 1218 - DNA, 1107 bp, M.catarrhalis
ggatgcttcatgttgtattggctattacagcaaacagacattgccatcggttcattgactttgcgggcactgcttgcggtgattacatcgctgcttattgttatcattggtggtaagcctgtgattcattatctgcgtaccttaaaatacggtcaagccgtgcgtgatgatggaccaaaaactcaccttgccaaacaaggcacgcctacgatgggcggggtgctgattttggtggcgattggtattgctaccttggcatgggcggatttaggcaatccttatgtttggattttaatggtggtcatggtcatttttggtgcagttggctgggcagatgattggctaaaaatcaagcacaaaaacccccaaggactgattgctcgcaaaaaatatttttggctatcggtcggctcgctatttgctggctgttcgatgtattacatcgccacacagcaagataccaataccatgatcgccatgcaagacatgctaatcccactgtttaaagacattgtgattccgttttcagcgatcccattgggtttgggatttattattgcgacttattttgtgttggcaggctcatctaatgcggtgaatctgacagatggtttggatggattggtgattttacccgtagttttggtcgcagcaggcttgggcgtttttgcttatatttctggctcgccacattttgctgattatatgcatgtgccttatattgcttataatgctgaggttaccatcgtctgtgctgccatgattggcgcaggcttgggctttctttggtataatgcagcacccgccgatgtatttatgggcgatgtgggtgcattgagtcttgggggtatgcttggtaccattgctgtgatgactcgccaagagttggcgtttgcgatcatgggcggtatctttgtggctgaagcggtatcggtgattttacaggttggttcttatcgtctgcgtaaacaacgcatttttttgatggcacctttacatcatcattttgaagagcttggactcaaagaaaccaaagtagtcgcgcgtttttatattgtgtgtattattttggtggtgcttggactgatgaccttaaaattacgctaa

SEQ ID NO: 1219 - DNA, 1572 bp, M.catarrhalis
ggatgtatgatgatgccaataagttttcgtgaagtgatccaaaaagcggtggccaccccccatactgtggcggcagaacttggtttgatgacacttgagtctgtgtttgcaccgattttggcgtgtcaatttgaccaattttgtttggatagtcgtaagattggtacagatgatggttttgtactgttaaaaagtagtcgtcaagatgctcagacaaacctaaataatgccaatcgttatcttatgtcggtcaaagacagtgcggcatttgtcatcagtgagtttgatttggtgggactggatttagatggcatacaaattcctatcgttagcgtgccaaatattcgcacctatttgggtgatttgattgctgctcgccttcagctacatcatgccgtggcattgcccaagattattgcggtaacaggtacgaatggcaaaaccacggtcagtcagctgatcgcacagctttgtcaagcgtctggcatcagctctgctgtgatggggacggcaggtaatggacgattgggtcagctgatccagtccgccaacaccacaggcgatgtgttattgacacatacatttatccatcaaatggcacaagaaggcgtacaaatgatcgcacttgaggcaagctcgcatgggcttgatcagtatcgcttacaaggcgtaccaattatcggtgctatctataccaatttatcccgagatcatttggattatcatgctgatatggcgtcttatcgtgatgccaaagccaagctttttgatcaatcattgttcccaacactaagatttggtgtggtgaatttagatgatgagcctgctttgtttgattatgagactgcagattttcagataattggatatagccaacaaaagccaaacgctgatttttatgccaaagcagtacgcctaagccttgattgtgttgagattgaggtacaaacaccccaaggtgagatgacggcgataagtcctttgcttgggttgtttaatgtggataatttgcttgccagtatggcggcatttacggctttaaaccctgcaagggcagcagatttgccaaatttgattactcaattacaaggtgcaagagggcgtatgcagcgtgcgtcatctcagacgggtgcttttattattgattatgcacacacgcccgacgcacttaagcaggtcttatcaagcctgcgtcgccactgtacaggccggctaattgccgtctttgggtgcggtggtgatcgtgatcgaggtaaacgcccgcagatgacccaagcaggtttggcgtatgcagatcaagtgattttgactgctgataatccgcgttctgaatcgccatctgccatcttagcagatatgcaaaaagggctgtcttgtgaggatcattataaaatcatcatcgagcctgatcgaaaaaatgccatcgaattggcggttaaaaccgcaggcaaaactgatatcgttgtgattgcaggtaaggggcatgaaacttatcaagaaatccaaggcgtgcgttatgattttgatgatttggcagtattgggtgagtttttacaaaaatatcaaaaataa

SEQ ID NO: 1220 - DNA, 1011 bp, M.catarrhalis
ataaccacagtgagcaccatgtcaaacaccatttccacctctgatgaatttagtcatacgacggttttgttaccagaaacagttgcgatggtgcttggtgtcaaacaattaaacgatgtcacttcaaaagtttcaggtgtgtatgtggatgccacttttgggcgtggtggacatagccagcttttgcttgaatatttggcacctgaggcaactttggcggtctttgataaagacccagaagccatcgctgtcgccaaaagtctggcagcacaagatgaacgcattaaggttgtgcatgacagctttgctcacttaacaaaaaatttacaggcattgggtattgataaaattgatggtttgatggcggatttgggtgtctcaagcccccagttagacgatggaactcgtggctttagtttcatgcgtgatggcgtagttgatatgcgtatggataccacacgaggtgagcctgtctctgagtggttacagcgtgtatcggcggatgagctggctgatgtgttgtatgaatatggcgaagaacgccattctcgcaagattgcccgagcgattaagtccatgccaaattacacctccacaagacaattagccgaagtcatcaagcaagcccatcctgcatggcaaaaaggcaaacatcctgccactcaaagctttcaagcaatgcgtatttttattaataatgagcttggagatgtggaggcatttttggcacaaagtatcggggtgctaaaagcaggtggtatgcttgcggtgattagttttcattcgcttgaagatcgtttgattaagcagtttttgcagcgtcacagtcgtggacagtatgaagaagatgcacgcctgccgatcatccctaagcgtccaaaatattttggtaaaccaaagcgtattgggccttgtgatcaggaagttaaagccaatcccagagctcgcagtgcgtggctgcgtggtgctgtgcgtagtgatgtcgctttggtggcacaagacgaagattga

SEQ ID NO: 1221 - DNA, 222 bp, M.catarrhalis
ataagtactttatatgatggatacaccattaaccattcttatccatggcttacacttaagcccttggtatatgaaacctttggagaaaaaattaatcaatttgggattatcgacccatcgctacgggtatcgcaggttgatgcagcccatcgccgtacacaagggaaaacctacatcaatatcttacccaaacccatgatgtcaatcgccccaatcatttaa

SEQ ID NO: 1222 - DNA, 540 bp, M.catarrhalis
tacaatctgttactaacagccgcttgccatcaggcagttttatttggagaatacatcatgatgcgtatcattttactaggtccaccaggtgcaggcaaaggcacacaagcccagttgatatcaaaggaatttggcattcctcaaatctcaactggtgatatgttgcgtgcagcaattaaagcaggtactgagcttggtaagcaagcaaaaagtgtcatggatgcaggtcaattggtttctgatgagctgattattaatttggttaaagaacgcttaaaacagccagattgtgacaatggttgtatttttgatggattcccacgcacaatcccacaagccaaagcactggcagatgctggtattgccattgactatgtgattgaaatcagcgcccctgatgatgaaatcgtaagccgtatgtcgggtcgccgtgcacatttggcatcaggtcgtacttatcatgtgatctataatcccccaaaaactgacggtattgatgatgtcacaggccaggcacttgtgcagcgtgattatgaataa

SEQ ID NO: 1223 - DNA, 1161 bp, M.catarrhalis
gcgttttcaccaataaaaggttttaaaatggcagaaaaaatggttgttggtttggttgggtggcgtggcatggttggctcagttttgatgagtcgcatggttgaagaaggcgattttcagcacattacgcctgtatttttttcaaccagcaatgctggtggtcaagcaccaagttttgatggtgtggacggcggtacgctcaaagatgcaactgatatcctagagttatctcgatgcgatgccatcatcacctgccaaggcggtgattatacaaagcaagtacacagtgcattgcgagatagtgggtggcatggctattggattgatgcagccagtagcctgcgtatgcaagaagatgccatcatcattctagaccccatcaatcgtgatgtcattgataaggcacttgctgatggtaaaaaagactttattggcggcaactgtacagtcagcctaatgctgatggcaattggcgagctattccgtcgtggttgggttgagtgggtatctgccatgacctatcaagccgcttcaggtgctggtgcgaataacatgcgtgaactcatcaaaggcatgggtgttctgcgtgattcggtgtcagatcagcttgatgaccccgcctcagccatccttgagattgatagaactattgctgatacacagcgtagcgacgattttcccaagcagcattttggtgctgtactggcaggcagtttaattccttacattgacagtcagctagataatggtcaatctcgtgaagaatggaaagctcaagctgaaaccaataaaatcttaggtaaatcagctgatgaaaccatcaatatcgatggtatttgtgtgcgtatcggtgccatgcgatgccacagccaagcacttaccatcaagctcaccaaagacattcccttggcagagattacaactgcactgcgtgaaagcaacaatccatggcttgatgttgttgaaaatgataaagccgccagcatggagcgtctgacccctgtggctgttacaggtacgctaaatgttgctgtgggtcgtctgcgtaaactgaatatgggcggcgaatacttgaccgcatttacagtcggtgatcagctactttggggtgctgctgagcctttgcgtcgtatgcttgccatcctgcaaggtagtatctga

SEQ ID NO: 1224 - DNA, 1359 bp, M.catarrhalis
actccatttaactttcttaatcccaagattgacactatgttttcatccctttggcaagctttaagtgagcatcctgaatttatcgccatgctgaccatcccacctgtcacagcatttgtgacttgggcgcatgtgtggatggcacttgagatgttgttttatccgattaaattttggggcatacgcatttttgggctgccgtttagtttaaaaggtgtggggtggcaaggtattgtgcctgccaaggctggcaaaatctctggtattattgttgaccaaacactctcaaaacttgggtctttagatgagttttttcaggcgatggaacctgaagagatggcggagtttatcactgccaccgttgataaaaatctagaaagcttaattgatgaaattatgcttgagcggtcttatactctatggacgcatacgccatatgccatacgccgccgtatttatgcccacgctcactcacatttggcggcaattatgaaatctttggtcatggatttgacttataatgttgagtcgctcgtagatatgcgtgagatgattgtcaccaaaatggaaaatgaccgtaagcttatggtggatatgtttttacgggtcggcaaaaaagaaattaattttatttggaaaattagtgctttgattggctttggctttggtgtgctccaaatggccattttttactttgtaccgcagcattggacagtgcctttttttgcgatgatttggggagctttgaccaattggattgccatttggatggtatttaacccagttgagcctaaaactgtcccatttgttcgcctatttcgttatgagatggttgatcatcaaaaacgaatcgtatggatgcacccgcattggcataaatattcttggcaaggtggttttatgaagcgtcaggatgaggtttcaactgtttttgccgaaattgtcgtcaatgaacttgtaacacttgaaaatatcatgaatgaaatgatgtatggcaggcgagcggataaaacccgagagttggtgaaatctcatctttatgagatgcttgaagatccaattgtggcaacaagcctaaaagtgggtatggataagcgtagtcttgacacctttaaagatacaattattgataaatccatcgatgcaacgatggtgcctattcgtgatcccaaactcaatgtttctcgagccaataaaatttttggattatttgaaagtcgtattcgtgccctaactcctaaagagtttcaaaatttattaagaccagcttttcaagaagatgagatcaccttaattatcttaggtggtatcacgggatttttggcaggttggttacatttggtgattgtctttttttag

SEQ ID NO: 1225 - DNA, 1017 bp, M.catarrhalis
catagccctaaatacagcttaattattatgacacctacccaatcacccatttgcctcatctatgctggcggcacttttggcagccatggcacaccactatctgctttgcctgctgagatttttttgccaatactcagcaatctatatggcacaactgatcatcatataaaaatcttgaacaatcagatcatcaaagactcaagccttatgacgccatctgattttgtgggcttttatgagctgattttgaccgcttatcatgatggttatcgaaaatttgtactcatcacaggcactgatacgctcagttttttggcggcttttttggcacatgcatttgatgaatttaccgatttaagtctcgtgattactggcagtatgcagcctttattattgccacaatgtgctgatttatccatcaattatgatagcgacgcttggaataatttatcgcagtctttggatttggcagcggcacagtgtggcacatttgtccattttcatcatcaatcattcaatgccaaacatacccaaaaaatcaatagccaagcacccaatgcctttatgggagcagatgccatatttaataaatcatcaccaccatcgatcaataccgccatttacttaaatcaattaccctcattgattaagcgtgctaaatctgtcaagattcggtcagtgtatgcactgcctaacgatcctaatgcactggctgatgaattgttggtagcggctgatgcttgtgcggtgattttgattggctatggtgcaggcaatctacctaaatcacaagccataattgatgctttggcaaagttaacagatcgtggcgttgccatcatttgtaccaccatgtgtgcctatggtggcacaaatacggactatgcagcaggggcttggcaatatgaacatggtgtttgggcatctggttcattaaccattccgtctatttatggtcaaatactttggctatccatcacccaaaagctcaccgcttggcactggaaattctcatga

SEQ ID NO: 1226 - DNA, 912 bp, M.catarrhalis
acatggtgtttgggcatctggttcattaaccattccgtctatttatggtcaaatactttggctatccatcacccaaaagctcaccgcttggcactggaaattctcatgaaaacacatactttggctgtcggtatcgaattcatcggcacacgctatcgtggttggcagcggcaagaagaagtcatcggcgtacaagccgtcatcgaaaaagcactatccaccattgccaatgagtccattgagcttatcgctgctgggcgtaccgatgcaggcgtacacgcaggtaatatgattgcacattttgtaacgcacgctgagcgctcagcccacagttggttgcgtggtacaaatagcctactgcctgatgacattgccttaaggtgggttcagcccatgcctgatgattttcatgctcgctttagtgccatcgctcgtcgttatcgctatatcacactcaatcagccctatcgccctgccattttacgccatcaagtcacgcatgaatacactaagcttgatatagatgctatgataatagccagccaatttatcgtaggtacacatgattttagcagttttcgggcagctgcctgccaatcaaatcagccagtacgtacagtcacacatgccaacttgtttcagcatggcagctacttgatactagatatccaagccgacggatttttacatcacatggttcgtaacatcatgggagcgttatttgctgttggacgaggagaaatatccccagagacattttatgagctgatgcttgcaaaaaatcgcactttggcaccaccaaccgcatctgctgatgggctatattttatcaatgcctattatcataaacgctttgaatcactactaccgcagatgccactaacgccattatggctaaacttacctgattga

SEQ ID NO: 1227 - DNA, 612 bp, M.catarrhalis
aaccatcaaaggagtattatcatggcaaaacccaataaacgcttgatgttgtttattattccgctgattatctttatgatactggtggtgatgttctttatgcgacttggcaagccgaccgagattaataccagacgtttggtgggcaatcccttgccaaacttaagcttacccttattatccgataccacacgcacaatcaccaaggcagattttccagatacgccatttattttaaatgtttggggttcgtggtgtttgacttgccatgctgagcatccatttttgcttaagctgcatgagcaaggcgttcccattattggtgttaattataaagatgagctgtctgaagcgttggcatatttaaataaaaatcaagatccgtttgtttattctgtacaggatgttacgggtgattttgcccttgatttggggctgatgggtgcacctgaaagctatgttgtggggacaaatggcattgtttatcaacatattattggtgagattggtgagaaaaattgggctggtattcaacactgtttgacagcggttgctgatgatggtttatccgatgccaaaaaaattaaagcctgtcataaggatgattcatga

SEQ ID NO: 1228 - DNA, 213 bp, M.catarrhalis
cctaaggctatttttgtcgcaaaaagtgcattgcctttgattttgtattctttaattttgtataatgctacctttgataaaatcaccgcaaacaccatgaaaacatgctacaatacgatgtgttatcatatcatgattttaatcaataaactccatttaactttcttaatcccaagattgacactatgttttcatccctttggcaagctttaa

SEQ ID NO: 1229 - DNA, 1272 bp, M.catarrhalis
ggcatcgatatgacaccaagtttaattttatttttttcattgtgtgctgttttgacggtattgctctctttggtagtcattctaccttggcgaaaagttggcgtatcatctgacaatcaactgatggcgattaatgtgcagatttttggtgaacgcattgctgagcttgatgctgataaagcaacaggggttattgatgaggcatcttatcaaacccaaatcaccgaactaaaacgccagctgatagatgcccaaacgacgacagaagcacaaacgcccgttggtatcaaagggcgtgcaattatcatgatttggattccgatattggctgtcattgcttatatgatgaccgccgatcgtacggcagtttttacactttggcaagctcaagataaagtcggtcaagtggcggacgatttattaactggtaagattgatgtaccgcctgaatgggcagccaaagagtcaacggcactcatcagtgccatgcaaaccaatgtgcatcgcaatgctgatgatgctaatcgctggatgcgtttatctgagctatttatgatgctcgaggcacagccacaagcattagaagcattggcacgggccaatcgcttacagcctgataatgaagagattgcattaacttatgcacagaccaatttttttatcaatgaaggcagaatggatgcaacaacgcataagattttaacccaaatcttaacccaaacacccaatcatgaaggtgccatgatgatgatggcaatgggtgaggtgcgtgcaggtaattatcctaatgccaaagcatggattgccagattacgctcaagtttgatggcacgctcaggtgaccatagtgaagctttggcaagtttggataagttggttgaaaatattgataatcagcaggctgctgttgcccaaggtgtgacgattaccatcaatctggcacccgccttggtagacaagctaagacctgatgatgtcttatttgtctctattagtgggcaatcaggcggcgcaccttatgctgtcaaaaaactgccagccagtgagcttatgagtcaacaagcggttagtgtgacactaagtgatatggatgccatgatgccaacacgaatactgtcatcagcacgccaagcgggcgaggcattggtagtaaatgcacgcatcagccatttgggtgatgccatgcctaaagcgggcgatttggcagccaatccgatcattttggataaacaaaccgaagtgtctttgatgatttctcaaattgtgccataa

SEQ ID NO: 1230 - DNA, 2079 bp, M.catarrhalis
caatttaacatcaaaaagccccgcaaaattttgccagcaaatgagtgttttactatgctaataacagaacttggatacttttcgctattgcttgcgttggtacttgcaatgctacaagccattttacccgccatcggtgttatcaaacatcaagtacagtggcaaagactggcaccaagtctagcgatggcacagtttttagcgatggctgtatcatttttggcattgattgcaggttttttatataatgattttagcttagtttatgtcgctaagcattcaaatagcttgatgccttggtattataagctttctgcaacttggggcgggcatgaaggctcgttgctactttggatgacaattttggcaacttggtgtatgttggttgctgtatttagccgtggcttaccattacagatgcgtgctcgggttttatctatattaggcggtgtgcaggttatgatgcttgcaatgatgatttttacctcatcaccgtttgaccgtgttttaccaagtttgcctgttgatggtgctgatttaaatccattattacaagatcctggtctgatttttcatccacccatgctttatatgggttatgtggggcttgcagtaccatttgcgttttgtatggcagcattatgggcgggtcgcttagatgcagtttggacacgctggagccgcccctggacattggttgcgtggacatttttaaccttaggcattgctttgggttcgtggtgggcgtactatgaattgggctggggtggctggtggttttgggaccctgtcgaaaatgcatcactcatgccatggcttgccgctacggcactcatgcactctttggctgttaccgaaaaacgaggtgtatttaaagcttggacgatgatgcttgcgatttttgcctttgcattatctttacttggaacatttctggttcgctcaggggtcattacctcagtgcattcgtttgcagctgacccaacccgtggtttggctgtactggcgattttaacaatcgttattgggtttggcttattaatgttcgcattgcgtggttggagattgactgttgaaagcagttaccgtctcaaatcaagagaaaccatgttggtggttaataacttagttttgttggttgcaacattggtcgtcttattgggtactttataccccatcattgccgattttttcaaattaggtcaagtatctgtcggtcctccgtattttaatgcattgtttgtgccgctcacttggcttttgcttggatttatgggcgttggcgttgtcatgcgttataaacacgatagccgcccatttttagcaaccttaatggcttgtgccatcggtgcatttgtacttggatctgcgctggcttatatggtgtctcaattggcagaagagccattgtttgattatggtatttatgtctctgggattttatcgttgtgggtgcttatctttattatcttagacattaaagataaactaaagcatcataaaggcggtattttttcaggcttagccaagcttagcccaagctactggggtatgcagattgcacatattggcgtgattgtctgtatgatgggtgtggcagcgaccagcagtatgagtattgaaaaagatgttgccatgacagtgggcgatagcgtacatgttcaaggctatgatttttatttacaagaatttgagatgattcaaggggtcaattatgatgccactcaagctaccatcattgttagacagcatggtcggcaaattgctgtattatatccccaaaagcgtgattatgttgtcagtatgatgccaatgaccgaagttggtattcgaccaagtttattaaatgaaatgtatgtggcattaggtgagccaatcagcactcaaaatggtcaagtagatatgaatacttgggcggtgcgtgtctatgtcaaacctatggtacgctggatttggttgggtgcaattattatggctgtcggtgcattcatcgctattttggataaacgatatcgcatgtaccaaaccaagtctggtaaatattcatcaaagttcaacaaaaccatgacaaaccaataa

SEQ ID NO: 1231 - DNA, 234 bp, M.catarrhalis
ttacttaagattatggcaaaaaaagacgatattatcgaatttgaaggcgaggttattgatactttgccaaatactttattcaaggttcgcctagataatggacacgaaatcatcgcccacatttcaggtaaaatgagaaagcactatatccgtatcctaacaggcgataaagtcaaagttgaaatgacaccttatgacttaaccaaaggtcgtattacataccgtggcaaataa

SEQ ID NO: 1232 - DNA, 519 bp, M.catarrhalis
ttcatgaacttgcgtactttgatgatggtattggtgattggcgtatcaaccaccgccgccgcaagctttgatctgtatgaatttgattcgcctcagcaagaggctcagtatcgagtactcatcgaagagttgcgttgcccaaaatgccaaaatcaaaatttggcaggctcagatgcacccatcgcccaagatttaaaacaaaaaacctatgaaatggtcaaagatggccgtagtgatgctgaaattcgtaattatatgtttgagcgttatggagactttatcagctataagccgcctgtgcgtccatctacatggattttatggttttttccacccatgcttttattacttttgctgttgggctggatttataaagcccaaaaaggtcgctcttggtctaagcaagtccctacaagtcatgcacctttatctgctggcgaagaagcaaaacttaaaaaaatcttggcacatcatcaaaataaatcgttggatggcagtgattcaaaaccaacaaaataa

SEQ ID NO: 1233 - DNA, 621 bp, M.catarrhalis
acgatcattgtcatgaaaaaacccactcaaaaatccaccaaagctgtcaaccaagtacgcatcatcggcggtcagcataaacgcagattattaagctttgtagatgcacaaggtctacgccccaccccagataggctcaaagagacactctttaattggctgactggatatttaaccgatgccaaaattttggatacttgtgcaggtagcggtgcgcttggctttgaggctgtatctcgtggggcaaaaacagcaacattgattgagccaaatcttgctcaagcccaaatgcttaaacaaaatgccaagcttttgaaactatcagacaggctaaccattgttagcaccgatgccatcagtgctttaaacaccatgcacgatagacacgatgcctttgatattatttttatcgatccgccttatgctctcaatttatggcagcctattttagaaaatctgcttgacaatgccttaatccatgctgacagtagaatctaccttgaggctgacaaacccttacacagcatactagatgatgacacatctgccaagttcactctcatcaaatcaaccaaagtaggtcaggccatggcatatttattaacaccaacacccaattaa

SEQ ID NO: 1234 - DNA, 852 bp, M.catarrhalis
aagaggagattaaccgtggcgcaagaattaccaaccacagaatctctctttgattttttatatcttgacagcattaaaattcgctcgttttatgtgcagctgacagggtttggctcgttggctagcattaaggcaaataacgcacttaatagcagcttagcgagcgagggtgcttttggcgtaaatgctatggcaaagattgacgctaaggtgaactatgctacaggtgaaaatcaatctagcgaaaagacttatgatgcgacaccaacattacctagggaaatgattgataagctagacgagttaggatttatcagtcgagaacttggtgagaattcagcaggtaatttggtgttattaaacggtgtgctaagcattacagatatagaaacactgcaaaatctacttgagccaacaatgtactttgcaaccgaagaagaatacaagcaattgtatggtgatagaaaaaggcaggcggtaaagaaaaagcttgaggaaaacaagccagtggttcaattaattaaggctattccatatgcacttgaagctagactaaaagtcggtgaagacatggtatggatgaccttaaatcgtggagaaatggtcggcaatccacacgatatcaacctaaagcatggtaaggtgttgtttggggaatattatgttttgggagtgttagacgccatcccaaatgatgatatgaatatagatatgacaactggtagctttggcgatgtaatcttggaattgtctcagtcgctcaaagaaacaatgggtaggaatacaagcagttatggcatcaccccgattgctatctttagagtaatccgcaccaatcaacaagctaaatag

SEQ ID NO: 1235 - DNA, 231 bp, M.catarrhalis
atatatcttaccaacaatttaaggataagtcaaatgccaaaaatcgttgccaaccccaaaactcgtgctcaaatccaaaaagacagcgatgcacgccgtagggtaaaacccatcggttttaaagtccccatagagtttgccgagctacttgatgagcttgccaaacaatcaggcaaaaccaaaaacatcatcatcatggaagcggttgagctttgggcaaaacagctctaa

SEQ ID NO: 1236 - DNA, 1176 bp, M.catarrhalis
cagcccaaaaccatgactgataagaccgacgatgttaagccagataccgatggcaaccacccaaaaaaacaaaaaccccacacacaagccaaatcaaagcccagacctttggcgttattcttattattggcactcattggcagtgtgcttttggtgattatttttggtttgatacaaagctatggcacaccgcaaaacttgccaacagctaacgccattggtagcacaaatgagccgccaaagggggtgattgcccatctcagacaaaagattgccggacctgccacatttagcattcaagggcgtgtggagggcgaaacggtgaacatcagcaccaaactgcccagtcgtgttgctgccatttatgtcaaagagggtcaagctgtcagggcgggtgaacctttggttcagcttgtcagtcctgaaattgacgccaaaaaacagcaagccgctgccatgttacagtcagcccttgcctttcagtcgtccacagaccgtggcacaagacaagaaaatgtagacaccctgtacgccaattggcaaagtgccaaagctcaggcaacgctggcagaggagagccatcgccgtggtgagtatttgtatcaagaaggcgtcatctcccgccaacgccgtgatgagatgagggcagcgaagcagtcttctgcccaaattgcccaagcagcacagcagcagtatctaaaagcccagcgtggtcgcactgatgaattaaaatcatccgccgacgcccaagtccaaatcgctcgtgcggcggttgccgaagccgatgccctagatgctgaaaccatgctttatgcccccattgatggcacggtctcaaaaatctacattcaaagcagtgaactggtcatgccagcggtgcctgtaatgagcctgcttgacaaccaccctaccattaccataagcgtccaagaaaatcaatacagtcatgtccatgccctgcccaagctaactggttttatccctgcactgaacaaaaccgccgattttaaaatcgtgcataccgatgacgagggagaatttgccaccatcaaaaatactagacagacaggcggttatgacattcatagctttaaaaccaaacttgaacccatcacccccattgaagggttaaaagtgggtatgagtgtgatatttgatatcactgttttgccttaa

SEQ ID NO: 1237 - DNA, 318 bp, M.catarrhalis
aacaaaaccgcttttattggcaatcagcttatctgcggtggctggtgcattgttttcagggtgggatttaaattgctcacctgctgccctaatttcgtcaggtgtaattgctttaaccacaaaggcagagaatttatgcactatcctgttaccctaacccctgatacagacggcttttgcgttacttttcgtgacattccagaagccatcagccaaggcgataccacggacgaagccctagacatggcacaagatgccttaatggtcgccatggagttttattttgaagataaccgagccgtaccaatgccaagctaa

SEQ ID NO: 1238 - DNA, 234 bp, M.catarrhalis
caccatttttataaaaatcaaggattttttatggcagataaagcaagcccgcaagcacgcaaaaaagcaaccgctaactattttgataagtcactggcacgcatcggacttgtcattagccatactgagcctcatgttttagatgccttaaatcagattatggctcataaggattgctctaaggcaatggcaatcaaaatcgctttggttgagtatgccagaacgcttgactaa

SEQ ID NO: 1239 - DNA, 1974 bp, M.catarrhalis
atagcactatataacttaaaaaaccaaccgtcctttatgggcggttttttattgggtgaatttatgtcaaatacatatcgcttagacatacaggtaaatgccgatagtgctaataccgccttgggaaatctaaaagagcattttgataagattgaacaatcaagcggtaaggcaagcgttggtattaatggcttttcagacaaagcggataaggcgtcaaaatccagtaaaaaagctggtgatgaagctaaaaaagcaggtgatggggctaaaaagtttggtgatgatgccaaaaaagcaggtaatgatattgatgacttaaagcataaagcagatggcttaaaaacagcgtttggcacattaaaaggcgtgatgtttaccgcctttgccgttgctggcgttggtggtatcatcgccaccgccgatgacatgcaaacccttaccagtcaaatcaaaattgccaccacaagcaccaaagattatgcccatgcaatgagtgagatagaacgcattgcgatgggtaatatggtcagccttgactctgttgggcaattgtacgcatcaaatgagcggtcattaaaacaacttggcaaaagccaagatgaagtgattaagtttaccgaaaatatcacaacggcaatgcgtgtcagtggtggtagtgcagaaagccaagcggccgccttaacccagcttgggcaagccatggcgtcaggggtgttgcgtggtgatgagtttaactcagtggctgaacaagctcctgttattatggagctgatggcagacagcctaggggtaacaacaggcaaactgcgagatatggcaaaagaaggtaagcttacctcaaaggttgtttatgatgcccttgctggtgcgtctgcaagtgataagcttgctgaaaaatccaaaaaaatgtctacaaccatcagcggtgcaatgcaaaacattcaaacgcagtggcgtcttggtgttcatgccatcatgaatggtgagggcggtttatccagcgtgcttgctgatggtattaatagcattgcgttgggggcgtcatcatttgttgatagcttgcctgcgattaatcaagccatcactgataccattgccaaagccaaagaaatgggtacggcatttttagagtctgattttgggcaatctgcgatacaaactgccaaagatgcctttgaacaattaaaatcagccatgcaaggtgtggttgatattgcaggcgatgtaaaagcattctttgagaaaaaccctgagcttgcaattgcactggcgagcggtgttggggcggttgctggggcgtttttattatttaaaggtgtgctgattgtatgggcaggggtggcaacgctggcaacagtggcggggggtgcgttggcggcggtgatggcagtactaaccagtccgattacgcttgtgattgcagcttttgctgcactggtggcggcaggtgtgtatgtataccgtaattgggacacaattaaacaaaaggcaaatgacgcatggaatagcattaaagagacttggcagggcgttggcgaatggtttggcgagctttgggataaagtcaaacagaccttttttgattggttatcacaaatgccaaaaccagtacaagatatggtggctaatattggtgaaatatttagcacaattgtggatgtggcaggggcggtttgggatggcattgccaatattgctaaaagtgtgtggcatgcgataacaaaatttgtctcttacgctattgacaaaattaagcctgttatcaaatctgttttagagttttttaaaaacgcatgggacggcttggttagtattgctaaaaccgtttggcaggcggttgtcagtgttgttagccatgtttttgataaaatatctggcattatcagtacacaatttgaagtcatgaaagcgatttttatggcaggtgttaccatttttgccagtatttttatgcaggctttgagatggtga

SEQ ID NO: 1240 - DNA, 210 bp, M.catarrhalis
tattgttatcatcaaggagatgggtgtatgcaagataatgctaaaaaatcagatgcaactcaccactctgctcaacttttgcgtgatatgtttagttgcctaaaccaagcaatgagcagggaaaccgagaaatttcaccaagagcaaaaaaaggtaaaagaggagattaaccgtggcgcaagaattaccaaccacagaatctctctttga

SEQ ID NO: 1241 - DNA, 1206 bp, M.catarrhalis
attttcatccaaataagtctgatatccatgattgttcgctttattcgtgctttttgccaagcatttttgcgtgagcttaaccgcttatcatgtaaccgatttgatttggcgatggccatgatagcaccgcttgtcatcattgtcttatttggagccatgttttatcatggtaaagcacatcatctgcctgtggctttggttgatgaggataacagtgaattaagccatttgatttatcagcacattcatcataatgaaaccattaaaaccgtcctaatcttagataatgtacaagatgctcatcatgccatcaatcgtctggatgttggtggctacatacacattcccaaggatgctcaaaatcatttggtgcgtggtgaaaatacaggcattcacattgcctacaatcaatcattttttagcattggcagtgccatctcatctgccctatctaaaagcaccaaaggcggtattgccaaatttatacaaaccaagcatttaactggtgtcttaccccatttgtctggcaacatgcctcatgtcaaaatatcggtgctgtttaaccccaatttaagctatgaattctttttagagccgtttttggtcgctgcggtgctgcatttattactgtgctgtttggttgcccacgccattggacaagaatttcatgaacacagcgtacatgaatggttatgtcattcaccttttggggcgttgtttggtaaaataagcgtgtatgtgctgataatcagcctttggcatgggctatggcaggcgtggcttattggggtgcgtggctggtttgtggcagggtcgttatttgtactgattatcggtcagctgctgttttatcttgcttatgccttatttggggcgatggtggtacttaaaacccaaaacattaataaaagctatggcattttggcggtctatggcggctcatcaatgagttttgcaggggttactctgccgctaaataacgccccaagctttacccaattttggtcgcagattatcccctttaccccctttgcccgtctacaagttgaacagtgggtgattggcagtccatttatcatcaccctagcacaccttaactctttgctgatatttgtgctgatttttggcatcggtagcctattactgcttagacgcatcaaaaagaccttaatagccataccaaatacgcccaaggatgacagttga

SEQ ID NO: 1242 - DNA, 663 bp, M.catarrhalis
atgactttacaaagtattgacaaagtacccaaattatacttactgacgaatgatgatgagctgacaactttattagataagcttgaacgggtgtttgatacaggtgcggtgtcattactgcaagtgcgtcgtaagtccaccttgaaactttatgatttggcgacagtgtatcgagaagctgaaatgatcgtcagtcttgcgaatgattatgatattaaagtcgttatgaatgatagtctagagcttgcatcacattttgggacggggcttcatttgggtcagcgtgatggtagcgtacgggtcgccagagagattttgggagaccatgtggtgattggtcgcacctgtcatacagaccttgctttatttaaagaagctaagcgagaaggggcaacttacggtgctatgggtacagcatttgcatccatcactaagccacgcgccaaaattatctcaaaagacatattaaaaaaagcctgcgaacttgattttcctttatgcgtgattggtggtatcacccttgaaaatatccatcagcttcgagataagttaaacggtgcagccatcgattatattgctgtgacagctgatattatggggcattcggttgataccattgcagataaatgcttagcgtggcaacaaaaacttaacacttggtaa

SEQ ID NO: 1243 - DNA, 498 bp, M.catarrhalis
caaatctggcaaaaaagaacaccgcatcaactttatagagcatactattttatagagcatattatggtaacttccaatcgattcgctcgtcgccaaagaccgctaaatagtgacatgaatgttgtgccttacattgatgtgatgttggtgcttttggtgatatttatcgtaacagcaccaatgcttgctacaggtattgaggtatcactgccaaaagagcagaccaaacccatcacacaagctgacaagctgcctgtcattgtcagcattcaggcagatggcaatctgtatgtcagccataaaaatgccatcgatgtgccaatcacgcctgacaagctagataccctgctacgccagatgcaccaagacaataccgatttacaagtgatggtcaatgccgatgcagataatgcctacagccgaattatgcagattatggcattgattcaaaatgttggtatcacccaagtgagtttgcttagcgaatctgttcaataa

SEQ ID NO: 1244 - DNA, 1260 bp, M.catarrhalis
ctatcatttaaaaatatgcattctaccgataatttaccagtccttgccaaagacagacattatttaaataaactaaaacagaaaatgaattctaccacaggcgatctaaaaactaagtgcaaaatacgctatgatgctatctatgagcgatctgccgaacaggtcgccaatcgtatggatagcataccaaaaaatctatcagaaaaacttaatcatgatttgcccgtgactgctgaagccgatacgctaattcaagcgatccgtgatcatcaagtggtgattatcgcaggtgagacgggttctggcaaaaccacgcaactgcctaagcttgctatgatggcagggcgtggcatcacaggtcaaattggccacacacagccacgccgattggctgcacgctcggtagcgatgcgtatcgctgaagagcttggcgagccacttggtcagacggtgagttttaagattcgcttcaccgaagaaggtggcaagcactctattgtcaagctgatgacagatgggattttacttgctgaattgggctctgataagtttttggcaaattatgataccatcatcattgatgaagcacatgagcgtagcttaaatattgattttatcatgggctatttaaagcgtcttttacccaaacgccctgatctaaaagttatcatcacctccgccactttagacacccaaaggttttctgactattttgcagcgaatggcaaacctgcacctgtgtatattgtcgagggtcgtagctatcctgttgaggtgcgctatcaccccttgaccgatgccatcgtatctagccaagatgatgatgcatttgatgatattgaggacaatctgccacgcgctttgacagcagcggttaatgaatgctttgaagatgcacgcaccaaggggcatccagatcaggcagatatcttaatttttgcggcaacagaagctgaaatccgtgagctacaagaagtgctgatgttatatgcgcctgcccatacagagattttgccgttatttgcacgtcaaagctatggtgagcagcaaaaaatctttgcaccgtcaggtaaagggcgacgtatcatcatcgccacaaatgtcgcagaaactgcgttgacagtgcctaatattcgctatgtgattgatttgggttttgccagaatttctcgctataactatcgatcacgcatccaaagactgcccatcgaggcaatcagtcaagcccgccgccaatcaaagaaaagggcggtgcggtag

SEQ ID NO: 1245 - DNA, 3588 bp, M.catarrhalis
cgtggcaacaaaaacttaacacttggtaatacgatgattgatacatttaagcccaaattagatttgccaaccaaggcaaattttaagacaactttacccttacttggcggtgctgatttgagtttttggcttgcactggcagccaaaagtgaagagcggctgattgtgatgatcgccaatcatcaaaatgaactgaatcagttggatactgagctgtctttttttggcattgatgcacatgtttttccagattgggagattttggcttatgatcagctgtctgttcatcaagacattatctcagagcgtattgctttactaacgagaatgccaacaactggtgtcttattggtcagtactcagacattgatgcaacgtatcgcaccaccaagctggctgataggacagcattttgatttggctgtcggtgataaatttgatattcatgaacagcgacttcgattaaccaaagcaggctatgtgcagacggagaatgtgtttgagccaggagaatttgcggttcgaggcagtattgttgatatttttgccgttggtcaaagcctaccttttcgtcttgatttgtttgatgataacattgagacgatcaaattttttgatcctgacagtcagcgtactttatccgataatgatttagctcagctaaaaaaagatgcccaagcaggcatgaatacgcatcatgcccaaaagctgccatcatctgccaaaatcaccgaatttcgcctgctgcctgctagagaatttcccttggaagaaggcaaagagatgtttcgccaaaattttgcgagcctgtttcctaatgccagcgcccgcaagatagaattttataatgatgtcatggcagccattgctcctcagggaattgagttttatgcaccgttattttttgagcttgacgcatggatgaaaacaggcaatttatttagctatttgcccgatgatacactggtggttagtcatgataatcttagtgcttgtcatgatgagtattatcagcaaatccaagcacgccatcattctcgtgcacatgataaatcattgccgattatgccgcctgattatttatttttggcgaataatgaatttcatcaagtattgaaagcctatcccagagttgttatcaacacaaaccacgatacggcaaaaattggtgccatggagagtttaccgccgccgattttaccgattaatcatcaagctgccaagcctttatcagaactgctatcattcataaaatcagggcaagtaccgattttattggtcgctgaaagtgctggtcgccgtgaaattattcttgagctattaaaagataaagtcgctgtcaaagtggttgataattatcaagaatttattaataatttagatgattttaatactgattgtattgctttgagtgttgcaccgattgagcgtggtctttggttgcgtgatgaaactggcggattatgcatcatctcagagacacaaatttttggtaggcaggtgcttcaaacacgccgtcgtcgtcaatcaagtgtttcacaggcttttttgattaagtcggtaactgagttgaccgaaggggcgttggtggttcatcttgaacatggcatcgggcgttatcaaggtttggtggtgctggatgtgggtgaaggtgagcaagaatttattcatctaaaatatgccgatgatgccagtatttatgtacctattaccaatttggcactgattgggcgatatagcggctcagatttgcagacagtcagcctgtctaaaattggttcgggcaaatgggaaaaagccaagctaaaagctttggaacaaatccatgatgttgccgccgagcttttaaatgtacaggctcgtagaaatgctaaatcaggcatcagttttgatattgatatgtctcaatatgagctatttgccagccaatttgcttttgaagaaaccatcgaccaagctgaagctatccatgcagtgatgcacgatatgaagcaaaataagccgatggataggcttatctgtggtgatgttggttttggcaagaccgaagtggcgatgcgtgcggcattcattgctgttcaggcgggctatcaagttgccgtacttgttccaacgacgcttttggcagggcagcacgaggacagctttttaaatcgctttgctgattggcccattaagattgaaagtttatcacgatttggcaataaaaaacatcaagatgccattttagcagggctggcagatggtacggtggatattgtgattggtacgcataagctcattcaggacgatgttaaattcaaacagcttggtttgatgattattgatgaggaacatcgttttggcgtacggcataaagagcgtattaaagcactacaaaccaatattgacagtttatcaatgactgccaccccgattccacgcaccttaaatatggcgttatcgggcatgcaggatatttctatcattgccacaccacctgccagacgcttggcgattaagacttttttattacccaaatctgatgagacaatcaaagaagcaattttacgggagatactcaggggcggacaggtatattatctacataatgatgttgctagtatcgaggcagcagctgacacactgcgtgaattggtcggtgaagcacgagtagcggtagcacatgggcagatgaatgagcgtgagctttcggtggtgatgaatgatttttatcataaaaagtttaatgttttggttgctagcaccatcatcgagacaggtatcgatgtgcctaatgccaataccatcattattcaccgagcggataaatttggtatcgctcagttgcaccagttgcgtggtcgtgtgggtcgcagccatcatcaagcatactgctatctgatggtgccatcattgaaaggattatcaagcgatgccaaaaaacgcctaaatgccatcaccagagccaacactttgggtgcagggtttatgcttgccagtgaagatttggaaattcgtggtgctggggaaattttaggtaaagagcaatctggtaacatgcaaaccattggttttggcttatatatggatatgcttgagcgtgcgaccaatgccatcaaacaaggcaagacaccgagtcttgccacaccactggatttggttagtgatattgatattcatgcatcggcactgatacctgatgagtatttgggtgatgtgcatgagcgtttggtattttataaaagaatcagtagcttagatgatgtcaatcagctcatagacattcgtactgagatgattgacagatttggcacattacccacccaaacccaaaatttatttgcggtgcatcgcattcgcatacgagccaaagccttagggattgctaagattgatgcaacccaaaccaccatcagtattgagtttcgtgccgatacgccgattgatggattggcgattattaagctgattcagtccaatgacggttatcgcatgaatggtgcaacggccatccgatacaccagccaagagcttatggatacccaagctagaattgacaaggtgaatgagctgttactatattttgaatctaccaaaactgcctaa

SEQ ID NO: 1246 - DNA, 345 bp, M.catarrhalis
aattggcaaaaaatgaaaacttttacatgggacatatcggcagacagtagcgaaacaaccgccttaaataccaccataaccgcctttggtgatggctacgagcaggcggtaagttttggcattaacaacagccgtaaatcatggcaatgtagtaagactgacacaaaggcggtgattgatgagattttgagctttttattaaataccaaaggggtagagccatttacctttgcccccatcaagggcgagcctgccattaaagtccgcctagatggtgagatatcacgccaaaagacggggggcgatgtttggcaaattgggtttactttaaagcaggttttttaa

SEQ ID NO: 1247 - DNA, 456 bp, M.catarrhalis
caacaatatgagcgaactatgtttcaattacatcccacgctggccaaagatacctttttggttggtgatttcccattatcgaccgtgcgtttgatgaatgattgccaatttccttggctaattttggtacctcgtgtttcaggcattaaagaaatctatgagctgtcagcggctgaccaagtgcaatttttgcgtgagtcaagctgggtatctagccaaatggcaaaaatttttggtgcagataagatgaatgttgccgctttgggcaatcaggtatcacagctacattttcatcacatcgtacgctaccaaaatgatgccgcatggccaaatccagtttggggtcatgaagcgatgccatatacccaagaggtactcagccacatgcagcaaacgctgatgatggcattgcgtggtcatcatcagatgccatttgattggaaaatggatgtttga

SEQ ID NO: 1248 - DNA, 795 bp, M.catarrhalis
accatgcgactaaccaaaaccattaaagaagctatccacgcccacgccaaatccgcctatcctaacgagtgctgtgggcttatcatagatgggcagtattatccttgtgataatgttgctgtaaatcctaccgagcattttgagatagaccccattgacatgtttgagatggaggaaaagggtcaaatacaagcgattgtccatagccaccctgacggcaatgccgagccgtccgaagtggatagggtgcagatgggcatacatgggatagattgggtgatttgtgcttttggttaccacgcaggtggcaaagagtactttgatgtcaaatgccataagcccaaagcgtatcaagccccattattagggcgtgagtatcatcatggcgtgcaagactgttatagcttggtgcgtgattattatcaccgtgaacttgatattgatttgcctgactttcaccgtagcgatgcttggtgggaggatgagaaccatgaacccttatacgagaaaaactttgccaaagcaggttttatcaagatgcaagataaaaacgacttacaaaagcacgatgtcatcttgtgccgtgttgggcggacgcatcatgtcaatcatgctttgatttatgtgggcgatggcaagttaaaaagcgaaaccacgcctgattgtgtgggtaatgccctaattttgcaccacccccatggcagtcttagcgtgcgtgagatttatggggacaattggcaaagacgcacggcgatggtggtgcgtcatcaagcatcaaaccaaaccaacttgtaa

SEQ ID NO: 1249 - DNA, 189 bp, M.catarrhalis
actgcgagccgctgccaaaatcaagccaaaaaacagattggtttttggcttgattgcttattatctacttatttactacttcgcataatatatattatgttaaataatataagtaaaccaaataacaattcattgttaatatttcactttgtcatatttaaatttaataattttatcattaaatattaa

SEQ ID NO: 1250 - DNA, 285 bp, M.catarrhalis
atgaaaaagcttttaattgatgaaattgatttggcagacctaccacgagcgatagcatacacacatagcttaatgatcaagccagatgcaaaggaacaaggggaatttcaaatcacctgtcatcaggcaactaaccaagcgatgaactatctgcatggtttgcacgcagaaatcaaacggcttgggggcgtagcacccagcttggatatagatgaagatgaaatcgctagagccatcattacaagaatggttcaaggtaagagatttatggtcaatcttgactag

SEQ ID NO: 1251 - DNA, 2022 bp, M.catarrhalis
agtcatgaaagcgatttttatggcaggtgttaccatttttgccagtatttttatgcaggctttgagatggtgaaaaccatctttagcaccgcttttaaagtgataacagccgtattaactggcgatatgcagggcgtaaaagacgccatcaaagatggttttcaaaaagccgttgatatcttaaaaaaattggttggtaacattgtagatgccttaaaaaaacttggcaaagatttactacaagttgggcgtgatgccatgcagggctttattaatggtatcagcgagaaaatagatgcagcggttagcaaagccaaacagatggcaagtagcgtaaaaaatgccatcacaggcttttttgacattcattcgccatctcgtgtgatgaaacaagttggtggctggatatcagagggcttggcaattggtatcgcctataaagcaccgatagcagccaaagaagccaaaaaccttgctaaaagcgtaaaaaacgaccttgaaagcgaactacaaaaaaccgcagaagagatatttttaaccaaacagcacattgcaggcaacccatacgcccagctaaccaaagacattgcctttggtaaatacggcaaacaagacaccagccgattacaaaagttggcacaagagcaaatcttacaaagcaatattttaacgctcacccaacagctgcatgaagcccagcaaaatctcgccaatgttggattgactagcattgaaatcatgcaaagacaatatgatgaaaccgacaaatctgtccgagcgtctttggatttgtttgagcaagtcaagaaaacaagtcaagagctaattgatgcaaccaatcgccatgaggcgacccaagagtttgaaagcacgctaaaagacattgcaaaacagatggcaattatgggtagtcaagagccgttggctgagtttttatatgacttacaaaacgctgagaaatatgcttattataccactgagcagttggcaactcttaaagatgagatgattaagctacaaaatgccaaagacgccaaacaagcaagcgatggcattgaggaaagtctaaaagatattaacaaacagctggcattgctaggcagtaatcaccccttagatgactttttttatgagcttgaacagacagataaatacgcccatgcgaccactgatgaaatcaatgagctaatagacgccatctttaagctacaaaatgccaaagatgctctaaatgctaaacaagcatttgatacgctaatgaaagatacagcactggcaaatgaaacgccagctcaaaggctacagcgtgaatatgatgaaaaaatggcggtaattgataggtatgagcaaatgcacagcgataagcttgaaaatgccacaagcctaagacagcaaatcaccgagcgatatgagcaagccgaaaaagatgctaaagtcaaaaactatcaagagcatttaacagcatttgcagggtttttaaaaaacacagcaggtgagcagtccaaagcctaccgtgtgatgttcgctgcgtcaaaagcctatgccttggcggatgtgggcgttaaaatgggtaaggcggttgctgatgcttgggcagacccatcagcggtgacaatttggcagaaacttgccaatgtcgccaaagtgtctttggaacaggggcatgtgttaagcatgattaacgccattagccccaaagggtttgccacagggggctacacaggcaacatggggataaatcaggtggcaggggtagtacatggtcaagaatatgtactaaatgctaaagctacaaagcgtatcggcgttggcaatcttgaacggctaaaccgtggtgatggcattggtggtcatgtcaatcatattaatgtccatgtaaccgtaaactctgacggtagtaatgtccaagccgatacccaaatgggtaaaaccatgggcgaagccatggcaaaaatcgctcggcaagtcgtgatacaagagagcaaacaaaacggacaccttgacaggctataccgcagataa

SEQ ID NO: 1252 - DNA, 1107 bp, M.catarrhalis
cagttgatgagacgatttatcaaacaatatctgaccatctggcttgatatcatcaaagacaggtctatttttttgaccatggtgctgtcggtggtgttttatggttttttttatccgtttgcctatcaagctcagcgtcctgccgatttgcccattgtgattgttgatgaagagcaaagcccgctcacccaagccatcatccacaccacaagccacacgcccaacatacatgttttggcggttgtgagtgattttaggcaagctcaaatgctggtacaatcagcaaaggcagatgggattttattactgcctgacaatcttagccaaagcattcatcacggtcaaacaggcggggttgggctgtatctgagttcggcgtattttttgcgtacacaaaatatcggtgcaggtctggtatcatcattacaagcaaccatcatccaagagttaggacaagtcacccaaaccagacacaaacccatgccagagcttatccatcaatcagcattatttaaccctctgtcaggatatggtagctatatttttcctgctgttgctcccatcatcgtctaccaaaccatcgtgctgggtcttgccatgcttgtggcaggttatcgtcaaaggttatggcgtgccagtgcttgtgattttttggcaatttatgcggtggcattgaccattggctgtttgtcgtgtttttatttatttggttttgtattttggtggcatgattatcctaggggtggtaacttttgggggatgatgctcggtgtccccatctttgtcagctgtgccattggggtggctttattaatcgcatcatgggtagctgatggtgctaaggtgggtgtgttgctcatttttagctctgtgccattatttatgctaacagggcttgcttacccactgatggcgatgcccaaatttttacaaccattagcccacgccctaccaaccacacaaggcgtacaaatgttcattcagctcaatcagatgggcgtatccattcaagatgtttggcaaaagatggcatatttggcaagtgtggcggtgctttgtttgggggtggcgttttggcggttaagattagtgaacagatcagtttaa

SEQ ID NO: 1253 - DNA, 231 bp, M.catarrhalis
gcacaagatggcgagcatttggttagcttgccaccgtctgtatgggtaaaggtgttactgcttaacgaaatgattgcccaaaatgtcagccaagctgagcttgccaaaagaatgggcattgtgccacaaagtctaacccgccttgtggatttatcgcacaccaccaaaattgacacccttgccaatgcttttgccaaattgggtaagcagttacaagttggtttggtttga

SEQ ID NO: 1254 - DNA, 471 bp, M.catarrhalis
tccggcttaggtgccaatacaggtgttcagttacatttggtcaacccgcttggatttgagttgaatgatactcgcttaaaacgggcagggcttattattcatgaatacgcaattttaagcgttcacgataattggcaagagacaaattgggcactaaaatcgttgggcgtggagcgtattgttgccatgacgaccaagtttacccgtccgttttatgaatatcaatttaagctggataatgatcagcataaagtcgctttggtatttggttcggagaccgatggattacctgaagaggtgcgtgctgatattggtgctaatcattggctacggctgcctatgttgccagattcacgcagtttgaatttagccaatagcgttggtatttgcctttatgaagtatggcgtcaacttgggtttgtgggcgatattgggcaaagtgtgggctatcacaaacccacatcaagataa

SEQ ID NO: 1255 - DNA, 234 bp, M.catarrhalis
tttttgcaagggttttttatgacagacagcaccacatcaccagcacgccaaaaggctaccaacacttaccgccaaaaggcacttgccaacattgctttggtgattagccataccgagcctcatgttttagatgccttaaatcagattatggctcataaggattgctctaaggcaatggcaattaaggtggcgttggtagagtacgccaacaccctaagtcaaaccagccgctga

SEQ ID NO: 1256 - DNA, 327 bp, M.catarrhalis
ccgcctttgggtatagccgactgtcaccttagttgggatactcattggcattattttgaccaaatcggatcacgcaccgtgcctgatgttgggatggtgcgtatggcattacttgatagcgaacggatcatcagctggtttttattgccttggttggatgtatatataatccgtgtgcctgatggtgaaaagctggctgatacatcagtgcctaacaccctaaaactttgttggatacggcctttggtattggcgatgatgatttgtccacctgataaatatacaagctttgatccatctgggcttaagcgtggattggtggcataa

SEQ ID NO: 1257 - DNA, 699 bp, M.catarrhalis
ttgtcaattatgaacgaatccattagcctaatctcgctggtcattgaagcaagcgttgttgttaaattggtcatggcgatactgcttttgctgtctacaatcagttgggtactgatttttcatctgggtaccaaaattggcggtattgccaagtttgataagcgatttgagcgatggttttggactgatgatatcgatcatcagctgtctgttgtgcaagcagaatcagagcgtgcagggcttgagctgattttttatacaggtttttatgatcaaaatcaccaagaccaagattcttcactaagtgatgataaaaaagtgcaaatcgttgagcgtcgcttgcgtatggcattaggcagtgagcaggtgcatcttgaaaaaggattatcaacgcttgcaacgattggttctgtttcaccttatatcggactatttggtacagtatggggcattatgaatgcatttattggcttgggtcaagccgaatcggttggtcttgcaaccgttgcaccgagcattgctgaggcattgattgcaacagcacttggtttatttgcggccattcctgcgacgatggcatataatcactttgccaccaaatccaatacactgtatgaaaatcgtagcctattttgtgaaggcttaataagtgcattggtgacaaatctggcaaaaaagaacaccgcatcaactttatag

SEQ ID NO: 1258 - DNA, 1545 bp, M.catarrhalis
aatgcatacataatttacccaaaaaatcaatcattaaatttgatacacatgtccatcaaatgccagttggttgctattgataatattatcaagccttgttatgataagattttaaattttgtttatttttcaaccatgaaaatgccctattttttgcttttgggattgttgttagcacagcaggctgatgctgattatagcttgcttgatgcccaaaaacagctcatgagcagcagctctgccatccaagcaagtcatgccttgtatcaagctgatgtcttacaagcagaatcattacaaaaattacactatcctaggatatcgctcaatgcacacgcctttgtactgcaacaaaacagcagcatacccttagatcatatcaaagagcagaccgcccagcacattaacacccattttgaccatcgctttggcagtgcacccgatggtctgttagatgccttgcatgacagcacccaaaccgcccttgaccgcctgcctgaccatcaagatgtcaagctacgccatgatggcattaccccaaacattaccgccacgatgcccatctatacaggtggcctaatcagtagcagcaaaaatatcgccaatctacaagcacagcgtggtaaatttggattacaagaacgcatctctttggcaaaacttaatttgattcgccattattttaatgtgcaattacaaaagcagctgaccgacacacaacaaaacatgcttagtgccatgcagttacatgtagataatgcttataaattagaacagcaaggttttatcagtcgtggacagcgtatgcaatttgaagtggcacgcaatcgggtgcaaagactgtatcaaagcacccaaaatcagcaccaaaacagcatttatgaacttgctgttttgcttggtttgccccacattgaaccgctaagcacaccgctgtttatcaacacccagcatcgccccaattggcaagcattactcaaagactcccaaaatacaccattaaatcaaaagctaaaaaccgacattttgcttgccgatgaaaatatcgccctaagacaatccaccaaaaaaccaaaaattgccgctgtggctcgttataccttagatgataagcctgattggtttgcaggtgtggcggtttcttacaacctattcttgggcattgaccgtgataagcagattgaggcagcacacctacaaaaacaagcagcccaattgggtcatgaacaagtcaatgaacacatcacaaccaccatgcacaccgcttatggcgagatggtgctggcacaaaaaacccacgccctactacaacaaaatcgtcaagccgccaaagaaaatttgcgtatccagacgctgtcttttcaagaagggtttgggacggtggcaggtgtggttgatgcccaaagtgctttatcacagattgacagcgaaaccgctctaaatgcgtatcgctaccttttggcattggcgacgctgttgcatcacacagggacaattgatgactttgatgattatttgtctttggatgatgctcataaattgtga

SEQ ID NO: 1259 - DNA, 309 bp, M.catarrhalis
  unsure (163): Identity of nucleotide sequences at the above locations are unknown.
gtgcaagacatacacaaaatggcgttagaatgccttgatgtgcattttagtggcttggtagcagatggcgaagaaatcccattgtctaccaattgtgatgcacacacccaaaacagccaatttgacggtatgatgtgggcatgggtagctgtggacttgtcanaatatgatgtaaaaagccacaaaattaacattaccttacctaaccacctgattgccaaaattgacgaaaaagtcgcagctcataaatcgctatacaaaagccgttcaaactatctggcacaattggcaatggcggatttggcttga

SEQ ID NO: 1260 - DNA, 831 bp, M.catarrhalis
tgcatgataattcataaggcaaatcaatcgatgcgtttatccgataatcatccaacagtcaattttgataaatctgcgctaattttaccaattttagccagtgttttattacataccgtcatcatcatagcggtagcagcgccactgattacaccgcctactaagcccaatactactattcagaccgctttggtaggtcaagaggcttttaatcgtgtcaagacggccttgagcaatcatcatgccgatcaaaacaagccaactgccaccaacacttcaagtaccatcactgccaatgataatgataatgcatttatacaagctcaaaatcagcatcgttatcacccacaggtttctacttctgccaccacgacccaagcgtatcatccaccacccaactcagcaccctttgaatcaaattcaccaaatatacaaaatcaaccaacaaacgctcacgccaagctggctgaatattctaatcatgtctcagaccttgagcagtcaaatcataccgagtctacgccaagccgagcacaaatcaatgccgccatcacctcggtcaaacatcgtattgaagccatttggcaacgctatcctaagcagcccaatcaaaccatcacctttcaggttaatatgaatcaacaaggcgatgtaacctcaatccaattcggtggtggccatcctgatttgcgtgaatctgtagaagcggcggtatatgctgccgcaccattttatgaacttggcggtatgcgtgacagtatccgcctgcagttcaccacagagcagctaattatggataataaccaaacaaccaatgagcctaatcactaa

SEQ ID NO: 1261 - DNA, 1320 bp, M.catarrhalis
ttatggataataaccaaacaaccaatgagcctaatcactaatcgtcatggagtttttatgaaatcacccattaccaaagtttgccttgctctgaccataagcttttctgccgctttgacgcacacttatgctgatgatgaattgattgtgattagcgaacaagttgctccgagtcaataccccgtggcagtcatgcctttttcagaagctcatcaaatgagtcattatctaagcctggcaggtcttggtactactcaccaaaacctgccacagcacactcagacgaatagcgacattctgaataatctgaccgcatggcgtaaccgaggatttgaatatattattttggcacagtcgcatcaaattttgggaaataagcttgcaattaactatgaaattattgatactgccaatggtttggtaagcgtcaagcatacccaaattagcgataaccaccctgcttctatccaagctgcctatcgtcaaatcagcgatacaatctatcaaatcatcacaggccagccatcagatttgatgggtaaaatcgcctatgtggaagaaagcggatcgccacaaaataaaatctcatctcttaaattaattgatccaagcggtcagcttatccgtacgctagataccgtcaatggatcaattataacgccgacattttcccccgatggcttgagtattgcttatagtgtacaaacaaaaaataatctgcccatcatttatattgtgtctgtatcaggtggcacaccaaagcttgtcacgccattttggggtcataatttggcaccaagtttttcaccagatggtggcagtatcttattttcaggtagccacgagaataataacccgaacatttatcgtcttaatttacataccaatcacttagatacgctcactacattcaacggtgctgagaatgcaccaaattatttggcagatgcgtcaggatttatttatactgctgataaaggtacacgccaccaaagcctatatcgctatgattttggcacgacgcatagcacccaaatcgcctcttatgccaccaatccacgcttaagcccagatggatcaaagcttgtatatttatcaggtggacaaatcatcatcgccaataccaaaggccgtatccaacaaagttttagggtgttaggcactgatgtatcagccagcttttcaccatcaggcacacggattatatatacatccaaccaaggcaataaaaaccagctgatgatccgttcgctatcaagtaatgccatacgcaccatcccaacatcaggcacggtgcgtgatccgatttggtcaaaataa

SEQ ID NO: 1262 - DNA, 684 bp, M.catarrhalis
tcaaatgagattgccatgagttttaacacagacatacaacaaaccaccgtacaaggctttattaccttgtacgaattagacgcacgaaaattgggcggtgagatttaccgctttcatgggcataacgatggggtgattagatggcaggggcaggattttcatcccatcgccatcaaggcagacggccttgaaatgcgttcagatggcagggcaagcacgcctaagcttagcattggcgataagattaatggcatacaaggggcggtatcagccctttgccgattgtatgatgattttgcaagggctaagcttactgtaacgcataccctgcaggcgtatcttgacagccatgatgcccaaaattaccgccagcaagaatggtacatagaacaaaaggtgagcgaaaacccaagccttggcattgtagaatttgagctatcaaaccctgtggactttgaagggcaaaaaatccctgtgcgtcaaatcaccacctattgtaatgaagcagtctgtggtcgttatcgtggcgaagtgtgtggttatacaggtacagcacgatttacccatgatggcaagccaaccgatgaccctactttggacagatgtagcggtttattagcccactgtaagttaagggacaatgaaggcagtttttgtggttttcctgccgctggtttggtttag

SEQ ID NO: 1263 - DNA, 240 bp, M.catarrhalis
ggtaacaggatagtgcataaattctctgcctttgtggttaaagcaattacacctgacgaaattagggcagcaggtgagcaatttaaatcccaccctgaaaacaatgcaccagccaccgcagataagctgattgccaataaaagcggttttgttttatctgagcgtagtcttaaaaatctacagatgattattgcccccttgccaaagcaatggcacaggcaagcggtaagctgggcgtaa

SEQ ID NO: 1264 - DNA, 420 bp, M.catarrhalis
atcaagggcttttttaggagcaaaacaatgagtgaaacaactctaaccgaactatcacgcaccgaagcgacggtattacagagctttatcgcacaggtggacttttggaaaaaccaacacggcgataaagctgccaccattgaagtcatctactaccctgaggatgacggctttgaagtgagtaacaatgagcctaataacggcgtgctaaaacgcaatcgcaccacggcgtttcgtgctgatctgttggcatgggcgtctaaccagttacgccaattacaaggctgggacaacagccaaacggtcaccgcctttattctgtcttttaaggacaatcgctatggggtgcgtgctgcccttgccagtgaagccacagacaaggcagatgatggggctgaacaggctgaacaagataagtaa

SEQ ID NO: 1265 - DNA, 3045 bp, M.catarrhalis
ttgatttgggttttgccagaatttctcgctataactatcgatcacgcatccaaagactgcccatcgaggcaatcagtcaagcccgccgccaatcaaagaaaagggcggtgcggtagggtagcacctggggtgtgtattcggttgtattctgaagaagattttaacagtcgtccagaatttaccgaacctgaaatcctacgcaccaatttagcatcagtgattttacagatggagcgtcttcaacttggcgatgtgaatgcctttgactttatcacaccgcctgacttacgattggtgaatgatggccgtaagcttttgatagaattgggagcacttgatgataaaagttttaccaaaacacgcgccaaaaagggacgcacacagcttagcagtctaaccaaaatcggacaacaaatggcaaaaatgcccatcgatccacgcttggctcgcatgcttgtagcaggtgatgcctttgattgcttggcggatattttaatcatcgtgtcagcgctggcggttcaagatgtgcgtgaacgcccaatcaataagcacgctcaagccgatcaaaagcatgcgttatttcgtaaagaagattcagattttttattttatttagaattgtttgcagcactgtttgatcggcattcaaccaatgacaatcaagcacttagcagtaatgctcgccgcaattttgccaaaaaacattatctaagctacgcacgcatccgtgaatggcaaaaaactcacaggcagcttagtgagatgatggcagagatgggttttgagattaataaacaaaaaaatcaccaaaatgatgtgaaaattgataccaaaaagggcgttcgattatcacttaagtctggtacctctcatcaaaaatccatcaaacaagcactcgtgggtgccaaagccctaaaaaatgacattgataacaaaacaagcattcattatgccaatattcatcgtgcacttttgagtgcacttttgtcatttgtggcgcataaaaccgatacggtgggcgaatatttgatggctcgtagccaaaaagcccgtatttttcctgccagtacgcttcataaaaagggtgctcagtgggtcatggcgtttgaggtggtggaaacttcgcaagtttatatgcgtacgcttgctaagattgaacctgaatggattatcaaagcagcaccgaatttattaaaatatcattattttgaaccgcattggtcaaaaaaagcagggcgtgtgcgtgcttatgctcaaatcagtttatttggactgattgtgattgccaaagaattggtgaattttgaacaaattgatttggtacaggccagagagatttttattcgtgatgctttggttgccaatcaatatgggatgcagatgaaatttttggcagataatgccaataaaatcaaagacattgagcgtattgaagataagcttagacgccgagatttattggttgatgaagaaagtttatatcaattttatgatgccaaaattcctaatcatatcgccagccgtaaaagttttgaagaattttatcacgatgctgaaaacaaaacacccaactttttgcattttagtgatgaagatgtgcttaatgaagctgttgatgatagtcgagaatttcctgaaagttggcatttgggcggtgtacgcttgccgctgtcgtatgtctttgatccagcggctgataatgatggcgtgaccgtgcatgtaccgattaaggcattggcacaggttgatcctgtggcactgctttggggtatctcagggtggcgttatgaattagtactacaattattaaaaacattgcctaaagaaattcgccgacagattgtccccattccagatacttgccaaaagatttttcaccaattggacgcaagctcaaagatgggtttattagatcagcttgtggcagcattaaagacgcttggtgtgcaagcacacgctcaagattttgcacctgataaggttgaagattacctgcgtccattgatttgtgtggtggatgataaaaatcgtgtgatcgaaaaaagtcgtgacttgccgaaattacaggcacgacatcgtaaagctagcgttcaaagcatcgctattgagcagggagtgcatcatcattttccaaatcattttaattttgtcaaaaataagcacacatcaggcattgtcatgcaagaattttctgcactaaaagcagatgcggcccaaagtgcggtttttattgcgacatttacagagatgaacgctgctttggctgagcataaaaagggcgttttaacgctcattaaggggcatttgggtgcgaaacaaaaacagctgactggtcaaattgataaagcatttaaattggcgttcgcaccattaggtgatttagaaaaactaaaaaatatcgtcgtacatgcaactttagaagcctgcctttatgactacggtccagactttgatcataagcctgtcagtcaacacgttgatcatgccagagcagcaattgcaggtctaataacacaaaataatcaatggctgatttcacatttgccactagatgaacgagagtttgacgattgtcaagacttaattttaaagaattttttactggttggtcaagaaatcttaagaaacttaaaagaaatttataccgcttggcaaacagctcgtggcaagcttttgatgctagatcaggagattttcggtgaaaatatcgaagacatcgaagatcagcttgatgacttgcaattggcaaattttgtatatcagacggattatcggcattggcgtcagtatcctcgttatttacaggcactcaatattcgccttgataggctacagcataatttagaggcggacttggatgctgtatatttgctagatacgcacatggaacgcttagcaaggtgcgttaaaaatcctaagtttgcagaatatcgctggctggtcgaagaataccgcattaatttatttgcccaaccgatgaaaacagttcagccagtttctgccaagcgtcttgaaacactgtgggcaaatctgacaactcaataa

SEQ ID NO: 1266 - DNA, 1005 bp, M.catarrhalis
atacacggcaacaccgccgagctacaaagtgataatttaacctttactaccccacaaacaggtaaaaccgtctacagcattgatggattgaagtttactaatgataataatagtatagtaacagtcggcactactcgtattaccagagataaaattggctttactggggctagtggtgaacttgatgaaaatttaccatatttggataaagaacaacttcaagtgggtaaggttataattaccaaagacagtggtattaaagcaggtgatcaagaaatcaccgaggttaaatctgccattgctgacgcagctaatggacaagtagaccaaagctttattaatcgtttagaaactgctaataacagcaaatcaaaatatgccgccaccatcaaagacctgcatggcttatcacaagtacagctgacctttgcaggtgatacaggcacaacagctaaaaaactgggcgagattttaaccattaaaggtggtgcagataccagagaattaaccgataaaaacatcggtgtggtaaaagataatggtaatggtggtggtctgcaagttaaacttgctaaaaacctaagcggtcttgatgcggttaataccaaaaccctaaccgccacgggtaaaattcaggtcaataataacggcaacaccgccgagctacaaagtgataatttaacctttactaccccacaaacaggtaaaaccgtctacagcattgatggattgaagtttactaatgataataatagtatagtaacagtcggcactactcgtattaccagagataaaattggctttactggggctagtggtgaacttgatgaaaatttaccatatttggataaagaacaacttcaagtgggtaaggttataattaccaaagacagtggtattaaagcaagtgatcaagaaatcaccgaggttaaatctgccattgctgacgcagctaatggacaagtagaccaaagctttattaatcgtttaagaaactgcttataa

SEQ ID NO: 1267 - DNA, 621 bp, M.catarrhalis
ccccgtggtgaagacgatattttggataccaaagagcgtgacatcagtttaattgttctagatttgatgttgccagatatggatggcatggaagtgtgccaaaaagtacgcggttcaaaaaataccatgattaacaaagtaccgattgttatgctcaccgctaagggggacactaccgatcgtgtcttagggcttgagatgggtgctgatgattatattgccaagccatttgagccacgagagctattggcgcgtatccgtgctgtcttgcgtcgtcacgaaacgccaaatcaagcagataccaactcaggcagcctaacttttggtcgtttgacggtttatccagacagccatgaggtcacgattgatgaaaagaccgttcgtctgaccacacaccagtttcagcttttacattattttgctacgcatgctggcaaagtactcaatcgtgagcagctttggcaagccatgccaaacgatgacagctcagaaaatattgatcgtgccatcgatgttcatatctcaagattacgcgctttgattgaagataatccacgccagcccaagcgtatcatcacagtgcgaggcgttggctatcagtttgccaccgatcaagtttaa

SEQ ID NO: 1268 - DNA, 693 bp, M.catarrhalis
  unsure (534): Identity of nucleotide sequences at the above locations are unknown.
acgagctgctgcgggaatcgtgatttaacagggctaaatgacttggttgaaagcattttgttggtgtctcggctggatgcaggacacgctctgcaagccaccgaacaagtcgatttgtatgagctgattcgctcagaagtgcagcactatcctgaggcgacacttatcggtgaatcagtgagtatgatggctcagccaaaattgcttacgcatttggtgcgtaacctactcaataatgccatgattcatggcataccgcctgttcaagtttatctgtatcacgccaccaatattcaagaagccacctcaatccctcagtacctgctagacagtttttgtaacattggtgatggcgatattttacactcaaaatcagatgaagcaaacgctttagacaacaaaaccccgactgattttgtaaagcgtctaactcgtcccaaagataaagagcaaaaggcagatcagccaaattttgcagtgcttgcttttatcgatcaaagcttacgcattcccaaggataagcgtaaggacatntttagcccttttgtacgcctaatacaagaaaaaaaaggggtagggcttgagctatcattggtatcaaaaaatgttgaagctcatcacgggacaatcataacaaatacttggcttgggcataccccttttttggtgattttaccaatgactggcaaataa

SEQ ID NO: 1269 - DNA, 903 bp, M.catarrhalis
tcaacagttggtcgtcttatgaacttggtacattatggaaaatttggttttcgctccatttcagcacgattatttatcagcgtttttttggcacttttgacctttaccattgcttttgtgctattgtcacaatttgcacataataattctgattataccagaaatcgagctattgccagtcaaattatgaatcaaattgagccatttttggcagaggcacacactttatcagctaaaaataatttgcttcaggcgagattttctttggttgttatcaaaaaaagttttgatatttttgatgaaagcttgaatgccaaaattgggctgtatgattctcaagggcggctgatgctacaaaccgaaaataccgacttgcctgaaacgcttgtgcctaatccaccatggattagccaaatctttgcaccatcacccacccacattgtggtcaatagcacacttggctattctttatggtacgaaaatcgcattcttagccctgaacgccctttgatggcatggtttaatctattttcaggcacagtcttattatttaccatcatgtcggcagtactttggtggatttcgcacagtattacttggcgaatcaatcaactaagccaacagatgagccgcttgggtgaaggtgattttagtgtgcgagtcatcgaaaaaggtaatgatgagattgcggtgcttgcacatggatttaaccaatccgcccaaaaaatcgaacaattgattgatgcacacagcctactacttgcgcacgcttcacacgaatttcgtacgcccattactcggattcgcttacaaattgagatgatggatatgctaacaagccagcttgatgaaactacaaaagccaaatttgataaacgagctgctgcgggaatcgtgatttaa

SEQ ID NO: 1270 - DNA, 459 bp, M.catarrhalis
caggctgtgccaataaatcaacaagtcaagttatggttgctcctaatgcacccacagggttacactggggttatctatactggtgttgcacctttggtagataatgatgagaccgttaaggctctagcaagcacgctacccagtttggtttattttgactttgattctgatgagattaaaccgcaagctgctgccatcttagacgaacaagcacaatttttaaccaccaatcaaacagctcgtgttttggttgcaggtcataccgatgagcgtggtagtcgtgagtataatatgtcactgggggaacgccgtgcggtggcggtacgcaactatttgcttggtaaaggcattaatcaagccagcgttgagattatcagttttggtgaagaacgccctatcgcatttggcacaaatgaagaagcatggtcacaaaatcgtcgtgctgaactgtcttattaa

SEQ ID NO: 1271 - DNA, 258 bp, M.catarrhalis
cccctccacacaaatttagcagggtttattctcattgggggggttggcatcaagcgccctaaaataaaacaaaaggcggagccccaccttaggggaggggggggaaaccttataaatggttttaacagtatggatgggttaaatgcccacattaaagaatgccttttaatcaagaatatctaccttaaggcaggcaacttgattttgatgttgtatcctcacgccaaagttaagccaacgggtggggcaagtgtttga

SEQ ID NO: 1272 - DNA, 831 bp, M.catarrhalis
accaaaataacgccaaaatcatccatgaataaatccaccaaccaatttaatcatttaaaagtattatcaataaaaacttatgataaattgcaatcaggctttgtattgttagtcgttttggttgtgctacttttcatcagtgggctgacggcactcatgatgagccaaaattctgtggatgtacgcagtgtactttatcaccaaaatcaatacaagctttttatcgcagctgataaggcggtgatgaatctatggcagttgtctcccaaacatcttgttcatatggctcagactgatacatggcttgcctcactattatccgataagaatgatttgacaaaaatttatacagctcaaagctgtaatgactggcaaacatttagtatcagtacgcttgacgatccgccaatacaatgccatcaaactgcacctattgtaagttggcaagctacttatatagagccaattggtgccaatcattatctaaatacattgctccaaaatacactgtcaaaaaaatcagcccatgatattcaaaaccccgatcaacaagcagtgaatgatgacacagctcactatgaaatttttcacttaagattatatgccatcgccgctcaaaattcacaagatatcatccagtgtcaagaaccgctatatcaaacacgcatcaccacttgcctaaatgaccacgggattattcataaaatcagcgttgctgaatggttaatttggcgtcaaaaaattcaaaagaccgattcatctgccgaagcggccaatgctattcgtatcatgcctttgcgaacctatgatatacgctcaatgcgtgaatag

SEQ ID NO: 1273 - DNA, 2604 bp, M.catarrhalis
atgattatgacagatacagtacaaaaagatacagcacagtcccccaaaaaagtttatctaaaagactacacaccgccagtatatgcagttgataaagtggatttggatatccgcttgtttgatgatcatgctgtcgttggtgccaaacttaaaatgacacgagcacacgcaggcgatcttcggctttttgggcgagatttaaagcttaaaagcattcacctaaatggtcaggaattagagtcgcaggcgtatcatcttgataaggaaggcttaacaattttagatgcaccagatgtcgcagtgattgagacattggttgagatttcaccacaaaccaacacaacacttgaagggctatatcaagcaggaacaggtgatgataagatgtttgtgacacaatgcgaacctgagggttttcgcaaaatcacctttttccctgaccgccctgatgttttgacagaatacaccacacgcctagaagcaccaaagcattttaaaaccttgcttgccaatggtaatttggttgagtcaggagatgtggatgaaaatcgccattataccatttggcatgatcctaccaaaaaacccagctatctattcgccgctgtcattgccaatctagaagtgcttcaagaccactatacaaccattgaaggtcgagaagttttgcttgaggtgtatgccgatgctcaagatattgataaatgtcatgttggtatgcaagcgctaaaagatgcgatgaagtgggatgaagataattatggtcgtgcttatgatttagatcgctatatgattgtggcgacaggtcagtttaatatgggtgcgatggaaaataagggcttaaatatctttaacaccagttgtgtattatcaagccccgaaacaacaactgacgaacgcagttttttggttaaatcggtgatcgctcatgagtactttcataactggacgggtaaccgcattacttgccgtgattggttccagttatgcctaaaagaaggatttactgtatttcgtgaccaaagtttttcaggtgattttcgctcaaaagcggttcagcgtatcgaagatgttgctgtattacgggcagcacagtttgctgaagatgcaggttcgttagcacaccctgttcgccctgagagctttgttgaaattaataacttttatacaatgaccatctatgaaaaaggtgcagagattgtccgtatgattgccaatttcttgggtaaagagaaatttcgccaaggttcggatgaatattttgctcgctatgatggtcaagcggtaaccgttgaagatttcttatctgcgatgtcagtggcagatgctcgagtgatggattttttagcgtggtatcgtcagccaggcacaccagttgtatcaggtggctatcgtgttcttggcgataaagttattattaatttatcccaaaaaacccgccatgtacctaattatgatgcacccgttgcactaccaatccccgtagatacggcaatttttgatagcctaacaggtgagatgttggcaagcagaatgttgcttttgacaacagataatgcacaatttgaatttgatcacattcagctgtctgatggtgctcatcctgtggtatcagtgttgcgtaatttttcagcacctatcaagattgactttgattatacagatgaagatttggcaagtttggtggcgtttgaaagtgagggattcaaccgttggcaagcactgcaaatactgatgaatcgatggttatccggtagcgtagaggacgccactttaatcatttcagttatccaaaaagctgttgatgaattgattgaagatgatcctatgctggcagcacgattatttgatattccaagccaaaaagagcttgcgatggcttatgatgaaaattatgaccctatcagtgttaaagctcgccgagatgaattgattggcaaaattgctgatggtttgctagaaaatgccaagctttggtatcaaaaattaccattacaagcgtatgaagacacaccgcaggcacgaggtcgccgtttattgcgtaatgttttattgaatttgcgtttgacggcaggcgatgagatggctcatcaagatgcttatcatcaatacgataatgcgtcttgcatgagtgagcgactgggtgctttgatggcaatgattgagcataatttggataaaaaagacagctatcttgatgatttttatgccaaatttagccatgaagatttggtgattgatgcttggtttgtcgcacaagcaacgccagatagtaccagtgtctctcaaatagcctcactcatggagcgtaccgattatgattggaacacaccaaatcgtgtacgcacgaccttaagtgctttggctgccaaacctgtgcaactttggacagctgagggtcttgatttgtatttgtcatcggttgtacgcttagatggtagcaatccgcagttggcggcacgcttgctttctgcgttggctcgttggaatactttgacagctgataaaaaagcgatggctcaagaaaaactggctgcagttacctctcaggtttcatcaaaaaatgtgcttgaatttttgcaaaatatgcaaacggtagcataa

SEQ ID NO: 1274 - DNA, 600 bp, M.catarrhalis
gctttttattttttgatcatcatgcttaagattcactctgccatttttttacaacctgcaccacaagtcatcatcgcatttgcaaaaatggtacaaacaagccgtcagcgacttaaacaaaaaaaggctcaatctgcgtgtgtgcgttcacttttacaaatcaccatgcaccgctttgacattgttggtgaatttcatgaccatgcacacccttattatattaactcaaataaaatacgctactttgtcagctttagccattcagataatcaagtcgctctcatcatcagcttaacaccttgtgccattgacatagaagttaacgatattaaatacagtgtggttgaacgatactttcatcccaatgaaatttatctacttactcaatttagctctactgataggcaacagcttattaatatcttatggcgattaaaagagtgccgaatcaaactgattcaagatcagctgtatactggcatgggtgcggatatgtcatgttatctgactgacattcggcccaattcaatcaatttaataaaaaataatgacgattacttttataaccaccctaagctcaagctaactgctctattttaa

SEQ ID NO: 1275 - DNA, 1155 bp, M.catarrhalis
aatggatacgcaatctataaaatttatgttacaatcaatgagatttttaagtttttattttatcacaatcaacatataatggagagatttatgaccttggctcgaaataagtttgctcaagtcatgccaaagtttgccgctatagccatcgcagctttggcggttggctgtagtcaacccacccaaacaatctcacaagcacctgccgatacctcaaatacatccaccgaaaaaatccccaaaaccattgcgattaccgccatcgttgagcatccgtcattggatgatattcgcttgggtgtggtggatggtttggcaagcttaggttataaagacggtgaaaatttgaccgttaatttccaatctgcccaaggtaatatggcgactgtcgggcagattgccaagcagtttgtggcggatacacctgatgccatcgtagctattaccacaccgagcgcccaaagcttggcggcagcgactacaagcattccgctgatttatacggctgtctctgaccctgtggctgccaaattattaaataacaatcatcaagctacccagcctaacattacaggtttatccagtcagctgcccattgagccacaagttgaattatttcaaaaaatcaagcctgaagccaaacgcattggctttgtttttagccctggtgaagccaattctgttgccgtcaaaaataagttaattgaaattttaccaaaatatggcatgactttggtggaagtgcccgccaatcgatcaagcgatgtgggcgatgcgacgcgttcattggttggcaaggtggatttactttatacatcactagataatggtgtggcatcagcgatggaagcgatggttttggctgctaatgagttacaaatacctgtgattacctcagatgaattttcggtacgccgtggtgcgacagctgctttgggtgtgaacgattatgattttggcttgacaaccgcaaaactggtcgctcaagtgttagatggtaaatccccaaatgaaattaaacctgaagtgatgaatactttgaccttatttatcagcccaaaacacgcagccaatcaaggcgtaacggtggatttgacaacactgggtgagagtatcaatgttgacaccacgccagcacgtcagccgaataaataa

SEQ ID NO: 1276 - DNA, 1017 bp, M.catarrhalis
ctacaaccagccagcgttaatagtgcagcagttggtaagcttaaatattggatggtagattttttcataaagatgctcatcactcaaaagctaatttataaaatttatcgaagaaaagcacgctgtgctataatacttgattggcgaaaatgcccttattataacacaattcatcaacaaatcacgcacaccaacctttacatttggttgctttattttatttatcaattaactatgaccatcaccaacgatagaaattttgataccattagcgaacactttgccaaaaaagtatatggcggtcttaaaggacgcattcgcttagccgtgcttcagcaagatttaagcgaagcgatggatcagcttatgctcaatcgccctttacgcatcttagatgtgggcgcaggactggctcagattagcctatctttggcatcagatcatcatgtaacggtcaatgacatttcaaccaatatgctagatatggcaaaagatcatgccaaatcgcttggggtatatgatcaagtacggtttatcacttgcccttatcaggcattgtcaaatcatttggcaggtgagcagtttgatattatcttatgtcatgcactacttgagtggttgggcgagcctgaaaaaatcatgactttttttgatcagtatttggcagatggtggcatgctgtctttgtgtttttataatcctgccagtaaaatttatcgtaatttaatcatgggaaatttttatcagcttaatacgcctcgccctgctgatgataaaagtttaacgcccaatcaccctgtcgcccccgataccgtcgaagcatggctaattgctcattattataaaatcagtattcgctcaggtattcgggtattttcagattatgcacccctgaagcgtggtggcctaaataaccccgacgatgtggttgcgatggaacttgaatactcacgccagctgccttttcgtgccatggggcgatatctgcatatcatcgccttcaaaaatcctgcttga

SEQ ID NO: 1277 - DNA, 330 bp, M.catarrhalis
ctgtcatgccacgcatttggggggcgtatctttaaagagggtagtggcagccagccagatgataatcctgatatcttggactattatggttatggtgatgtgcgttttttatatcaactagaaaataaaagtaatatttcaggtacggtacgctataatccacgctcaggcaaaggtgcgttgcaacttgactatgtctatccgcttggtaagggaattagtggctattttcaaatatttcaaggctatgggcagtctttgattgattataatcatgaggcgacaagctttggcgtcggacttatgcttaacgactggatgggtctataa

SEQ ID NO: 1278 - DNA, 1914 bp, M.catarrhalis
ccaataatgcaatgtatatttattgatattttgtcattaataaatcttaatgaatatatagtgccaatgattatatttaaggataattatatgaattttgagaaatatactcgaacactgcaagaggttattcgtggggcacagcaaagcagtcttgggcatcatcatactgcaattgcccctgtgcatttgctgagtgctgtggctgataatcatactgcactgtccatcattgaggcgagcggtgcaaatttagcacggctacaagatgagattaagacactgctttcttatcaagcggtgatcaatcagcccacaggacaagtgaatttatcacctgaaactatcaaggtcttacaggcaacagaaaattatgcggccaaagcaggcgatgagtttgtaccgattgaatggctgattttggcactatttgagaataaatcactcaataaagcctttgtatcatcaggtgtgaccgcccaaaatttacaaacaattatgaaaaatattcgaggagatgaggctgtgaccaatcaaaatagtgaacaaaatcgacaagcattagataaatataccatcaatcttactgagcgtgcgatggcaggtaagcttgaccctgtgattgggcgtgatgatgaaattcgccgtactgtacaggtgttatctcgccgtaccaaaaataatccagtgcttatcggtgaagcaggtgttggtaaaactgccatcgttgaagggcttgctcagcgtatcgttaatggtgaagtgcctgaaagcctaagaaataaaagcgtgctatcgctggatatgggttctttgattgctggtgcgaaatatcatggtgagtttgaggagcgactaaaagcggtgctaaatgagcttgccaaacaagacggcaatatcattttatttattgatgagctacataccatggtgggtgctggtaagaccagtggtgcaatggatgctggcaatatgcttaagcctgcacttgctcgtggtgagttacgctgtgtgggtgcaacaactttggatgagtatcgtcaatatattgaaaaagatccagcacttgagcgtcgtttccaaaaagtcttggtagatgagccgactgttgaagataccatcgccattttgcgtggtctaaaagagcgttatgagctacaccatggtgtcaaaattatggattcggccatcattgctgccgctaagatgagccaccgctatatcaccgatcgtcagctgccagataaggcaattgatttgattgatgaagctgccagccgtatcaaaatggagcttgatagtaagcctgaaagtttggataagctagatcgtcgtatcattcagctaaaaatgcagctagaagctgtaaaaaatgaagaagatgctggtgcaaaatcacaagtcaaatcacttgagcagcaaattgatgacgcacaaaaacagtatagtgagcttgaagaggtttggaaagctgaaaaagtaggtgttgaaaaaagtaaacagcttcaagccaagctagataccgcacgcatcaccttagaaaaagcattgcgtgaaggggattatgctcgtgcttcacagctacaatatggtgaaatcattgcacttgaaaagcaattggcagaagagcagacagatgagccagaacatgcacccaagctacttcgtaataaagtgactgataacgaaatcgctgaggttgtgtcgcatgccacaggcattcctgttgccaaaatgcttcaaggtgagcgtaataaactgttggcgatggaagatgtattacatgagcgtgtcatcggtcaaaatgaggcagtggcggcggtcgcaaatgcggtacgacgcagccgttcgggcttgtcagatcctaataagccaagcggttctttcttatttttgggccgcgggcgtgggtaa

SEQ ID NO: 1279 - DNA, 1050 bp, M.catarrhalis
gcttgggttaaatatcagctcattagactgtgccatcatggatggtctatgaaaccaatattgacaaatcagcaaggcatgactttgatggagctggtggttgccttaggtttgggttcattcattgttttgatggcagtgaatttttatgctttatcagccaaaaatagtgcctatacgcacagtattgcacaatttatagatcgtgagactttgggcatcacggccatgaccgagcagcttagactggcaggcattggcatcatagatatgccagctgtgcttgttcataaagaacagttacttggcatcagtagcagccaaagtattaatcttaatcatcagctatcccaaacaggtggcttaccaagccactatcctaaatcctccgatcagcttaccatacattatattgcgcctgcggatatgtgggattgtgaagggagtgttgttcttggaccccgtccagctcgcctaaaaaatggtaagatggctatggtagatggtcaagttgttatcgaaagatattttgtacaaacagaaacagacggttctttatccttacgctgtgatgcagggcgatacatcaccgatgaaatcatgcgtgatggcactcgaaatcgacacggtatcagcgcaccttatataactgcagtgattgatgctcaggtcaataagcgatttggcaccgataaaccaaaccatattcgtgggcttggtaaaggagatgtgatactgtcagatattgaaggtttttgggtgagactgatcgtggctgatggatcaaccagacatagcatgacgattgaaaattatcaaacacattggtatggttatcccattattggtgtacagcttgctatactcagccgcagttcacctgcaccacatgcaagccagacacacaactttttaatttttgatgaaagcatctcgccgccgaatgatggtttaccaagaagattacatacgatgaatgtcaattttgtcaatgcttctttgaatcagaccaagatgaaccaaaataacgccaaaatcatccatgaataa

SEQ ID NO: 1280 - DNA, 273 bp, M.catarrhalis
tgttgtatcctcacgccaaagttaagccaacgggtggggcaagtgtttgaagatccccaaaaacccaaggataatcaattgcccaatacaggtgttgatttatatttggagcggttattatccagtatttttattcaaagctcaaattatggtacacgggtttcaaatttactgtgtcttcaaaatcatcatctgacttggcaagaaaaacagcaacagggtaagcatatgggtcaaatattttcttggtctggtcatttacaatacaaataa

SEQ ID NO: 1281 - DNA, 849 bp, M.catarrhalis
tgttgccaaaaattaaagccaagctatcaccaaaaaaacactaaggagtgtaccatgttacaagctaccgatcttcgcctaacctttaatcttggtacgcccatcgaaaatcctgcactgcgcggactgtcgttatcaattgctgatggcgagtttgtgacagtgattggtaccaatggtgctggtaaatccactttcttaaacgccatcagtggggcggtgcgtgtcgatagcggcagcatcaaaattaatggtcaagatgtcactcgcttaaagacgcatcagcgtgccaaacaagtggcgcgtgtttttcaagaccccatggcaggtacttgtgaggcactcaccattgaggagaatatggcactggcttacaagcgtggcggtatgcgtggcttagcaagtgcattaaatcacaaaaatcgtgagttatttcgtgaaaagctatccatcttaaaacttgggttggaaaatcgcctaactgatcgtatgggacttttgtcaggcggtcagcgtcaggcggtcagcctattgatggcaagcctgcagccctcaaaaattttgctgctagatgagcatacggcggcactcgatccaaaaaccgctgcttttgttttggatttgactgataaaattgtcagtgaagggcgtctgactacgatgatggtgacgcattccatgcaacaagcactcacgcatggcactcgtactgtcatgctccaccaaggtcaagtgatgctggatgtatcaggggataaaaggcagggcatgaatgttcaagacttattaaatatgtttgaaaaaactcgtggtgaaaaggtggaagatgatcgcttgattttgggctga

SEQ ID NO: 1282 - DNA, 1041 bp, M.catarrhalis
ccgttcatgaaagtttcactgtctacattgactttatctattttgtcatgttttgctatcctagctattcagcaagcaaaagctgtaccaaatcctgtggcatttgttgacgaagtacgcagtgaaaatgatcttgggcaagacaatgaattacccattgatgtccaaagtgcgacacaatcggcgtctactgatacggctaatcctttagacgaacatgaaccagagctttatacgacagctttagaaaataaaaccatgctgattaactgctcagcacttaatcaagatatcatgcgtttggcgtgctatgacactttggtgcatggtgagacgccagcggtaattaaaaccaagcgttccattcgccttgatgaaacaatttggcagaccatcaaaggcaaaccccaggttatctatcaagaaacgacagatccgatttttttaatgggtaatgaaaaaggcatgctgaccaaaaaagatgccaaacagcttgaatatgcagccaaacagtttacaccactgagcttatcatttgatttagaccgaaataatacaccactttggtcatcacgaccacacaatccgatgtatgtattgcccatatttatgcacggtaagcctaatcgaagcccaaatacgcccagtcatgaagcaaaacaatttaccccaaatgaatttcgtgctcccgagctaaaatttcaggtttctgttaaggttaaagctgctgaggatttatgggggacggattcagatttatggtttggatatacacagcaatcgcactggcagatttttaatggaaaaaactctcgtccttttagagtacatgactaccagccagagattttcttaactcaacctgtatactcagacttaccatgggatggcaaagtccgcatgattggcatgggtgcggtacatcattccaatggtgaaagtgccaaactgtctcgctcatggaatcgtgcttatttgatggcaggcatggaatggaaaaacctgactgtcatgccacgcatttggggggcgtatctttaa

SEQ ID NO: 1283 - DNA, 675 bp, M.catarrhalis
gtgagtcagaaagccagtgtttcacgcttggtgggtgcacctccaggttatgtcggttatgaagaaggaggtgtgctgaccgaagcggtacgccgtaagccgtacagcgttgtactctttgatgaagttgaaaaagcacatccagatgtctttaatatcttactgcaggtgcttgatgatggtcgattgactgacagtcaaggtcgtgtggtgaactttaaaaatactgtcatcattatgaccagtaacttaggcagtcatgcgatccatgagatgacagactcgccttatgaagacatcaagactgcggtaatggcgtcggtcactggacattttagaccagaatttatcaaccgtatcgatgagattgttgtctttcatggtttgggtgcagatcaaatgacgggcattgctgaaattcagcttgatcgtttgcgtacacgccttaaagagcgtgagcttggccttagtgtgagtgatgaggcgatgaatcatttggtatcggtgggttatgatcctgtctttggtgctcgcccattgaagcgtgcgattcagcaagagattgaaaatccattagcacaacttttattatctggtgagttcaccacgggagataccatctttgttgagtggttgaatgatcaattcacctttaataagctgcgttatagctga

SEQ ID NO: 1284 - DNA, 753 bp, M.catarrhalis
accaacatcgacgactatcttaatcacatatcatcactcatgaatattattttattaaacgataacgattttatcaccgccgacagtgccgttattcataatcagtcaaccattgtacatctaaaaacggtattaaatgtacaccatggcgattttataaagttgggaaagctggggggcaatatgggtcatggcaggattgtccatatggatgaaaatcaggtgatattatcagagattactttgaccaagtcgccaccttgtaaacttaatcttgtggttgttttggcactaccacgcccaaaagttttaagaaggctggtgatggatatgacagcagcaggtgttcgccatatggtctttattaatagttatcgtacggataagtcctattggagttcaccattactgtcacgattggatgaatttgtcatcgagggtctgcaacaaggcatagatacaataactccacagataacacttgccaaacggtttaagccatttgtgcaagatgacttgccaagccttatcggtgatggcggtgcaattgtggcacacccttatgccgaagaacactttggtaaactcacccaaaaccagttaccacaagttttggttgtgggggcagaaggtggatttattccttatgaaattcagcttttggacagtgtaggcgttcaagctgccagtttgggcaagcgaattttacgcactgaagctgcggtcaatgcgttactgggtagatggctataa

SEQ ID NO: 1285 - DNA, 1029 bp, M.catarrhalis
attaagcgacttggcatgacaggagttgctatgaataactttttaaaaacgaccctttgggcaagtttggtggcactaaccttggcggcatgtggtggtgataagcctaccgctcaagctgatttggctgccagccaagccaaaacagtggcaatcaccgccattgttgagcaccctgctttagatgccgctcgccaaggtgcgttagatcaattgactaaggaaggttttaaggaaggtgaaaatctgaccgtaaatttccaatctgcccaaggcaatatggcaacggcaggtcaaattgccagacagttcacctcggataatcccgaccttatttatgccattgccacaccgtcagcacaggctattgcagcggcaacccaggatattcctgtggtattttcggctgtcactgatccgatcgaagctcggttggttgcaaacctagaaaactcgggtaataacatcacgggcgcgtcagatgcgctgccttatgaaccccaaattgccttaatccaagagcttgtgccaactgttaaaaatgttggttatgtttttagcccaggcgaggtaaactcaactgtggtacttaaaacgctcaaagaaaaattagcaccgcttggtatcaatgtcatcgaagcacctgcccaaaaatctagcgatattactcaagctgccaactcattggttgggcgtgttgatgtgatttatacttcaacagataataatgtcattaatgcttatgaagcgttatatcaagttgcaaaaaccgccaaaattccattaatttcagcagataccagtactgttgagcgtggtgctgtggctgcactgggcgtcaattataccgatcttggcaaagaagctggtaaaatcattgcacgcatcttaaagggtgaaaaacctgctgatattcctgttcatatctctgaaaatctagacttgtatatcagcaaaaaacatgcggctgagcaaggtatcattttaccacaagcggtcattgatcgagctaccaaagtggttgaataa

SEQ ID NO: 1286 - DNA, 915 bp, M.catarrhalis
ctttttgggcggatatggctgatgaatttgattgctttttttggagcactggagagtggtctgatttatgctttgatggcactgggtgtgctgatttcctttcgcattttagatttccctgatctaaccgccgatggcagctttccgttgggcggtgcggttgcagggatttgcattgtcgcaggcattaatccttggctggcttgtgtttttggtatgatggcaggtatggtagcaggtatgatgacagcttggctgcatgttaagttgggtattttacacctacttgctggtattttgatgatgaccgccttatattccatcaatctgcgaattatgaatgccccaaacctgccgctacttggacagccgacagtatttacaccattgattgatggtggtaatggattttgggtgcgtgtggcagtcattgcaggggttgtattggtggtaaagctggctttggattggttttttatcaccgaaatgggtctgtcaatgcgtgcgacaggttcaaatctgcgtatggcacaagctcagggcattaatacgccatggattatcattcttggcatggcgatttcaaacggtttgattgcactatcgggtgctttgtttgtgcagacccaaggatttgctgatgtttctatgggtattggtacgattgtgattggattggctgcggtcattattggcgaggcggttttatctgccaagcgaattttttggatgactttggcggtggtgattggtgcgattttataccgtttatttatccaaattgcactttctagtgagctattgcgtggcatcggctttaaatctcaagatttaaatttagtgacagcatttttggtgatcattgtcttgatgttgccaaaaattaaagccaagctatcaccaaaaaaacactaa

SEQ ID NO: 1287 - DNA, 858 bp, M.catarrhalis
cgactggatgggtctataactcaacggcaaatcaatatggaacacggcttgataaacttgctaaaaaaccataagcataagcgggcttttaatcagggcgttttagctaagcctgtatttgatcaaccatactgggtgcatcatcaggccgcaatttggctatttaggttgcatcgtcgctgtgttttatgccaattacaccatctggattatcagatgggtcggatgaattttatttgtgctgattgccaagcaaacattgccacccaagtttcgtattttaacatccacctaaacattggcaaagattttcctaccaataaagataggttgaccgcccaacaaaccccaaagcgacaacatatccgtgcttatcctgtaagctattatcagtatcctgtcaatcagctcatcaaaaaatttaaagaccatgaaaattcacaatcattgttagcattgtacgcattgattgcccacttaccaaagcctgactattgccatgcaggtaatacggtcattttacccataccaacgacccaagaacgcatgcgtcagcgtggatttgaccctgttgcaatcttagccaaatttttggcgtggcactggcaattaccactttggcagggtgtggctcgccatgatggcaagcgtcatcagcgtgggctaactcgtcatgagcgtttagttaatactcaaacagatttttatttatgtcaacaaattcccaatcgtcaaatcattatatttgatgatgtcatcaccacaggggcaacagtagcagcggtggccaaatttattaatacggcatcgtcaagatattcgactgattgcaatttgtatggcacatggttctgctga

SEQ ID NO: 1288 - DNA, 1242 bp, M.catarrhalis
tatctattaggcaaatttatgaaacaattttttgcgttatctgtgttagccatgtcaatgagcacatcggcaaattatttaaccaattatcaagatccaaataccgatcagctcattcaagctctcaataataaccgcattcatatcgtacagctgggcgactcacatactgcaggcgacagcatgaccgaagcactacgtagtcagttacaaagtcgctatggtaacggtggtatgggctgggcgatgccgatgtattttagcggtcagcgtatggcacgctatggctatgataattatcaatggacacccatctcaagtcgccgcaatcaaaatgaggattatacattaggcggtttaatcgctaagccaaatttttcaggcagtacgctgactattaaagcaaaaaatcaagagcctatgcaatcaatgaccgtcagcattcgccaaagtgccactgatggcttatttaaaatcagtgatgcagatggcaatcatctgatacttgaagcaccgattaaaaacgatacttggcaaaccacaacttttgatgccaaattgccttttacgctcactgctgaaggcagtatgacaaataccgccattggtggctggtggggtaggtcaaaacatgaacttggtgccattgtctcatcgcttggtatcaatggtgcagagctatcacattggagccgctggaatcaaaacgcatggcaacaagagttggcaaccattgcacctgagctaatcatacttgcctatggcacaaatgaagcttataacaatcttagtgccgaacgcatcgctaccgtattagatgagcgtattgaacaaattcgtcaagcatcgccacattcagcgattatgattgtctcgtcgcctgaggtgctaaaaaatacagcaggcagctgcggtgtacgcccaccaactttacatgccattcaagaagtgcagcgtcaaactgcccaaaataaacacacgcttttttgggattggcaatcggccatgggtggcagctgctcaatgaagcagtggatgaaaagtggcaaagctaccaaagatggggtacattttacccatttaggttatcagcaattgggcaggcaaatggctgatgacattatctcattgtctgcattaaattcatcttcacacttaacaccaccgccacagatgatatccccatcacccatatcaattgcaccatctttatcaacaacacgcactttttatcaaaaatag

SEQ ID NO: 1289 - DNA, 465 bp, M.catarrhalis
gctggtgatatgctaatagttgaagataatggcgtgatcatcacattaaatggacaagtaaaagacccattattttggtggtcgatgatattgctgctgctgggtgtcttggtggcaatcatttgtttgattgcacccgttttttatgcaatcggtgcgttggctttatttgcagttgtggtatttgtgtttaatattcaaaggcaaaaagccaaaacttgtcatatgttttcacaaggtcgcttaaagattacgcccaaacgctttgagattcataacaaatcactaaccttatcagcatcggcaacaatatctgctaaagataacaaaatgacaattgttgatcggggcattgaatatcattttacaggttttgctgatgaccgtgaaattaatatagccaaacaggtacttttgggaaagtcaatcaaaaccaatgcggtggcggtaacattggctaagtag

SEQ ID NO: 1290 - DNA, 741 bp, M.catarrhalis
  unsure (131): Identity of nucleotide sequences at the above locations are unknown.
caaaattgtatagtgagaaaaattatgcgtagcaacaatcgccaaaataacgagtttcgtcccattcattttatccgccaatataccaaacatgccgaaggttcggtattggtgtgttttggggataccanagttttgtgtactgccagtatcgaagctggtgtgcctcgttggcttaaaggtcaaggtaagggctggctgaccgctgaatatggtatgttgccacgcgcgacaggtactcgtacacagcgtgaagcagcacggggcaagcaatcaggacgcacccaagagattcagcgtttgattggacgctcactgcgtgccatgcttgacttatcaaaacttggcgaaaataccatttatatcgattgtgatgttatacaggcagatggcggtacacgcacagccagtatcagtggtgctgcggtggcacttattgatgctttagaacacttgcagcgtcgtaaaaagcttacccaagatccgcttttgggcttggtggcagcggtttctgtgggtgttaatcaaggccgtgtattgcttgatttggattatgctgaagattcaacttgtgataccgatttaaatgtggtcatgacgcaggcaggtgggtttattgagattcaaggcacagcagaagaaaagccatttactcgtgctgaagctaatgcgatgcttgatttggcagagctgggaattgggcagattatcgaagcccaaaagcaagtattaggctggtga

SEQ ID NO: 1291 - DNA, 990 bp, M.catarrhalis
gtgatgagcatctttatgaaaaaatctaccatccaatatttaagcttaccaactgctgcactattaacgctggctggttgtagtcatgacaaccaccgtgatgatgagatggcggtggctgagcctgtcattcagcagattgatgatatttgccaagcaccagccatgcaagcaaatctacaaaatagtatcaagcagtctattcttgatgccacgataagccaaatgacggatgcagaccccaaccaacgcctagccatacaaaacaccattggccaaaaactaaatactttacaaatcaccacccaaaatgccacgaattttgccgatagctgtatggcggatgtgcatgtaacggtaaacccccaagatttggcgaatgcagaatttgcttttgctcgttcaggggtaactttattacagcgtgctagccaagatcaagttgagttttataatggcacaattgtcgctaaacaaataacttatcaaatggtcaatggtaatgtggtgatgtatggcaacaatcataatgccattcgtctgattgccgatattttggcagcttctacaagcagtttgccacaagtatccatacagcctgatgttaccgcacgaccacaagcgattgagcgactgccagagacaccaatagccatgccatcaaatcctcaagaagattctagtgtaacgacgcacattgaacaaaagccagcacctaacgcacaggtgtcatctcgcccacgcagtgaaaagccttcaaataattcagcacagacacccacacaaaactcggtagggcaatcttctgcaactggtagtacccctcgtgtggatcgtgatagtcaagccaaggccaataccgagcgtaccaccgagcgttctacaagtaagacacctcaagatttggcacacccacagccaccaacggcgaatgccagtagtgatggcaaaacaagtatcagtatcgttgagtcaaacgaaacctattga

SEQ ID NO: 1292 - DNA, 204 bp, M.catarrhalis
accgttacaataattgacaagccaaaatctggtatccttatgatgttacatattcaaattgccgccgctgccgccgctttatcggtactaacttttatgacaggctgtgccaataaatcaacaagtcaagttatggttgctcctaatgcacccacagggttacactggggttatctatactggtgttgcacctttggtagataa

SEQ ID NO: 1293 - DNA, 1323 bp, M.catarrhalis
aatcacttgatagccatgtctgatacccatgctgttcgaccgccgttatattatcgtttggcaaccgtgatgcttgcacccatttatcggcaaatggttatcaaaaaatccaaaaataagccaacgcttaagcgggagttaaatgagcgttttgctaagcactatcagccgccacctgttggcaggctaggcgttatttggtgtcatgccgtttctttgggtgagctaaatacagtatacccattattgcttaagcttttgaatcacggttatgggctgtgggtaacgagtaccacccaaacaggttttgagcgtgcggctaaattatttgataatgaaatccgattggggcgtgtggcacatagttttgtacctgtagatacgccttcggtgattgatacttttttaacgcatgtcaagcccattgcagcattgttcattgaaacagagctttgggctaatactttatatgcctgccgaaaacatggcatcaaaacattaatgattaacgcacgcttaacccaaaaatcttatctaggatatgccaaaattgccaaagtaagccaaacgatgatggcaaatcttgatggtatcattgctcaagatgccagctctgcaaagcgatttgggcagctgggcagggtttatattgtccaaagtgattcgttaaaatgggcaagtgtcagtacgctaagcgatgcccagttggcagccgttaacatcctaacaaggcagcttaatcaagcatgtaaaacatacatttgggtgatggcaagttcgcatgatggtgaggagtgcattgccctaaaggcacatcagcaatttttacaaaaattccccaatgcactactcatccttgtgccaagacatcctgagagatttgaagtcgtccaccaaatgtgtttacaaggtggttttttgactgctcgccgttcaatgggtgaaaccattagctcaaagacgcaaatttatcttgccgatacgatgggggagctactttcttggtatcaagtcgctcagattgcggtagttggcggctcgtttgtgccaattggagggcataatcccattgaacctgccagccttgccacacctgttattatgggtgcttatgatgataattgtaaggatttagttgaagcactaaaacaggttggtgcattggtacaactgccagatgagcctaatatttcagagcaattatttaaaagcttattgcaggcatctttatctcaatggacgggcaaatcaggtgctgtattggtacaacaaaaacagcgtgctttacaagagcagtttttatttgtgctgcgtatgatttag

SEQ ID NO: 1294 - DNA, 768 bp, M.catarrhalis
gagaaagtgatgaaagctattaaattatctgtagtttctgctgcagttctactgtcaacttctgcaatggcaaatgttgttaccaatactggtgcgaccgttgttgacggtactcgtaccatctttagtacactggttaaacctgcagctgtgagtgctgaggttggtactttgggttatggtgctaacattggctgggcagtgaatgatactgttgagctacaagcaggttgggctggtggcaatatcgcaaaatctatcaatgataactttaatgccaatggcgttaactatcaacttgaaactgatttttctaacccatacttgggtgctcaagtgcgtcctgctgccaactggttcaccgttgggacaggtatcatcgtacctaagaacgacatcaaagtccgctcaaataacacaaccgatggtgttttccgtgttgatggtaaagactacaaacaaagtgatgtaggtcggcttactggtaagcttgagcatcgtaacaaattagcaccttatttgacactgggtttccgcccaaatctacacagtaactggggtgtatttggtgaagttggtgctgcttatttgggtaaagtagatgctactgttgatgcacaaaatccaaccaaatcagtaactgctactgatagcaagacccaagaaactgtcattaaaattgcaaaacaagcagagcgtgacatcgaagataaaaaatatgccaactggttcccaatcgctaaagttggtgttacttaccgtttctaa

SEQ ID NO: 1295 - DNA, 609 bp, M.catarrhalis
ttgcaatttgtatggcacatggttctgctgatttcggttttgatactcatgacagataataatccatcccccgctttgataccgactaatgaaagtggttttgggctgattgaggtattgatctcacttttattgttatccgtggtggcacttggactaattacagtacagggccgactgcttgtgcaaactaagcatgctgatcttcgtttacaagcagttcagctgatggcaaatgactaccatgcagttcggtcatttacgccagagcaaaagcagatttatatccaaacacttcaaaggatcgcacaaacagcacaaagccgctcagaatcagacatgaatagttatcgtatcgcagcttatgctaccactatccgttgtcgcccagagtgccatttgaatgaacaagcccaatctttggcgatacaatcagcacaagctgctgcacgggcaaatatcatactgtcggtcaccgattgtcagttgggtcattgctgggtcgctggatggggtatgcaagcttttgaattaatcaaaacttgttctaacgatgagcttgggttaaatatcagctcattagactgtgccatcatggatggtctatga

SEQ ID NO: 1296 - DNA, 1140 bp, M.catarrhalis
ttgttgttatttttgcgccgtcaggcattccaggatttatttatgcaaacttctaatcaaccaatctcaaaggtcgcccaaaccaagcaataccctgagcctaagcatattcggctaaagctgcgccccaagccttattttcacggcaaaagttacagctatttgctgatagtgctgtgcttatttgccacacttggtgcatggataatgcaaaattccattaatgcatattatctacaaacttatcacaaaagcagccctttaagcttacttgatcgttatcctgcttggaaaatgggtggtgatatcggcaataaactgtatgcttggcatggtgatttaaccagtgctattaaccagaaaaatcagcaaattgttgattattttaatgacaatttggcttatacccccaaatatcaggcaatgatggcaaaaagccttgaatctacgcccgctgtacagatggataatgttggcgtatcagaggccaaacctgacaatccttatgtactacattcaggtgatgagattttttttgctggcgactcaatgatgcaaggcgtcgcaccgcatatccagcaatatcttcaaaaaaattacaacatcaaatccgtcaatcttgccaaacaaagtacaggtttggcttatccaagcctatttaattggccaaaaaccatcaaagagacactgtccatcaatgccaatatcaaaattttggttgtatttttggggcctaatgacccttgggatatgcctgatttggtcaatggcggtcaattaaaattccaaacgccagaatgggagatgggctaccgtcagcgtatgatggatattttggacagtgccaaaaatcacaatacgcaagtcatttggatcacaccgccaaatatgaaaaaacaaaagctcaataagcagatgatttatctaaatcagattatgcaagatgaactaaaacgccatcatgtacttatcattgattcacgcaagctattaggcacaagcgatgatatttataatgattatctgatacaagatggaaaaagcgttaaaatgcgtaccgctgatggtattcattttagtgtcaaaggacaaaagttaatcgcccaagctgtacaagatcaaatcaccatcataccataa

SEQ ID NO: 1297 - DNA, 1500 bp, M.catarrhalis
gccatgttttcttttctgtctttagaatttactttaatgttcattggttttttggcaatttattggctgtttcgccaaacaccaaaattccaaaattttctcattatcctatttagctatacggtcatttatctaatggcaggtacgcttgcgacagagattttatttggctatacaatatttgtatttttcatcacaaagatgatgaatggctctaaaatcaagaaattttggctgattttagggattgccatcacactgattcagttgagcatttttaaatattatgattttttccgagaagggattaagtacagccttgatgccatgcagctggattcatcaggggtgatggcaaatatcatttttccgctcggtatttcttattattcattccaagccatcagttatatggtcagtcgttattatgatgaatatgatgtacctcagttaagttttatggcactgttgcaccacttatccttttttgggacaatcagtgcaggacctatcgcacgcaccaagtcggtatcaggactgactgatattgagggcaatccttgtggtatgagcgaacaaatcatcagccaaaatccacgccgtattttatttcccaccatcgcactttgcctgattttattagcactcattaaaaaatggtggctggcaggctggttggctgaccattgggtcaatcccatctttgccaatcccatgcaatatcatagcttagaggtattagtcgcaatttatggctatacgctacagctatttttggacttttcggggtacagtgagatgatggtagcatttggtttattgattggttttcgcttgcctgtcaactttaaagcaccattaatcgcacataatattcgtgtcttttgggataggtggcacattagtttatctacatggattcgtgattatatctatattcccttagggggcagtcgccaggggttttttagaactcaaatcaatttattaattgccatggcattatcaggcatttggcatggctctagtgtgaattttctactttggggcgtgttgcatgggcttgccatcatttggttaaattgtaccgataaactctaccaaaatatttatgctgtcgatgccaaacatgcacgcaatgcactatatcgccacagttggctaggtaaagtgattgggatttttgtgaccattcattttgtggcattttgttttgtgttttttcgtgcaaccagctggagtgaggcaatacaaatttttgaggcattggcatacaaccataccaacattgcttggagtggtaatccgctgtttatactggcactttttatgatagcttggttcatctaccccatctacacacgccaaactcttaatattattcgccttggtagtctattgcccaagcccatcctaatcagtcttttatttgtttgtttgatgattgttgttatttttgcgccgtcaggcattccaggatttatttatgcaaacttctaa

SEQ ID NO: 1298 - DNA, 993 bp, M.catarrhalis
atgctaactttaacagttgacaagccgtttggtttgggtcggattgtccgaaatcagggtaaagttgttgccatcgttagggaaaaagatgccgacacacaacaaaaattaatcacagagattaacagtggcatctattgtgtggataatgcgttgcttcataaatatctacccatactgaacaataacaatgctcaaggcgaatattatttgacagatattatcaaattggctgttgatgatggcgttgaaattgtaaccattgaacctaagtttgcctttgaaattgaaggcgtgaatgatcgtattcagcttgccaatcttgagcgagattttcaatcacaccaaattcatcaattacaaatcgctggcgtacagtttgccgacccaaatcgtgtcgatattcgtggcaaattgacctgcgatcgagatgtttttattgatattaatacagtatttgtcggtgatgtccatctgggcatgggcgtgcagattgatgcaggcaatgtcattacaaatagtcatattggcaaccaaacacacattaaacccaactgtgtcattgatgatagtatgattggtcaaaatgttagcattggaccatttgcccatataagaccaaaaaccatactatcagatgatgttaaaattggtaattttgtagaaactaagaaaacgaccgtaggtgttggcagtaagattaatcatctaagctatgctggcgatagtatcatcgggcaaaatgtcaatattggtgctggtgtaattacctgtaactatgatggcatcaataagtttaccaccacaattggtgatcgtgcgttcatcggcagtaattcaagcttagttgctcctgtgactgtcggtatgggtgcaacaatcggtgcaggatcagtcatcaccaaagatgccaaagacaatgctttgaccttggctagagcgaaacaagccaccattatcggttggtcacgccccaaaaaaaatcaagtttag

SEQ ID NO: 1299 - DNA, 1851 bp, M.catarrhalis
gtatttatggcagacgacattaagcatttacgcaatattgcaatcatcgctcacgttgaccacggtaaaactaccttagttgataaacttttacagggatcaagcgctatgggtgagcgttctggtgaaatcgaacgcgtgatggactcaaatgcccttgagtctgaacgagggattacgattctggcaaaaaataccgccattcgatggactgataagcgtactaacactgagtatcgtatcaatatcgttgataccccagggcatgccgattttggtggcgaggttgagcgtgtcatgtcgatggttgactgtgtattattattggtggattctcaagaaggtcccatgccacaaacacgatttgtgactcaaaaagcatttgctcgtggacttaaaccgattgttgtcattaacaaaattgacaagccagccgctcgtgcagattgggtaattgaccaagtctttgatttgtttgacagtttagatgcgactgatgagcagttagattttcctattgtctatgcatcgggtattaatgggattgcaggacttgaaccagataatcttgctgatgatatgacgccactatttgagacgattgttgatatcgttgagcctcctaaggtggatgtcgacggtccatttcaaatgcaaatatcaagccttgactacaatagctttgttggggtgattggggttggtcgtattcaaagaggctctgtaaaaacaaatacgcccgttgcaatcattgataaagatggcaataaacgcaatggacgaattttaaaaattatgggctaccatggtcttgagcgtgttgatgttgaatcggctcaggcaggagacattatctgtattacaggtattgattctttgaacatctctgatacgatttgtgacccacaacatgttgaagccctgccagcactgtctgttgatgagccgacggtctcgatgacttttcaggttaacgactcaccatttgctggcaaagaaggtaagtttgtaacttctcgtaatatccgtgaacgccttgaccgtgaattgattcataatgttgcactgcgtgttgaagatacagacagccctgaaaaatttaaagtttcaggtcgtggcgagttacatttgtcggtattgattgaaaatatgcgtcgtgaaggttttgagcttggcgtatcacgcccgcaagtcatcatgaaagagattgatggcgtcatgtgtgaaccgtatgaaaatgttacttttgatgttgaggaacagcatcaaggagcagtcatgcaggagatgggcaaccgtaaaggtgagctgacgaatatggaggttgacggcaaaggtcgtattcgtattgaagctactgtgccttctcgtggcttaattggttttcgttcggcgtttttgaccatgacttcaggcacaggtattatgacttccagctttagccactatggccctgccaaagatggtacggtagccaagcgtcaaaatggtgtgctggtatcaatggtaacaggtacctgtttggcttatgctttatttagcctacaagagcgtggtcgtttgtttgctaagccacagcttgaagtgtatgaaggcatgattattggcattaattctcgttcagatgacatggtggtaaacccgaccaaggccaagcaattgactaatattcgagcgtcaggctctgatgatgcgattattttaaccccagcgctggattatacacttgagcaggcacttgagtttatcgaagatgatgaattggttgaggtgacacctaaatcgatccgtatccgcaagcggtatttgactgaaaatgagcgtaagcgttttggtcgtaaaaaagattga

SEQ ID NO: 1300 - DNA, 237 bp, M.catarrhalis
tggctttggcgggtaaagatgttcaaaaagggcacttttttacccaaaacaggtaatttttcccagaccaaaaccaacaatttgggcaccggttcatcgggtcaagatgggcatttccccattttgccaaaaaaaggtaaaagccttattttaatatggcaatggaactttaactcaggcccaaaaccttacaaaacctttgttaaaggcaatacccaccggtatcttaaatgctaa

SEQ ID NO: 1301 - DNA, 402 bp, M.catarrhalis
gtagaagagcttcgccaagagttgcgtgtattctttgattatgataaatcattcatcaaaccacaataccgagaagaagttgctaaagttgctgcgcaaatgcgtgaattgcaatgtgcatctgccaccatagaatgtcacgcctcacgcgattcaatacgctcaagtgcacgctacaaccagcgtctatctgaagctcgtgctaatgctgttaaatcaatgctatctaacgaatttggtatcgctccaaaccgcctaaatgcagttggttatggctttgatcgtcctatcgctccaaatactactgctgaaggtaaagcgatgaaccgtcgtgtagaagcagtaatcactggtagcaaaacaacgactgttgatcaaaccaaagatatgattgttcaataa

SEQ ID NO: 1302 - DNA, 279 bp, M.catarrhalis
ccgccaatgtctaatgcaaattggtcagggtttttggaatatcgccatacctttaaacaagataaattggcgaattttgaacgcccaaccccagctcataacttggtgaatttggggcttaactatcagcacaagccaagccatcaagcaggctcggttcaggtattttttaatgctaacaatctattaaacgataaagtctttgctcatgagacatttttcccagacatgccacaaatggggcgaaactttatgctcggggcaaatttcaaattttga

SEQ ID NO: 1303 - DNA, 372 bp, M.catarrhalis
actataggtgccatcatgtccgactttcacacctcccatcagcataatgagatacttggcagactcattgaaatgcaaaagctgaatgatgatattcaagcgttaacgcaacaacttaaaaatgcactcaagcaaatacaaaagttgcaagataagcatgccaaacttgatgaattttatcaaaaagaatgccaaagtctttgtaccgcttaccaaaatggtagtatcagtgagcaagatttggattatgtgaacaaaaaagcacagaccaaaggttattctattttaagtgaagatggtatttggaatgtattgattgatgctgaacaaactcaagtggcattaattaagcaattggttcggtcgttataa

SEQ ID NO: 1304 - DNA, 753 bp, M.catarrhalis
aaaaccaaacaaaaccaatcacatacattaatgagtactattgacatgaaaacagacacacctgtggcaattgccaaagcctgtgattatccaacactcacccccattgaccgccctattttaaccccacccaacggacataaaaaagtactgctacattcatgctgtgccccttgttcaggtgaggtcatggaggcgatgattgccagcggcattgaatttaccatttatttttataaccccaacattcaccccaaaaaagaatacgaaattcgcaaaaacgaaaacatcgcctttgcccaaaagcatggcataccattcattgatgctgattatgacatggacaactggtttgcccgtgccaaaggcatggagcaagaccctgagcgaggcagacgatgtaccatgtgttttgacatgcgatttgagcgcaccgccctatacgcccacgagcatggttttcctgtgataaccagttctttgggcatctcacgatggaagaacatggctcagattaatgattgtggtcatcgtgccgctgccccttatgacgaccttgaatattgggattttaactggcgtaaaggcggtggcagtaatcgcatgattgagattagcaaacgagagcatttttatcaacaagaatattgtggctgtgcttactcactgcgtgataccaataattttcgccgcagccaaggacgagaacccattaagattggggttaagtattatggtgatgacgaagaatga

SEQ ID NO: 1305 - DNA, 183 bp, M.catarrhalis
gctttaactggaaggctgccacgccaaaccttgcttatcctggaacaatggtgggaaaaaccactggtttctaaaattcttagtggtggccccccagaacaaaatcccctttttaccttgaaaagtgggcccccaaaaaaggggggggggattttttttggtaaaaaagggggcccatattaa

SEQ ID NO: 1306 - DNA, 405 bp, M.catarrhalis
acgaacaagcaagcaaacagtacaatcaaaacagcaacccaagcagaaaatgaaacatcagcacagccaagccaagcatctttatgtgttgccaatattaacgaaggctttttatcactattaaactggtgcaatagatacacaggggcaaagcatccaccgaaatttgttattagacagcaatttagccaacatgcggttgatattggcttattaacacagctatcaggtttaattgacgcaggcaagctgcctaaatctgtactgtatgataaagcccgtgagtttaatttaatcagtggcgagcttagcaatgatgaaatagatggcttaattgaacaaccgagcatgacttatgaagcatttaatcaatttagaaaggttcaaggttcatctggcaaataa

SEQ ID NO: 1307 - DNA, 720 bp, M.catarrhalis
cttatgaagcatttaatcaatttagaaaggttcaaggttcatctggcaaataagtttaaaaccacacttaatgaaattgatgagtttttacaattggtggtatttcgtcatgaaattagtgagcttaactataaagaatttgagttattaattggcgagagtaagcagaagctcttgggctttttggcaggttacgccttggagttaacccaagattggcaagagctatacgattacagctatacgcttgaaaccaaaatgattgatgatgataagccagatacgctaaacatgaatgagccacaatttgacgcagacagccccatcaagctatctgctcaagttggtgtaacgcttaatcagattttggctaagttgggtgatgaacaaagcacagagataagtaatgccatcagctatgcttatgccaatggcttaccaaacccagaacttgttaggattattaggggtacacgcaaaaaaccgctaccaagaatggattttacaaattacaacacgccatgcaaagaacattgttacaccagtacagcccttggtgtgaaatcagccaaacaagcattttttatgaaaacaaagaatttactaaaggcttttaagttcttggaaccttgggattaccccacaaatgccatttgggaggggttaagaaggggggttttgccttttggacaaggccgattcccccccttaaagttttaa

SEQ ID NO: 1308 - DNA, 234 bp, M.catarrhalis
gggtttttttgttgttctctgacatattcccaattaatatcaggacgccagtcttccgcttttaccttaccgcctgtcgcttgctcaatagctaagcatctaccccttggcggattgtttttatcccatttactcaatgcccaaggcgtgatgccaagtgagcgagccaaggctgatcaatttcctaatatggcgatcactttatctaatgcagtcataaataatcctacttaa

SEQ ID NO: 1309 - DNA, 570 bp, M.catarrhalis
gtagaaaaattgaggagaatggcagtgcaggatttttccatacgactgaatcaagctatgtcagctaaaaatttatcactgcgtgatttaagtgaaaaaacgggtattaattacgaaatgatacgccgttattccaaaggtcaagccaagccaagaaacgacaaaatgaaactgcttgcgcaatgtcttggtgtacctataacttggcttgactacggcgaaggtgagatgacaaaaaataatgataaactcgcccctatcaccgaatgggacaatggcgccccattggatgacgatgaagctgagatccctttttataaagacattgcctttgcttgtgggcatggtgcagtcaatggtgatgcaccgcttgagggtcgtaagctgcgcatgggcagacgcaccttgagcaatctgggtgtgatgcccatcaatgcctttgcagtcactgcgtgcgatgacagcatgacgccctatgtgcaagatggcgacaccatctatatcgataaaagacgaaaagaagtcaaggatggtcgattgcacctcaagggtgaaaggaaccgggcctca

SEQ ID NO: 1310 - DNA, 369 bp, M.catarrhalis
atgaacgaatttattataccaaactctaattctgtgagcaatgattttaattattcaagaacagatttagacgcccaagagcaacaaatcgctgaatttatcaaaaaaggtggcaaagtcatcaatcttgacaattccgaacagccaaagaaaaaatcagcaaaaaagcgtgattttaacaaccaaaggataaatagcaaaatgcaccttgttttgtgctatctaaaaaggtcaggtaagcgtatgactggtacacaaattcaagaaaaattcggcatatcagcacaaactttaggggttcaaatgagcctaataaacgaacaagcaagcaaacagtacaatcaaaacagcaacccaagcagaaaatga

SEQ ID NO: 1311 - DNA, 330 bp, M.catarrhalis
ttgtttggattgaattatttagccatattacatacaataatcagcataatttgtatgtattatcaatcaaactcagacgaagttgcgcttatggctaaaacatatttattgactgcatcgataatgtctatggcaatctctggatgtcaagtcatccatgccaatcaaggtaaggttaatactaattctgctgtcatcacaggtgcagatgctcacacgcctgaacatgcaacgggactgaccgaacaacagcaggtgattgtaagtgattttatggtagcatcagccaatccattagtaactcaagcaggctatgatatcttaaaataa

SEQ ID NO: 1312 - DNA, 441 bp, M.catarrhalis
tccattaagtcattaaatgcctcaatcaagttaaacttaactataagagagtcaattatggcatattcagataaagttattgatcactatgaaaatccacgcaatgtgggcaatttggataaagctgccaaaaatgtcggcacaggcatggtcggagcccccgcctgtggcgatgtgatgcgtttgcaaattcaagtgagtgatgatggcatcattgaagatgctaaatttaaaacttatggctgtggctcagcgattgcctcaagctcattggtcacagaatggctaaaaggcaaaacacttgaccaagctgccgccattaaaaataaagacattgccaatgagcttgccttaccgcctgtcaaagtacattgctcagtactggcagaagatgccatcaaggccgccattgaagattatcaaaccaaagcacaagcataa

SEQ ID NO: 1313 - DNA, 336 bp, M.catarrhalis
aggcttgcgtttgcggatcgtgatgtatatttgggcgaccctgattttgtacctgtacccattcgccagttgatttccaaagactacctaaaacatcgcagccagctgcttaagcagtcggataaggcactgcctagcgtatctgtaggtgattttattcatgagtgggtatcttcacaagcgattgagttaccttctaccagtcatatctcaattgtggataaggcgggtaatgtgctatcaatgacgacttccattgaaaatgcgtttggctcaactttgatggcaaatggttactggctcaactttgatggcaaatggctacctgctgaataa

SEQ ID NO: 1314 - DNA, 333 bp, M.catarrhalis
ggcggtagtgctgcagatgcgatggtggcggtgcagacgacactaagcctagtagagccacagtcgtcaggcttgggcggtggtgcatttgtgttgtattgggataataccgccaaaacattgaccacatttgatgggcgtgagacggcaccgatgcgtgcgacgccagagttatttttggataaagatggccagccattaaaatttatggaagcgttggtcggtggtcgctcggtgggtacgcctgctatccctaaactgatggaggtaatacacagcgatacggtgtattgccttggggaaaattatttgatacgccgatccacttggtaa

SEQ ID NO: 1315 - DNA, 275 bp, M.catarrhalis
gaagactgtatatgaaaggcacgccccagtttccccaatgtggattttcagcgcgtgcagtagaggtactgacccaaattggtagaccctttgcttttgttaatatcctagaaaatcctgaaattcgcagtactctaccactcatcgccaattggccaacctttccacagctttgggttaatggtgagttaatcggtggtagcgatattatcctacaaatgtaccaatcaggtgagctaaaaccacttattgaagagcatagctctgatgcctga

SEQ ID NO: 1316 - DNA, 1263 bp, M.catarrhalis
ttcacaaatcacaaccatcactttaattgggaatccagcatgagccagacttcactcatctatttagactacgccgccacaacacctgttgccaaagaggtcgcagataaaatggtcaattatcttacctttgagggcatttttggtaaccccgcttcacgctcgcatggctttggctggcaagcagaagaagctgttgaaaatgcacgcttacaaatcgctgaaacggttggcgccgacccaagagaaattgtttttacttcaggggcaaccgaatcagataatttggcaatcaaaggcgtggcacatttttatgaaggtcgtggcagacacatcattaccagtaaaattgaacacaaagcggtactggatacttgccgtcaattagaacaagaaggctttgagattacttatcttgagcctgaagcaggtacaggcttaatttatccagaacaagttgaaaacgcattgcgtgatgacactatcttggtgagtttgatggcagtcaataatgagcttggtaccattaccgatatcgctgccattggtgaaatcacacgcgcaaaaggtgtgttatttcatgtggatgctgcccaagcagttggcaaaattaaaatcaacctcggtgagcttaaagtagatctgatgagctttagcggtcataaaatctatggtccaaaaggcatcggtgcattgtatgttggtcgtaagccacgcgtgcgtatcaaagctgaacaacatggtggcggtcatgagcgtggtatgcgttcaggcactttggcaacgcaccaaattgttggcatgggagaggcgtttgctttatctgtacaacgatttgacgaagaccatacgcacatcaaagcactgcgagataaactttggcatggcttacaagatatcgaagaagtttatttaaatggctcaatggagcatggcattcctaatatcatcaatgttagctttaattttgttgaaggcgaaagcttgatgatgagcctaaaagacttggcggtatcatcagggtctgcctgtacttcagcgacgcttgagccttcttatgtcttgcgtgcgattggtcgccctgatgagcttgcccattcatctatccgctttagtattggtcgctacacaaccgaacaagacattgatttggtattaagccaaatccatgaagcggttgataaattgcgtgaattatccccactttgggatatgtttaaagaaggcattgacctaaataccgttgagtggcaagagcattaa

SEQ ID NO: 1317 - DNA, 561 bp, M.catarrhalis
atcatttaccgtttaatcgccaatcttgataaggaatttatgatgaacaaagctaacttttttggtttatttgggctacctatcgcatttgatattgataaaaatgcgttaaaatcagcattattatcgctacaaaaacagcatcaccctgatcgagatgccaataaagccagcaccaaccaagcttcgcttatcaatcatgcctatcaagtcttatcccatgccgacagccgagctgcttatttgcttgagctgtctggtcaggcagtagatttgtcgcagtctattaatgattgggactttttagatgaaatgatggacttgcgtattcgcttagatacgaccgatgacaaaatggttttggatcaaatatccaaccaagttcatgcactcagccaagagcaatctacaagatttatgcaaaattatcaaaatcacacatgggcagaagcaatagatgcaacccgtaagctccaatttcttagcaaattactggttgatatcgatgccaaagttaccaaattattatcccaaggtcatgatgatgatttgtatgtataa

SEQ ID NO: 1318 - DNA, 219 bp, M.catarrhalis
gtggtggaacgcccacctgtttgtgtgacttatcgtatttatgaagtgtgcggtatgagtgcaccaagctcaggtgggattgctgtgggtcagattttggggattttaaatgaattttcacccaatcaggtggggtatgatgctgaaggcttgcgtttgcggatcgtgatgtatatttgggcgaccctgattttgtacctgtacccattcgccagttga

SEQ ID NO: 1319 - DNA, 537 bp, M.catarrhalis
aaccaaaataggcaggacggaagtatttcaatgcgtttaacaactcgtggacggtatgccgtcactgccttattggatttggctgtccaagagagtcgccatcaaggcgcagtgtctttatcagacattgccaaacgccagtccatctccatatcttatttagagcagctattttcaaaactgcgtaaaaaaggattggtgaatagtactcgtggtgctttgggcggttatcatttagcaaaaccacttgaagatattgacatcatgagcattattaccgccgttgatgaaagcatcaatgccactcagtgtggcggaaaaggcaactgccaagatggcgcaatgtgcttgacacatgatttatggcacaatctgtctcatcatattgaaagctatcttaaaaaagtgactttggcacagcttttagaaaccaaaaatacacaaaccatcgctgatcgccaagtcaatcgcctacatcagtttgaaaaagataattcacaaatcacaaccatcactttaattgggaatccagcatga

SEQ ID NO: 1320 - DNA, 339 bp, M.catarrhalis
gtaaacaaaggagtcgctatgatcaatttaaccacacaagcagcacaacatattaaagattttcttgaaaatcgtggtagcggtgttggtattcgagttggtgtacgcacagctggctgttctggtcttgcttatgtacttgaatttgtggacgacccaaataatagtgatgagcgttttgaatcgcacggcgtatcggtatttattgaccccaaaagcttggtgtatctaaacggactacaaatggattatgtcacagaaggcctaaactctggctttaagttcaccaatcccaatcaaacaggcgaatgtggttgtggtgaatcatttaccgtttaa

SEQ ID NO: 1321 - DNA, 363 bp, M.catarrhalis
actgatggaggtaatacacagcgatacggtgtattgccttggggaaaattatttgatacgccgatccacttggtaaaacaaggctttgaggtgtcgccaaggcttgccatctcggttgagcaaaattggcagcatttggcacgctatccaaaaacagccgcttattttttgccgaatgatgtgccgctacaagcaggcagcttgctgaaaaatttagaatttgctgacagtgttcaggcgttagcagttcaaggtgcaaaagctctgcatactggtaaatatgcccaaaatatcgtttcggttgtccaaaatgctaaggataaccccggtcaattatccttacaagatttatctgattattaa

SEQ ID NO: 1322 - DNA, 1869 bp, M.catarrhalis
gaatccatcatgtctttattacaaatcagcgaacccaatcaaagcaaaaacccccatcagcatcgttatgcccttggtattgatttgggtacaacacattccttggttgccgttgtcagatcaggacgctccgaagtgcttgcttttggtcagtcgccactgttgccatcggttgtttattatggtaaaaaaagcagccgccctatcgtcggtaatgatgccttaaactatgccgatgaccataaaaataccatcatctccgccaaaagattcatggggcgtgccaaatcagacattaaattttctcatccttatgatttgtctggcaatcatcaaaccatgcctgcttttttaaccgctcaaggtgaaaaaagccctgtagaaacttctgcacatattttaagacatctaaaaaatcatgccgccgctgccttaccaccagacagtattcaaggtgcggtgattaccgtacctgcctattttgatgacgctcagcgggccgccaccaaagatgcagcgaccgcagcaggcttaaatgtacttcgcctactcaatgagccaactgcagcagcaattgcctatggcatcgataaaaataccgctcaaggaaattatttggtctatgatcttgggggcggtacttttgatgtctcattgcttcgcttatctgagggtgtctttgaggtacttgccacagggggtaattctgcccttggtggcgatgacattgaccgactgattgcacattggttaatacaatcatctcacctgaccccagcagatattgatgagactgaaaaatctcgcttagcaaaacttgccaaaacctataaacaagcattaagtagtcaagacagtgttgttattgaagttgagattggtggtattttagtcacgcaaacactaaataatgacatgttaagtgagattatacaacctgttatccgtcgtaccattcaatcttgtgaacaggtcatgcgtgatgccaaaattgacaaatccaatcttaatgacatcattttggtgggcggctcaacacgcatgccagtcattcaaaatgccgttacagcatattttgagcgtacgccgttatgcaatattaatcctgatgaggttgttgctatcggtgctggcattgctgctgatcaactgattaatcaatcaaacgaaacgctacttcttttagatgtgacgcctttatcgcttgggattgaaacaatgggtggattggtggaggttatcattccacgcaatacccccattccagtgactcgccgtcaagtttttaccacacatcaagacggacaaactggtatgattatccaagtggtgcaaggtgagcgtgatacggttgccaattgccgaggattggcacgctttgagctacatggcattccaccgatgaaagcaggtttggcacgcattgaggtaacttatgccatcgatgccaatggtcagttgacggtatccgctcgtgaaacaacgacagacatcatcagtcaaattcaagtcagtccaagctatggtttatccgaagagcaacaagagcagctcttgcaggcgggttttattcatgctgctgaagataaagctgctcgcatgctcatcgaaactaaagttgaagcccaaagggaattacttgccttacagtcagctttggatgaatttaccgatttacttagcgatgaagaacagacaaatttacgccatcatatgcaagtgacggcagattcactaaatacagatgacaaggccgccattgacgaagccatcaaagccttaaaggtacacagtgaccattttgccagtgttattatggataaaaatgtcaaagacgcccttactggtacacgcaccagcgactggtaa

SEQ ID NO: 1323 - DNA, 348 bp, M.catarrhalis
gagaacatcatgaccgttgtaaccattttacctcatcacgaaatttgcccagagggtgcaaccatcgaggttgcagagggtgaaaatctatgccaagccatgctcgagcgtggtataaaagttgaacacgcctgcgatatgtccaaggcatgcacaacttgccatgttgttgtacgacaaggctttgatagtctagaagaaatggatgatattgaaggcgatttgcttgaccgtgcttggggtcttgaaccagattcacgcttatcttgccagtgtattattgctgatgaggatttggtgatcgaaattccaaaatacaccctaaatcatgccaaagaaaaccattaa

SEQ ID NO: 1324 - DNA, 360 bp, M.catarrhalis
ggggaaattgtgagtaatcaaacaaaaatacaagccatcaagcaagcttctgagcagattttggcaatttgtgagacaccaaacacagcattacaagccattcatttgattttaaggcatggtggggcaggagagttgtcttggcaagtggtgtatcagcgggttatggctgatgaagatgtgattggtgctggttatttgattgattttgcacaaactgccgaaaatttaccatttgatgtattgcctttgattagccttgtactaaacaaaggtgatgagacgctaaaaaccaccatgttaaataaattacctgataatgccaaggaaaatttacgcattatgggctatatatgttag

SEQ ID NO: 1325 - DNA, 486 bp, M.catarrhalis
tggcaaatggttactggctcaactttgatggcaaatggctacctgctgaataatgagctgacagactttagttttgagccaataaagcagggcaaacaggtcgccaatcgtgtcgagcctggtaagagaccacgctcctcaatggcaccaaccatcgtatttaaagcaggcaagccttatatggcaatcggctccccaggtggtggccgaatcattggctatgtcgctaagacgattgtggcgcatcgtgactggaatatggatatccaagatgccatcagtgcacccaatttattaaatcgttttggtagctatgaattagagatggatacaaccgccgtccaatggcaacacgcattaaatgatttgggctataagactgatgtgcgtaagctaaattcaggtgttcaagccattattatcgagccaagcaggctggttggcagtgccgatccacgccgagaaggtcgagtgatgggtgattag

SEQ ID NO: 1326 - DNA, 603 bp, M.catarrhalis
gcactgctgccgttgcccaagtccagcgttaatgttgatgataacattaaggtaaccgcaattaatggtcaggcaatccatcatggattattacaaccactacaacaaaatttcactttagaaccaggtcggcatgtcattacggcgcgttatgatcggttgtttaaacttggtcgtgatgatcatgattatctaaaatcaggcgatattaccattactgccaatttagctgatcatcaaacctatcgacttattatgccaaatcagcctaaagactatcacgctgccaaagattatatcaaaacacccagtttagccatcacacaacacggtgcgattattacccaagaagataccactcaaacgaagcgttcaggtttatttggcggtattacaagtacgattaacaacctatttggtcgtacaaattcggcaacaactgccaaccaagaggcgattgctgcaatcagtacttacaataccgccaaacccactgacaatcatgcggtgcgtgctgatgacaacttagatggctttatgcaaatttggctaaacgccagcgatgaagagcgtgagaaaattcgccaatggattgaaaaataa

SEQ ID NO: 1327 - DNA, 1116 bp, M.catarrhalis
gttttcatgtatccagccaaaattgatccgttttttcgccgtctgtttattttagcggcgttatgtttgtttttatatgccctatttttgatgaaaacggtcattacaccctttgttgcagcatttattttggcatattttttaaatcctttggtcagccgacttgccttaattatgccaagaattttggcagtctcagttgtgtatattagctgttttgtggtcatgggcgcattaatcatttggttggtgcctatggtttgggcacaaatgcagatactttgggagtcattgccacatatcattacttggtataatgacactggcagagcttggattgctcgctataccgacagtgagcttttgccacttgatattgacctaatatccaatacggccttggattactttcaaaataactatcaagttaacgatgttcaaggtttaattaagcaagtatttagctcaggtatttcagcggccaataacattggtttgattgtcatggtgcctattcttaccttttattttttattgggctgggatcaacgactgtatacatggaagctatctattcctaagccctataccaataaggtcgttagaattgctcgtgactgcgatactgctttgatgaattttgccaaaggtcaatttttagtcatgttgctacttggtgcaatttatgccattcagctacagctcatcggtttgcagttaggattgattattggcatcaccgctggcattgcaagctttgtcccttatttgggttttggtattggtattattgcagcactgatcgcaggattatttcaatttggattagactggatctatttgggactgatttttggggcatttatgatcgggcaagttgttgaaggctatattcttcaacctctattactaggtgataaaattggcctatcgcctttatgggtcattttttctgtcttggcaggtgcatctttatttggttttgtcggtatgctcatcgccctgcccgtctctgcagtcatcaatgttttatttcattatgcgtatgatgcctatttacgcagtgattggcatgaaggtcaaaggcagctgcctttatggaaagaagatgactaa

SEQ ID NO: 1328 - DNA, 294 bp, M.catarrhalis
ggcattgcccatggtattttaacaggagatattttcatggcacataaaaaagccgcaggttctactcgtaacggtcgtgattctaacccaaaaatgcttggcgtaaaagtttttggtggtcaagatgttgttgctggtaacatcatcgttcgccagcgtggtaccgaattccacgcaggtgaaggtgttggtatgggtcgtgaccatacattatttgcattaactgaaggtgtggttaaatttgagaccaaaggtcaatttaaccgtcgctatgtttctgttttagcaaaataa

SEQ ID NO: 1329 - DNA, 786 bp, M.catarrhalis
acacccatcaaggctgtcatcatgacccaagcaatacaagattcattgaatttagatattcgtcccgaagcatcacttgaggattttcaatcttcaagttaccgccccattttggatgctattgataaattggtacaaggcagtttgcgtgagctgttcattgtcggtgattctggctttggcaagacgcatttggcaagtgccatctatgagcattatacttcaatgacctcaaaaatggtcatcagcttaaatctaaccgaactcatagaacaagatccgcatgcaactgcacttgttgggcttgagatgtttgatttgattatcgtggatgatttacaaatggttcggcatagctatgaatggcaagaagggttatttcatctaatcaaccgccttcgtgaacaccaaaaacagattttatatttggcagatgatccagcacgagagctacaaattggattattggatttacatactcggctatcgctagcccccatgctgactttgccagataatgatgatattaatgatcgtcgtatcctgattgaggtgattttaaagaaaaaaaactggaagctgcctgaagagatttttgactatttacttgaagagggtcctagaaatgctggggatattaataccatccttgatcacattcgacctttactgacacgcctttcacgcgtgcaaattcccaaaaaaaccatcgcagaagccaagcaaattattttacatgaaacattcatgcttgaaatcggtgataatgctgactccaatttttga

SEQ ID NO: 1330 - DNA, 549 bp, M.catarrhalis
caagggtcaaatatgacagatcaaaccccacttagctataaagatgcaggcgtagatattgatgcaggcgaggcattggtttcgcgtattaaatcggttgccaaagccaccagccgacctgaagtaatgggtggtttaggcggatttggtgcgttatgccgcattccgacgggttataaatcaccattacttgtatcaggcaccgacggtgtcggtacaaagcttaagcttgcactacagcttaatcgccatgaaactataggccaagacttagtggcaatgtgtgtgaatgatttattggtctgtggtgcagaaccactatttttcttggattattatgccacaggtaagcttgatgttgataccgctgcaaccgttatcgcaggtattggcgagggttgtcagttggcaaattgtgcattaattggcggtgagacggccgaaatgcccggtatgtatcaagatgaagattatgatttggcgggattttgtgtcggtgtggtcgaagagtcagaagtgattactggcgaaaatgtccaaaaaaggtga

SEQ ID NO: 1331 - DNA, 396 bp, M.catarrhalis
cttgggccagatgcactgatggcacccactcgtatttatgtcaagtcagtcaatgccttacaaaaatccttgggtaatgccaatattcacgccatggcacatatcacaggcggcggcttaaccgaaaatctgccccgtgtcctacctaaaaatttggcggcacagatagacaccagcagttgggcattgcctgaggttttccaatggctacaacatggcggtaatattgacactttagagatgtatcgcacctttaactgtggcgttggctttattttggttgttcctgccgatcaagccaagcaggcgatgaataaactgactgccgaaggcgaacaagtttggcagattggtcagattattgagcgtactgatgatgcggtggtgtatgcctga

SEQ ID NO: 1332 - DNA, 687 bp, M.catarrhalis
tgcggtggtgtatgcctgatgagccaaaaaccccttaaggtcgctgttttggtatcaggcagcggctcaaatttacaagtcatgattgatgccatgaaatcaggtagccttgcgattgatattgttggcgtcattagtaatcgtgaagatgcttatgcaatcacacgagcaaaagatgcaggcattcaggtgtcggtattgtctcatgtgccaaatggtaaacgtatgagtatcaatacttttgagaaatatgcacttcagcaaattcaagattggtcacctgatttggtggtgctggcaggctttatgcgagtattgtctgcccaatttatcaataacatgccttgtgcgatgattaatttacatccgtctttattgccacattataaagggttggatactcatcaacgggtactgcagtcaggtgataaatatcatggttgtagcattcatgtggtaacaccgaagcttgatgcggggcaagtactcactcaggcttggcttgctgttgatgttttggatacacccaaaagcttggcaaagcgtgtacaaacacttgagcatcgactcgtcccttatacgcttgatatgatgataaaaaaggtaattgatattgataacattatggcagggcgtatgaatggcatgatacctttacccctaaaattttggatggatgatgaatga

SEQ ID NO: 1333 - DNA, 930 bp, M.catarrhalis
tttatgaaatcaatcaaaacttttaccgcctgtcttacgatgtgcttagccttggttgggtgcggtcagcagaccaaagaagacatcaacgcacaggatactcattctccaaaaaaactgtctgttgtcacaacttttactgtcattgctgacattgcccaaaatgttgctggagaggctgccgatgttcaatccattaccaaggcaggtgctgaaattcatgaatatgaacccacgcctcaagatgtggttaaagcccaaaaagcagatttgattttatggaatggacttaatctagagctttggtttgaaaaattttatcatgataccagcaatgtgcctgccgttgttgtgacacagggtatcacaccgattaacatcactgaaggtgcttataaagacatgccaaacccacatgcttggatgtcgccaagtaatgccttgatttatgttgagaatatcaaaaatgcactcattaagcaagacccagccaatcaggaagtttataccaaaaatgctgagcagtacagtgcaaaaattaaagctatggacgctccactgcgtgccaaattatcacaaatccctgaaaatcagcgttggttggtaaccagtgaaggtgcgtttagctacttggccaacgattacggtcttaaagaagcttatttgtggccaattaatgccgaacagcaaggctcgcctcaacaagtcaaatcattgattgatacggtacgcagcaataacattcctgtggtatttagtgaaagtacaatttcagacaaaccagcaaaacaagttgccaaagaaacaggtgccaaatatggcggtgtactttatgttgattcactgtctgaagctggcggtcctgtaccaacttatcttgacttattacaaaccaccgtctcaaccatcgccagcggttttgaaaagtga

SEQ ID NO: 1334 - DNA, 1677 bp, M.catarrhalis
cctgtgttgtttattgataatggatttgaatctatgcaaaaaattctaagaattttaatcattatagcgatgctaattacagcatatttgctgattttggcatggcgtgatgactatgcaagaaaacctgtagttacgcagcctgtggcaacccaaaccactcatgctgatgtgccaacaacacaggttgtgggtgatattccaagcttgacagcaggatcggtagctgatttggctgataccgatttgatcactgtcagcactgaccgttatgaaattaagatcaatcctgttggtggcgatattgtttatgctgctttaaaacagcacaatgccaccaaagatagtactgagccatttgtacttttagaaaccgatttacgcacctatgttgcacaatctggattgattggacgagatggcattgacacagctgaaggccgtgcggtttatcacagtccgcgtagcagctatgtgcttaatccaagtgcagggtcgctacaagtccctttgacatatcacaaagatggcttgacgatcaccaagacctatacctttaatgcaggcaaatacccaattaatctgagttataatattaataataattccaatcaaccatggcaagggcaaatgtatgctcagcttaagcgtgatagcagtaaggatcctggcctagaggataaaggcatgcttggcatgtcaacttacttaggtggcgcttggggtgtgccaagtgatccttataataaactgaaattttctaattttgacgataatatcaatattagcagtaaagacggctgggtggcaattgtccagcattattttgtatcggcttggacgccatcaaacagttttgaagctgacttttttgctcgtacgacaggcaaggatttttatattggttataatagccccgtgattaatgtggcgtcaggcaagcaaatcacccttaacagtacgctgtatgcaggtccaaaagttcagtcagaaatggcatcggtggctgaaggcttaaatcaaacggtggattatggattgttatggccaatctcaaaagtgctgttcgctattttagataacattaataaagtgattggcaattggggctggtcaatcattgtactgactttaattatcaaagtcgctttattttggctatcaaataaaagctatatgtctatggcaaaaatgcgtgccatcgccccaaaattgcaagcgctcaaagataagcacggtgatgatcgcatggcgatgagtcaagagatgatgcagttataccgtgatgaaaaagtcaatccaatggcgggttgtttgccgattttgattcagatgccgatttttttggggttgtactggatgctggttgagtcggtggaactgcgtcatgcaccatggattggttggattaccgatttatcagcaatggatccttggtttattttaccgatttttatgggtataaccatgtttgtccagcaaatgctcaatccacagcctaccgacccaatgcaagcaaaaatgatgaaaattttgcccatgatttttgtggtgttcatgctatggttcccagcaggtctggtattgtactggacagtgaataacttatttagtatgactcatcaacatcttgttaataagcgtgtggaacgccaaatgaaagcaaagcaagcttaa

SEQ ID NO: 1335 - DNA, 288 bp, M.catarrhalis
gttattattacaaataaggaaatggcaatgttttcaatgatttgggcattaattgtaggttttgttgtcgggttattggcacgagcacttaagcctggtgtggatggcatgggctggatactgaccatgattttgggtattgctggtgcttatgtgggtgcatttattgccgactttgttggcgtcaacgcccaatcaggttttagttatttaattttttctgtgattggtgcaatcattttattgtttatttatgaaattttggcaggtaaacgccatttaaaataa

SEQ ID NO: 1336 - DNA, 1440 bp, M.catarrhalis
gatattaagacagttggagtttttatgcaatatatcagtacccgtggcaagactcagccgatgcagtttagtgatgtgcttttgatggggcttgcacctgatggcggtctgatgctgcctgaaacttatccaagtattgatgaagcaactttacaaaaatggcgtaatcttagttatagcgagcttgcatttgagattatgtcgctgtttgtgacagatattcctgcagatgatttaaaaaatatcatcaataaaacttatacaaaagcagcttttggcagtgaggatattacgcctgtgactcgtctttatgatcggttggcactgcttgagctatcaaatggtccaacgcttgcttttaaagacattgccatgcagtttttgggtaatgcgtttgaatatgtactaaaacaaaaaaacgagcgtttaactgtcattggtgcgacatctggcgatacgggcagtgcggctgaatatgcactgcgtggtaaagataatatcgaggttttcatgatgtcacctgaaggtaagatgagtgcttttcagcgggcacagatgtatagcttggatgatgccaatattcacaatatcgccgtggagggaatgtttgatgattgtcaagatatcgttaaagctctccaagaagatgcaaaatttaaggcaaaatatagcttaggtacggttaattcaatcaattggggccgtattttggcacaaattgtatactattttaaaggttattttggtgcaaccaccgacaatgcccaaaagatcagtttttgtgtgccttctgggaattttggcaatatttgtgctggccacatcgcacgccagatgggcttaccgattgatcgattgatcgtggcaacgaatgaaaatgatgttttaaatgagttttttaatacaggcaaatacacgccacgcacttcggtcgaaacttatgtaacttccagcccatcaatggatatttcaaaggcttcaaactttgagcgttttgtgtttttattacttgataaggacagcatgcaagtcgctaagctgtttggagatgttaaaagtggtaagggttttgatttgtcggataatttaaaactggtgagtgaaaaatttggatttatagctggtaaatctacgcatcaagaccgcttggcaaccatcaaaaaagtttatgatgatacgcagcgattgatcgatccacacactgctgatggtgtaaaagttgcgattgagctacaaaaagcagatgagatgattttggttgccgaaacagcattaccagccaaattccaagaaactatcgtagaggcagtaggtgagatgactttaccacgacctgagcatacccaaggcttagaagataagcctcaatatgttactgtggtgcctaatgatactaaggcggtagcagcattgattgagcaatatattactgcgtgctga

SEQ ID NO: 1337 - DNA, 801 bp, M.catarrhalis
atgaaaaagaccatttttaacattgcaaaaatggactgcccgtccgaagagcagctcattcgcatgcgtttaaaagatgtatctgatatttatgaattacagtttgatattgctgggcggtgcttaaccgtctatcacgataatcaagatacaacgattttacaagtacttgaaccgcttaattttgatagtcatatcatttccaccgaagtgattgttgataagatagtgtttaacaagcctgatgagcgcttagaaaaaagattattatatcaagtactcatgattaactttgtgttttttatcatagagtgttcggttggtatttttgctaattctatggggctgattgctgatagtctagatatgctagcggacagctttgtctatatattggcgctatcagccattggtatgacgctggcgtataaaaaacgtgtggcatttttggcggggataacgcagataatattggcgttatttggggtgatagaagtgattaggcgttttatcggtactgagcagctgcccaattatcaactgatgattggcacggcatttttggcattgattgcaaactggctgtgcttatatctactgagcaaaaatcaaaataaagaagcccatatcaaagccagcatgatttttacatccaatgacattatcatcaatatcggtgtgatagcggcgggagcattgacgttattgactcattctagctatcctgatttaatcattggtatgattgtctttgtcattgtactatttggtgccagaaatattttaaaattggcaaaataa

SEQ ID NO: 1338 - DNA, 846 bp, M.catarrhalis
gtcatgattgcattactacttgagccttttgcttatgaatatatgctcaaggcaatttttttaagctcattagtaggcggtgtttgtgcctttttatcagcctatctgatgctaaaaggctggtctttaatcggtgatgccttatcacatgctgtggtgcctggtgttgcaattgcctatgcactgggtgcaccttatgcgttgggtgcgtttttttctggcattttagcggccttatctattttatggattaagtctgtgaccaaactgcgtgaagatgctgtcattggatttatttttacgactttttttgccttaggcttatttatcatttctttaaaccccaccgctatcaatgttcaagaaattatttttggcaacatattgggcattgccaatacagatatgtatcaagtgactgttgttatggtcattactttgttgattttattaatattttggaaagatttgctgttggttttttttgatgaaatacaagccaaagcggtgggtttatcaagcaaatattataaattattattttttagcctacttagtgcctgtgtcgtctctgcactacaaaccgttggtgcaatcttggtcattgctatggtgatcacacctggagcaactgcttatcagctcactgataaatttcgtacactgattttaattgctggcgctattggcgtcatcactggcggatttggcgtatacttaagttattttttagatggtgcaactggagggattattgtctgcctacaaacagcactatttatcatcgcttttttgttttcacctaagtacggtaagttaaaacagccaaaatttcagtctccctaa

SEQ ID NO: 1339 - DNA, 498 bp, M.catarrhalis
ttgtgtcatgctatttttaacctaggacatccgtttatgtaccgcatagaacagcttcgccccttatctcgaaagcatcagcttggcttaagcctatctcgtcaagccatgcaatgtcccaaagacagcacgactgatgatatttttaggcattggcaagcattggtggcatatgttcatgatgaccgaatcgcacattttgcgattgaagagaggtatttggttgcccctttattggcaaatcatggcaaccaccccaaagtgatggcgcttggtaagcagctgcttgccgaacatgagcagttacgcacattaagtcagctgactgagtctgccagtcacccaaccattgatgatttacatgccttggcacaagcgttatacgaccatatccgctttgaagagcgagaggtttttccagtcatacaagagctgttgacaactaagcagttggatacggcatatcagcaaacgcttcaacacaacccgaccaaataa

SEQ ID NO: 1340 - DNA, 642 bp, M.catarrhalis
atgccattttatccatcaactcacgagtacaccatgcaccaaattaaccctgaactgctgaccaaatccaaacagtggcggcatgatattcaattttctcaagaggtgctgggcaaaccctttaactttaccagtacttgggggatttttagccctgaaaaattagatgatggcagcttgatgttattagattatattgattttcaaacacaagataactccattgaccttggctgtggctatggcgtacttggcatgacggcggcgcgtgaatgcccaaagggtcatcatttattgattgataaagattttgttgccatagaatacgccaaacttaattgtaaaaataatgggcttggcaatgccgaggtgatgctttctaatggtttttatcatgtggataaatctcgccaatttagtctagtcatgagtaatttgccagccaaagccagcaaagaacagcactatttatacttacttgatgcttataatgccatgacaagtggcggtagattttatgttgtaaccatcaatggactgcgtgattttatgaagcgttcttttaccgaggtttttggcaatgccgataaaatcaagcaaggcaaaacctacactgtgaccatggcaatcaaagaatcatga

SEQ ID NO: 1341 - DNA, 1038 bp, M.catarrhalis
gaaatgaattttatgaaccaccttactcaatcaaaaatgcgtatcatatttgcagggacgcccgaatttgctgcagtcagcctaaagcatcttattgatctgcaagatgttttaaacatacaaattgtcgcagtttatacgcagccagatcgtaaatctgggcggggtcaaaaattaaccgcttcagccattaagcaagtggcacaggtgtacaatatacctgttgagcagccgataagttttagcctaaagtaccaacctgagcagggtgtcagtggtgctgtttcacgtgaaactttggcgaattatcagcctgatataatgattgtcgcagcctatggactgattttacccttgggcgtcttaaaaataccaaaatttgggtgcttaaatattcatgcatcactattaccaagatggcgtggtgccgcacccattcagcgtgccattatggcaggcgatcaagaaactggcattacaattatgcaaatggcaacaggcttggatacgggcgacatgctatatcgggtatcatgtcctattttggatactgataccacgcagacgctacatgataagctggcagtgattggggctcatgcgatcaccacggtgctacaaaatttattgcattttcaatcattggccaaggttcaagatgatagcttggcaaattatgccgaaaaaatccatactcaagaagggttgatagattggaatcaagatgctttgacaatccagcgtcaaatccgtgcattgaatgcccacacttatcataaatcggagcgtatcaaggttttaagtgcattgccgatcaaattcgatcaaaccacatcaattccagctggtcagatcgttagtgtgggtaaaaatgccattttggtctcatgtggggctgatacaaatggtatacagcacttgattaatattacaagcatacaatggccaggcggtaagccactgactgctgaacagatttgccaaaccaataaactttgtgatagtgactattttgagataaaaactcatgaaaaataa

SEQ ID NO: 1342 - DNA, 1248 bp, M.catarrhalis
ttaatgagctattcatcgctaacacctgagcaatcaatgcttgcactttggtacataaccaatacttcattgatttcatattataagctcgtcaatcattgtggcgatgcagcatctgcattaagccaaaatcagtctatttggaaattgcttggcatccatgcggcacacattaagcgttggcaggatgtcaacgatgttttggcttttcttgataaggttcgccatgatgtagagcttaagatgtatggcattgtatatgtcagtgatgaagattatccagaaacactaaaaagtatttatgacccaccgccagtactattttatcgtggtaatttgatacgccttaaagaccgtcagattgccattgttggtagtcgatcgccgactgagattgcccaaaaaatcacttttgatttggcacaatatcttgtccaatcaggatataccgtcaccagtggtctggcgcaaggtgtggataaacaagcgcatctgggtgctctttctcaattatctgttttatctgggcgtactgttggcgttatgggaacgggcatcaatgtgtgctatccgcgtaatcataatgcactttttgctcaaatcatcaaagatggtggctgtttgattagtgagctattgcctgctacaccagccagtaagcatacttttccccgccgtaatcgtttggtggcagggctgtcacttgccacggttgttacggaagcggcacttcaaagtggctctttgattacagctcgtctctcagcagagcaaggcaaacaggtttttgccataccaagccatattcacaatcctaacgctgaaggttgtctgcacctgattcgtgaaggggcaacgctcatatatcatcctgatcaaattttggaagacttaagtcagcatgaccaagagttttttaacgcattaccaaaaagctttagtcaaggtatgtcaatatttagtgaagaatcaagtaagttgaacactcacccatctcaagcacctgacacaaataccttggtaagtccaaaccctaagacagccgctcatcacttacaacctgcaagccgcagtacttgtgtgccagagcatttggcggatttgtacgctttgatgaatgagccttgtgatttggatcagcttgtttttagtagtcaaaaagataccggcagcctcttagcagaactgatggagcttgagatattgggtttgattgagcaggtggggggacgctatggcaggctctaa

SEQ ID NO: 1343 - DNA, 1809 bp, M.catarrhalis
catatctttaaaatcagattttttatcatgacaacaccaaagcccactgtatcaccgcatgttaacattgatttgtcgttattgattttttatcagccaccaatcgaaaaactcaccaatcatctgctaactcagcctgccatgtacgcccagcttctggcaaaaaagcaggtacaagagcaacaaaaacagtccaataatgaaactaaggacggcgatgatggtattacgcttaccgaagaagatattgaaaatttgattgagcaaggatttagtgaagaaaccattgagagcgtctcaaaggcggtcaatgaacagctaagcaagaatgcaaatgatgatgccaagcaagatgataatactgatgataatctgcccaaaggtgatgatgccaatcagacacactcaaaaataaacccaatcaccaaaaagattagccctaatgattttgcccatacctcacgcccaaatcaaagcaaagttcacaagttggctcaaaacccgtcgcatcctgccaaaaccgatgatacgaaatctcatgttgctcaagctttagcacagtcagccgatgcatctgcagctaagattgcagaaagtttggataatgatattcatgcggcagtagaaaaacagctaaaagaacaacaagaacagcaagagcaacaatacgaagcatttaaacaatatcttgccaagaaaaacagcgaaacagccatcgactatcgccaaattcggattgatattgaatctggagcactgccgacacgccatttttatttgatgaatggtttatcggctgtgattgcagggtttgggctgttagcaaattcacctgcagtggtgattggtgcgatgttaattgcgatgctgataggcccgatcagtggcattgctttggcgattattgatgctcgcttggctttacttaaaaaatcactgttaaccttattgtctggcggtgcgttgatttatgctattggtgtgctgcttggctttttatatcctgatcaagctgcaagccaagagattattgcccgaactgcccctaatacgatggatgtttttgtggcattggcaggtggcgtggcaggggcgtatgcgttgatttctcgtaatttatcggttgccgtggttggcgtggcagtcgcaacagcacttgtccctccgctgactgccagcggaatattgcttgccacgggacattatcaattggcattaggggcattgatactaactttgaccaatattttggcgattcagtttaccaatgctttagtgctttgggcggtggggtttcgccgattggatattgatgaaagtgaagatgaaaccgtaaaagattcacgatggcaacaaaactggttatttattcgccgtaatatggttactttgattttattgattgggctaagtgtgtatttgacgcttgattttcagcaacgcattcgtcaaaaaagctacgaaaaggcagtcattgaggttgttcagcagcaaatccaataccagcctagctatgttgttagtagtgattttggtgtggtggaaaaaggtcaaaacaataaagcttctgctgatagctatatgattcgagtattattgcaagggctgattgcaccgagtcatcaggatatttggcagatggaacaaaaaattcaaaccataacaaccaagcgttatcccaaacgctcgccaattaaattgcaagtgcgatttgtaccagagcaagtgattgaaaccaccccagtcagtaaagcagatgtgaagcttgatgatgcctcaatcagtcaattagaagaaaataagaattag

SEQ ID NO: 1344 - DNA, 198 bp, M.catarrhalis
tgctcatgtttattactaaggtcattcaatgttaatatctcatatttttatttatttttaaccatattaaataatattcgctttaaagaatattcattatttgataatagacacaacactggcaaaataattttttttgagcatttaaatcccactcactggcaaaaatgggggctaatttcgccttttacgccataa

SEQ ID NO: 1345 - DNA, 252 bp, M.catarrhalis
tatatgctaaattttcaacaaaaacaggaattattttttaattgtttaaatgagaaaaataattcttatagtgatgatattcgtaaagaaattttattttattttgattttttggaaaatgatttaggttttttgaatagatttagttcagaaattgagattaagaattttacaaatatgcttgtttcaaaaattattatgaatgaatatcaagacggtgttcataatattattgaaaattattgttgttaa

SEQ ID NO: 1346 - DNA, 201 bp, M.catarrhalis
aaattcataaaaattttcccaagtcgtgatgaaccttttgatttaatcacgccagatgggcaaattttaaatgccaaagtctgccaagagaattcaaaagccttaatgaccaacccaaattctgcgttggctgattggttattgcgacaattattaaacttaaaaaaggcgagctggcaaccagcgaaagattgcagttga

SEQ ID NO: 1347 - DNA, 1293 bp, M.catarrhalis
aatagcataaaaccaatccaaatccaacaaacccagcccaataaagatgcttttatgaaacctcttgccgaacgcatgcgtccaaccacgcttgatgctgtcattggtcaaacccacttacttagtgagggagcgccgatttttaatatcgtacgccaagggtttttgccatctttgattttgcatggatcggcagggattggtaaaacgacacttgccatgctactggctgatgctgttggtcgtccgtttcgccccttatcagcagtcagtagtggcgtcaaagaactcagagaagtgctcagatctgacgatgggctatttcatgagccacctgtcgtctttgtcgatgagattcatcgatttaataaagctcagcaagatgctttgttacaagcggttgagacaggtgaaattactttgattggtgcgaccaccgaaaacccttcttttagcgtcaataatgctctactgtcacgctgtcaggtatataaacttgaacccttaagtgatgatgagatttatgcactcattgtgcgtgcaatacgacaagacaccttactaaaaaccaaagacattcaaattaataacttagcggcactcattgatctatctcaaggcgacggcaggcgtgcactgaatttacttgaacttgtggcagcagcacctgagccaattatcatcgataatgcttctgttgttgctgtggcaggtcagcccttggtacgctatgataaatcaggtgatgggcattatgaccttatctccgctatgatcaaatccgtgcgtggctcggatgcagatgcggcgatatactggatggctcggatattggcggcaggtgaggatcctgcatttgtcgcaaggcggctggtcattttagccagcgaggatatcgggcttgccaaccccaatgccctactactggcagatgctggactacgctcagttcagtccattggcatgcccgaggcacgcattattttggggcaagtgattatttatttggcaaatagtcctaaatcaaattcaagctacaacgccatcaatcgtgccttaaagcttgccgaaaccgatcaatcgcccgtaccactacatttacgcaatggtgtcaccaagcttatgcaagcagaaggctatggcatgggctatatctatccgcacgattatcccaatcattatcacccacagcagtacctacctgatgcactgataggtacacggttttatgaatttgctgataaccaaaaagagcaagccaattttgcctttatcaattggctaaaaacctaa

SEQ ID NO: 1348 - DNA, 498 bp, M.catarrhalis
ttaataataaaaaatttaggagtggtgatgcattgcccattttgcaataaagcagataccaaggtgaccgattctaggttggctgccgaaggtgcacaagtacgccgacgccgacaatgtttagcgtgcggagagcggtttacaacttttgaaatttgtgaaattttgatgccacgaatcatcaaaaccaatagccgtattgagccttatgatcaatcaaaactcagacgctcaatttcactacctctacaaaagcgtcccatcagtgttgatgaaatcgaagcatgtatcagccgcatagagcatgaacttagaaaaacaggtgagcgagaagtatcaagtaagattttaggcgaaattgtgatgaatgaattaaagatacttgatgatgttgcttatgtacgctttgccagtgtttaccgtgattttcaggacattggtcagtttcaagctgagcttgacaagatcaatttacccaagcgtggtgaatcttcatga

SEQ ID NO: 1349 - DNA, 936 bp, M.catarrhalis
cacatgacaaacaaacctaccgttgcgttaataggtgccccaaccgatgtgggtgcaggtgtgcgaggcgtgaacttagggcctgatgccttacgcattgctgacattgataaagccattgaacaatatggttttactgtcattgaccgtggtaatttgcaaggcccagccaaccccaatcagccccctgtgaacggctaccgtcattttgatgaagtggttgcatggaacaaaatggcacacgatgctgtgtatgatgagctgaaaaatggcaactttcccattttgatggggggcgaccattgtttaggtttggcatcattgaccgctgtggcacgccattgccgtgagcaaggcaaaaagttgcgtatcctttggcttgatgctcatgctgattttaataccagcgaaatgaccccatcaggcaacattcatggcatgcctgtggcttgtgcttgtggttttggtcctgatgagttaaccaccattggcggtgtcagaggagcgattagcccaaaagatgtgtatcaaatcggtatccgcagtgtggacgctaaagaaaaatacttcatcaacgaaaaaggcgtcactgtctttgacatgcgttatattgatgaaaatggcatgcgtcataccatggaacaagcgttaaaaggcttggataatgacacgcacttacacatcagttttgatgtggattttcttgacccaagcatcgccccagcggttggcacaacggtgatgggcgggcctacctatcgtgaagcgtcattgtgtatggagatgattgccgatactggcttaatggcatctttggacatcatggagctaaacccaacccttgatgaacgcaaccgcacagcggtcatcatggtggattttattgaatccttgtttggtaaatccaccctagtcagacctgacacaacccaataa

SEQ ID NO: 1350 - DNA, 189 bp, M.catarrhalis
aataggaaaaataaacaaatgaaagcactaaaaatcatcgcacctgtgttggcactaggtctatcttttacagctattgcaaatgccctagatgcacatcgagccatccaactcaccaataaggttcgccaagtgacttgtatagttgccccacaggtagtttccccacaggcgacacggttcaagtga

SEQ ID NO: 1351 - DNA, 1425 bp, M.catarrhalis
cttagcagaaaaccttatcaatttatgacaaccagtatccaacaattaccgaccatcgccgccatcgccagccccatcggtcaaggcggtgtcggtatcatccgattatcaggtaaagacgcttatcgcatcggttgcctaatgacgaggcggtcaaatttaatacccagaatggcatattttggtggtttttatggtcaagagggtgtgattgatgagggtgtgataatttattttaaggcgccacattcattcactggagaagatgtggtggagctacaaggtcatggcggcatggtactacaaaacatgctgttggctcgggtgtttgagcttggtgcacgccaagcagcagcaggggaatttagctaccgagcttttgaaaatgataaaattgacttggtgcaggctgaagccatcagtgatgccatttcagccacttctgtcgctcaggctaccagcgctattcgttctttgactggtgaattttcccaaaaaatcaatgagttattagataagcttgttcatcttcgcttgtatgtggaagcttcgatcgattttcctgaggaagaagatgttgattttttgtctgatggtatcattgaaaataaattaactgagattttgtcaggtattgatcgtatcttagcgacagcaaaacaaggtcagctgttgcgtgatggcgtgcatgtggtgctggcaggtaagcccaatgcaggtaaatccagtctgcttaatcgcctatcgggtactgagcgtgccattgtaacagagattgcaggcaccacgcgtgacactttggaagaaactttgattttaaatgggttgactgtacatttaactgatacagcaggtcttagaaaaactgatgatcatgtcgaaaaaattggtatcaagcgagcatttgatgcgatccgtcaagcagatgtattgataatggtttatgatgttacaacagaaactgatccgttagcattagccgatcagctgttttgtgagggtgtgactgaggatgttggtgatattattcgccaaaaattgattttggttgcaaacaaaagtgatttattgatctcaaaaccagttttacaggtttcatgtgaaaccaaatcagcacccaaacttgtttatgtttcatgtgaaacaggtgaagggcttgatgaattgattgaaatattaacccaaaaggtgggttttcatcctcctgaaaatagtttgattgcacgcactcgccatcttgatgccttaaatcgtgccaaagggtacgccatcgaagcgtacgagcagcttaccatttatcatgctggtgaattggtagcagaaagtctaagacagtctcagcaagcattgggcgagattacaggtcagatgagtgcagatgagctgctgggtaagattttttcaagtttttgtattggtaaatag

SEQ ID NO: 1352 - DNA, 1059 bp, M.catarrhalis
atcttcatgaatgacaaacgattgatacagcaagatatttattatatgcagcttgccatagcagaggcaaaaaaaggcatttataccacaagacccaaccctgctgttggctgtgtattggtcaaagatagtctggtcatcggtcagggttatcatcctaaggctgggcagccacatgctgagatttttgccttggctgatgccaaagcacagggttttgataccaaaggtgcaaccgcttatgtgacacttgagccatgtagccatacgggccgtacaccgccttgtgctgatgcgctcattgctgcaaatcttaggcgagttgtcgttgcaagcttagaccctaatcccaaagttgctggtaatggtatcaaaaaacttcaaaatgcaggaattgaggtcttggtgggggtgtgcgatcagcaggcagctgcgttaaatttgggttttttgaaggcgatgagaatgggcttgccttatgttaggttaaaaactgccagcagtttggatgggcgtacagcgatggcatcgggcgaatccaaatggatcacaggtatagaggcacgagaagatgtgcagcgactgcgtgcccaaagtgctgcgattatcacagggtcaggcactatcatagcggataatcctgcgttgacagtgcgtagcaaacagcttggtgtggatctacatatgctgcctaagcccaaggtggtcattgtcgatcgtagaaatagattatcagattcagataattaccaagtgttaaatcgtgatgacaccttgatttggcgtaatgatttaatgagtctactaaaaactttggtatcacaatatgcctgctatgatgtattgatagaagcaggtagtgagctgtctggcgcctttattacagaaggcttggttgatgagctgattgtataccaagcgccgtgtattttgggtcaagatgcccgtccgatgtttgcatgtcagcttgatcaattggtgcagcagtatcgatttgggctacattctgctgatatcatcggcaatgatattcggctaatttatcgcagtttaacttaa

SEQ ID NO: 1353 - DNA, 1353 bp, M.catarrhalis
aaactcatgaaaaataatataaaaaaactacacaatcatcagctttcatctcgtgcaaaagttatcttagttattgaagaaattttaaatggtaaatcgctgtcagagctacttgatcctttattagaatcaacggagatgagtagccgagggtttgtacatgaactactgctgggtactttgcggcagtggtgggcattatctcgaatttctgagagcttgattgaaaatcctgtgacagatcaaggggtgcaggccgctattaatatcggcttgtatcaacttatctatatgaatataccagagtatgctgcgattaatgacacggtggaagccttaaaacagcttggtaaagaatatggcacagggcttgtgaatgcaattcttcgaaaaactcaaaagtcaaaaacaaaatttaccaagaaagtcaataaaaaccacagcttaccaaattggctggctaagcagctcaaacaagattggggtgagtattatgatgagctgggtcgtacactaagatttgctgcaccgatttttttgagagttaatacgaagttttcagacaacgtatcttattgccagattttagatgagcatcatatacagcacagtttggtatcgcttggatataatcaggcacaagccgtcaggctagatggtggtgtacgaattggtgaattaccttattttgatgaaggatgggtgtctgtccaagatgcacatgcacagttggcaggttttttattggcgcctactttgcaagcacaaggcagtcatcaagctgtgctagatatgtgttgtgctccaggcggtaaaaccacgcatttgcttgagatgtttcatatgaaacatttgaccgccgttgatagtgagagtgctcgattaaaaagaatgcacgaaaacattagccgccttaagcttgatacaaaagatatttctgtggttcatgctgatggtacctcttggcgatcggatcgatgctttgatgtgattttgcttgatgcaccttgtactgccacaggtgttttgcgtcgccatccagatattggactacttagacaagaacaggatattgcaactaccgttaatttgcaaagaagcatactggacaatctatggtcacggttaaaagttggtggcgtgcttttgtatgtgacttgctctatcttgaaggctgaaaatgagcgacaaatcattgattttttgagagctaatgacgatgcaaacgccataccttttgatttaagcttaccacatcaaatcaagcagcaggtaggttatcaatgcttacctttagataccaagggtggcgatggcttttattatgctttgctgacaaaaacagcaaaatga

SEQ ID NO: 1354 - DNA, 912 bp, M.catarrhalis
aaagtgatggataaaatcaccatcagccttgacgatatttcggttcgatacaataacggacacaccgctttgtatgatgtttcgctacatctacaaggcggtacaacctgtgccttggtcggaatcaatggtagtggcaaatccaccttatttaaggtgctgatgggactaattaaaccccaaacaggttatgtcaagctttgtgatttgaccatcgctcaagcacttaagaaaaatttggttgcctatgtgccacaaagcgaagaagttgattggcaatttcctgtatcagttttagatgtcgtcatgatggggcgatatggacatatgaattttttacgccgaccaaaaccaaaggattaccaaaagattgatgaagccatgtcacgcgtccaaattaaccatcttgccaatcgacaaattagcgaattatcaggcgggcaaaaaaaacgggtatttttggcaagggctttggctcaagaaagtaaaatccttttattagatgaacctttcacaggcgttgatgtaaaaaccgaaaaagccattatgaatcttttagatgaattgcgtcaagaaggtcatctcattttaatctcaacacataatttagggacagtacctgaattttgtgaccaagttatcatgataaatcgtaccattttagcaatgggaagcaccaaaagtacattcacccaagccaatcttgaaaaagtttttggtggtgttctaaggcagctgcacttggtgggtgaagacttgcacgatgatgatgataaacgcactttgacgattttggcagacgatgaaattcctgctgtcttttatggtcatcatcaaaaccgcagctcttatcatcgcaaaaatgtcaaatccagcgaaaatccccaagctgagcaagaggataagtcatga

SEQ ID NO: 1355 - DNA, 183 bp, M.catarrhalis
gcctacttactaagtggggggggggggtccttcctattttcccgcgtattgagtccacatggtgaaaccccccccttgtttgtgtgtggaggtgggcgaaacgcgcgtttgtattatattattgtgttgcgcgtgaccaaaacgggtggacatgcgcgtgggggtgggtgtgttcatatatga

SEQ ID NO: 1356 - DNA, 312 bp, M.catarrhalis
aatattctactaatcttgattgagatttatcgccgctggatcagtccgatgatgacgccaagatgtcgttattacccaacttgctcagcttatagccgccaagcgattatttggcatggagctatcaaaggacttaggctcagtatttggcgaatcggccgctgtcacccttggggcggctgtggtattgattttgttccactgcctttggctcgctatcactatcaaccaagccatctttatttttcttatggattcaaagacacattaagttatgcagcacggctaaatcatttaatcaaaacaacttag

SEQ ID NO: 1357 - DNA, 1254 bp, M.catarrhalis
tgtaaatgttggcaaattatgacgatatcagcagattttttagaagaaatttttggcgaaaacttagcagacctgaccattatggacgaagcaccttattttattggtatgatgagtggcacaagcttagatggcatggatgcggtattgtgtcggttttttgaaacggatgatgaaacatgctcggttgagattatcgcaagccacagcgtgccatttaccgaggacttacggcaagcgttattatctttaacgacgcctaatggtgtcgctacatttatccaaacttgtgagtttgactttcaaagcgagctggatgtctatggctgggcgagcgtgtattatgcaaccttcgccgctcaagtcgcccttgagctgcttgataaggcaaatatcagccatgatttggtttgtgccattggttgtcatgggcaaactgttcgccatcgccccaattggtcatttagcttgcagttattagacccaaatattttagctgagtatacaggcattgctgtggtcagcgactttcgtcgccgtgatatggcagtcggtgggcaaggtgcaccacttgtgccagcttttcaccaagccatatttggtcatgataagcaggttaagggtgtactgaatttgggcggaattgccaatattactgtattaaatcatgacaaaagtacaccgattggttttgatactggggttgccaatctgctgatggatgcatggaactttcgccatacaaatacctgttatgaccaagatggtacttgggctgccagcgggcaagtcattcagccattacttgatattttgcttggccatcctttttttagccaatcaccaccaaaaagcacagggcgtgaagactttaatttgtcatggcttgatgcaatgatcgatcaattaaacagcagtcacccaaatttgtgccatacccctgccgatatacaggctactttgtgcgagctgaccgctgtcagtgccgccaaacaaatccgccattttattaaatcaggcactgtgcttgtctgtggtggtggtgcaaaaaatacccatctgatggcacgcctgcaagcacatctgcccaatttatccatcaagccaaccaatgattggggcattgaggttacttggattgagagtgtcgcatttgcttggcttgcacgccaaaatatcttagggcgtcatggtaatgttcctgccgtcactggtgcaaacaaaacggttgtattggggcaagtatgtttttga

SEQ ID NO: 1358 - DNA, 636 bp, M.catarrhalis
ttgagcaggtggggggacgctatggcaggctctaaacaaatttttggagctgatgagctggacttggttgctaattatttgcaggcaggtggtgtattggcataccctagcgaaagcgtttgggggcttggttgtgatgcatttaacactgatgctattaatcaaattatcaatcttaaacatcgtgatattggtaagggtttgattgtactgacagatgcagctgaacgcttaaaatcgttaattgatgtttcacatgaaacatctttacttgattacatgcaaaatttttcggatgagtttacgcatgagtattcacgtgccttaacatggctgatacctattcagtcatcggcattgccatcggtgctgatcggttcatacgataccttggcggtgcgtatcaccatacatcctgtgttaaaggatttgtgtcacgccttaatctcaccgactaacccttatggatttttggtatcgaccagttgcaatccatcaaagagtacacctgctaaaaatttaacacaagcaatgggatattttggtgatcaaattgcttacttagataccgatggtttgggctttgtgcaaccaagctgtatcaaggatttattggcgggtcatatcttacgataa

SEQ ID NO: 1359 - DNA, 321 bp, M.catarrhalis
ggttcgccaagtgacttgtatagttgccccacaggtagtttccccacaggcgacacggttcaagtgaattatggcttcagtgatcaagcactaccgacctatgccgaagccaattttggtggtaaaactcgtttcttgccaattaatttggtagaatcaattggcgaattaatgatttttggtgatgataatgattggcaaatctttggcctctatttacaacttgacaatgatcatcattcatatgtgcacattattgacccagatgcagaagccagctatcgttgcgatgtggtaggtacaaagcgtattaaagactaa

SEQ ID NO: 1360 - DNA, 498 bp, M.catarrhalis
tggtcatttatgaagatgagctgcccttattgttattctgccaaatctcgccctctgagtttcggcgagcggcaaatggcgatcagcgtatttggcgatgcacttaaattagacgatattcgtctaaagactgcatggtgggttatccaaggctatgccgtctcacccaatggtcatgtgtattttcatcccaaagatttttgtgaggatttttcatctcaacacttgatgaagcgtgcttggctgattcatgagctggtgcatgtgtggcaggtacaacaaggtattcgggtgttttggcgtgcgattttgagccgccgctatcggtatcggtggatacaggggaaagcatttttaagatatggtattgagcagcaggcacgcatggttgaggatttttatatacgccgtgaatgtggcaaaaactgcgataaatggtatgaatgtgtaccctttttaagccgtgagattaaatccacacagtgctttaaaaattga

SEQ ID NO: 1361 - DNA, 678 bp, M.catarrhalis
gaaaatattatgtttacaggaattattgaaaccacaggcagactcaaatccatcaatcagattggcggcgatgttcagttggtaatccatgcgccagacatggattttaatgatgtgcatcttggtgattcgattgcatcaaatggcatttgtctgaccgtggtggatattggtgataaaacttatgcggtggatgtatcacgtgaaacactgagcaagacggctttaaagaattggcgtactggcgatacagtcaatcttgaaaaagccatgcgaccaactacacgttttggggggcatattgtcgcaggacatgtggatggtgtgggcgtgattcgtcatatctcaaaagacgcccgttcgatttatattgaaattgaaattccaagtgagcttatgcgttacgctgccgataaagggtcgatcactgttgatggcattagtctgacaaccaatgccattaagcctgaacaaaacattgtatgccttaatatcatcccacatacggccaaatgtactaatatcgatcggcattggtcggtgggtgggcttgtcaatattgaggtagatttgatttctcgatatcttgaaagattgttatttgcttcaaatcaagtacaaaagcctaccagtagcatttctgaagagttgctcaatcaggcaggattttacctttaa

SEQ ID NO: 1362 - DNA, 1104 bp, M.catarrhalis
gagaacattatggctttaaatactattcctgaaatcatcgaagacatcaaagcaggaaaaatggtcatcttaatggatgacgaagaccgtgaaaatgaaggcgatcttatcatggcggcaaatcatatcacgcctgaggcaatcaactttatgatcacgcacgcacgaggtttggtgtgcctaaccttaaccgaagcacgctgtcagcagcttgatttgcctttgatgagcgataaaaatggcgcaaaattcagcaccaattttaccctatccatcgaagctgccgaaggggttacgacaggtatctcggcatctgatcgtgcgcgtactgtccaagctgccatcgcagctaacgccaagccaatcgacatcgtccaaccaggtcatattttccccatcatggcaaaaaaaggtggtgtgctgcaccgtgcaggtcataccgaagcaggctgtgatttggcacgcttagcaggacttgagcctgcctcggtgattgttgaaatcatcaaacctgatggcgaaatggcacgccgtgatgatttggaagtatttgccaaagaacatgggctaaaaattggtaccatcgctgatttgattcaatatcgtatggcaaccgaacaaaccgtcagcgaagttgagcattttgctatccaaactgagcatggggattttaccgcatatcgttttagtgagtttggctcagatgatacgcatttggcatttgtcaaaggtaagccaactggtggcgtcagcacagtgcgtgtacatagtttttcgcccatgaaagacttatttgggattcataccagcggtagccgctggaatatccaaaatgcactggcaaaaatcgccaccgctgagcatggtgtgctggtgtggattggtcatgatgatacacttaatcttggtgatggttttgaggcactaaaggataagcagtcggtaacctcggtgaatcgccgtgcaccttatcagaccattggcgttggtgcacagattcttaaacacttaggcgttaaggacatgcgtttattatcaagccctatcaaattcaacgccctatcaggttttgatttgaatgtggtcgaaacgatagataaataa

SEQ ID NO: 1363 - DNA, 1308 bp, M.catarrhalis
cacaacccaataattcaaaccattcatggacatattttttttaaggacttcactatgaacaccaccaaccaaccatcaaacagccaagcttatattgaccgtgaagagcaatacggcgctcacaactatcaccctttgcctgtggtattaagccgtggcgagggggtgcatgtttgggatgttgagggcaaacagtattatgattttttatctgcctattcagcggtcaatcaagggcattgccaccccaaaatcatcaccactttaaccgaacaagccaaaacgctgaccttaacatcaagggcatttcacagtgataagcttggtgagtttgaagcctttgcctgtgactattttggctatgataaacttttgccgatgaacacgggcgcagaagcggtagaaaccgccattaaaatttgtcgaaaatgggcatacgagaaaaaaggcattgatgaaaaccaagccaaaatcattgtctgtgagaataattttcacggtcgtaccaccaccatcatctcattttctaatgatgaaaatgctcgtaaaaacttcggcccttatacccaaggttttattaaagttgaatacgacaatcttcaagccttagaacaagtgttaactgataataaagatgtggcagggtttttggttgagccaatccaaggtgaggcgggtgtgtatgtgccatctgaaggttatcttgccaaagccaaagccctttgtgataagcataatgtgctgtttttaggcgatgaaatccaaacgggcattgctcgcacaggcaaattacttgcccttgaccatgaaaatgtgcgtcctgacatcttaattttgggcaaagctgtctctggtggcgtttatcctgtatcagtggtcatggcagatgatgacatcatgaatgtcattcgcccaggacagcatggctcaacttatggtggcaatccgctgggggcagcggttgccaaaaccgctttagaggtggtgcgtgatgacaatttagcggataatgctgataagcttggtcatatctttcgagaagagatgcaaaagttggtggataagcatgagcttttaaccttggtgcgtggtaagggattgctcaatgcggtggtcatcaatgacaccgaagacagcagtacggcttgggacttatgtttggcactcaaagaaaatggactgcttgccaaacccacacacggcaacatcattcgatttgccccaccgcttgtgatgactgaaacccaactgcgtgagtgtgtggacatcatcgccaaaacggttgccaagtttgaagcagacagatga

SEQ ID NO: 1364 - DNA, 1236 bp, M.catarrhalis
ataaaggcgatgaccatgagtgattttttacccatcaaagaccaattgacgcttatcatgcgaggggtgcaagagatttattccaaagaagatttgataaaaaaattagaaaaaaaccgcccgctacgcattaagcttggcatggacccgacagctgctgatttacaccttggacatactgtggtactaaataaattgcgtcattttcaggatttggggcatgaggtgctgtttttgattggtgattacacggcacgcattggcgacccatcaggcagaaatgccacccgtccgccattgacagaagccgaggtgaaagccaatgcccaaacctatgccaaacaggtttttaaaattttggataaagacaaaaccaaaattgtctttaattccgactggtttggcaaaatgagtgcaggggatatgatacaactggcaagccaaattactgtttcacggatgcttgagcgtgatgatttttcaaaacgctataacagccagacccccatcgccattcatgaatttttataccccttggtgcaaggctatgacagcattgctttagatgccgatgtggagcttggcggaactgaccaaacttttaatttattgatggggcgaacgctacaaggtcgctatgataaagagccgcaagtgtgtattactatgccaatcttagaaggcttggatggtgtacaaaaaatgagcaaatctttggggaattatattgggattaatgaccctgctggtgtcatgtatcaaaaaattctatccatgcctgatacgctcatcgctcgctactttgagcttttaagctttaagccaatgagcgaagtcaacaccttgcttgatgatatgaaaaatggccgtaatccccaagaaatcaaacgcattttagctctagagctgattgagcgttttcatgacaaagaatctgctgataatgcccacaaatcagctggcaaccgcttggcagacggtgagttgcctgtggatttgccagaggtaagcttatctttaaatggtcaagataaattatttatcacccaagtcttaaaccaagcgggtcttgctaaaaactctgctcaggccaaagacatgctatctcgtggggcggttaaagtggacggtcaagtggtcgatggcagttttgccttagaacaagggcaaacggtggtgattcaagcaggtaaaaaagcgtatgccagagtctggattcaatcagcccaaatataa

SEQ ID NO: 1365 - DNA, 798 bp, M.catarrhalis
aaatatgagatattaacattgaatgaccttagtaataaacatgagcattatgaattattaaatttattaggctatggtttagcgaaattcaataatgatttcataaagcaatttaattgccgtacaaaagagcaattttatcagtattttgttgattttggcattgcaaaaaccaagagtgtggtcaaaaatcgccaagatttatttgacccttattttgataatggtagattgggctggtggcagaaaaaggaagtttatgaacaccgaaaattactgattgatggtttgtttggtactgaaaatgtggttaattatgccaatattgttaaattgattttaaaagataattataaaacctctgattttattgttgaaaaaatcagcattgaaccaatcacacaatcaaaatttaaaaaaatgcaagaaactggtttagaggctgaattgtattttatgaataattatcagaatattgaattatttggtaatggggttttacaagatgcaagattatttggcgatggttatgattttcaaattgcaaccaattcaaacaattatttggcagaagtaaaaggcattcgccaaaataagggaaaaatccgtttaacagaaaatgagtatataaaagcctgtgaatataagcatgattatattttaacattggttttaaatttaaatgaagtgccaagatttttagttatagaaaatccagttaatgaattaaattttaaagaagtaatttttcagtcaaagcctgtaaaagagtatcatttggagcgtgatatatgctaa

SEQ ID NO: 1366 - DNA, 216 bp, M.catarrhalis
cgccaagatgtcgttattacccaacttgctcagcttatagccgccaagcgattatttggcatggagctatcaaaggacttaggctcagtatttggcgaatcggccgctgtcacccttggggcggctgtggtattgattttgttccactgcctttggctcgctatcactatcaaccaagccatctttatttttcttatggattcaaagacacattaa

SEQ ID NO: 1367 - DNA, 879 bp, M.catarrhalis
gtcctaggtgtaccaaacctttttagtttattacttatgtcaaattctattttatactggttcaccgagccttttagtcatacctttatgcaacatgccctcatctcagcggtggcggtggcggttatttgtgcacttttatcctgctacattgtgttaaagggatggtctttgatgggagatgccatctcgcatgcaatttttccaggggtggtggtcgctttttggctgggcattccgatgacttttggagcatttattgccggagtatgttgtgctggtgccgtaggctatttacaaactcacacccgacttaaagaagatacgctgatgggcgtggtattttcaggtatgtttgcattagggcttgtgatatttcataagattgacagtggtcaacacttgacacatcttttatttggcaaccttttgggcatcagtcgcaccctgatgtaccaaactttaggtgtttcagcaatcatctttttgatactcattttaaaaagacgcgaccttttgttgtattgttttgacagccatcatgcccaagttgcaggtttatcgatacaaaaactacactatggcttattgattatattgtcagcaaccattgtggttgctatgcaagcggttggggtgattttggtgattgctatgctcatttcacctggcatgactgcttttattttatgcaaacgctttgatacaatgttgctgactgccatcattagctcatgttttacaagtgtattcggggtaattatcagttatcatctggattctgcgacaggtgcgacgattgtactgatgcaagctttggtatttttgggtgcaatgatttatgacaaaatttgcttatggcttttaaacttttattaa

SEQ ID NO: 1368 - DNA, 183 bp, M.catarrhalis
attggggtattccgaggtcatttctggtgggatatagaggtgattgggagattatttgtgcggggaactgagggacttaattatgtttgggggggagaacgaataggaaaacttttgagcctacttactaagtggggggggggggtccttcctattttcccgcgtattgagtccacatggtga

SEQ ID NO: 1369 - DNA, 387 bp, M.catarrhalis
gcaaaatcattcattgtcgccagcaaaggcgtttttatgcaaatccccatccatgccatttatatacagttggctgacgccagtcgtatgcctgagatggcatttgtaaggtgcgaatttggcaataaacattgcaaaaccatcatcgcccatgtgcttatcacagatgggcaagtacaagaaacgggggattttgagcgtgatggcgtaacttttccaacgacggaagtttggattgattttatcaaccctgtgaacagtgatggcgatatgttcccaacaggcaagttgatagacatattgacagtgccaaatgtggatgaatttgaagtgaccttgattaacgcaggcatgcccaccatctttatttgtgccagtgatctttaa

SEQ ID NO: 1370 - DNA, 1128 bp, M.catarrhalis
atgctgctgttgtgcttgatgaagtgtacaagaaatatctacaaggaaaagacaatgaagcatagggatttttatgtttatcaagttgcagaaacagtactgaatacaagtattagaaccgttggttttttgtttgcttggttaatgcttaccgtatttaaaaacccccagcatttgggggtttttattggaacttcttgggcgtgtcaggtgttggcattgttgttgttttcttgggtgtgcagtcaaccaaaatttaccattcatagtaaaaagatattactgtgtttttgtgttatttgcttattatcttttttgccattattatttattcataactattttatttttggtataatttttgttattagttctatttttaccattcttttaaatccgttagggacaagccttaccaatgacttgtatggtggtaacaataaatcaaatggttttaaggtgcgtggatttgtcaattccatcaataccatcttgtctcccgctatttctgggtttattattcattattttggtgcacatcaaattatatgtgcttgtattattttatcttttataagtggcattttgttttatggtataaaaaatataaaattgcaggaaaacttagaaaaacaatcaaaaaatacctttaaaatattacttaaaaatcccattgaaagattgatggttttggtatcattgctggctaattttatcatcaccccaatgattgcttatatcattccctataatatagcaaataaatttaaattacctgcattttatatcggtattagtgagggttgttttggtattggaatgatattgggtagtgtttactttctaaaattattcaataaaaaaattggcagtcataaaagtgtggtgtgtagcattgtattggttgcgattgggattttattgtctttgttggacggattttatctgttttgcatggcattaataatgatgggtgttggggtggtaatgtttaatattaacagtacccatattcgctgtacagcaaccccaaaggatattcgtgccagttttgaatttatctttttggcgtgttgtattgtgtttattcccattggtgttttttttgacgacttgggtgttaaataa

SEQ ID NO: 1371 - DNA, 816 bp, M.catarrhalis
gctgttaaaaccatgcgtcaaatttttatgcaccgattattaccgccaacactgatggcaagctttttattattaagcgcctgcagctctggcaattctcatgccaaagatacctctaatgccagccagccaacaacccaaacttcttctcaaagcgataccacgcttgtcaagacgctccaagataatttgacccaagcaggggttgatatcactgtgacaaatgccctgccaacaaccatgcctgatatctattgggtcagctttgaaaatgcccctgcaatgttcacagataaatcgggtgaatatttaattcaagggcaaattgtcaaattaagtggtgattatccgacagatattaccgctgacattcagtcatctttggccaaagaaaccttagccaaagccaatactgatgatatgattatttaccctgcaaccagtcagcataaagcatctatttatgtttttagcgacccaacttgccactactgccgaatgctacacaaggatatcaagcagctcaatgctggcggtattgaggtgcgttatttggcgtggccacgctcagaacaagacataccgctcaccgaagcaatttggtgcagccaagaccgaaaagcagccttaacagcagctaagcttggtcaaactgtccatgccaagcattgtaaaaaccctgttcaagaacatttggcattagggcgtagtttgggcgtatcaggcacgcctgctgtttttgccgaatctggcaggcagattggtggctatatgcctgccaaagatctcatccatactgccattgaacaacgataa

SEQ ID NO: 1372 - DNA, 615 bp, M.catarrhalis
ctttgggagactttacaaagctttcacacaccaaaggacatcgccatgaaactgcttaaaatcaccttatttgccagcatattgggcagtgccactttcagtcattctctatccgccattgctaacactcgctttgaaacaatcgatatcacaaccttgaccaatcaagccgctcgtggtgattatcatgcccagttttttcttgccaaacgcttgcaaaaaggagaaggtgttaccaaagacgcctcaaaagctgtttattggtatacccgtgccgccgaaaaaaatattgctccagctcagctcaatcttggcatcatgtatttgcgtggagaaggtgttagagccgatatagccacaggccgagcttggcttgagaaagcagccaatttgggggataatcgtgccagctatgctttggcaatgattgatgagcagcaacaacgcttggttgatgcttataaatggtatgatttatccgctcgtgagggtatgcttgatgataatgtacgcaatcgtgctaaggttaaagtcagccagcttgctctgaatttatcctccagtgaaatcgaatctgccaaacgcagtgccaatgcgtggtttttaaatcagtaa

SEQ ID NO: 1373 - DNA, 270 bp, M.catarrhalis
  unsure (4): Identity of nucleotide sequences at the above locations are unknown.
gatngttattttcaagatgccaaagatggtgttgaaaaactggttccggagggtatcgaaggccgtgttccttataaaggccctgtggcaggcatcatcggtcaattggcaggtggtctaagatcatccatgggttatacaggttgccagaccatcgaacagatgcgtaagaataccagctttgtcaaagtgacttccgcaggcatgaaggaatcgcatgtacacgatgtacagattaccaaagaagcacccaattatcgccaaaattaa

SEQ ID NO: 1374 - DNA, 186 bp, M.catarrhalis
ttcagaaaggcaattgtcatttcaggggggctagctgcttataagcttggtattacaaaagaagaaattcaagaaatattgatacaaaacgcaatattcagtgggtttacaagagcaatgaatgctgctgttgtgcttgatgaagtgtacaagaaatatctacaaggaaaagacaatgaagcatag

SEQ ID NO: 1375 - DNA, 504 bp, M.catarrhalis
tggatgatatatgtatttggtgtagactttaaagatagtcaagaaatggtttattctggaagtgactttgataaactaggctgtatttttttcaatgaagagatttttgttgataaagatgatttgtttatcttagataagattatacacgaatctgctcatcaaatattgttatctgtaatgatacatgatgaagttgtgcttaactcagatgatgagcgttatccatcaccccttagaactggcttaagaacaatgaatggtatatatcacgcagcttttgttttgtatagaatagcacgattttttaatcaaattatcaaaaaacaaaatactcaatattcttacgatgatctgatttctcatatcaataaaaataaggaacaatttttagcttgctatgatgttatttccaaaaatggaaaattaacgaatttgggaagtgccataattgagaactgttacaaagaattaaaggatatgcctaatgaaattaacagataa

SEQ ID NO: 1376 - DNA, 894 bp, M.catarrhalis
aaaattatgtacgataatccgatatcttgtttggctaagtctggatttgttgatgggctgcattgtgtcgtaacgactgtgagtacgccgctttgggatatactgatttggatgctgattggtattgggctattttttacgctattttcaggtgtggcacaatttcgtttatttggccgtagtatcaaatccatgcttggtagtcgcaatcagcatgatgatgcaggtatttcaggctttcaggcatttgtgacagggttggcaagccgtgtgggcgtgggcaatgttgcaggtgtcgcaattgcaattggtattggcggtgctggtgcggtattttggatgtggctgattgccttgattggtatgtgttcagcattagcagagtcaagcttggcacagttatttaaggtgcgtgatgccacaacaggtcagttcagaggtggacctgcgtattatattgaacaaggtcttggtcaaaaatggcttgggtgtttgtttgccttggcattgattgtgtgttttggtttagtttatcaatccattcaatctaataccatcacacttgccatacaatcagcattaggctgtgtggtagaagatgccatttgccaaaatcaatggcaaagttataagcacatgattggggcgttgttggtgattttgaccgcaccgattatttttggtggcattcgccgtgtggcaaagattgccgaaatggttgtaccgatcatggcattgatttatattttgggggctctggctattatcttgatgaacataaccgccataccatcaatcattgcactgatttttgaaaaagcatttgtttttgaaacaacaagtggcggactctttggctctatggtatttgttgcgatgatgcagggcaattaa

SEQ ID NO: 1377 - DNA, 186 bp, M.catarrhalis
catcttaatcatcctatcccaaaagtcatcgacttaactaaaatagataatctcaaaaaattataccaaaaaatggccattgctaccaagatatttcaggatatttgtttaaatgacagcgttaatttttactgtggtttgttttggttttatcgcattggattattattcatattacatttataa

SEQ ID NO: 1378 - DNA, 534 bp, M.catarrhalis
atgaattttaatgatatttataatccaaaccaatctttggcaattgtattgcgtggtgcaaataatgaaaagattgtagattctttttattatttgttggatgtttgcgatgaaatcttagataaagatttcaagaaaaatatagccaaaaatatagagtttgcagaatctcactccatattgggagatatcttattccactttattaatcaccttgttaaatcaattacaaaaaataatatttatgaaataaatgatgtgtttatttcttttaataaatttatctcgttttatgatagagaaaaaataattttctctggtgtgggagatgtgggcaacctgtacttaaatcagtttaataaaattaatgatgatgcttatgaattttcctgcaaaccaattaatgttaatttaattgatgagtataagttaaaaattaataatcttatgaattttattaaggatattgattttgaaacttatatggaaattgacaatatagtggatgatatatgtatttggtgtagactttaa

SEQ ID NO: 1379 - DNA, 3318 bp, M.catarrhalis
cccatcttcctttatttttacgagccagttatgaccgaccaaatcaccgactacaagaacaccctaaatcttgccgataccacttttgccatgcgaggagaccttgctaagcgtgagccactttggttggaacaatgggaaaaagacgatgtttatgggcaaattcgtcaggctcgccaaggccgcaaaacctatattctacatgacggccccccttatgctaatgggcaaattcacttaggccatgtggttaataaagtcctaaaagatattatcatcaagtataaaaccttggatggttatgacgccccttatgtccctggttgggactgccatggtctgcccattgagcaaaaagtagagcaaaaaattggtaaagtcggacaaaaggtcaatgcaacaaagtttcgtgaagcgtgccgagagtatgccaaaagtcaggtgcaactacaaatggcagattttaaacgcttgggtgtgcttggcgattgggacaatccttatttgaccatgaattaccaacaagaagccaatatcgtgcgagcattgggaaagatttatgacaacggtcatatcgtgcgtggcatgaaacctgtcaactggtgcttagattgtggttctgccttagctgaggcggaggttgaataccaagacaaaacctcagatgccatctatgttggctttgatattgtcaatcgtgaaaacctacccatcatcgccaatatcagtggcacgcttcaagccgtcatttggacaacaaccccatggacactgcctgccaaccaagcaatctcggtacatggcgattttgattatgtcgtcattaagggcaaaaaaacccccatctttgcactgccaagccaaattgacagtaaaaattttaccctaagaaccctaaccaaagccgataagcaggcactacaagcgtgtgcatccgaccctgccatttggcaatttatgccaaccaaacgacacctgccagaggtgtttgaaccattttttgaacaagcagtgaaagataaagcctatgccattattgataagcgaactggcaatatcatcggcacaacccgcttttgtcatgacaatgccaaagatgataccatcggtattggttttaccttcatcacacccgaattttggggcaaaggggtaaatgatgagattaaacacaccttattaaaccacgcctttaaatacagaaatgccgtctgttttcagatacatgaaggcaatgaccgctccaaaaaagcggtagaaaaattgggggcagtttatcaaaaagatgtaaaaaatgactttggtaaaatgtgggtctataccatcacaaacccaagcaccatcaatcacaccacccattttatcgtagcaaatgatttggtggcggattttagcaaaaatgtggcacttgatgatgttgagacaatcacaaccatcaaaggggcggatttgaccgtcttaaacgcccaacacccccttatcagcgaacgccaagtacccatcatcacaggcgagcatgttaccgctgacagtggtacagggttggtgcataccgctcctgctcatggtgtggacgactatattgtgggcaacaaatacaatttacctgttgaaaaccccgtcagtgatgcaggcgtgtatttggacaatgccaaggtttttgtgggtgaacacatctacaaagcgcagcctaagattatcgagactttggggtcaagcggacacttgcttgaccacaaaaaaatccgccacagttatccacactgctggcgacacaaaacccccattatttttcgtgccacgccccagtggttcatcagcatggaacaaaacggacttcgccaaaaagccctaaacgatattaaaaatatcacatggacaccagcatggggtcaaaaccgcattgaagccatgattgatggtcgccctgactggtgtatctcacgccaacgcacatggggtgtgccgattaccttttttatccacaaagaaacagaccaattgcacccacgcacctccgagcttattgaaaaagccgcccaaatcattgaaaaaggcggtattgaagcatggtttgatgctgacattagcgactttttgggtgatgagagcggtgagtattacaaagtaaccgacacactggatgtgtggtttgattcaggtgcaaccaattttgctgtcctaaatcaccgcaaagagctatccaaccctgctgatttatatttagaaggctcagatcagcatcgtggctggtttcagtcatcgttactggtcagtgaatctatttatggtcgcccaccttataaacaagttttaacgcatggctttactgttgatgccaaaggccataaattatccaaatccaaaggcaataccaaaggttttgaaccatcagatattgccaataaaatgggtgtggatattttgcgtctgtgggtaggttcgtcagattatcgctacgagatggctgtatctaaagaaggctttgaccgtacaaccgatatgtatcgccgcattcgtaataccattcgctttttacttgccaatacagacgactttgaccccaaaactgatatgatatcaacagataaactcatcagtttggataaatatatcttatatcgcaccaaacatatccaacaagagattatccaagcttatcatagcatggactttcatcaagtttgccaaacggttatgggattttgttcccaagatttgggcgggttttatcttgatattatcaaagaccgcacttataccactaaggcagatggtctgccacggcgttcagctcaaacgactttatatcacattgcccatgctttattgcgttggattgcccctgttttatcatttactgcccaagaagcttggcaggttttaaaagatacacaaggctatatttttaccgctgaatggtaccagttaccagactttcagatgaatgatatcagtcacgaagattgggataaagttgccttaatcaaagatacggtgaataagtccatcgagcaagcacgcagtgataaaattgtcagcagtaatctgaccgccaaagttaccattaccgctccacaagatatcactgatatattaaataagtttggtgatgaactacgctttgtattcatcacctctgatgcaaccgtgaaatctggtgatacgctgtctacaaccatcacgcctgctgatggcacaaaatgcgtccgctgctggcatgttcgtactgatgttggtacacacgccgagcatcctgagatttgtggtcgttgtgtgcagaatttagatgatggggagatgcgtttgtatgcctaa

SEQ ID NO: 1380 - DNA, 2334 bp, M.catarrhalis
gcaagggataatttgacaaaaacaaatttgatttcaagcctcataatcggagttattatgaataagtttcaattattaccgctgacattggcggtgagtgccgcttttacaaccactgcttttgcagctgttagccagcctaaggttgtcttggcaggcgatacagtggtcagtgatcgccaaggtgcaaaaattaaaaccaatgttgttaccttacgagaaaaagacgaaagcacggctacagatttgcgtggtttgttacaagatgaacctgccatcggttttggcggtggtaatggtacttctcaatttatcagcattcgtggcatgggtcataatgccattgacctaaaaattgacaacgcttatcaagatggtcaattacactaccaccaaggtcgctttatgctagacccccagatggtcaaagtcgtttcggtacaaaaaggggcgggctttgccagtgcaggcattggggcaaccaatggtgcgattgttaccaaaaccttagatgctgatgagcttttaagaaacagcgacaaagattatggctttaaagttggtgcaggcttatcaaccaacaaaggtcattcttatcatggcagtgcctttggtaaagcacagacaggatttggtcaggtagatgcccttgtctcttataatcaagtaaatgacagcgactataaaggcggtaaagggtacaccaatctgttgggcaatgatgtggttacaagaagtgccttggataaatccagttaccttgtcaaggcagggctaactgctggcgatcatcgatttgtggtcagccatctaaatgaagttcataaaggcattcgtggtgtgcgtgaagagtttgacttcgccaatcgtgccttgacgctagatataaaaaaagatgataaaacccttaccgaaactgagcttcaggcagagttagataacaaatatgcaggcaagggttacaaacttggcagtaaaacaccagatggtaaaaagtataatgtggttgatgccaatggtaaattggtggctgatttagataggaacaacccaactcagcgtgaaacctaccagaagttaactaaccttgaatggacaggtaaaaaccttggttttgcaaatgaagttactgccaatgtctataagttagaacatggacgcaactcttctagcgatcaaggtaacacctatatcaccaaagatgtgcccaaagagataatagataatgttgatacaccatcaaacatgcatgtggtagccacaggggctaatattaattttgataaagaatttaatcacagtccattaaaaggctttggtgttgacaatactttattaaaatatggcatcaactatcgccatcaaaaagctgtaccgcccagaagtctaaaacctggtgtggtgcatcaagaaaaaaccgatgctggcatttatctagaagcggttaaccaaattaatgactttaccatcaatacaggcgtgcgtgttgaccgttttgactttaaagccatggacggtaaaaaggttggaaaaaccgacatcaacccaagctttggggtgatttatgatgtcaatcctaatcttagcgtcagcggtaacctaatctatgccactcgtagcccacgctttgctgatgctatcctaagccgtggttatcgtggtggtgtgattagtattgatgacaatgcaaaagcagaaaaagcacgcaataccgagattggttttaactataataatggaccatataccgcctttggcagttatttttggcagcgtgtggataatgccagagcgaccgctgatataactcgtcatggtacaacagatgctaatggtaagtctattaaagtaccaacgcttggcaaccaaggtcatcagaccaaccaaggctatgagctgggtgtaggttataccgaaggtgcgtggcgtgcgcgtgctggcgttgctcacagcaaaccaaccatgcacaatgtcaaatttagtggcaatcctgaatatgccgtgcgtacaggtcgtacatggacagcagatgtcgcctatcgcctgccaaaccccagtgtagagcttggtgtgagacacacattggttgaaggggtagatgccaaagacacatccatcataagtggtgaagttagcaaacttaaccgtgaaggctataatgtcagtgacatctatgccaactggaagccttatggcaatgataaggtgaatgtaaactttgcggtgaataatgtctttaataaaaactatcgcccacacactcagcgtgcttccatagataccttacctggggcaggtcgtgatttccgtgttggcgtgaacttcacttactaa

SEQ ID NO: 1381 - DNA, 264 bp, M.catarrhalis
tacttaatcaataaaacaaaaagacaccagattttaacccagtgtctttttgattggcattacttcttatctttaacaccaattgtcataattgttttgcagtttgattggtttttaagcccaacagctttgcttaggtctaattgctttaacataattccttatataaatgaaaaagataaacaccataacctaaaatacctcatcagcctatggttctttgattctaagttaaaaaaacaagatgttaagaattttttataa

SEQ ID NO: 1382 - DNA, 687 bp, M.catarrhalis
cgattaactgatatgaacagccaagagatattaaaacaaattcaccaaactaagtttttattgtccgctcccacctttaaactatgccctgaagatacaggctttgaggtggcatttgctggccgctccaatgctggtaaatcctctgccatcaataccatcacacaccaaaaacaacttgctcgttcgtcaaaaacaccaggacgaacccaaatgattaacttttttatggtgggtgatgaacaagcacgcatcgtggatttgcctggttatggttatgccgctgtacctgaaagcatgaaaatcaaatggcaaaaagaacttgaaaactatctggtatctcgccaatccttggcaggtctggttttgatgactgatatccgccatccacttaaatattttgatgaacaaatgttacactgggcaaaagatggcaaattacctgttcatgttttactcacaaaatctgataagcttaagcgaggcgcacaaaaatccgccttgttagcaacaaaaaaacagctagaagtattggacttaccttttagtattcagttgttttctgcacttaaaaaaaagggtatggatgagcttgctttggtgcttggtgattggctacacctaacaccttctgacaagcatcatctatcacccagcaatacagatatttttggtgagaatgaataa

SEQ ID NO: 1383 - DNA, 264 bp, M.catarrhalis
aggatatgcctaatgaaattaacagataagttatccaaagaaaccatcgaattgatgcaaagatttaatgacgatgcagtaagaaggctaaacgatgatttatacccaatagcaccagatttagttgaaatgcttattgattcaatttatggaaatatttatcaaagaggtgttttgagcattaaagaacggcatatagcaacattatcagcacttattgctatgggtagttcagaaaggcaattgtcatttcaggggggctag

SEQ ID NO: 1384 - DNA, 558 bp, M.catarrhalis
aataactacgaaaaactgccatccatcccaaaatccaattcaccaattgaataccatctcatgaatacacccattttacccagtgaagaagttcgcatcacccataaaagcaccgtcagtttacattttgaggtcagtttgatgaacggtgaggtgattgattcaacttttcatcgccaagaacctgtcacactcaccatcggcgatgaaagtttattggcaggatttgaaaaagtcttaatcaacctcaaagctggtgatacacgcaccgccaccttgtcagccgatgatgcctttggacaatggaatcctgaaaatgtccaaacttttactcggacacaatttgccctatctgagcccaatcctgtggttggtatgatgatggaatttgccgataaaggtcaaaattcactggttggtgtcataagcttggtaaccgatgatgaggttttggttgattttaatcaccctttagcaggtcaagatgtgttatttaaagtgcaaatctttaaggttaccccgcccaatcaggttggttttcaattaaggtctagttag

SEQ ID NO: 1385 - DNA, 354 bp, M.catarrhalis
ccatgcaaagaaaaggtggggataatggacgaccaactgccaatatgcttcagtttaagattgacccagcagaattatttgagctttaaagttatggcactaaaaatcaccaccgactgtatcaactgcgacatctgtgaaccagagtgtcccaatgatgccatcagttatgaccaaaaagggcaaaagacttatgtcatcaaccctgatttatgcaccgaatgcctaggcttttatgatgaaccgacctgtgataaggtctgccccattgactgtatcatcaaagatgatagccgacctgaaacccctgatgagttaatggcaaaatataagcagatttggggaaaatcataa

SEQ ID NO: 1386 - DNA, 1206 bp, M.catarrhalis
  unsure (1205): Identity of nucleotide sequences at the above locations are unknown.
cctatgctacgcattgcctatgatgctttgacatttgatgatgtcttgcttttgcccgcctattctgaagttctcccaaaacaaacttccctaaccactcgcttaaccaaagatattaccatcaatttgcccatcatttctgctgccatggataccgtcaccgaatcaaaaatggcaattgcgatggctcagttgggcggcatgggtatcattcataaaaatatggatatcgctcaccaagcgcgccgtgtccgccatgtgaaaaagtttgaagcaggtacggtggcagatccgattactgttaccgccgatgcaacggttggcgatttgcttgccttgacgcgtgagcataaaatcagtggcgtaccagtggtgaaagcaggcactaataaggttgtgggtatggtcactcatcgtgatttgcgttttgagaccaatttatctcagccagtcgccaatgtgatgaccccaaaagataagcttgtgactgttaaagaaggtgaaacccaagagcgtatcaaagagctgttacatcgccaccgtattgaaaaagttgtggtgattgatgatgattatcagcttaaggggttgattaccgttaatgatttttctaaagcagaaaataacccgaatgccgccaaagacagtaaaggtcacctgctggttggtgcggcagttggtactggtgccgatacccaagcgcgtgttgaagcattgatcgatgcacaagccgatgtgattatcgtagataccgcacatggtcattccaagggtgtgatcgatcgtgtggcatggattaagaaaaactaccctaatatccaagtcattgggggtaatatcgcaacaggtgatgctgctttggcactgttagatgtaggggcagatgctgttaaagtgggtattggtcctggttctatttgtacaacccgtattgttgcaggcattggcgtcccgcagataagtgccattgatagtgtggcaagtgcgttaaaagatcgcattcctttgattgccgatggcggtattcgtttttcgggtgatatcgccaaagccatcgcagcaggtgcttcatgtattatggtgggtagcttgttggcaggtaccgaagaagcacctggtgaggtggaattattccaaggtcgttattataaggcttatcgtggtatgggtagtttgggggcaacgtctcgcgaaacggccgcatng

SEQ ID NO: 1387 - DNA, 1332 bp, M.catarrhalis
tttggagtgcgtatgagctggtttccaaaatggcaaccttatacaggtgatattaacacacagcctgtggcaacgaatgaatatctgccagttgggcagagtattatgttgggattgcagcatgtcttggcgatgtttggggcaacggtgcttgcacctttactgatgggatttgatgccaatcttgcgattatgatgagcgggatttgtaccattttattttttgtgatgacaggcgggcgtgttccgagttatttgggttcaagttttgcttttattggtgtggtggcagcagcaacagcacatgccacaggcagcggcgctaattcaaatctatcagtggcgttaggtggtatcatcgcttgtggttttttgtatgctgtcattggttttattgtgatggcaacaggcacacaatggattgaaaaactcatgccacccgttgtgacaggtacggtggtgatgattatcggcttaaacttagccccaattaccgtcagcggtgtgcaaggcaagccgtttgatttatggatggcattgatgactgtgttatgtatgggtatgattgcggtttttgcacatggatttttacagcgtttgttactactgataggtttggtgatggcatatgcaatttatgcgatagcgaccaatattttgggtttaggtgagccgattaattttgctttaattactgatgccgattggtttggattgccaaattttagcagcccaacttttgataccaatgccttgccaatcattgcaccagttgcatttattttggtagctgaaaatcttggtcatatcaaagcggtgggtgcgatgacgggagaaaatttaacaccgtatcttggcagagcatttgtggccgatggcgtagcaacagcattatcagcaagtgtgggcggcacaggtatgaccacttatggcgaaaatattggtgtgatggcggtaactcgtgtctattcaacactcatttttgtactggcaggcatatttgccatgattttgggattttctcccaaatttggtgcaatgattcagaccattcctagccctattttgacaggggcgtccattgtggtatttggtttgattgccattgctggtgctaagatttggattgataataaagttaattttgccaataataaaaatcttatggttgctgccattaccatcattttgggtacgggtgattttggtttgatggttggaaattttaatcttggcggtattggtacagcgacttttgcggcaatcattctacattggtttttaagtcttcgagagttcaattcttcgagagttcaattcttcgagagttaa

SEQ ID NO: 1388 - DNA, 534 bp, M.catarrhalis
atgatggggagatgcgtttgtatgcctaatcatttgcttttaaataccaagcaggtcatgggctattatctcattgctattgtggtcttagtcagtgaccagatgaccaaattttattttaaaaacacctttcagcttggtgagagtgttgaggtcatttcacccatcctaaactggactttggcgcataattatggtgcagcgtttagttttttggcagatcaaaatggctggcaaaaatggttttttgctattttaggtttgatcgtctcaggctttatcatcatttatctaaaaaaagcaccaaaaaccgccaacatcctaaacttaggcttatccttggtattaggtggtgctattggtaatgtcattgaccgtattttacataatcatgtggtggatttcatccatgtgcattatgctgatgtgtggcattatccgattttcaatattgcagatattggtatttgtgttgggatggcaatgattatttatgacatgctatttttagaaaaaaaacggcgatctgtttaa

SEQ ID NO: 1389 - DNA, 759 bp, M.catarrhalis
aatccgtcaatcttcatcgcttgtgaggatactcgtctttcatccaaattgttaaagcattttaatatccccacgccaacgattgcttatcatgaacataatgccgataagcaaaccgtacacctaattgaaaaattaaactctggtcagtctgttgcactcattagcgacgcagggacacccttggtctctgaccctggatatcgattggtcaaggcatctcacgaacacggtatcaatacagtgcctattgtgggtgcatgtgcagcgatagccgccctttcggtggcaggactgccctcagaccgatttacttttgctggatttttgcccgccaagtcgcatggacgacttaaagccttgcaacactggcaagcctgcacacaaactttaatattttatgaagcaccacaccgcatcgttgactccttaactgacatgatgactgtttttggggcaactcgtgaagcaactttatgtcgtgagctgaccaaaacctttgaaaccatcaaaaagctgcccttaggtgagcttgtccaatttgtccaaaatgacagcaatcaacaaaaaggtgaaattgtcgtggtggttgcaggatgtgatgacacagtacaccaaagcacggattatgatgcgtggcttcttgctatcaccaaagaactcccacccaaaaaagctgccagcattgttgcagatgtacttggattaaaaaaaacgaccgtatatgatcggctgctagccctacaaaaccatatttaa

SEQ ID NO: 1390 - DNA, 1179 bp, M.catarrhalis
gaaaccgttgtgtctgattatgaacaaacagcaccgtatcttgatccaagttccgttggcattgtccagccacagacacttatttttgatgagcctttaacattagaatgccagcagattttgcctgcttttgagcttgtcattgaaacttatggtacgctcaatacagataaatctaatgccatcttaatttgccatgccttatcaggcagccatcatgctgcaggttatcattctgctgatgataccaaggctggctggtgggataatcttattggtaatggtaaagcgattgataccagcaaattttttgtagtttgtttaaataatattggctcttgccacggttcaacaggccctaccaccatcaatcccaaaacaggtaaaatctatggtgcagattttcccttgattactatcaaagactgggttaaaacccaagtcatgctctctgatcgcctagaaatcaaaaaatggcatgcaattgtgggtggctcaatgggcggcatgcaggcactgcaatggtcggttgattatcctgatagattatctcgctgtgtgattatcgccagtacgcccaaattatccgcccaaaatattgcctttaatgaagttgctcgccagtcaatcttatcagatcctgagtttcatgatggctggtatttagagcatggcacttatccacggcgtggtttaatattagctcgtatggttgggcatatcacttatattaccgaagatgccatgaaagccaaatttggacgagatttaaaatctggtcggtttatgtatggctatgatgttgagtttcaggtagaaagctatttacgctatcaaggtgaacgcttcagccaaaactttgatgccaatacttatcttttaatgaccaaagcattagattattttgatccgactcgtgactatgcacctgatggtctgtctgatgaagatgccctaaagctgactttgtctcgcacacgctgccaatttttggtaatatcttttaccacagactggcgatttagccccgaacgctcagttgagttggtcgatgctttaatggctaataccaagccagttagctttgtaaatgtcgatgccccgcatggtcatgattcttttttatttgatattcctcgttatcgtgatgctctcaaaggttttttacaggccaaataa

SEQ ID NO: 1391 - DNA, 459 bp, M.catarrhalis
aggaaaactgtcatgactttaaaagactcattaacccaaaccatcaaatcttctatgaaagctcgagagatggaagtggtaaaaatcctgcgtaatgtacaagccgccatcaaaaaagtagagattgatactcagacaactttagatgataatgctgtgcttgagctgttacaaaagcaaatcaaacagcgtcaagaatcattggatatttatgaagcgaatggtcgagatgatttggcagccaaagaaaaatttgaaattgaggtcattgggcagtttctacctgctcaacttaatgaagcggcgctgaatgatatcatcgctgcgactattactgagcttgaagccaatagcatgaaagatatgggacgcgtaatgaatgctgttaaagaaaagaccgtcggtcaagctgatcctgccatcatttcaggattggtcaaaaaagcactgacggcatag

SEQ ID NO: 1392 - DNA, 297 bp, M.catarrhalis
tgtttaatattaacagtacccatattcgctgtacagcaaccccaaaggatattcgtgccagttttgaatttatctttttggcgtgttgtattgtgtttattcccattggtgttttttttgacgacttgggtgttaaataatggatttttgatttatttttatggtgtgattatttgttttttattaatgttgtctgttatgattgataaaaatttagatgttgttcatatctataaggtagataatgataaactggagggttattacaaaacttactaccctaaaatttatcaataa

SEQ ID NO: 1393 - DNA, 1377 bp, M.catarrhalis
acgcttttttcagagtttggtggtctttttatcgccaaatgtatcaaaattaacattccgatagcggagtattttgtgaataataccatcaatcttgccgtactgggtttgggtactgtcggtactggcgtattaaaccttattaaagataatgtcaatgagcttgctcgccgtagcggtcatcagcttgtgataacacacgcagggactcgccgtcatcgccatgatatcgacccaagtatcaatcaaactgctgatttaatgtccattgcagaggcgaaggatgtggatatcgtgattgaggtgattggcggtacagatattgcctatgaagtcatcacgcatgccattcgccacaaaaaacatgttgtaaccgccaacaaggctttacttgccaaacatggtaatgagatttttagattggctgaagagcatggcgtccaagtacgctatgaagcggctgttgcaggtggtatcccaatcatcaaaattgtccgagaagcgttggcggcaaataaaattgactggctcactggtatcatcaatggtactggcaactttatcatgacagagatgcaacaaaaaaatcgtaaatttgacgaagtacttgttgaagctcaagcgcttggttatgcagaagctgacccaacttttgatgttgaagggattgatgcggcacataaattatccctattggcatctatcgcctttggcattcctgtacagtttgataaagtttattgcgaaggcattaccaagatcggcttacaagatgtcatctatgccaaagagcttggctatacgatcaagcatttaggctttgctatccgccgggatcatggcattgaacttcgcgttcatcctacacttattccttcgcaagcactgcttgccaatgttaatggcgtcaaaaatgccgttatgattgatgctcaccccttaggtcaatcactggattatggagatggtgcaggtgcaggtgcaaccgcatcagcagttatggctgatgtgatggatctgatttatgtcatcaatgccgacacaccaagcgatgtaccacattcgggatttattcccgaagagctgtctgatattggtattttacctgccgatgagatgacatcgggttattacttgcgtttaacggtcaaagatgaaggtggtgttttggcagacacaactcgcattttaagtgataatggtattaatatcgatgccattttacagcgtgatgcccataaatcaggcttagtaccagtgattattttaacactacctgtcttagaaaaacaaatgaatgccgctatccgccaaattgaagcactcggggcggtggttgaacctgtcgtgcgtattcgcctagaaagcttagaataa

SEQ ID NO: 1394 - DNA, 648 bp, M.catarrhalis
caaaaattttcatcaaatccatataggtattttatgcgtattgaccaccaacttgttgagcaatggatagaacctaatagtcgtgtactggatttaggatgcggtgatggaacgctgcttgaacatcttcaaaagcatttaggcgtcacaggttatgggcttgaaattgatgaatataaaatcaatcaagccattgccaaaggtttaaatatcattgaacaaaatctcaatgatggcttagcacgctttgctgataatagctttgatacggtcgtcatggctcgtgcgttacaagcagtcaaggccccagaccagctattgattgatatgctcagagtcgccaaagaaggcattgtcacttttccaaattttgcctattggcaaaaccgtatgtatttgggcatcaaaggtatgatgccgatatcagacactctaccccatgaatggtataatacccccaatattcatctatgtacttttaaggattttgaacaattgtgcgataaaaataacattcgcattctagacacagttgccattagcgataagccaaatccaaaattacctccagtgctattaaatcatatggtcaagcgtattccaaatctgctggcagatgttgccgtttatcatattgccaagtactaa

SEQ ID NO: 1395 - DNA, 375 bp, M.catarrhalis
ttttatagctctatcagacgcaaaaagttattccaaaacaagaaattgttgtttttgggggattgggctaatggtgaaagattttttgatcaagataaagatttaaataaagagcttaaatctcagtccgagcaagcaatatctgataaagttgcattatcagaatgccgagaaatggtagggcgagatgctaaatatccagatagcgttgattttaaactattaaacacaagtgttcaaaaatcaaaaacccatggtaatgtcattgttacgactaaatttaccgctaagaatgattttggggctgagctaccttataccgctaagtgcttatttacgcctgatggtaaagtagagtttgaatatatcaagtaa

SEQ ID NO: 1396 - DNA, 198 bp, M.catarrhalis
atggtaggattaatattaaagtgttctaatcagatgctcaagtatcttttcttattaaatcattgttattttttaaatatgctatataataatgtgctttatttaattatgttatatcataaccgagggtatcatgataaaaaaaccacttgtttgtgcgatatcggccacctttgcgatgccagcggtagcagataa

SEQ ID NO: 1397 - DNA, 396 bp, M.catarrhalis
ataaggatgcccgctgtgaaaagcaaccgaccgattaacctaccattaagccaagtgattgcggtgaactcaaaatcaccgattgctatggcttctattttgcatcgtgtgtcaggcattgtgctgtttttgcttgtgcctgtcatgttgtgtattcttcaaacttcattatcatcagctgatagttttgctgctgtatttaacaatatcgccctgcgttttgtggcatggatttttgtggcggcaaccgcttaccattttgttatgggtatcaagcatttgcttgctgatgctggcatgaatgaagagcttaaatctgggcgtactgctgcggtgattagttttgtaatcgcggctgtactgattgtcgcatcgtttgtatgggtgatgttctaa

SEQ ID NO: 1398 - DNA, 690 bp, M.catarrhalis
cagggtctatatcccgaaagcccgaatgttaaaggtctttatgccattggtgagtgtgcgtgtgtatctgttcatggtgccaaccgcttaggtactaactcactgcttgatttggtggtgtttggtcgtgcagcaggtcagcacatcattgatgaatttaaccaaacggggcgtaattataagccgcttaatccacgggtgctagattttacccagtctcgtcttgataagctacaaaactctaccgaaggctacaatgcccaagaggttgctgatgagattcgtaataccatgcagtctcatgctggcgtgtttcgtactcaggcactgatggatgaaggtgtacaaaaaatcatggcacttgccccaaaagttgagcaaatccatttggcagataaatcagctgtctttaataccgcccgtattgaggcacttgaggtagcaaacttatatgaagttgcaaaagcaacgatgatttctgcgtctctgcgtcacgaatgtcgtggtgcacatatggtggttgattatgagcatccagcagattatgagccagcaccacttggccgtaatgatagcgaatggatgaagcacacactttggtattcagagggtaataaagttgtgtataagccagttcgtaagcagccattgacggttgattattgtgtgccgcgtgttcggactttctaa

SEQ ID NO: 1399 - DNA, 2292 bp, M.catarrhalis
gttgaggatttgactttggcatttcatgggttggcggagtcagatttggacaccacatttccaaccaatgatttggcgattgggaaatcagaagctaaattgcgtgaaattatcgaaatcttagagcgtgtgtattgccaaagcattggttatgaatatatgcatgtttttcaagcggctgaaaagcgttggatcgaaaattatatcgagtcaaatcacggccatatcaaatttgacaaagataaaaaattagaaattctagagcgtctaacagcggctgaaggtttggagaaatacttagctcgtaaatatacaggtgtcaagcgttttggcctagaaggtggcgaaagcttcattcctgcagtgcatgagatggtacaacgcgcaggtactcatggctcaaaagaggttgtcattggtatggcacaccgtggccgtttgaatcttttggtcaatattttgggcaaaaaaccaagcgatttgtttgatgaatttgatggtaaagtgcagcctgttaatggttcaggggatgtaaaatatcacaatggtttttcatctaatgtcatgacaccaggcggtgagatgcacttagcattggcatttaacccatcacaccttgagattgtctctcccgtgcttcaaggttcggtaagagcacgccaagcacgccgttctgaaaaatatggcttacaaattgataacagtacggttttgcctttggtggtgcatggagatgccgcactggcaggtcagggtgttaaccaagagactttccaaatgtctcaaacacgcgcctataagactggcggtacggttcatattgtcatcaataaccaagttggctttaccacttctcgtattgaagacgctcgctcgacagagtattgtactgatgttgccaaaatggttcatgcaccgattttgcatgtcaatggcgatgaccctgaagcggtcgtatttgcctctcaattggctgtggattaccgccgtgaatttggcaaagatgttatgctagatattttctgttatcgccgtaatggtcataacgaatctgacgagccatctgcgacacagcctttgatgtatgcagtcatcaaaaaactaccgaccacgcgcgcccaatatgttgagcaattggttcaagagggtatcattactcatgagcagggtgccaagcttgaagatgactatcgtgaactattggatcgtggtgagtttgttgcaggcggtttggtcagcgagccaaatactgaactgttcgttgattggaagccttatttaggtcacgatttgcaagacgactgggaaacgggcgtcgatatcgaaaagctcaaatcctatggtcgtgcgatggcaaaaatccctgaagggtttaccctgcagcgtcaagtggcgaaagtcgttgagcagcgtttggcgatgcaaactggtgaagaacctcttaactggggcgctgctgagactttggcatatgctagccttgctgctgaaggttcattggtgcgtattacaggcgaggatgtcggtcgtggcacattctcacatcgtcattcagaactgtataatatgaatgatggcagtatgtatattcctctgcaacatatcaccaaagaccaagcacgctttgccacttataattcactgctatcagaagaggcggtattggcttttgaatatggctatgccaccacagtgccgaatgcattgattatttgggaagcacagtttggcgactttgtgaacggtgcacaggtggtgatcgatcagtttatttcatctggcgaaaccaaatggcagcgtgtttgtggtttgacgatgcttttacctcatggttttgagggtcaaggtcctgagcattcatcagcgcgtctggagcgtttcttgcagctgtgtgctgaggataatatgcaggttattacgccaacaacgccagcacagattttccatgccttacgccgtcaggtagtacgcccaatccgcaaaccattgattgtgatgtcgcctaagagcttgctcagacatccacttgcaacctctaatttagaagaattggcatcgggcaaatttgaaactgtcttgcctgaaattgattcaatcaatcatgagcaggtgacacgcttggtactttgtggcggtaaagtgtattatgatttgcttgatcagcgtcgcaaactgggtcaagagcatatcgccattgttcgtattgagcagctgtatccgttgcctgaagaacgcatcttggctgaaattgacaagtatccaaacttagaagaaatcatgtgggcacaataa

SEQ ID NO: 1400 - DNA, 243 bp, M.catarrhalis
acaaatcttcattcaccaactaatttttgcttttgtgcctcagaatggtcggaatctgactttaagtttgacgggttaattttattggtacatcgaacattgtttcaaataccttttatttcaagggacaatttaaatgtttttgaccaaaaagggcgtttttttgataaaattgggcaaatgggaatggtcaataaaattggaaatgggaaaaggcgttattataaaaagcttgatttttag

SEQ ID NO: 1401 - DNA, 1146 bp, M.catarrhalis
ccaaagcttcaacatacgaataccaaatgcaatatgcaatcattaggaattaacatggcaacaaaccaagataacacaattaataatatcccaacgctaaactttgatgccgtcatcgttggcggtggtggttcaggcatgcgtgcgtcattgcaattagtcaatggtggtatgaaagtcgctgtcattaccaaagttttccccactcgctcacataccgttgcagcccaaggtggtatcggtgcatctttgggtaatatgagtcctgataactggcattttcatttttatgataccgtcaaaggctctgactggttaggtgaccaagatgccattgaatatatgtgccgtgaagcacctaaggtcgtttatgagctagaacacatgggcatgccctttgaccgtaacgcagatggtacgatttaccagcgcccatttggtggtcacagctcaaattatggcgaaaaacctgtgcctcgtgcgtgtgctgccgccgaccgtacaggtcatgcgcttttgcataccttataccaaaaaaatcttgaaaaaggcacacagttttttgtggagtggattgcgctcgacttgattaaagatgatgaaggtaatattaatggcgtgatcgccctagaccaagaaacaggtaatatttcggttttccaagccaataccacagtattagcaacaggtggtgcaggtcgtatctttaaagcatcaaccaatgcttatattaatacaggagatggcttgggcatggcggtgcgtgctggcattcctttgcaagacatggaattttggcaatttcacccaacaggtgtggcaggagctggcgtcctattgaccgaaggctgtcgtggtgagggtgcaattttacgcaataagcatggcgaagcattcatggagcgttatgccccaactctaaaagatttggcccctcgtgatttcgtctctcgctctatggaccaagagattaaagagggtcgtgggtgtggtcccaatggtgattacattgtcatggacatgacgcacttaggtgctgctacgctgatgaagcgcttgccgtcagtgtttgagattagcaaaaacttggtaatgtggatattaccaaagaacctgtgcctgttgtgccgactatccattatatga

SEQ ID NO: 1402 - DNA, 189 bp, M.catarrhalis
tatattattaaaaaaatttatagcttaacgctatttttacatacgtataaccaaatcttgtttttttattgcccaaaacttatttggtcaaatgtttgtgagtttgtgaacaatggtcaatgcttctcatctttatggcaaatagtcaataaaggtaaatatgatctcatttgcattggtagatggtag

SEQ ID NO: 1403 - DNA, 552 bp, M.catarrhalis
agatggctcaatcagtgcatccaaaaaagcatgtcagtaaggtgtgttatgaaaaagttcttaaaacgccttggtattatatttgctgtattttttggtattatggtggtacttgccaccatcattgaaacgcctgaacaagaaaccaagaaagaagttgagcaaacagacgagcagaaaaccgagcaaacccctcagcaagcaaccaatcaaaagactaagcaagagactgggccaaaagctgaagcaaaggctaacaacgggcctaaagcaaagccttgcgttagtaagcccatatctgaacacgcttttacagaatacgacaaagaaaactaccccaaaatataccaaaaatggggcaatgattggattgaaagactagaagccccccaaagggcagcggctgataaaattgccaattctgataatgcgtgtgatagcattagttttatagctctatcagacgcaaaaagttattccaaaacaagaaattgttgtttttgggggattgggctaatggtgaaagattttttgatcaagataaagatttaa

SEQ ID NO: 1404 - DNA, 207 bp, M.catarrhalis
gagccactaaatcaaggtgcttggtattacttagcacctgagctattcgcatgggtagtacctgcaccgacgaaggcaaaaatcattacaccttccgcgcgtcctgccgccgctgcacctgcgacaggctcaccaaaactgcacaccgaacaacaaaaagctttgattgctgaagccttgggtgtgacagtggaagccttgaagtaa

SEQ ID NO: 1405 - DNA, 1128 bp, M.catarrhalis
  unsure (65): Identity of nucleotide sequences at the above locations are unknown.
cgacatataaacaacatgccacctcttatgctggtagtgccttatgggatattacgccaggctcntcgagggggaggagagggagctcacataacgagaggcatgggatcgccgatggagctgtattatcaaggcggacatttggcgaccagctcttttgagcatggcaataaaaacttggtcaaagaaaaatcggataattatgagctgggttttatgcatacagcagataaagtcagctataaagcaagcacttactatagcaattttgataactatatttttaatgagaccattgccaaagaaggcaatttatacatcagacgctataatcagacgacggctaagttttatggtgtggagggttcattaacttaccagccaaatgccaatcacagtgtgatgttttttggtgatatggggcaaggtaaaattggtgcattatctgatattaaagggaagcttgtatatgctggcagaaagtgggtttattttgatgatgatatcaaggatatgaccgttgatgataatggtgattatgatgccgatggtggtttgacttgtgccttaaaaacgcctgaacaatggggacaaattaacgataataatgattgtagtacaaccattaatgtctataaaaacggtacaacaacctcaggcgaggaggattacgaccgtttggcacgaaatccaacttacgcacccagagtaccgcccagccgcttgggcattcgttggcaagggtattttggtgatcattggtctgccaatgcagaatttaaccatgtgtttgcacaaaataaagttgccacctcaacggttgccattaaacctcaattcaagcagccagaaggttgccaacgccatgagagcaattgccgaatcagcgactatggcagtgataacaaccctttgatgatgcagccaagatatatcacagaaaacaaaacggcagggtataatttgctcaatgttggcttaaattataacaatgcatatcgtaatgttgattatacgctgtcaattcgtgcaaataatttactcaatgaacaaatcttcattcaccaactaatttttgcttttgtgcctcagaatggtcggaatctgactttaagtttgacgggttaa

SEQ ID NO: 1406 - DNA, 372 bp, M.catarrhalis
aatggcgaaaaacgaatgacaaacagtagtaaagatacggtggcctttgcaaacaccgaattggcggcagacagtgcagcctatgtcgaagcactgtatgaacaatatatggcagacagccaaagtgtgagcaaagagtggcaagattattttgctacttatcgtcaagatgatgatgcaccacacaatgcaatcaaagagcagtttttattgttggcacgcaaccaatcaggattgaccgcaaaatcaagcgactcatctgtcgagcatcatcctaaacaaatggcggtacaggcattaatttctgcctatcgtcgccgtggtcatcgcaaggcaaatcttgatccattggggctacatccgcgtccatag

SEQ ID NO: 1407 - DNA, 1467 bp, M.catarrhalis
agaaaaaaagagaatatgatgaaaaattcttatgatttagttgtaattggtggcggtcctggtggctatgaagcagcgattcgtggggcacagctgggctttagtgttgcttgtatcgaaaagcgtgtacataaaggcgaacctgctcttggtggtacttgcctaaatgtgggctgtatcccatcaaaagccttacttgacagctcacaccgctttgaggcgaccaagcatgaattgactgaccacggtatcacaacaggtgatgttaatattgacattgccaagatgcttgagcgtaaagacagtatcgtcaaggggctaacccaaggcgtggcaggtcttttgaagggtaatggcgttgactggttacaaggctggggtacattggttgatggtaaaggtgctgaaaaacaagtaaaatttacaccacttgagggcgatgaaagtaccattactgccaaatatgtgattctagcggcaggctctgtcccaattgagattcctgttgccaaaactgatggcgagtatatcgttgactcaacaggtgcgttggaatttgctgaggttccgaagcgtttgggtgtgattggtgctggtgtgattgggcttgagcttggctcggtttggcgtcgtttgggtgcagaggttgtggtttatgaagccatgccagaatttttggcagtcgctgacaaagacatctcaaaagaagcagcgaagctacttaaaaaacaaggccttgatatccgtgttgataccaaagtgacaggtgctgaggtaaaagatggtcaagtgatcgtaaccactgatgttaaaggtgaaactcaaacagatacctttgataagctcattgtgtgcgtaggtcgtcgtgcttatagtgaaaagctgttggcagaaaattgtggcattgagcttaccgagcgtggtttggtagcggttgatgaccaatgtaaaaccaacctagacggcgtttatgctatcggtgatttggttcgtggtccgatgcttgcccacaaagcgatggaagagggcatgatggctgttgaacgcattcatggcgaaaaagcccaagtcaactatgacaccatcatcagtgtgatttatacccatcctgagattgcgtgggtaggtctgtctgagcaagctgccaccgaacaaggttatgaagtgaaaacaggctcatttagcttatctgccaatggtcgtgcattagcacaaggtgagggcgttggcttgattaaagtggtggctgatgccaaaactgaccgtttattgggtatgcatgctgtatcagttggtgcaggtgatattgtccaccaaggcatgattgccatggaatttgtttctagtatcgaagatctgcagctgatgacttttgctcatccgacggtttctgaggcggtacatgaagctgctttatcggcagatggcagagccattcatgccattcaacgcaaaaagcgtaagtaa

SEQ ID NO: 1408 - DNA, 579 bp, M.catarrhalis
agccgtgaagatgaaaccttaactttccgccgctcgtgccgtgagggtatttgtggctctgatggtatgaatatcaatggcaaaaatggtttggcatgcttgattaatatgaatactttgccaaacaaaatcaccatccgacctttaccagggttgcctgtgattaaagatttggttgtggatatgaaccaattttatgaacagtatgaaaaagttcatccatatttaattaataaccagcctgcaccgcctaaagagcgattgcaatcaccagaagagcgtgaaaaaatgaacggtctttacgagtgtatcttgtgtgcgtgctgttcaacggcttgcccatcattttggtggaatcctgataaattcttaggcccatctgcattattaaatggctatcgttttattattgatagtcgtgataccgacacccaagctcgtttggctcgcttagatgacccatttagcttattccgttgccgtggtattatgaactgtgtcagcgtttgccccaaggggttaaacccaaccaaagccatcggtcatattcgtaatatgcttttagatcaagcaggataa

SEQ ID NO: 1409 - DNA, 408 bp, M.catarrhalis
ttttgtaatcgcggctgtactgattgtcgcatcgtttgtatgggtgatgttctaatgagaaataattctggtattaaaagtgcgactggcttgacaggttcaggttcacgagattggattttacagcgtattagtgcggttgtcttagcagtttatagcgttgttatggtaggctttttcctattcaatgatgtgaattttgaaagctggcaaggctttatgctaagtctaccaatgaagctatttagcttggtggcgattttatcattggtatttcacgcatgggtgggcatgtggacggttttgacggattatgtcaaatcatcaggtttgcgtttggtcatccaatctttggtcattatcgctgttttggtctatctgttttggggcgtgatgattttttggtaa

SEQ ID NO: 1410 - DNA, 1800 bp, M.catarrhalis
  unsure (1704): Identity of nucleotide sequences at the above locations are unknown.
ttatgttatatcataaccgagggtatcatgataaaaaaaccacttgtttgtgcgatatcggccacctttgcgatgccagcggtagcagataataccaagctgggtgaagagccaaccaccaccttaaagggtgtattggtaagctcgcaaacgaaccaaaatacaggttttgtatctaatgattcaaaacaatccagtgatcttacgctttcaaaagataaattaaaatatcgttcggcaaccttgggcaatgcgttaagtggtgagcttggtattcatagtaacccttttggtggtggttcatcggcacctgttgtgcgaggacaagagggcgtgcgtcttaagattttacaaaatggaactgatgtgattgatgtgtcatcaatatcgcctgatcatgttgtggcgaccgatacacttttagcgtctaaagttgagcttgttcgtggtgctgatacgctgttatatggcttggcatcgccagctggtgtgattaatgttgttgatgaccgtatcccgaatcgtatgcctagtggtgctatccatgataaaatcgaaggcgagacgatgcttcgatataacacaaacaaccatgaaaagcttgcaactgcaggggtgagctttggggtaggagatcgcattgcggttcgggtggagggcttaaagcgagaggctgatgactatcaagttccccattttcaggcagatcgcatgttagattatgtgccaggtagtgcaaataactctaccgttggcatgattggcgtgtcttatattcatgataatgggcatatcggtgcttcttatagccaccgtaaagatcgttatggtatcccagggcatatccactgcgacagccaacgagagcattttatcaaatggcataatatcacaaaatccaattattatttacccatttatcctcatttgatggaagattcagatattgatgacaatcctcatacgcattgccgccacaaccacgaagaccatatcggtgagcataatcccacgggcgtgcccatcaatcatgaacatcattcgccttggattgatatgaaaaccgatcgctacgacattcgtggcgaggtatatcggcctattcaaggtttggataaaattaagctaagcttaacttatgcagattattatcatgatgaaaaagatgctggcaatgagcaagacccaaacaatcacaaaccttctgagcgtgatacaacggtggataagggtcatgccagctctatttttacaaaaaaaggcgttaatggtcgcttggagttatatcatacaccgaccaaacgcttatctggggtattgggtattgggtatcaaacccaaaaatctgcagcaggagaggcgtatttgccaagctattttcaatcagaagcagaatggcaaaaagcccaaagtcaaaacattaaccaatatcgtccttacttattagttccaaataccaataaaagccttggtatttttggacttgagcaactaaagctaaatcaaatgacttttaaggtggcgatgcgtcatgaaagacaaaaaacaccaattgaatatgaccagcatttacttgaccatgctttgcagtattttttaagtaaagcacagctaaaagcacctgatcatcctgatttgacgacatataaacaacatgccacctcttatgctggtagtgccttatgggatattacgccaggctcntcgagggggaggagagggagctcacataacgagaggcatgggatcgccgatggagctgtattatcaaggcggacatttggcgaccagctcttttga

SEQ ID NO: 1411 - DNA, 1263 bp, M.catarrhalis
tttataaacttgaaggagtttattatggctgaaattaaagcccctgtatttccagaatcagtacaagatggtacgatcgttgaatggcatgttgctgaaggtgaagccgttagccgtgaccaacttttggctgaagttgagactgataaagtagttttggagattgttgcgcctgacaatggtgtgattaccagtatcgttaagaatgtggatgataccgtattatcggcagaagtggttgcaatttttgaggcgggtgcgtcagcaccagcaggtgaagcaccatcaaaagatggtgagctgtcaaaagacgaagctgataaaggcacaaccattgatccagcatcggttgcagcaccagtacaaccaaaagatgaatcagcaacatcagaagctgaatataaagatcacagcccagcagtcagaaaagccgccaaagaaactggcgttaatcctgctgatgttcaaggctcagggcgtggcggtcgggtgaccaaatctgatatgattaaccctaccctaaaagctgataacggtcaagtgattgccacagctgttggtcagcgtatcgaaaagcgtgagccgatgactcgtctgcgtaagcgtatcgctgaacgactattgtcagccactcaagaaactgcgatgttgacgacatttaatgaagttaatatgaagccgttgatggatttgcgtgccaaatacaaagatcgttttgagaagcgtcatggcgttaaacttggctttatgtcattatttgttaaggctgccaccgaagccttgaagcgtttcccagcagtgaatgcatcgattgatggtagcgatatcatttatcatggctattatgatgtgggtgtggcggtatcaagtgatcgtggcttggttgtgccagtgctgcgtgatactgatcgcatgagtatggcagatgttgaggcgggcattcgtgattatgcaactaaggcgcgtgatggtaaactgagcattgaggagatgactggcggtacatttaccattaccaatggcggtgtgtttggttcattgttatcaacaccaatcatcaacccaccacaaactgcaattttgggcatgcatgcaatcaatgagcgtccaatggcagttgatggcgaagttgttatcctaccgatgatgtatcttgcgttatcttatgatcaccgtttgattgatggcaaagaagcagttcaattcctagtgacaattaaggagttgattgaagatccatcaatgctactacttgacctataa

SEQ ID NO: 1412 - DNA, 426 bp, M.catarrhalis
tctttatattcagcttctgatgttgctgattcatcttttggttgtactggtgctgcaaccgatgctggatcaatggttgtgcctttatcagcttcgtcttttgacagctcaccatcttttgatggtgcttcacctgctggtgctgacgcacccgcctcaaaaattgcaaccacttctgccgataatacggtatcatccacattcttaacgatactggtaatcacaccattgtcaggcgcaacaatctccaaaactactttatcagtctcaacttcagccaaaagttggtcacggctaacggcttcaccttcagcaacatgccattcaacgatcgtaccatcttgtactgattctggaaatacaggggctttaatttcagccataataaactccttcaagtttataaatcaaaatatgttattttaa

SEQ ID NO: 1413 - DNA, 444 bp, M.catarrhalis
ccgatgacacctgcccaagccatgataacaccgctcaaaccgacacaaccgacacccaaaaatctcattcaccaaagtgctttgatgcgagcggtgtattttgttttgggcttggtgtgtttgattttggggctaattggtatcgttgtgccaggcatgccgacgacggtttttattttattggcgggctatttttgggcaagaagctcacggcgattttatgcgtggctactggcacatcgactatttgggcagatgattatcaattggcaaacgcatcgtgctattccaagatttgccaaatatttggcttggtcgatgatgagcctgtcaacaatcatattattttttaaattaccaagctcgtggcagtgggtggcttggcttttggcagcaattagccttggggtaggcatatggatggcaaggttgcccaacgcttaa

SEQ ID NO: 1414 - DNA, 237 bp, M.catarrhalis
aaatcattgcctatgcaagcttggttttgtgtttatgaaatactggcagatgaggctgtttggatggtatcggcgacagcaggtgttggctgggcgtcaaattcaaaacgcccacccatgctgtggctaaaaacagccatttcttggattttgatattgattgctgtacaaatcatcattcgatttgtgatggatatgggcgaagtatttaataactcttatcttacaatcaaataa

SEQ ID NO: 1415 - DNA, 204 bp, M.catarrhalis
ctcgttaagttaatgcatttgggctattatcgcaccttgccatcaaattttaaaggacaaaagcataattttcaaacaaatcgttatgccaaaaaagacaatcatcatctaaagacacttaatatcatacaaaatcccagcgacacagtatcaactcagctgaccgtacccatcttggcgtgtctatacggctgtatatcataa

SEQ ID NO: 1416 - DNA, 810 bp, M.catarrhalis
gtcaatttcaccaaaaatacaaatgttatgaacgatttttttagccaaattaagacgcatgctgatccaaatttcgtcgataaaacggcggtttatttgccaccagagcatcgattctctacgcttagccatgccttatctgagtatcacggtgtagatattttgtctttgacacaaaataatgatctgattgcaggggttgataggcaacaactgaatcaagcctatgaacagttgctcattaataagccacagccccatgcttgcgtgcttgttgccattactgatgagattggcccaaggctattattgactcgccgagcaagtaatttatcaagccatgcaggtgaggtgtcgctggtgggcggtaagcgtgataagacggatcggtcttcttatgaggtggcgacacgagaggcatttgaggaggtgggtctattaagacaagacagcactttaattggatttttaccgatgcaaatctccaaaaaaggtcttttggtacgccctgtggttgtcagtatgacacctgcaatagcagacagtttaatcgccagtgaagatgaaattcagcggttattttgggctgatctgacatatctaaaaacaacgccacccatagattatcattttgagcgtcctaagcttgggcgagcatatttgcatacaccagcatggctgattgatgatcgtcaaattggcaagcctgaagtggtgtggggattgacagggcgtatcatcgccaattttctacacatcggctatgaggtgtgctatcagtggtactatcaccttcaggcacaccgctaa

SEQ ID NO: 1417 - DNA, 522 bp, M.catarrhalis
accaatgaaaccaatgagttcgcctttatgaccacattacccaatcttcaccaaatgcaaggcagctatttcattagcggtattgataccaacattggtaaaaccatcgcaacaggccatatcgcctgccagcttttaaagaatgggcgaacggttatcacccaaaaacttatccaaactggcaatatcaagctaagcgaagacattgttaagcaccgacagatgatgggcgtgggtatgttgcctgatgatgagacgcacctaacaatgcctttgatactaagctaccctgcatcaccacatttagcaagcaagatggatggcgtatcggtagatgttagccatcttttagcatgcaccaaacagctggcagaggcttatgagatagtgctgattgaaagagcgggcggtttgatggtgccgatgatggatgatgtcaaaggtgggctgatgattgattatatcgccagtcaaaattatcctgtgattttggtaagctctggccaggcttggcagcattaa

SEQ ID NO: 1418 - DNA, 192 bp, M.catarrhalis
aaatctagaacgctcggaaaattccgtatcaatatcggtgcgatgtcatcaaatagcgagtgtgaacaattcacaaaaaataattatagcataccttttgggcaaatgcttgttttatttcatcaaaattcaacagatttggtttatgatatacagccgtatagacacgccaagatgggtacggtcagctga

SEQ ID NO: 1419 - DNA, 864 bp, M.catarrhalis
gagcaaatgacaaaatccgctttatcatcaaatcccaataaaatcgcccaaagattttgtagggcccatcaaagctatcgcgctcatgcaaccgttcaggcgaagatggcaagacggcttatcatctctttaaagatggttaaagcaaagatggttaaagcttgtaataccaaaaatactggcatgcaaccttatcgggtcatacaagatgaacacatatcaagattgcttgaaattggcgttggcagtggtcttttaaccgatgctttatttgagaattttagcgttgatacactgtatttaaatgatttgtatgataatatccaaaccaacgcactgccaaaggatattgatgccaattatctgatcggtgatattgggatgattgatttgccaaaaaccttagatggtgtgatttcatcttctgcactgcaatggatttatccgccagatgtgctatttaaaagagtttttcagactttaacagctggcggattttttgctgccagtacttttgttgagggtaatttatctgaaatacaagcattgacagggcgagggctacgctatgatacgccaaaacagctgatggtgcgtttaaatcaagcaggttttatgattgatgagtttaaggtagatgagcaagtgctttattttgactctccgatggcggtgctaagacacctaaaagcaacaggcgtgacagcagttggcacagagcaggcatgttggagcaagcaaagtttggcaaagttttgtcaaaactatcaacaatttcataccgatgcaggttataccttaacttatcggccgctgctttttgttgctcataaaccaatgaaaccaatgagttcgcctttatga

SEQ ID NO: 1420 - DNA, 981 bp, M.catarrhalis
tttggggtagctatgcagtggagtggtctttggttaattttagcgttgatggttgtgattttgggcgtattttttgtgatacgtagtttgcgtcgtaataatttggtactagaatcggaagccttgggcgtaaaaaccaaatatggattaccaattattccaagagatgaaagggaattgccgtctagaattgagagttcaaataaaaaagtagagcctgaagatgcattatccagtatggctgctgctgtggtggctgcacctgtgatgtcacaaacctcgcaagcacaaatggtttatgagcctttaacagagaataataaagaaaatcaggcagatacgcaggcaaaaattgatgagaattcacaaaatcaagacagtgttcgcgtcaataatccaagtggcggtctgtcgcacgctcaagattggcaagcacatgatgatgaaaatcaggacgctgattatgtggtagatatgacctttgacaaacgctcggctgtactcgatgagcatttggatgaacgccgaatttttgaccaaaataacgaccctttgcttaatgcaacagaaacggtgagcattgccattatgccacgcaactcgtttgctgggttgccaggttgcaccgtacttgaaattgtgcgtacatatggtatgaaatatggcgttatgaatctgtttcatcgctatgaaaatgaagatggtacgggtgatttgtggtttagtatgatgggcgttgggtatgagggagtgtgtgcatttgacttaaacagtttgcctgaatctcattttatggggctgactttatttttggcattaccgcatccacatgcgttaagaggatttgacagcatggtctcggtggcacatatgattgctcaggacttgtcggcagatatgcttgatgagcaaggcaatttgtttgatgatacttattttgctaagcttcgttcggtcgttgctgagcataacgccaattga

SEQ ID NO: 1421 - DNA, 243 bp, M.catarrhalis
cctgctgcagcaggcgctgcggcaggttatgttgcaagcaaagttgctggtaatcgtgctgctaccgctcaagcttcacaaaccgcccaaacaccaacaaccacacagcaaccagcacaaaataaccaacaagccaccaacagcaatcgccaaagcctcgctcaagccacccaagacaaccgagctggcaccactcgccaaggttttggtgcgacaggcggtgcgacaggttcggcctcatga

SEQ ID NO: 1422 - DNA, 933 bp, M.catarrhalis
tctatgatttatgagacaaccacaatgaccaaagattttatccatcaaaccaccacgctgtctgactgtgtaggcaatacgccacttgtcaagctcaatacgcttgccaaagatagccaagctactttacttgccaaacttgagggtaataaccctgcaggttctgtcaaagaccgtccagcgtttaatatgatttatcaagccgaacagcgtggacaaattaaaccaggtgatacactcattgaggcaaccagtggcaatacaggtattgcactggcgatggttgcggcaatgcgtggttatcagatgaccttattaatgcctgccaattccactcaagagcgtaaagatgcgatgactgcctatggtgcaacactcatcgaggtagcagatggcatggaggcagcacgagatatggcattacagatgcaagctgatggacaaggcattgtacttgaccaatttaataataccgataataaacacgcacactatctgaccacaggccctgagctttggcaacaaactgagggcaaaattacccattttgtcagcagtatgggtacaacaggcaccatcatgggtgttagtcaatatcttaaagaacaaaatccagccattcaaatcattgggcttcagccagatgaacagtcatccatcgcaggcattcgccgctggcctgctgaatatttaccaggaatttttgatgcatccttggttgatacgatcatggatgtcaaccaaactaatgccgaacgctatatgcgaaaactggcacgagaagaaggcatcttttgtggtgtatcctctggtggtgcggcgtgggcagctcatcaaattgccaaaaatacccctgatgcggtcattgcatttattgtgtgtgatcgtggcgaccgttatttatccacaggattatttggtgtaactgactga

SEQ ID NO: 1423 - DNA, 1602 bp, M.catarrhalis
tctattgattatatattgataaaatacaataaaaccttgatcagttcattcattgtttcaaaatccataatgcttaaaaacccatctaacgacaggcaagcttttcacatgacccaaacgcattcacttattcaaaaccccagtaaaaaaggcaaaccaactgctcgagcacgcaagcgtttggcagatacaccaccccttgaatttcatatcacaaacttagcacacgatgggcgtggcgtggcagtttatgagaccgataacaccacccacaatcctgataaagcaggcaaaaaagtctttatcagctttgcattaccgggcgaggctgtcttggttaagatgaccaattctaagaaaaattttgaagaaggtgatgccttacaagtcgtcaatcatccccattcccagcgtcaaacgccaccctgcccacattttggggtgtgtggcggatgtagtctacagcactggcaggcagatgctcaaattgatttcaaacagtccgtactaaaagagctgctcatacatcaagcaggcatcgagcctgatatttggcttaagcctttggttggcgatcgtcttggctatcgcaccaaagcacgcatgggtgtacgctatgttgccaaaaaagactcggcactggtcggttttcgtgaacgcgccagcaactttttggcagaactcaatgaatgccatatcttagataaacgcatcggctttgagcttgaaaatttaaaagcactcatcaccgacctaaatgcacgagatagcattccacagcttgagattgccatggggcagacactgccacatgtgcctgacagcatcaaatcggttgcggttattgtgcgtcatatgcaggagcttgatgatgaagacttggctaagttgcgtcaattttttgcagctcgcaactggcaactgttcttacaaccaaaaggcgcagacagcgtacatcgcatcgataccgaagatgctcgcccaacttcgctgactgtaccacccacaggtggtctgttttatcatctaccaaattttgagttgacttatgaattttcgccattggattttacgcaagttaatttatccgtcaaccaaaaaatgatggatttggcaagcagtctgttaaacctacaaaaaggtgagcgtgtactggatttattttgcggattgggtaattttagcttagtattggcaagacaagttggcgaaagtggctttgtggtcggtgttgaaggcagtgagcagatgaccgaacgcgccaaaatgaatgcttgtgccaacggcattgcccatactgaattttatgccaaagacttgacccaagatttaagcgatcagccatgggcaacgggcaataatcgctttgatgcactcttgattgacccaccccgctcaggtgcttgggaggtgatggcatacttgcccaaatttaatgccaaacgcatcgtttatgtctcatgcaaccctgtcacactggctagagacaccaaagcactcatagaagctggctatcggctgacacatgctggtgtgatggatatgtttagccatacaggtcatgttgagagcattgcacgatttgagcgtattgatgcttaa

SEQ ID NO: 1424 - DNA, 873 bp, M.catarrhalis
aataaaaaatatcttaaaaaatatctgaataggtcaaccatgaatcctttcacacttatccaaaatctcatcccacagcaggcactcagcgaatttgcaggcaacctagccgccagccaaaatccgtatgttaaaaaatccttgattcacagctttgctaaggcgtatcacataaatttggatgaatatgcacgcagtcaattttctgattatagcagttttaatgacttttttacacgcgaactaaaatcagatgcacgcccaattgatgagacgcccaatcagctgatttgccctgctgatggtacgatttcacaaattggagacatcaaacaaggtatgattctgcaagcgaaaggtcgcacctatgagattgggcaactgcttgctgattatgacgatggtcagtattttatgaatggcagttttgcaacaatttatttggcacccagcaattatcatcgtgtgcatatgccctttgatggtcaattgactgccacacgctatgtaccaggtacgctgttttcggttaatcacacaaccgccaagcatgtgcctgatttgtttgcacgaaatgagcggctaatttgtttatttgataccaattttgggcgagctgctgtggtgatggttggggcaatgattgttgcaggcattgaatcggtagcaactggtaagattaatcgcacgccccacattcaatatcgtacccatgagttaactttatcaaaaggcgatgagcttgggcgtttttatttaggctcaaccgccatcatcatattaccaaaatccgcccacaatgactggcttgcacacatcactcacggtaaaaaagtcatgatgggtcaggcaattggcaatatgcctgtctga

SEQ ID NO: 1425 - DNA, 1335 bp, M.catarrhalis
aaaaaggcgtacaagtcatcatcgcaacgccagggccgcttgattgaccatatgcgtgaaggccgtgttgacttatcaaaactagatatgctgattttagatgaagcagatcgtatgcttgatatgggatttgcagatgatatcaaagaaattctacaaaatacgccccagacacgccaaaccgtgatgtcctcggcgacttgggatggtgcagttggtaaaattgctgaaagctttacggttaatcctgaaaaagtttctattaaagttgagtcagcacatatcgatgaaagtgtgtattattgtgatgattttaaccacaaaaataatatcttgcttcaagtattaaataaccctaaaattaagcaagcagtgatttttgcagccacaaaaatgtccacagaaaaattggcagcgcagcttgtcgaagcgggttttaaggcacgctatttgcacggtgatttgcctcaaggcaagcgaaatcgtatcgttagcgacatgaaatcgggcaaatgtgatgtgttggtcgctactgatgttgctgcacggggcattgatatttcagccattagccatgtgataaattatgatttacctcgccaagttgaggattatgtgcatcgtattggtcgctgtggtcgggcaggtcgtactggcgtggcggtgaatttatgcagtatcgatgacaatcgtcagcttgagcatattaatcgttatctgaagcgacaaatgagcgtctcaaccatcgaaggattagagccacgccgtaattttggtatccaatcacaagagcgtcgccgtggtcgcagcaagtctcaaaaccgtactcgccaagatggtcgacaaaattttgagcgtactgatcataaatttggtagccgtaatcgccatgaacatcgtcatgagcgttcatttgagggtaagcgtgaacgatttgaggatcgtgaacgcagcgtcaatcgtcgtgaaaatgatgaaaatcatgagcgtcgcaatagtcgctttgaggctcgctctgatcgccgttttgataaaaatagacaaggttattatcaagctgatggcacagctcgccaagataaaaaagcgtatacacgcaattttgatcgccgtgacaacgatcgtaacgatactcgatttgataagcctaccaaaaaatttggcacacaaactgactttgatcgtccaagacgcaacaaagcatttggtgataaggtcaagccaaatacaggttttgataaatttggtggtaagtctcgtccaaaggcagttgaagagatcttttttgccaagcgacaagataaaaaagccaagcgtagatttggtgaattttaa

SEQ ID NO: 1426 - DNA, 855 bp, M.catarrhalis
ctcatcagccaaaaacgggtgacccaaattgaaattatcaccagatccaatcgtgaaccaaatcgtgattggttgatggcgtcacttggctatatccataccgcacgggcaaaatccaaactgcgtcaatggttcaataaacaagatcgggacaaaaatattgaaacaggtaaggcgttattacttaaagagtttgatcgtctgtcaatttcacccaatcaaatcagcctatcagaatactttaccgatctgaatgtcaaacatgaagacgatctgtatgtggcgttggtcattggtgatattaccgtcacacagatcagtaatttggtcgcccaaaagcttaatttaaccacccaagtgcctgataaagccaaaattgaaatcaaacagccaattcgccccaataaatacaaaattgagcttgaagaccttgataatgttgagatacatttggcaagatgttgcaaccccgtgcatggcgaaccgattgctggatttatcaccttatcaagcggggtcagcatccacaatgatggttgccctgagtatttacgcttaattgagcgtgaaccagatcgctctgtgatcgcacactggcaagaaagctttggacgctatcagcctgtggtcatccatgttgaagccaaaaataccaacggactgctgcgtgatttggtgcatgtgattgatcgagaaaaagtcaatattcaccgcgctgaaactgtctttaatgatggtgcaatcagtcatatgaagttttatgttgaggtggcaggcattgcacatttatcacgcctactcaataaaattgaacagcagcctagtgtgctacatgctcgccgtgcaactgcttag

SEQ ID NO: 1427 - DNA, 1266 bp, M.catarrhalis
ccaacaagccaccaacagcaatcgccaaagcctcgctcaagccacccaagacaaccgagctggcaccactcgccaaggttttggtgcgacaggcggtgcgacaggttcggcctcatgaagcgtatcactgttgcaccacgaccagattggcaaagcgaaatggcacgcattggctttaattatcacagcattgatggtaattattggcaagaagatgcctgctatgtatttaccgaatcccaaattgatttgctagaagatgccaccaacacattgcatcatatgtatgtacaagcagttgcccatgtggtaaaaactggcgattatgcaagacttggcattgatgatatcgccgctaagcagattgaggacagttttggcagacaagcacccagtttatacgggcgttttgatttatgctttgatggtatcaacccgcccaaactttatgaatataacgccgatacgcccaccgctttatttgaagcaagcgttgcccagtggtattggcttcaggctcaaggtggtatattaagaggagctgaccagtttaatagcattcatgaacgactgcttgtagagtttgaatcattaaagccgatgcttggtcatgacacgctgtatttaaccgctgcttcagacagtattgaggatttaaccacaacacaatacctacaagatgtcgccattcaagctgggctacagactgattatattgatatcggcaatattggttattgcatgagtgatggtcaatttactgatttaaatgacaatatcattcaccatctgtttaaactgtatccttgggagtggttacttgctgaagaatttggacagcatattgccagtagcaatattcatctgattgagcctgcttataaactcttgatgagcaataaagcattattgactgtcttatgggagatgtttccaaatcatcccaatctgcttgcagcaagcctaaatccaaacgatatttcaacaaatgtggttaaaaagccgtttttttctcgtgaaggtgcaaatatcagcttaactcatgccaatcaaacactctcaacgcatggacaatatggtcaagaagggtatgtctaccaagagtccaaacccttacccaaatttagcaacaatcaaggtcaagatgtgtttgcagtcattggtagttggattatcggtcacagtgctgcaggtattggcattcgtgaggacagcacgctcatcaccaaagataccagcttatttgtcccacacgcctttatctga

SEQ ID NO: 1428 - DNA, 1839 bp, M.catarrhalis
ttatccatgcaaatcaataaagcatttggcataaaaagcgcttatgggcagctgattttgttggtattcttaccgattgtggtattggcatttttaggttcgtacttggtcatgagtgaggtacgccgtgccatactctcagaacaagacaccatggcaaatgcagcattggtacgttatgatgccatcgtgcgtcctttattaacagaccttcaacatcgccaaaatcgtttggatgagcgtgtcgctcagatgaatgaagatgagatattaattgccattacgccacatgataccaatttaccaaatcgtgcgatggctcgccatgctcaagatataccattttttaataccaattggttcgtacaacttcaacagtctcgtaatcagcatgtacttcgagtggcaattatggatggcatcggtcaggtgctttttagtacgggaatgcagacagatttatcttggggagatgttgatttacaagccaaagaaatctatcgcataccaaccgctgtaggcaccgcctatggcaaatcattcatttttgataatgagcgttattggcttttggtggatatggataatacaccattgacgattacctcatatcgggtagcattggcgttgactgccattggattgacgaccattttactgcttttgctgattttaaatatttattctaaacgctggattacgccactttatgagatgcggctgtacttacagcgactaaataccgataatttatcccgtgtaccacaactaaaaaccagtggtgaatttgccttattgcgagatgattttacacgagcggttcgccgcctgcatgccagctttacagaactaaaaaaccatgccgatgaaacagaacatgatttacagcaagcatttgatgaaatggaaatgcaaaatatctctattcgaaatgctcgtgatgcagcaatctcaaccagccaagccaagtcagcatttttagcaaatatcagtcatgagctgcgtacaccattaaatagcattgatggttttattaatttgttagcccgtaaaggtgagttgactggtgagcaaaatttatatgtacaaaccatcaaaaaatcatcagcacatttgctggcactggttaatgatgtgcttgatttttctaagattgaggcaggtaagctgattttagatagccatgattttgatttatatgatgcagtgtatgatgtggttgatatgctgtcaccagcagcacttgaaaagcggctgcgtctggcagtcttattttatgatgatgtaccaactcgcattattggcgatagtttaagagtaaagcaaatcttaaccaatcttgtgggtaatgccatcaaatttactgatatgggcagtgtcgtggttcgagtgagtttggctgaaaaaacaggatatttatgcattgaggtggaagatacaggcaaaggcattagtgaaagtgataaagaacagctgtttcaaagttttggtcaaggtgatttgagcgtcactcgccgctatggtggaacgggtttgggtttagttatctcaaagcagttgacacaattgatgggtggctcgattggttttattgacaatcgcagtgaaaatattgctaatgcaggtgcaactttttggtttgagatgcccatgggtgtggatgaaggttcgattgatgatgccttacctaagcttgcagagctgttgcacacacccatgcaacttttggtttggattaaccatgcaccagcattgcgggtactaaagagcagtttggttggcacaaaagttcaattaacgatagccattggtcttgcagatttattagaaaaactttaa

SEQ ID NO: 1429 - DNA, 777 bp, M.catarrhalis
agcatttggcagatgggttttgtaataaatacatggatttcatgtacggttttattgtttaaattggcttttttgtctcataatgattacaatattaaaaacctaaaaaattcgattatgatacgactttatcttggcggctcgtttgaccccattcatcgggcacatctgcagatggtgctaagtgcatatgacaccatacaccaaaaaaccactgacactgtaaccgttcacctattgccaacggctggcaatccctttaaaaacgcaccgacatcgcatgcacaccgcatcgtcatgctcaagcttgccattacacccttgataaaaaaaggcatgaatatatcaattgatgagcgtgagctgtctttgatacctccgatatacaccatcgacaccatacgacagcttaagtccacttatcctgatgaccgattaatttttattattgggggcgatagtttggcaaatctacatcaatggaaggcgtatgatgagctgatttaccaagtcaaattgtgggcatttgaccgtgtcgataccacgccagctgatgagacagtagcaacaaagtgtactactaatttggatgaatttttggcaaatgaccatacgatttatttagatcacacacccatcatgaacatctcgtccagtcaaatccgcaccctaatcgctgatggtcgcactaagcttgctgcaccgctgatggatgagtgcgtcttggcatatatctgcaaagaaggcttataccaaaacctcaaaaatatgctataa

SEQ ID NO: 1430 - DNA, 1326 bp, M.catarrhalis
gcgatgattaacgaatttgataccgcccatttgtggcacccttacacttctatgacgagccctttgccagccttgcctgttgcttgtgccaaaggttgtcaaattcatctacaagatggcacggtactcatcgatggcatgtcatcatggtggtgtgccattcatggatacaaccatcctgttttaaatgccgccatcaccgaacagctcaccaaaatgtctcatatcatgtttggtgggctgacacacgaacctgccatcaaacttgggcaattattgcttagcattgtcccaaaaccgcttcaacacattttttatgccgattcagggtcggttgccgttgaggtggctttgaaaatggcggttcaatatcagcatgctttgggcaagaccaccaaaaacaacatcatgacaacccgctcaggctatcatggcgatacttggaatgccatgagtgtttgcgaccccatcacaggcatgcaccaaatttttggggatgctctgcccagtcgcatttttgtggatgcaccaacgattaagattgatgacccttgggatgatgcggccatggacgatattcgcttggcatttaagagacaccataaaaacttagcggcttttatcattgagcctattgttcagggggcaggtggcatgcggttttatcacacaaattatctaaggcagctgcgtaaattatgtgatgaatatggggtgttattgatttttgatgaaattgccacaggctttgggcggacaggtcgtctgtttgcttgcgaacatgccaaggtagtgcctgacatcatgtgtttgggcaaggcattaacgggcggttatatgacattgtcagccgtactcaccacaaccaaagtggcacataccatcagccatggtaaggtgggtgcgttcatgcacgggccaacatttatggcaaatccattggcatgtgctgtggcactggcaagtgttcagcttttattacaaagcccttggcaatatcatgttcggcgtattgctcggacatgtcgcatgacattaacccatcttaaacagttgccacatgtcgctgatgtgcgtattttgggggcgattgcagtggttgagatgacagacccggtagatatggcaatcattcaacaagaatgcgtcgcacgagggatatggattcgcccctttggacggttggtttatctgatgccaccatttatcatcagcgatgatgagttggcaactttattgcatgagtttaccgatttaatctgcacaaccttatcacccaattttaaaaaacagtcaatgaacccaataatcaatgaagatgaatga

SEQ ID NO: 1431 - DNA, 627 bp, M.catarrhalis
aaaaccagcaaaggaaattttatgagtgttaataaagtcattcttgtgggtaatttaggcaatgacccagaagttcgtaattttgataatggcggcatgattgcaacggtatcaatcgctacctctgaacgctggacggacagaaacacaggcgagcgtaaagagcataccgaatggcatcgtgtggtatttaataaccgattggcagaggttgcctcacagtatctgcgtaaaggttcacagatttatgttgagggcagtttacgcacacgcaagtggcaggatactcagacgggtcaagagcgttataccacagagattcgtgcggataatatgcagatgcttggcaatcgtgcaagtggcgataatggcggttatgccaattcccaaggtggttatgccaatccaaatcagcaatatcaaaatcagggcaatcaaggcggacagtatccaaatactgcctatcaacaagccaatcaatttggtggtcaaaattcatcaggctatacgcagcctcagccaaaccaagcctacccaaattcaggttatccccaagagcgagcatctcagcctcagagtagctcgatggcacaaaaccatgcttttgggcaaccaacacacatttag

SEQ ID NO: 1432 - DNA, 186 bp, M.catarrhalis
gagttattaaatacttcgcccatatccatcacaaatcgaatgatgatttgtacagcaatcaatatcaaaatccaagaaatggctgtttttagccacagcatgggtgggcgttttgaatttgacgcccagccaacacctgctgtcgccgataccatccaaacagcctcatctgccagtatttcataa

SEQ ID NO: 1433 - DNA, 1203 bp, M.catarrhalis
atgatgaatgaccagttattaaatttttatgccgaacagctgtctgctttaaaagcatcgcacaatcaccgccaattacaacgcttaaaacatcaagggcaacgcattggtgtcaatgacagcaagcctttgctcaatttagccagcaatgattatttgggcattgccagtcaaacatcactttatgaagaattcttagagctgctgcatgaacagcgttggccgtttagtgcgtcttcttctagattattgacagggaattttgaaaattttgagcgattagagaccaaaatggcatcattatttggtcgcccttgcttattatttaatagtggttatcatgccaatatcggtatcttacctgccatttgtgatgacaaaacggtgattttggcggataaattggttcatgccagtatcattgatggaatgcaattggctgccaaacatggcaccaaaaccatccgctatcaacatcaaaatctcccccagcttgaaggattaatccaaaaatatcaatcagataatggcatttgtcgtatcattgtcgttaccgaaagtatttttagcatggatggcgatatcacaaatttatcccatcttagccatttaaaggcacaatacccaaaggtgatgctttatgttgatgaagcccacgccatcggtgttcgaggtgggcgtggtttgggctgtgtggaagaatatggtgttatcaatcaagttgattttattgtcggtgcatttggaaaagcattggcatcagttggcggatactgtatttgccatcccattttgcgtgattatctgattaataaaatgcgtcctttgatttttagtaccgccttaccacccattaacattgcttggagctgttttattttagagcaaatacctttgatgaaccaaaggcgtaagcatctgatgaaacttagtgatgatttatcaaaagtggttcacttggcaaagctgccatgcccctctgccagtcaaatcattcccatcatattgggtgataatgctcgtacgctaaatgctgccgctgatttgggcagacaaggctatcatgtgctggctgtacgcccaccaaccgtaccaaaagggcaatcacggttgcgaatttgtttaaatagtaccattaatgatgatacaatgacaaagtttacccaagtgcttactcaaatcgtcagcagtgagagcaaatga

SEQ ID NO: 1434 - DNA, 1599 bp, M.catarrhalis
tacaacctagaaatcattgaaactatttgttttttagatttacaaggatttaccgtggttcagatacgagatagcctgcccttattgggcggtaatagtagcagcatggatagtgcaactttggcagccagtttggttgccaagcaactgcatccagattttaaggcacagcttgccaatcacaaactcatcagtgcagttgatcacagtagtagcacgaccaacccttgcgatatcaatgtatcggatatcgatattgagacttggatttgtcatgttgccgctcgtattggtaaagaagatttacccatcttacgccaagcctgccaatttgtacaaatccatgccaataagccccatgtcacccgctcaggtgcttatatcacaggcattggcatggcggatattttggcgtatctttttcaaaatgaaaacgccttagctgccgccatgctttatcgtacagcacgccgtgaactggtcagcattcagacgattcgggtaaattttggggaggatattgcccatttggtgatggatgctttagcgatgggcagattatctgaaagcattgagagcaatcaacgacttgaagattattttgagtccaatcaaagagagcagctttctaatatttatagcatgctcatcagcacaaccaatgatgtgcgtgctgtgctaatcaaattggctgaacgcacctttgcaatgcgtgaactgtcctttgcacctcctgaccgccaaaaaagagtcgcaagagaggtgatgaccatttatgcaccacttgcacatcgactctccatcgctcagcttaaatgggagcttgaggacttggcatttcgctatcttgcgcctgatgaatataaaaaaatcgcaagtctgcttgccgaaaaacgcagcgaacgagaagcttatattcagctggttaaatccaagcttagcgaagagcttgagcgtgcaggtatccaaggcgaagtgtcagggcgtgtcaagcatatttattcaatttggcgtaagatgaagtcaaagaatctttcttttgatcagctttatgacattcgtgctttgcgtgtgatggtcaataccaatgccgaatgctactatacactgggcattgtgcatggtttatggcggcatattcctgagcaatttgatgactacatcaccaatcctaagcccaatgggtataaatcactacataccgcagtcatcgctgagcagcgtacacttgaggttcagattcgtacctttgatatgcattttgaagcagagcttggcaaggcatcgcatgtcaattacaaagaaggactcaaggccaaaaaggacgactatcttacccaaaaaatcagctcactgcgtcagcttttaggcaatgaaaaagcagatggcgaagaagatatcgagcttgatattgataatgctgagcggatttatgtatttagccgtgatggcgatatcactgaactgccaaaaggtgcaacagtacttgactttgcgtattatgtgcatactgaagtgggtaaccgtgctcaaggtgcacgggtaaatggtcgctatgtaccgctgactcatcagccaaaaacgggtgacccaaattga

SEQ ID NO: 1435 - DNA, 636 bp, M.catarrhalis
tataatttttgggtagtgttcattaatcagccagtttattatagaccgatgccctactgtatgcaatgcggacataccgccacctacaccattcccaaaggcgatagtcgtcagcgtctcgtctgctcagcgtgcggatttattcattatgacaatccaaagatgatttgcggggctttggtacgccatgagaacaaaattctgctttgtcgccgtgccattgagccaagatacggctattggactttgccagcaggatttatggaaattggtgagaccatgatggaaggtgcgttgcgtgagaccatcgaagaagccgccgccattgccaccgatgctaagctgtactgcttatttgatatgccttatttggggcaaatccatgccatgtatttgaccaacttatcttgtgatgggcgatttggggttggtgttgaaagcttagaatgtgccttgattgatgagcaggatatcccttggcaagatttggcgtttcgcacgattcacttgacacttgaacagtatttggcggataaagctgcgattatcgcccaaggcaagaacattgatgattttgccaattatcccattcatcaaatcactttagacgaaattgtcgtggacgaattacaataa

SEQ ID NO: 1436 - DNA, 1236 bp, M.catarrhalis
ccatgcaccagcattgcgggtactaaagagcagtttggttggcacaaaagttcaattaacgatagccattggtcttgcagatttattagaaaaactttaataaaaatgagatgggtttatgattgggtgattgtggataattttggccaagacgctgccaaagatgatgtgggtgccgtgttacgacaaattcgcttacgatatgatggtaagcttgccagttttggttatcaagtgggtatcaacgaacagttgttattgcgttatcagacccaagcattatatgagccgatggataaaaggcagctatatgccatgcttttaaatcagcaaaacctgtcggcgatacaatcacctcgtcaggccaaatttgtggggcgtaggattttggctgtagatgaccatttaccaaatcttttggtgctagatgcattacttgctgagcttggtgttgaggttgttacggcaaatagcggctttgaggccatcgaaaggatgacgcagagcatcacagggtcaacgccacccattgacatgatatttatggatgtccagatgccaagaatgtcaggacttgagacctctatcgaaattcgaaaaattgagcaagcacatttgagcaagcctgtacctattattgcattgactgcccatggtctgtcagatgaaaaagatcagttggtctcatcggggcttaatgattatgttagtaagccaatcggtgaggtacagctggtacaaacgctacaaaaatggcttggtcatgatgtggcagctgataaactcaatgtattggatatggttgaaagtttgcccatacttgatgtaccaaaaaatgccggcgatgcccctgaaaaattacccgttgtacattggggccatgctcttgagcgttcagcaaataaacctaagcttgcctatagactgcttgagatgctcattgatggtgctgactctgagcgtcagtcacttgagcgtgcatgggcagaccgtgaccgtgtcagtttggctgatatcagccatcggatggttggggcagcacggtacgcaggcgtgccaagactgcgtgcggtttcagagatttttgagtcggcatgccgaaatgatatcacggcagtcactccaagccattttattgccttgcgtccagcatatcgggctttgattgatgcgctcgatacattgcaagcagtggagctagataaagtggcgatggatgcagatttggcagattag

SEQ ID NO: 1437 - DNA, 237 bp, M.catarrhalis
gctctggccaggcttggcagcattaaccatactctgctaagcttaaacgccctaaaaacttatggcatatatttgtacgcactggcgtacaatcaagccgatgatggcgatgatgagatgattgcaaccgataccaaacagtatttgcaagagtatctcaaagcccatcacagtgatgccctttggtgggagattcctaagttaaattcagccgactttggcctaaattcattttaa

SEQ ID NO: 1438 - DNA, 459 bp, M.catarrhalis
gtgcgtcttggcatatatctgcaaagaaggcttataccaaaacctcaaaaatatgctataattaaaagttatccatccaattatcaatcaattatgacgactttgaatttagaccaaacacttgcacttgttaccaaaacgcttgatgacttaaaagcaaaaaacataacgacccttgaaatcgaacatttaaccgaaattgctgaacgcatcgttatttgtgaggccaccagtaaacgccatgtcaaagctttggcggataaattgggtgctgcaaccaaagaagctgggctgatgccgcttggccgtgaaggtgataaagacagcgattggacactggtggatttgggtgcggtggtggtacatatcatgacgccacaagcacgggcattttatgacctagaaggcttatggtcatctccagatgcactcaaagccttagtagctcaaaaagactaa

SEQ ID NO: 1439 - DNA, 786 bp, M.catarrhalis
ctgaggcttggcatgatttgcaccccgattttagtatttgacattgaaaccatacctgacatacaaacaggcaagcgactttatccagagctggccgatttgggtgatgatgatgctttaactgcactcattgccctgcgtcatgctgaatcaggcacagaattcatgcgtctaccacttcataaaatcgcttgcttgtcatttttatggtttgatggcacgacctttcatcttaaatctctcacactacaaaccatgagcgaaaaagagattttggtcaattttttaagagcctttgataaaaaacctgtgcttgtcagctggaatggattggcttttgacttacctgtcttgatgcatcggtctatgcaccaccaattatctgcaccagcactatttggcagcgcccaaaaatttggctattcatatcgctatggtgagatgcatattgatttgatggacaaaactgcactgcataataacaaactacaccaaaaacttgatacggttgccagtttgtgtggatttgctggtaaaggcaatcttgatggctcgcaggttttgccgatggtacaaaactctcaatgggatgcccttagttgttattgtgagtccgatgtcctaaatacttggctgatttatttaaggtggctgactttaacgggcaaatcttctaccgatgaatgccaagcactcattgacaaaaccaaccaatttgtacaaagcttgaccaattcagctggcaagctacgccatcaaagctttttagatgcttgggtacggtag

SEQ ID NO: 1440 - DNA, 2973 bp, M.catarrhalis
aatccatgtatttattacaaaacccatctgccaaatgctttaaaatatctagaaaatccccattttcttattaaattcttctataaaaaaggcgttttcatggctcaagataaaattgccatccgtggtgcacgcacgcacaatctaaaaaatattgatgtagatattccacgagataaatttgtggtgattactggcttgtcaggctcaggcaagtcatcacttgcgtttgatactttgtatgccgaaggtcaacgccgttatgttgaaagtttatcagcatatgctcgacaatttttaagccaaatgcaaaagccagaagtagatagtattgatggtttatcacctgcaatcgccattgaacaaaagtccaccaaccacaatcctcgctcaacagtaggtacaattaccgaggtatatgattacttgcgtcttttgtttgcacgggtgggtgtgccttattgccctgaacatgatgagccgatggtcgcacaaacagtcagtgagatggtagatgggattatgagtttgccgactgagaccaaattgatgattttagcacctgtcgtgcgtgagcgtaaaggtgagcatattgctttgcttgagcagttgccatctcaagggtttacacgcgtgcgtattgatggggtgatttatgagaccgatgagttacctagccttgaaaaaaataaaaaacacagcatcgaggtggtggttgaccgatttaaagtgcgtgatgatttgggaaatcgtgttgccgaaagtttggaggttgcattaaaacttggtaatgatatcgccattttgtatcacatggatggtaatcctgttggtgatgatgagcagatattatctgctaagcattcttgccctgtatgtgaccgtgcggtgagtgagcttgagccaaggctgtttagctttaataatcctgcaggtgcttgccctgcatgtgatggcttgggtaagcgtcagtattttgcggccgagcgtatcgttacccatcctgaaaaatcactgaatcaaggtgctattcatggttgggataaacgtcatgcgtattattttggcttattatcaacggtttgccgtcattttggcattgatatggatatgccgtggcaagacttatcaaataaacaccaagcgattattttaaatggttcgggtagacaaaaaattgaatttaattttaccgatgaacgagggcgtaaaacgaccaaaaacacgccctttgaggggattttgccttatctagaacgccgttatacaaccacaaccagtaatttggtgcgagatgagttggcacagtatctatcagatacccagtgcaatgtgtgccatggtgtacgcctaaatgatattgcccgccatgtgcgtgtggaggataaagccatcggtgatatcatccatctgccgattggggaggcgtggcaatattatcaaaacttaaaaattactggtgctaaaggcgaggtggctgataagattttcaaagaaatcaaagagcgattgggttttttgaccaaggtcggcttggagtatttgaccttggcacgctccgctgaaacgctgtcaggtggtgaggcacagcgtatccgcttggcaagtcagattggtgcaggcttaatgggcgtgatgtatgtacttgatgagccgtctattggactgcatcaaagggataatgatcgacttttgtccactttaatacagttgcgtgatttgggcaatacggtggtggtggtcgagcatgatgaagatgccattcggcaggcggattatattattgatattggcgttggagcaggcgtgcatggcggccgtgttgtggcatcaggtagtgcagaacaggttgccaacaccacagggtcgctaacgggcgagtacctatctggcaagcgacgcattgaggtgccgactactcgccaattgcctaagaccatcgagataatcaaaggtaaaaaaaccatccaagagccattatggattcatttggagggtgcaactggtaataatctaaaaaatgttcatcttagtattccgattggtgtcatgacctgcattacgggtgtgtcaggttcaggtaaatccaccttgattaaccgtacacttatgccattggctgcgactaccttaaataacgccaccacacttgctcctgaaaaatatgaaaaaatttcaggacttgagcatttggataaaatggtggatatcgatcaaagtccgattggtcgtacaccgcgttcaaatcctgccacttatacaggcgtgtttacactgatacgagatttatttacccaaacgccagaagccagagcgcgtggctacaaagcagggcggtttagttttaatgtgaaaggcggtcgttgtgaggtatgtcagggcgatggattgattaaagttgagatgcattttttgccagatatgtatgtgccgtgtgatgtgtgtcatggtaagcgatataatcgtgaaactttggaggttaaatataaaggtaaatccatcagcgatgtgcttgatatgactgttgaggaagcgatgggattttttgaacccattcctgctattcatcgtcgcctagaagcactgcatgaggtgggtcttgactatatccgtttgggccagtcggcaacgactttatcaggtggtgaggcacagcgtgttaaacttgccaaagagcttgccaagcgtgatacgggcaagactttgtatatcttagatgagccgacaacggggctacattttcatgatatcgctaagcttttgcatattttacatacattgcgtgaccgtggcaatactgttgtggtgattgagcataatttggatgtgattaaaacagcagattggattgtggatttaggccctgaaggtggtagcggtggtggtgagattgtcgccacaggtacgcctgagacagttgccaaaaatagccgttcacatacaggcagatttttaaagcctatgcttaagtga

SEQ ID NO: 1441 - DNA, 210 bp, M.catarrhalis
cctaggggtatcgtaatgcaagcaaatttacatcaagtcgatcgtatcattcgtattgttattggtatcgctttaattgtattacctttgtttgcggtcatcggctggtggggctatgttgttggggcgatactactggcaacaggtctgattaatttttgcccaatataccgcttgcttggtatcaatacctgtaaatacaaaagataa

SEQ ID NO: 1442 - DNA, 918 bp, M.catarrhalis
ccaattatcatgccagaattacccgaagttgagacaacaaaattaagcctagagccattgattggtcaaactgtcacatgcgttcaagtcaggcatccacgcttacgctatgatattgccaaagatttggatagtttggttggctttgtcctaaccaaactacagcggcgtgctaaatatttactactagatttttatcacgcacatgacagtcgccaaaaaactttactgattcatttaggcatgtcgggcagcttacaacagcatatcaatgaaccaccccgcaagcacgatcatgtcttgattgactttgccgattctcatggtaaaatcattactctacattatcatgatcctagacgctttggcatgattctttgggttgtcaatgatgattatatcgaccagccaaacacctacgcacgatttttggcacacttagggcccgagcctttgagcgaagattttgatgccaactatctcatcagatacatcatgcgtcccaaatctcatcaaaaacctttaaataaacccatcaaatcactgattatggatcagtccgtcgtggttggtgtgggcaatatttatgccgccgaaagtttgtttttgtcaggcattcatccgctcacgcctgcctatttggttcatgaagataagctggtacgattaactcatcacatcaaacaaatattagctcgtgccattacccaaggtggttcaacccttcgggattttacagttggcagtggtaagacgggttattttcagcaaaccttgctcgtctatggcaggcaaggggaatcgtgtgccacttgcggtagtttacttgaaaatatcaaaatcagtggtcgggcaagcgtctattgtccaaactgccaaccttatcatgatcacaataacccaagcagtcaaaattaa

SEQ ID NO: 1443 - DNA, 465 bp, M.catarrhalis
aaaagacaaataatgaaagcattgatacagcgggtacaccaagcacgcgttgaggtttgcggtgaggtggttggtgagattgatggtgggatactggcttatatcggtattggcaagtcagatgatgttaagcaagcaaagcgtttggtggataagatattaagttatcgtatttttgaaaataccactgacgcagacaagcttggcaagatggataaaagtgtggctgatgtgggcggtggtttgctgttggtgtcgcagtttacactgatggcactgaccgataaaggtcgccgtcctgactttgggccagcgatgccacccaatcaggcagcacaactgtttgatgagttggtttgttatgccaaacagtatcatacgccagtggcgacgggtcaatttggtgctcatatgcaagtgattgcccataatgacggtccgattaactttatcttagaagtatag

SEQ ID NO: 1444 - DNA, 510 bp, M.catarrhalis
ataaatacatttgcattggctcatcagcggggcatatcagttgagataattatgaccgaatcaaccacccaaaccactgacagcaccaccgaaaattttgtaccacagtttagtgacttgggacttaataagcccatcttaaaagcactgacaaaaagtggttataccacacccacgccaatccaagcaaaagccattccgcacgctctaaatggtcgtgatttgcttttgtcagcccaaactggctctggtaagacggcagcatttgttttacctgtcttggataaaatgagccgtaagccgaccattgaaaagcatgtacaagcacttatcctaacaccaacgcgtgagcttgcactacaagttcaagacagtgtacgacgctatggcgatggcatgcgtaatatgtttagcgtgcctttggtgggcggtgcaccttatggcggtcagttgcgtgccttaaaaaaaggcgtacaagtcatcatcgcaacgccagggccgcttgattga

SEQ ID NO: 1445 - DNA, 534 bp, M.catarrhalis
caggtcgtggctatgagcctggccaatcagcgtcgtgaagatgccaattctaaaattattggtcgcttaaagcttgacgcaagctttagcccatttattatagtggcttatgaagttgaaaatgcgcgaggtgaacagcgtaccgatcttgataaactgattatcgagcttgagaccaacggcacgattgacccagaagaagctattcgcaaagctgcaacgattctacaacagcaaattgctatttttgtggatcttgaagctgaagaagcgcctgagcctatcaaagaaaaagaagagattgatcctgtgctgttacgcccagtggatgatcttgagttaacggttcgttcggcaaaatgcttgaaagctgaaaatatatattacatcggtgatttggtacagcgttcagaaactgaactattgaagacaccaaatcttggtaagaaatcattgactgagattaaagatgtgcttgcatctaaaaatcttgaacttggtatgcgtttagaaaactggccgccaagtgaatag

SEQ ID NO: 1446 - DNA, 720 bp, M.catarrhalis
agacaacaggcaagcaccatccagcatgccaaatacattcagacactatggcagcaatttcatcaaagacccattgctaaacttcaaatcatcttggagaaaatttcaccgccgccatggcaaaatttttatcatcgctggcagctcatccaaaataatacaaaagatgaggcacaagatgagcaaatactgactgactggttaattcacttatttgatttgctatttaatcatatgtattttgaccaaattccgaccgtgctggtgcgtggtgaaagcgaacctgaatattttcccagtgagcataatgcacctgcacgcattgaatttgcacatggtttttttcaaagtgcattacatgaaattagccactggtgcatcgcaggacaagctcgtcgcaagctcaatgactttggttactggtatgaatccgatggtagaaatgaacaaactcagcggttatttgagcaagttgaaatcaagccacaagccattgaagctttattaactttagcttgcggtcgatatttttatgtctcacaagacaacctaaatgcaaattttgatatctcaaacagcacctttgcccaagatgtctttaaccaagctaaattttatctatcaaacccaagcaccctgcccacagacgcacaacttttattatgggttatcttaacactcagccattcaaactactacacaacaattaagatgaggtaa

SEQ ID NO: 1447 - DNA, 498 bp, M.catarrhalis
tccgaattaaatcgaggtgacactatgacaaatgcaactgagtttctaacaccgagtgcgattaatgtcgatacggtcaatgaaacgactgcaaaggtcacgctcgagccgttagagcgcggttttgggcatacgctaggtaatgctctacgccgtattctactttcttcgttatcaggtgctgcagtagtagaagctgagattgaaggtgttgatcatgaatattcaacactagaagggttgcaagaagatgtactcgatcttcttttaaatctgaaatctttggcgattattctgcatgaccagaatgaagcatatttgactttggataaacggggtgcaggagttgtgactgctgctgatcttgagctaccacacaatgttgaaatcgctaatcctgatttggtgcttggcacattgagtgagcgtggccatctgaagatgcgactacatgtagtgacaggtcgtggctatgagcctggccaatcagcgtcgtga

SEQ ID NO: 1448 - DNA, 252 bp, M.catarrhalis
ctttgcccaaaagcaaaagagcttcgccgtgtggcagagcctttgattactttggcaaaagaagatagcgttgcaaaccgccgtcttgctttcagccgtatgcgtaataaggatatggttggtaaattattcagtgagcttggccctcgttaccaaactcgtccaggtggatatttgcgtatcatcaagtgcggttttcgtgatggcgataatgcaccaatggcttatgttgaattggtagatcgtccataa

SEQ ID NO: 1449 - DNA, 654 bp, M.catarrhalis
ggagatagacttatggctcgttatattggtccaaaattaaaattgtctcgccgtgaaggtactgacctgcaattaaaatcaggtgtaaagccttacgatgttaagacaaaaaaagcaggtcgtgtacctggtcagcatggtaatagccaaaataaaacctctgaatacgcatcacaacttcgtgaaaaacaaaaagttaaacgcatgtatggtgtattagagcgtcagttttctaactattataaagaagcagcacgtgagcgtggtgcgactggtgaaaacttgttggttacccttgaacgtcgccttgataatgttgtttatcgcatgggttttggtgcaacgcgtgcagaagcgcgccaattggttagccatcgtgctatcatgctaaaaaaagctggtcgtgatgagtttgtacgcgttaacattccttcaattcaagttcaagatggtgatgtgattgcagtacatgaaaaatcaaaagaccaacttcgtattaaaaacgcagttgagcttgcgacacagcgtggcatcccagcatggttagaagttgatcacagtaaactacaaggtgctttcaaatctgcgccagagcgtagtgaattaccagctgaaatcaatgaaaatttgattgttgagctatattctaaataa

SEQ ID NO: 1450 - DNA, 576 bp, M.catarrhalis
ggtaaacaaatgcaaaaattttatattcatcctgacaatccccaaaagcgtgtgttaatacaagctgccaatttactcaaaaatgaccaattaattatttatccagacccaagcggatatcgcttagccgtcagtcttgatgccaaacaatcacttgcccaagcattacgctttggtcaatacgagcctaaattttgtttaatgtgtcgccatatcagtgaaatatcaacctttgctaaaattagcgattttgcccatcgaaatttaaaaaatactctcaataaaaacactcattttttattaaacccaaccaaatcagctccaaagaaatttgtaaattctagcgacaaaaatatttgtgccagccttgcccacacaccaatcgtactgagcttaattgaagcactaaatgcaccatttattagcatgccaatttatcttaatggagaaaaagtaacatacgatagcacctatgagcttgaagctatgatggaaaatttggtcgacggatttttggacgcaggtgaattacaagaccaaccatcaccagttgtctcgttaatagatgcaagctga

SEQ ID NO: 1451 - DNA, 285 bp, M.catarrhalis
attagtcatgttttggaacatagcctttcgatggcttctggtgcgacccagcttgactccgcttttttcgatgtcgcatggtcaagtatccttttaattagcggttccgataagaaaaacgattcttcgtcacgctattcacttggcggccagttttctaaacgcataccaagttcaagatttttagatgcaagcacatctttaatctcagtcaatgatttcttaccaagatttggtgtcttcaatagttcagtttctgaacgctgtaccaaatcaccgatgtaa

SEQ ID NO: 1452 - DNA, 189 bp, M.catarrhalis
agttttggctcattgcctgattgcccatttgagcaagcagtcattaatgaggctaatacggctaccaaggcaacgccaaccagtggtcgaaaacaaaatattttcatcattattccttatattgataatcaagcacatgacgctccagccatttcaccaatgcgattaacgccaatgtcaaaaaactga

SEQ ID NO: 1453 - DNA, 219 bp, M.catarrhalis
ctggggtctccccccccctcacttattagggggacggtaaatcagatggggcatccaccaaaccaaatttaccgtttatatgacaatacaacaacacaacttgatgccatcgctaatggctatcaaactgattatcaggttggtaaatggcgatatccgccatcttggaccgtcgttatgtttagccgtaacaaattttactgtattgcatcgctatag

SEQ ID NO: 1454 - DNA, 1122 bp, M.catarrhalis
ataattaagttattaatcctaaaaaataaattgatagagagatttatgacagcacagtttgcccccctaaaaaatgaccgcttattgcgtgcattaaagttcttgcctgtggataccacaccagtttggatgatgcgtcaagcagggcgatatttgccagagtataagcaagtgcgtgcacaagcaggcgattttttaagtctatgtaaagatattgataaagcaacagaagtaactttacaaccattgcgtcggtttgagttagatgctgcaattttatttagtgatattctaaccattcctgatgcttttgatttgggtctatactttgctgaaggtgaaggtcctaagctgaccaagacggtgcggacagagtcacagattatggcgctgccaaagattgacatgacttcatcacttgattatgtgatgaaggctgtaacaagcattcgcaaagcattaaatggtcaggtgccattgtttggttttagtggcagtccttggactttggcaacttatatggttgagggcggttctagccgtgaattccgccataccaaacacatgatgtatgccacgcctgagcttttacatgcattgcttgcaaaaattaccgatgcagtggttgattatttagatgcacagattgtggcaggcgcacagattgtgcagatttttgacagttggggtggagtgcttggtcatcgccagtttaccgaatttagccatgcttataatcgtaagattgttgcccgcctaaaagccattcatcctgatgtgcctgtgatattatttaccaaaggcggcggcttatggctagatgttcaagcagatagccaagctgatgcactgggtttagattggacgatgccattagataaggcgcgtcacttactacatgccctaaatgccaaaaaagcaatacagggaaacttggatcctgcaaccatttttggttcaccgaagatgatacaaatggaggttcatcgtatgttagatgatgcgtatgtccttgataaatcaggttatgttgctaactttggtcatggcattacacagtggtcaaatcctgaccatgctaaggcatttattgatgcagtgcatgattatcagatttcataa

SEQ ID NO: 1455 - DNA, 1776 bp, M.catarrhalis
agacaagtgaccgaagagctaattgaccaaaccattaccatcgcaggctgggtacatcgtcgccgtgaccatggcggtgtgatctttttggatatgcgtgatcgtgaaggtttgttacaggttgtgattgaccctgatacacccgaagcatttgcgaccgccgatgctgctcgctcagaatatttgcttaagattacggggcgtgtgcgtcgtcgctatgaaggtaccgaaaatccaaatatggtcagcggtcaagttgagcttttgggtaaagagattgaactgcttgccaaatcagacacgccaccatttcctttgaatgatgacaacatcacagtctcagaagagctgcgattaaagtatcgttttttggatatgcgtcgcccagaaatgcaggagcggatgaaatttcgtgccaaagcaacctcaaccattcgccgctatttggacgaccatggctttttggatgttgaaacacccgttttaacccgtgccacacctgagggtgcccgtgattatttggtaccatcacgcactcgccaaggcaacttttttgcattgccacagtcaccacagctatttaaacagcttttgatggtggcaggttttgaccgttattaccaaatcgccaaatgcttccgtgatgaagatttgcgtgctgaccgccagccagaatttacccaagttgatatcgaaacttcatttttatcagatgaagagattatggacatcaccgagggcttaaccaaaaatttatttaaaaccatgctggatgttgagtttgataccttcccccgcatgacttacgcagatgccatgcgtgattatgcctcagataagcctgatttacgcattcccttaaaacttattgatgttgctgacatcatgcaacatgttgaatttaaagtattttcagggcccgcccaagatcctaaaggccgtgttgttgccttacgcattccaaatggcggtaacatgagtcgcaagcagattgatgagtacaccaaatttgttggtatttatggcgctcgtggattggcatatattaaggtcaatgacgcaagcaatatcaataatggcgttgaaaaagaatcaggattacaatcacccatcattaaaaatatgaccgatgaggttttgattgagctgattgagcgtaccgatgcccaaactggcgatatcattttctttggtgccgataaagccaaaatcgtcaatgatgctatgggtgcattgcgtgttaaaatcggtactgatttaaatttatttacctgtgaatgggcaccgctttgggtcgttgattttccaatgtttgaggaaactgatgatggtaagtggacatcagttcatcatccttttacacgcccaaaaggctcggttgaggaactcaaacaaagtcccgaaaccgccctatccattgcctatgacatggtactaaatggcacagaaattggtggcggttcgctgcgtattaatacggttgacatgcaagaggcggtatttgatgccttgggtatttctaaagaagaagcagagcttaagtttaagtttttgatggatgcattgcgttttggtgcaccgccgcacggtggtttggcatttggtctagatcgcctgattatgctgatggttggtgccagctcaatccgtgatgtgatcgccttcccaaaaaccaagacggcagattgcccattgaccgaagcacctgctgaagttgataatcgccagttgcgtgagttgggcattcgcattcgtgaaaaacaaaaagcagaatag

SEQ ID NO: 1456 - DNA, 624 bp, M.catarrhalis
ccgataacagcacagggcattcgtgatgaaatcacctgctatcccatcccagagctaaatttaccaagtgatatcccagagcgtggctggaaaaaactcaccacttttaagcctgacttatatgggctaaaaggaactgcactatttttggatattgatattgtaatcattgataatattgatgctttttttactcacaaagcccaacatgatgacagtgtgatgattattcgtgattggaagaaaccatggcgaatggtgggtaatagttctgtgtatcgcttcaatgtcggatatcatacttatccgcatttattggaatattttgaacaaaattttgagaaaatccgcaaagaggttcgccatgaacaagcctttttatcaaattatctcagagaacatcaccatttagaatattgggattcatcttggtgcgtaagctttaaataccactgtctacaaaagattcctatggcgtattttgtaccacccaaaaagcccatcaatgccaaaattgtcatctttcatggtgagattaacccgcctgatgccatcgctggcggtggtggcaaatggtatcgtcatgtattgccaagcaaatggattaaggatgcatggcaatga

SEQ ID NO: 1457 - DNA, 378 bp, M.catarrhalis
agcaacgaagcaaccaaaaaagtaatggcattaaaaaaacaagccattgatacaaacagtaaacaaatcttaggctttgtctgtggtaaaacagacactaacacctttaaacgactttatcagcagttaaatacccataacattcaactgttttttagtgactactggaaatcttatcgtcaagtcattttaaagccaaaacatataacaagcaaagctcaaacttttaccatagagggctataatagtctcattaggcatttcatagcaagatttacaagaaagtcaaagtgttattctaaatccgaaaaaatgatagaaaacacgttgaatttattatttgctaagcggaatggtagcttaagatatgtattttaa

SEQ ID NO: 1458 - DNA, 1329 bp, M.catarrhalis
agaccccatttatcttctcgaaaaacccaagaaattcaagcagttgagttacttgttgccctaaatactttggcaagcagacaggtttcggtgacatttttgggcgagcgtatgacattggatgtggtggcattgatagcactgcatgataaatatggtgtggcattggctgatactttggcgtttgccaaggctttggttgatcatggtttagaaaatacatcgcttgatattgtacaagcaatcaaagcacaaaagtcagccaatgagtttgatagcggtagtcaaatcaaagcaaccgatgtggtattgtatggatttggtcgcattggtcgcattttggcacgcttattgatgagtcgccctgcagcagagtcaggcttacagcttaaggccattgtcgtgcgtccagcgggcgagggtgatttggctaagcgtgcatcgctattagaacgagattcggtacatggttggtttaatggctctgtacaagttgataccacaaataatggtattattgtcaatggtcgctttatcaaggtaatttatgcgtctgacccatcagaggtggattatacagcacatgatatcaatgatgcgattgtcatcgataatacaggcaaatggaaagatgaagcggggcttggtaaacatttggcatcaaaaggtgtaaaaaaagtgttactaacagcacctgccaaaggcgaaattaagaatattgtctatggcgtcaatcacgataccattggtagcgataccattgtatcagcggccagctgtaccaccaatgccatcacaccaacactgaaagttttacatgatgaatatggtattgttcatggtcatatggagaccattcacgcattcaccaatgaccaaaatttggtagataatcaccataaagctgaccgccgtggtcgtgctgcaccactgaatatggtcatgaccagtacaggtgcagcgtctgcagtatccaaagccattcctgagcttaaaggcaaactgtcaggcaacgccattcgtgtacctaccccaaatgtttcattggcaattttaaacttaaactttgaaaaatcagtgggtgatactaaggcaattaacgcctttatccaatccaaggcacaaagtgagcagtggcaggcacagattgactattcagactcacctgaggcggtgtcaactgattttgtgggttctgaaaaagtggcaatttttgatgccaaagcaaccattgctactgataaccgtgccaccttatatgtttggtatgataatgagatgggctatagcactcaagttatccgtgtggctgaagagatggcaaaataa

SEQ ID NO: 1459 - DNA, 183 bp, M.catarrhalis
acccttgggtatccagatgaatcgcccctgtggcgtataaacccagcccaaaattttggttttcgccatgctctagccaatattggcataggcggttttgaagctcatacagtgcctggctttttatttcaaggtcaggcacccaaatatcaatggcactattggtcaaatgcttactcatag

SEQ ID NO: 1460 - DNA, 759 bp, M.catarrhalis
ctcaataatctatcgcttatgcacccaaagcttgaatttaaaaatatcagtcatgcgttcaccacgaatgcaaagacgccattatttgatggtctgaatcttaaagtcgcccaaggtagcgtggttagcatcgttggggcaagtggcgtcggtaaaagcacgctatttaatatcgctgctggtctgatttatcctagccatgggcaagtaatgatcgatggtaagaatgttacaggcacatctgggtatgtgggctatatgctccaaaaagacttattactgccctataaaacggtttatgataatatcgctttgccattgatgttgtcgcataaaaccaagcaagagattgcagcacaaattcagcctaatttgacaatttttgggctagatgggctgactaaaaaatatcccaatcagctatctggtggtcagcgtcaacgagtcgcattacttcgcacctatttatccaatcgtgaactgatgctacttgatgagccattttctgctttggattttgtgactaaggcggatatgcatgagtggtttggacagtttcgccaagccaatcagctgacttgtttgattatcacgcatgatattgatgaagccatttatttatctgatgaagtttatgtattaaaaggcatgccagcgatgtttacgcatcatttttgggtacctaaacagcgggatttttatcaatctactgaatatttaaccctaaagcaacaaattttaaccgccattcgatattaa

SEQ ID NO: 1461 - DNA, 1047 bp, M.catarrhalis
  unsure (935),(936): Identity of nucleotide sequences at the above locations are unknown.
gcattttttaaggataatcatatgactcgttttgccaatttttgtgcaggtcccgccagtatgccgaccgccgtccttgagcgtgctcaagctgaaatgcttgactggcaaggtcttggcacatcggtgatggagattagccatcgcagtacagattatattgagatggctcaaaaagccgaggcaaatttacgcaagctcatgggtatcagcgatgagtacgctgtgctgtttttgcaaggtggtgcaacgctacaattttcagcaattccgctaaatctgatgaatggcggcgtggcggattatcttgagacaggtacatggtcaaataaagcctataaagaagctaagcgttatgaagcgttgggtcttggtcaagtcaatttggtggcggcgggcagtcagacacagtttagcgacataccagacccaagcacttggcagctcaccaagggggcaagttattttcattattgcccaaatgagaccattcatggtgttcagatgtttgatgtgccgaaggttgatacgcccatcgtggcagatatgtcatcgtgcattttatctgagccgatttcggtggataaatttggtctcatctatgcaggtgctcaaaaaaatatcggtccagcaggattgactttggtcatcattcgtaaagatttgttggagcaagccagcgaatactgtccgatggtgatgaattataaaaatcagcataccaatgattctatgctcaatacgccatcaacttatgcgtggtatttatcaggccttgtgtttgagtggctgcttgagcaaggtggcgttgaggcgattgcaaaagtcaatcacgctaaggcaaaaacgctgtatgccgccattgacggtagtgatttttatcataatacagtcaatccaaaccatcgttcaatcatgaatgtaccgtttcattnngcagatgacagtttggataagcgattttttggaagaaatccaaaaaagcaggttttgttaaacttaaaaggtcatcgtgcggtaaggtggtatgcgtgccagcatttataa

SEQ ID NO: 1462 - DNA, 198 bp, M.catarrhalis
gattggtctaagctggtcagatgcaggtggattatctggtggtgttggtggcagttaccgctggaaataaagcctaaatttaactgctgtgtcaaaaaatatggtctgtataaacagaccatatttttatctaaaaaaattatcttaacttttataaagtattataagccaaagctgagtaataataagagatgttaa

SEQ ID NO: 1463 - DNA, 768 bp, M.catarrhalis
tttggtgataaattgatgaaaaattttaatcaatactttataactacacttatcagcagtatgctggttgcatgcagtgcacccataccaaccaacccacaagtatccccaataaaaacgccatcggtactgattactaaagataaaatcggtgatcatcatacacatgagcacgatgaatctgtaagccatgtcggtttgcaggcacattttgagacttggctacagatgcaccatgccaccaaacaagaggtagttaggtatcaggcgtatttacaatcaagacttggtaattatctgccaccaatgagtcaactactaacgactgcacggtcatggcaggcatgtggtcatgaaccttatcagctgccaccagaacatctttggggtcagattgtaccaacattgcacttgtatcaagatctcaaaagtaggggcatattgccaacaaatacccaaattcgctcagtttatcgcaatcctgaactcaaccaatgtgctggtggtgcagctatgagtaagcatttgaccaatagtgccattgatatttgggtgcctgaccttgaaataaaaagccaggcactgtatgagcttcaaaaccgcctatgccaatattggctagagcatggcgaaaaccaaaattttgggctgggtttatacgccacaggggcgattcatctggatacccaagggtttagaaaatggggtactcaattttctgaaacaaactctatttgtcgtcatgtcttaccaaaaaataagctataa

SEQ ID NO: 1464 - DNA, 1230 bp, M.catarrhalis
aatttgagcaaaattatgcgttttattgatgaagctgtaatcagcgtcaaagcaggtgatggcggtaacgggattgttagctttcgccgtgaaaaatttgttcccaaaggcggaccagatggtggcgatggtggcaaaggcggtgatgtttatgccattgctgatgacaataccaacaccttagtggactatcgctatactcgtaagtttgaagcacaccgtggtgaaaatggtggcagcaaaaaccgttcaggtaagggtgctgatgatatctatttggcagtaccgatagggacaacgattattgatactgatttggatgtggtgattggagatttaaccgaaaaaggtcaaaaaatcttgattgccaaaggtggtgatggtggttttggtaatacacgctttaaatcttctaccaatcaagcacctcgtaaagcaacacctggatttgctggtgagacaagaaatatcaagcttgagcttaaagttgtggccgatgttggtttgattggtttgccaaatgcaggtaaatcgacctttattcgtcaggtctcagctgccagacctaaagtggctgattatccgtttacaacacttgtaccaaacttaggtgtggtagatgttggctcgcatcaatcttttgttatggcggatatcccaggtttgattgagggtgcatctgatggtgcagggcttggcattcgatttttaaagcatgtggcacgcacgcgtcgtttgttacatattgttgatgttcaaccaattgatgaatcagatcctgttgctaatgcacagattatcttaaatgaattgaataagttttctcaagagttatcacagctgccacaaattttggtattaaataaaattgaccaaattcccaacgagcagcgtgatgccgtttgtcaagatatcatcacacgattgggctggacaggcgaagtattttacacctcaacgctgactggcgaaggggttgaagcggtcaaacatcatttgatgcaggtcattgaagatgagcgtgagcgtgagcttgaagatccaatgtttgctgaagcacaggcggctcgctttgcacgccttgaagaagaagtgcgtcataataccgaaatccaaaaagaagcttatcgtgcgatgcgtaaagcacagcgtgagggcggtgatggtgatgacgatgataattggaatgatgatgattatgatgttgcagttgaatatgcaccttattaa

SEQ ID NO: 1465 - DNA, 525 bp, M.catarrhalis
tatatagtaaaaataactaattttatcgctattctttggataatccatatgagccatgtcgccaaacagaccgacttagatacaaccgatcaaaaaatactgcgtatactgaccgatgacgcccgattatccatagcagagattagcgaacagattcatctgtcgcccacgcccaccatccgccgaatcaaacgccttgaggatattggcgttatcacaggctatcacgctgctaccaatcctacggcacttggctacgctttatcggtctatgttgcggtgagtatggacaagcataccgctgagcgattttatgaatttgaaagccaaatccaaaattttgacgaggtggtcagttgtagcgttgtgacaggacgcagtgaagattatttactgaaagtattggtcaaagacatgcgtcattatgaagagtttttattacatcggctcagtaaaattgagggcgtaagccagctacataccagttttgttttaagagaggtgtttcatcgttctgccatttga

SEQ ID NO: 1466 - DNA, 1332 bp, M.catarrhalis
gactccaaaaagcataattttaaggtatgtatgcaaacaaatatccgttttcatcatcagtctggaatcagtgttctactgattgtttcatggcttttgctggctgtatttgcacttattattggctatttggtgatgaacccaagtatcataaccaaagaacaattagagcagccatctgccataagtgtatcgaatgaaggtgagtggcaacccatcatcgccgatgatagtacaaaaatacatcctgatacacctgcaccaattgcgtcatattatgaagcagtaaaccgagctgcccagtcggtcgtgaatatttataccacccaaaatgcacaccatcaactatattcaaacgatcctgtattgcagcagtttttggagcgttattatggtggagcaccacatcaaggcgtaaatctaggctcaggtgtagtggtgtctagcgaaggctatatcgtcactaatgcccatgtgattaacggtgctgatgagattacagtggcactaaatgatggtcgtaaagcacgtgctaccgttatcggtagtgatgcagacagtgatttggcggtgattaaggttgagctggataatcttgtaccaatggcatttcgtgctgagccaattcgtgttggcgatgtatcactggcaattggtaacccatttggtgttggtcaaacagttacccaaggcatcatttctgcgacaggacgcactggtatcggtgtcagtagttttgaggattttatccaaacagatgcagcaattaatccaggaaactctggcggtgctttggttgatgctaatggtgctttgattgggattaatacggcgatttattcacgctctggcggttcgatggggattggttttgccattcccaatcaaattgtccagcaagttatgacatccctcatcaccacaggtaaagttagccgtggctggatggggattgaaatggtgcgtatgacagatgatcctacaaatatcgagagtcgctcgaatgttattattcgtcgagtttggcagaatagtccagcagagcatgcaggcttaaaatctggtgataagattgtgcgtattgatggcgtacacattaccagtatcaatgagcttgtcggtgttgtcgctcgtaaagcacctgacagtcagctgactgttgagatcatgcgtgatcagagaccgatgaccgtacaggtgatattagctgagcgacccagctcagaaacattaagccaacctgtacaaaactcactcagtcagtcaagacaaagtacacagcttgaacaactattgcaagagctagaattcctgcatggcacaccacaatga

SEQ ID NO: 1467 - DNA, 915 bp, M.catarrhalis
aatttaagtgattttatgccaaccattcaagccaccaaaagtcacccaatgattaatttggccgacgagatgcccagtattttatttgatacgcatcccagccgcctaaactatgctcagcaacaacgaatcactcgtttatgtatccgctgtgctttactactcatgcaatatggtgcagagtctgtggtggtggttgatttaacaaagcggcttggggcggcacttgggattgatggtgttgagtgcggtttgtcatttaatgcggtcaccttaaccactttatatcaaggtcgctgtatcacaacggtgagaaataccgttcatcaaggcattaatgtcagtatcttagtacaaattcaacaaattatcttaagtgccgaaaatcatcaagccaatcaatcccattgtttaaacacccaaagccatgacgcatgtatcagtagcgtagaacaagggtttgatgccatctaccaaactgtctattctaatcatttggtatcattttttgtgggcgtatcatgtgccagttttgcctatttaaacggtgcaacattggtgattgctctgattacttttattgccagttttgttgcgatgcgattgcgtatgtatcttttaaagcaacattttaatccttttgtcgtcgctatgataacggcatttaccgcaactttattggcagctttggcatattttttaaatttaggtactaatgctgacattgctgtcgccgccagtgtgctattacttgtaccaagctttcctattattaatgcgttatcggatatcttaaaaggctatatgaatatgggcgtaggtcgatggatgtttgcaaccatgctgaccctatcagcctgtgttgggattgtgatgaccttgatttttcttagaattccacattgggggctatga

SEQ ID NO: 1468 - DNA, 795 bp, M.catarrhalis
gagatgagtgattgtcgcattcaagcagttttggcatttgaagataattatatttggctcattgaaaatcaaatgaccacaattatcattgacccaggcagcagtcaagaggtgctggcgtacttacaaaaaaatcagctgacgcccagtgcaattttggtgacgcatcatcatgacgaccacacaggtggtgtcagagacttacttattcaatataaaaactgtgccttatacgcacatgccaatcatggttttgatgatatacccaaagtcaatttggtcgatgaaggcgatcattttgcggttggggacatctgctttcaagtgtggcgtaccgcaggtcataccgatagccacttaagctatgtgacggagattgaccaaaaaacgcgcgtattttgtggcgatacgctgtttagtgcaggctgtgggcgagtgtttacaggcacgatatcgcagttatttgccagtatgaagcgttttaatgacatggatgagcagaccgttttttatcctgcccatgaatataccgtatcaaatttaaaatttgccaaaagtgtggctttggacgaacatcaagatgccatcaagcacgccactcacatcgcaatcacacagcgacaaaataatcaaatgacactgcctgttagcttagcacacgaacgccaaattaatgtctttttacatgcttgtgatgataataaagccaaacaacttgccaatcagcatggattaaatgataattcggcgttggcggtatttagatggttgcgtgaacaaaaaaatcatttttaa

SEQ ID NO: 1469 - DNA, 219 bp, M.catarrhalis
tttaaactactgacaattaatctattgataatcaaagccttggagatttttatgaaacaaagtgagcagacgacttttaatatgcgtgtagataagcatttggtggagcaatttaagcaagcggcacgagataataaccgtactgccagtcaattattgcgtgattgtatgattgattatgtgaaaaagaaccgccaagcagatatgtttaagcgttaa

SEQ ID NO: 1470 - DNA, 753 bp, M.catarrhalis
gcggtatatcgtatgttgccaacacgccttattcaaaatcgtcatatcttaacgaaacttggtatcaccatatgggcatcaaaatatgctgatgtgacgacgctaccatctgcccatcagccaccaccgcagaagggggtgccgaaagcactggcccaacaaattccaacccagcaaaatccaaatgcccaaacgcagttagcatcaacacccgtcacacatcgcccaaagcaggtcattgatacaccgccaaaaactcagcaaaccaaaacatctcatctaacattaccgccacatcatgaagttttggagattaatcagtcgtcttttgcagccaagtcaattgaatatcatttgaaagtgatgatatatcgcaactggataatgatggctgatgtcgatgctttggacgcagcagggcatgaactttggctgtcgttacatcggtcgctgactcggcaggcaaaacagcagcagctgacattagtcagcaggcaatttgactacccattatttgaagatgatctgacaggtgattctgtttttttggcaaatatcagcctaagagggtttatatttgggtgcatgcgtgaatctggtcagataaaataccttgcaccattgacagctttacctgattatttggatttgcaaagtattcaaaatttaacacttattagcgattatcacattgaccaaatgttgctagatggcacgacaaaaaaagcattttggcaagcgttgcaccgttga

SEQ ID NO: 1471 - DNA, 1524 bp, M.catarrhalis
attatcaatagcaataataaggaggatattgtgagtgattcaaatctggtcaccgatgataatcatagtttgaacaaatcataccgtgaactgcatcgccctagctcaagttttgaaaaacgagaggattatttaaagcacgaactacaaattatgcagcctcatcgctggcgtatcaatttaccgtttcgtgattaccgttttgaattagaagatactatccctgcaatggcaggcaccattggtaagattgtgatggtgggtgcgatggcagctgcttttgctgcaccgctagggcttggcgaggcatttgttttagaaaatgtccgctatgagatgattattgctgcattttttgtacttattttctcatcatttatcctaccgacatctaatttaccaggcacgcatggccctcttcttccactcattcccatcgtggtagcggcaggagggcatccacttgcctttggtgtgctcattggcgtgtttgggctgattttggcattggtaaagggtggcagtctcatgactcggcttaccagtaatggggtggcaggaggattgttgctctatctgggttttgttgggctaataggtcaggtcaaaaagctgataacatgggcagatgccattggtctgccacacatcgcctttatcattattttatctaccatcatcatgtatgccctattggagcattggcaaaaacgttggcttgctgtgcctattggctgtatgttggcgggttttttggcatttatcctaggagcaccgtttgagtttaagaccgaaccgggattgcctccgcttagtccaatgtactggtggggggagagtacaggttggacgcttggtctgccagatttgaaggcgtttatcgtggtattcccttttgcagtattggcggttgccatgtggacacctgactttttgggacatcaggttttccaaaaaatcagttatcccaaacactcagaacgtacgcatatgagtattgatgatacgaccatcacctgttcattgcgtcagatggtaggctctgtccttggaggggcaaactttacatcatcgtggggaacatatatcgtacctgcatctattgccaagcgtccgattcccgctggtgctgccttgactgcgattttttgtattgtggtggcggtttggggttatcccatggatttggcggtgtggcaacctgtgttatcaacagcacttatcgtggcggtatatgtgccactgctcgaagcaggcatggagatgactcgtaagggtaagactacacagtctgccagcattgtggtgttctcatcagcactggtaaatcctgtgtttggttggtctctgaccatgatgcttgataacttaggcttgattggggataaagaacgcagccgtcagttggggctgtcaggcagagtaatcattcctgtcattggatttgtggtactttgccttgccatggcttcggtaggtatgttccctggtgtgccagcgttgataccacagtttagagtctaa

SEQ ID NO: 1472 - DNA, 1071 bp, M.catarrhalis
tcagtgcttggttttttaagatatgtaccgctgtcagtcctgcatggattggcggcgtgtgcgtcttatatttcctatcattgcaggcttagtatttatcgcagcatccaagccaatttaatcttggttcaccccaagatgccagacgcacagcggcaaaaactcgccaaacaaatcctaaaaaatcagctcatcagtgcagtcgacagtcttaaaacttgggcaatgccaccaaaatggtctatcgcacaaattaaaacggttcatcatgaagatatcctaatcaaagcacttgccaatccaagtggcatgcttgccattgtgcctcatatcggcacttgggagatgatgaatgcttggctcaatacctttggctcccctactatcatgtataagcccatcaaaaatgcggcggtagatcgctttgttttacaggggcgtgaaagactaaatgccagccttgtacccacagatgctagtggtgttaaggcaatttttaaaacactcaaagcaggtggatttagtatcatactgcccgaccatgtacctgatccatcaggtggtgagattgctcctttttttggtattaaaaccctaaccagtacgctggcgtcaaagcttgctgcaaaaactggttgtgctcttgttggcttaagctgtattcggcgtgaagatggcgatggttttgaaattttttgttatgaattaaatgatgaacaactttattcaaaaaataccaaaattgcaaccactgctttaaatggtgcgatggaacaaatgatttatccacattttttgcattatatgtggagctatcgtcggttcaagcatacaccactattaaataatccttatttactcaatgaaaatgagctaaaaaaaatagccataaagcttcaaagccatgtcaaaaggatagttatgagtgataccaactatatcatctgtaagaaatggggtaccaaatacggtgctgaatatgtcaatcgcttatataatatgggcaagcgtaatctgactttaccatttacgatggtgtgcctaaccgataacagcacagggcattcgtga

SEQ ID NO: 1473 - DNA, 666 bp, M.catarrhalis
tttgtgcctatttgtacatttttgtgtacatattttggtcagtatgttgagattttctcaattattgtcagagtatgcaatactaaaggtgtaaccatgaaaacagtgagcaaatctttacttggattagcgagcattactttaaccgcaagtttaagcatgaatgcacaagctggcaatagccctgccaatatcgacaatgtactacagcagcttaccacgcagcataataatgcgtcaagcttggtcaaatcagcgcgtcaacctgcctctttggcgcttaacagtccaatgattgctcaatccaccaaatccaaaaaaaccgatgaagatattcctgtgcttgaccgtctgaccgcagtcgcttcaagcactgtcaataagttcaaacaaaatggcatcgcttcgtggtatggtcgtcagtttcatggtcgtaaaactgccagtggcgaaacctttgatatgaatgccttaacggcagcacacaatagcctgccaatgaattgccatgtcagagtgaccaatcgtgataatggtaaatctgtggtcgtcaaaatcaacgatcgacccaaaaccaatcgtgtgcttgatttgtcttatggtgctgcccaagccattggtatgactggtaatgttggtaatgtaaccattgagcgtattgattaa

SEQ ID NO: 1474 - DNA, 249 bp, M.catarrhalis
atgatgcgtatgtccttgataaatcaggttatgttgctaactttggtcatggcattacacagtggtcaaatcctgaccatgctaaggcatttattgatgcagtgcatgattatcagatttcataataagttagaccgccccctaagcgatatactcagggggtttatcaatagcgatatttgttctaaattggtaactcaatcatcaatcaagtgtattgccataaaatcatctgataccaaaagataa

SEQ ID NO: 1475 - DNA, 531 bp, M.catarrhalis
ggaattatcatgcccaagatttcactcatagtgccgacactagctcatcagtcgcaaattttatcactcgccaaagcctttgaagataatgggctggtattacacggtatgtcactttctttatttgacagttatgaagattggcttaattttagtcgtgcacctgcaggcacacctgcaccaaatcatgcctttgttaaagtagcggatgatactttttttggtgtcgatgagttgggtttggttcttggggtgattaatgtgcgttatcaattgaatgagtttttaaaagttcaaggcggacatattggctacagtactcatccaaattactggggccaaggtatcgccagccaaatgctcaagcttgcactgacacactgtcaacaaaacggcttaaatcaagtactcattacctgtgatgatagcaatttggcatctgctaaggtgattgagaatcacggtggtattttagaaaataagttaaataccaatggtaaaaccattcgccgatattggattcatatttaa

SEQ ID NO: 1476 - DNA, 258 bp, M.catarrhalis
ggatatgccatgaacagtcacatcatacccacttatgtccgccaacccatcagttttgtgcgtggcgaaggttcatacctgtacaccaaagatggtacggcttatttggcattgattggcaggaaaaggcggcgactgtgctgtgtcaagccgctggcatggtgcaagtatttttttgccaattcgggtgctaaagccaatgaatgcgtcctaaaattggctatttcatcggcttcattgaatttagaatttaagtga

SEQ ID NO: 1477 - DNA, 192 bp, M.catarrhalis
atgaaccaaataacccacccttgcccactatgtcaagcagtaaccacatggtctgacaacccaaaccgtccattttgttcaaaacgctgcaagctcattgatttgggtgcatgggcgtctgatgagtatttgattgcaggtgatgaactggccatcgccctgaatatcatgaagttacagactattaattaa

SEQ ID NO: 1478 - DNA, 1770 bp, M.catarrhalis
accatcaaaatcgttaccattcaatatctaaaagtcaatgaactttttggagcttttatgccacacattaccccaaaaaaccctgcgtttgattttaataaatatcagccgtttgcgtttgcccctaagcttgaaaaccgtacttggcccgataagaccatcaccaaagccccaatttgggcaagtgttgatttgcgtgatggcaaccaagccttgattgatccgatgaccatcgaacaaaaattaaaattttttaaactgcttgtagagattggctttaaagaaattgaaatcggttttccgtcagcggcacaagttgagtttgattttacacgccgcttgattgaagagggtcttgtacctgatgatgtcaccttacaagtcttggtgcaggcgcgtgagcatttgattgatcgaacttttgaggcacttaaaggcgcacgccgtgcgattgtacatgtgtataactccacctcaaaagtgcagagagataaagtttatcagatggataaagcacaaattaaacaaatcgccatcgatggtgcgaccatgctgcgtgataaagcaaagcattatccagacacgcagtgggtgtttgaatattcaccagaaagcttcagccaaaccgaaaccgattatgccgttgaggtgtgtgacgctgtctgtgagatttggcggcctgacactgggcaagcagtgattttaaacttacctgccactgtcgaggcatcgacgccaaatatctatgccgaccaagtggaatatttttgccgacatctaaaagcacgcccccatgttaccatcagtctacatacgcacaatgaccgtggctgtgccgtggcggcctctgagctgggattgatggctggggctgatcgcatcgagggtacgcttttgggtaatggcgagcgtacgggcaatatggatattttggttatggcgatgaatctgtacacccaaggcattgacccagagcttgattttagtcaggtgagcgacattgtacaaattgtcagcgaatgtaacaatctgccagtacatccacgccatccttatgttggtgaacttgtctttacggcatttagtggctcacatcaagatgccatcaaaaaatctttagattataatgaaaaacaccccgagacccagcagcattgggatgtggcatatctgcccatcgacccaatacacatcggtcgaggctatcaagatgtggtacggattaatagccagtcaggtaagggcggtgctgcgtatatcttgcagcggcactttggttttaatttaccacgctggacacagattgattttgcccgtgtggtacaggcttatgcagaaagtatggcgcgtgaactaaaaactgatgagctgcttgaaatttttacccaagcgtatcttaagcaagataaattccgcctaagcgactataccatcagcaataaaggcgatgctgtcagcttccaaggtcaagtggcgacacccaaagcggtgtttgaggtgattggtcaaggcaatggtgcgttatctgcgttcattgatggcttggtgaaatccacgggcagacagattcatgtcaccaattatgccgaacacgccatcgatagcaaaacccatcaaaagaccgatacagataaccaaaccgatgccgccgctgccgcttatatccagctgtcggtagaggggcagatttattcaggcatcgccacttgccatagcactgtatccgccatgctaaaaggtgcattatccgctttggcacaggcgtggtaa

SEQ ID NO: 1479 - DNA, 732 bp, M.catarrhalis
gagaaattgatggaatttaaacaggctgttgagtatcgccgtgcggtgcgtgattatgactcaaatagaccgctagatccgacattggtgatcgattgcctaaagcttgcacagctatcacccagcagctcaaatatgcagttgtatgaattttatcatatcacaaaccccgatatgctcaaaaaacttaccaaagcttgcctgtcgcaacaagcagctgccagtgcatcacaaatggttgtttttgtgacacgccaagatttatatcgccaaagagccaaatcagcgttattatttgagcgtcataatatcaaaacctacagcccacccaagcggcaaggagccagaattcagcgtatgcaaaaatattatggcgtactaatgccaacaatttatcgtacaacttttggtgtaccaagtttacgcagtgcggcatttttagcaatccaaaaatttaaaccaacctatgatcgtgtatctgtggctgatgtgcgtattatggtgcataaaagctgtgcgttagctgctcaaacttttatgctggcaatgagtgcagcaggtgctgatacctgtccgatggaaggctttgacagtaagttggttaaaaatctactcaatttacccaaagaggctgaagttaatatgattatctcatgtggctatcgcaccgaaaaaggggtttggggtgagcgatttcgtgtgccttttgatgaggtttatcggcagatttaa

SEQ ID NO: 1480 - DNA, 993 bp, M.catarrhalis
ggaataatgatgaaaatattttgttttcgaccactggttggcgttgccttggtagccgtattagcctcattaatgactgcttgctcaaatgggcaatcaggcaatgagccaaaacttcaagagttgattattgcactagactgggtgccaaacacgaatcacacagggctatatgtcgcacttgatcaaggttattttaaagaagcgggttttgatgctaagattgtgcaaccaagtgaggacagtacttcaactttggttgcaaataagcgtgcagattttggtgtttattttcagccaaatatggttaagcgtctaaataaaggagaaccaattactgccgtggcggcgattacacagcacagcagtgcaggactgttatcgttagccaagcttggtgcagataagccccaagacttgcagggtaagcgttactcaacatgggaagatcctgttgatgatgccgtggttgaacagattgttggtacgccccttaagaaaatccccggtgaatctactgatgcaacgaccgcactacgcatgaatcagtttgattatattatggcgtactacagctgggatggtatccatgcagatattaaaggcgtggatacaaactttttttatttaaaagatgctgatccaatttttgactattatgcccctttattaattgcaaataatgatgagctaaaaaatcaccctgaaaaatataaaaaggcactggcggcaatcaaacaaggctatctatacgccgctcaccatccaaatgaaagtgctgaaatcttagttaagtatgcaccagagattaatgtagagcttgccaaacaaagccaagcatatatctcgccgcagtaccttgatgaacaaggtgattggggacgatttgactatgatcgttgggatcggttttttaattgggtttatcgcaagggtttgatgaatgaatttacgccaaaatcaggtgtgaccaatgattatttaactcaataa

SEQ ID NO: 1481 - DNA, 2637 bp, M.catarrhalis
gagactaagatgaataaaatttataaagtgaaaaaaaatgccgcaggtcacttggtggcatgttctgaatttgccaaaggtcataccaaaaaggcagttttgggcagtttattgattgttggaatattgggtatggcaacgacagcatctgcacaatcaaaaaaaggccaaggcgcgtacatcgctgctgaccagaatggcaacaaagccccaggcgagtactctttcgtcggtggtggctcgggtaacgaagccaaaggcaattactctaccgccagtggtggcgattataataccgccgaaggcaattactctaccgccagtggtggctcgggtaacgaagccaaaggcaattactctaccgccagtggtggcattactaacgaagccaaaggcgattactctaccgtcgcaggcggtgctaacaacaaagccataggcaagcactctaccgtcggtggtggcaatggcaacaaagccgaaggcatagactctaccgtcgcagggggcaagaataaccaagccacaggtgaaggttcatttgcagcaggtatagataacaaagccaatgccaaaaacgccgtcgccgtgggtaaaaagaacatcatcaaagatgaaaactcagtagccatcggctctaataataccgttgaacaaggtcaaaaaaatgtctttattcttggctctggcacaacaggtgtgacgagtaactcagtgctactgggtaatgagaccgctggcaaacaggcgaccactgttaagaatgccgaagtggatggtctaaacctaacaggatttgcaggggtgtcaaacgctggtaatggtactgtatctgtcggtagtcagggtaaagagcgtcaaatcgttaatgttggtgcaggtgatatcagtgccacctcaacagatgctgttaatggctcacagctatatgctttagccaaagttgttgctgacaactacaatgacattcttaacaacctagatgatatctacaatcttgatgatggtatcaaagatcttgatgatgaggtgggtttattaggcgaagagattaactcacttgagggtgaaatttttaacaaccaagatgccattgctaaaaaccaagcggatatcaaaacacttgaaagcaatgtcgaagaaggtttattggatctaagcggtcgcctgcttgatcagaaagcggatattgataataacatcaacaatatctatgagctggcacaacagcaagatcagcatagctctgatatcaaaacacttaaaaacaatgtcgaagaaggtttgttggatctaagcggtcgcctcattgatcaaaaagcagatcttacgaaagatatcaaaacacttgaaaataatgtcgaagaaggtttattggatctaagcggtcgcctcattgatcaaaaagcagatcttacgaaagatatcaaaacacttgaaaataatgtcgaagaaggtttattggatctaagcggtcgcctcattgatcaaaaagcagatattgctaaaaaccaagctgacattgctcaaaaccaaacagacatccaagatctggccgcttacaacgagctacaagatgcctatgccaaacagcaaacagacgcaattgacgctctaaataaagcaagctctgccaatactgatcgtattgctactgctgaattgggtatcgctgagaacaaaaaagacgctcagatcgccaaagcacaagccaatgaaaataaagacggcattgctaaaaaccaagctgatatccagttgcacgataaaaaaatcaccaatctaggtatccttcacagcatggttgcaagagcggtaggaaataacacacaaggtgttgctaccaacaaagctgacattgctaaaaaccaagcagatattgctaataacatcaaaaatatctatgagctggcacaacagcaagatcagcatagctctgatatcaaaaccttggcaaaagtaagtgctgccaatactgatcgtattgctaaaaacaaagctgaagctgatgcaagttttgaaacgctcaccaaaaatcaaaatactttgattgagcaaggtgaagcattggttgagcaaaataaagccatcaatcaagagcttgaagggtttgcggctcatgcagatgttcaagataagcaaattttacaaaaccaagctgatatcactaccaataagaccgctattgaacaaaatatcaatagaactgttgccaatgggtttgagattgagaaaaataaagctggtattgctaccaataagcaagagcttattcttcaaaatgatcgattaaatcgaattaatgagacaaataatcgtcaggatcagaagattgatcaattaggttatgcactaaaagagcagggtcagcattttaataatcgtattagtgctgttgagcgtcaaacagctggaggtattgcaaatgctatcgcaattgcaactttaccatcgcccagtagagcaggtgagcatcatgtcttatttggttcaggttatcacaatggtcaagctgcggtatcattgggcgcggctgggttaagtgatacaggaaaatcaacttataagattggtctaagctggtcagatgcaggtggattatctggtggtgttggtggcagttaccgctggaaataa

SEQ ID NO: 1482 - DNA, 786 bp, M.catarrhalis
aatagcctattatctgatttttatagccgatttatgcaccatttgatcacattgattcgccaatacagcttagtgctgattattttggtcatttggcaatttgtggtggcagtaggtatactgccagattatcttttgccaagtccttggcaaattctacacgcactcattgatgatgccaaacttttggcacatcatgccaaatacactttagccaccgcctttattggcactgttattggcctagcgttaagttttgtgttatcaattttgatggatctatcacgcaattttcgccaaagtgtgtacccactgatactactgaatcagaccattccaaccattgctatcgcaccacttttggtcatttggcttggctatggtattttacctaaagtggttttggtcgtgttatccgtgttttttccgatgactattgcactgcttgatggctatcgttctgttagtacggatgagttaaatttattttactccatgaaagccaacatttatcagacttatcggcatcttaagattccctcggcaatggggtatttttttacaggtcttaaagttgcactcagctatgcactgatttcagcggtggtggcagaatggcttgggggatattatggtttgggtgtgtatatgacccgagtgcgtaaatcctatgagcttgataacatgtttgcggtcatttttttgatcagttttttgacattggcgttaatcgcattggtgaaatggctggagcgtcatgtgcttgattatcaatataaggaataa

SEQ ID NO: 1483 - DNA, 483 bp, M.catarrhalis
aattccacattgggggctatgatgggcattatcgagattatccaaacaattgtattgtcatgtatcattactgtgggctggtgtttaatgtttacattgccaaagcaatacatcatgcattgcatgatggtaacagcacttggttttggtttaaaacaagtgatggtaatttttggtgtgcatttggttgtggcaacattctttggggcgatggcgggtagctttttgggtgtacattttgctcagcgtcatggcctgccacctaaagccttgattgtacctagcttgatttgtatgatgccgggaatcgctgcctataaagccatggttagcatggtacaaattggctattttggatttgatatggatttatttatcgttatgatgcgtcatttttttgaggcgatttttatcatctcagcattggttttggggctgtccattccaggtatcttatttgatcgtcgcaagccgattgtttag

SEQ ID NO: 1484 - DNA, 186 bp, M.catarrhalis
gcaaaaaaattaatatcggtatcgttgggggttattcctgatacccgttcggttcgagtatctaataaactgtgtatcggcattcatcacgatatcgatgttttgacaatcattgtggtgcaagacacttgtcaggggtgcagcagggcaagcggtacaaaatatgaacatcatgtttggttttaa

SEQ ID NO: 1485 - DNA, 894 bp, M.catarrhalis
acattaaaatctctgtatagtaaaagcatctcaagtggttttttgagtactcagacgccagataaattgaaaataaaaggatatttcatgttaacttacaaagcccctttgcgtgatattaaatttttaataaatgagatgcttgactatcaagcacattataaaacactggataatggtgctgccgcagatcctgagtcggtggatatgatcctagaaggctttgcagattttgctgaaaatatcttagcaccgctatatcagcctgccgatgccgaaggctgtacttttaaagatggagaggtgacgacaccaactggctttaaagaagcttatcagcaatttgttgaaggtggctggcaagcaatcagctacccagaaaaatttggtggcatgaacctacctatgtctttaaatctgattaaatcagaaatgatgggtactgccaactggccatgggcaatgtatcctggtttaacgacaggttctatcaataccatcttgcaatatggtgatgatgaacaaaaatccgtttatctgccaaaacttatctcaggtgagtggtctggtaccatgtgtttgacagaagcacagtgtggtactgatttaaatcagatgaaaactcgtgcggtaccaaatgcagatggcagttatgcaatcacaggcagtaaaattttcatttctgcaggcgagcatgatttgaccgagaatattgttcatatcgttttagcaagactgcctgatgcacctgcaggcactaaaggtatttcattgtttatcgtacccaaattcctaccaaatgctgacggtgaagcggataagagaaatgctgttgcctgcgggtctattgaacacaaaatgtcttcactatggtgtacgacggcgagacagtga

SEQ ID NO: 1486 - DNA, 753 bp, M.catarrhalis
  unsure (736),(738),(744),(745),(746),(747),(748),(749): Identity of nucleotide sequences at the above locations are unknown.
atggctatggcaaagttttatcagtatttcaatcgcaccttggtggcatcagatgatcgtatggatgatcgagcatttgcttttggtgatggattttttagcaccatcggcgtacgccaaggtcagatactttttgctcaactgcatcacatcagaatcacgcatggcttaactatttttaagcttaatttggatgttgatgagatgatgacttgcttaagtaagcttgcccatcaaatgacagaaggcatcataaaaattatcatcactcgaccaagacagagcatgcgtggctatggttttttgtcagtacagcccgcccaagtgttgattaaagtgatgccattagccatttatcaaggcgtatcgtttatcaaaggtgtacctatccagccaaccataccacgccaaatggtctgcttgacacacaagctatctcatcgcccaccacacttagcaggaattaagctgattggtgcaacagaacagatttttgcacacgcagagctactttatcatcagagcatggatgatggcattttagatggtttggttggcaatgtgcatggtgaatggatttgtgcgacgatggggaatgtgttttatcgtcttgggcagaattggtacacgccgttggttgataaatcaggtgttttgggggttatgcgatgtgccgttattcaaagtgggctggtcttcaccacggggctggaaggatccgacggtggtgctaggngntccatnnnnnngcac

SEQ ID NO: 1487 - DNA, 567 bp, M.catarrhalis
aattttattgatggcaatatcatgacaagcgaccaatctacgaacaacgccaacatcttcttcaaaaaaattcgtaaaacttggctgatctgggcaatcatcttggcggtatttgtgatattgtttttaacttttcgccccatgaccaaagatgacgcattggtcaaagatgatggcgaagttaaggtatatcagcctgtggtgtatgatactgccacatggcaaaaagccaccaagacaagcaatgagattgaatcactaaaagcacagcttggcagcactgccacaacagaagaggcacttgatttttatggtaggcgtgcgactcgttatcgctttagtacgccgtatgagccaccgttttatctcattgagtcagagaatttcttggaggtggtttggtattatgctgcgtccattgacgatgaggcaaccaaagcacagtctttagattttgccaagcgtgcttatcgtatgatgagcatgctgacaaaaatacaggcacacatgtcgtgcatcaaatacttcaaggtatcgctatgggatctcagcgtgttggtatgctga

SEQ ID NO: 1488 - DNA, 195 bp, M.catarrhalis
ggcaaccaaagcacagtctttagattttgccaagcgtgcttatcgtatgatgagcatgctgacaaaaatacaggcacacatgtcgtgcatcaaatacttcaaggtatcgctatgggatctcagcgtgttggtatgctgaatcttgagcaggcagattgtcaagattaccgttgccaaattatcttgcataaataa

SEQ ID NO: 1489 - DNA, 828 bp, M.catarrhalis
cctttaaccgttttagttgaccaaaaaatccaaatgatgcaacattttatcgttattggtaatcctatcgatcactcaaaaagtccacaaatccataccgcctttgcacgcagtgtcgggctgcctgtgagctatcaaaaacaatattgtcccaatgacgcagacagctttaccgccgttgtgtctgctttttttgctgggggcggtgtgggagcaaatattaccctaccctttaaagaaatggcatttgagatgattaaatcaaacggacgcctaagtacgcatgcccttgctgcaggtgcggtaaataccattttacaagaccaacaaggtctgtatggtgataacactgacggtcgtgggttggttgcagatttgtacgcacaggcaatcgagctggataataaaaaaattgctcttatcggtgcaggtggtgcggcacggggcgtcattttaccgctgctagaagcgggtgcacacatcagtatttttaatcgtacttttttgaaagcaacaaatttggtgaatgaatttcagtccgataaactcagcgctcattcacttgatgagctaaagactggtggtaaatttgatgtgattattaatgccacttctgccacaacaataggacaaatacttgatttgggcgactgctcagcaaattttgcctatgacatgatgtatggcaaaccatcagaatttttaacacattttaaacaacaaggtgctgatatctctgatggttttggtatgctaatccagcaagcaaaactgtcttttgaacaatggacgggcaaaacaatcgacttatcccaagtgcaattttga

SEQ ID NO: 1490 - DNA, 488 bp, M.catarrhalis
atattgtccccccggttccttccagccccgtggtgaagacagatgatatggatcaagtattagggcttgaaatgggggcggatgattatgtggcaaaacccgttcagccccgtgtgctattagctcgcattcgtgctttattgcgtcgctctgatactgtgccatctgatacctctccacaacgcttagagtttggtgatttggtcattgataatggtggtcgttcggttacgcttaatgacgaattggtagactttaccagcgctgaatatgatttgttgtggttgctggcatcaaatgcaggtcgaattttatctcgtgaagatatttttgaaagactccgtggtattgaatatgatggtcaagaccgttccattgatgtgcgtatttctcgcattcgccccaaaattggcgatgactcagaaaacccaaaacgcatcaaaaccgtacgcagtaaaggctatctatttgttaaagaaggcaattaa

SEQ ID NO: 1491 - DNA, 537 bp, M.catarrhalis
gtgttttttgcggttatcagcattttgccagagatgtttagtgctattaaagactatggcatcgtgggtcgtgcggttaaaaatggtcaagtgaatatccaagtcatcaacccaaggaattttacgacagataattataaacgcatagatgagcgtccttttggtggcggtcctggcatggtgatgatggcagaaccgcttgaaaaggcaattttatatgccaaagaattagctggcagggcaggctgcgatatccaaaatggcagatgccctgtggtatatctatcgccacaaggcaaaactttaagcgagcctttggttgccaccatgccaaatcttgatggcatgatactactgtgtggtcgatatgaaggcattgatgagcgattgattacttgctatgttgaccaagagatatctattggagattatgttctgacaggtggtgaactgcctgcgatggtattgatggatagcgtcattcggcgtcttcaccacggggctggaaggtccagcgagtggtgcgagcgggtgatt

SEQ ID NO: 1492 - DNA, 576 bp, M.catarrhalis
gtacttattaacttgtatatgaccaagccaaacctttgtaaaacaaatctggtacctgatgcttctgagatgattaagattgctaccttaaaaaaaccttacggcatcaaaggttggctctgggtttttagccagaccgacgaaagagccagcatttttcagatgcaaccttggtggatgaaaacggcaacagggtttaagccattaactgttaaagattggcgtatccaaggtcagggtttggttgcttgctttaatgaagtgcctgatcgcaatgttgctgaaacgatgaacggtacgagtatttgggtttgtaaagaccatttacctaagcttgctgatgatgaatattattggtcagatttgatcggtttgactgtgatgaatgagcaagcagaaaatcttggggttatcaaagagatgtttgagacaggcgctcatgagattatctcgcttaagccaacagcacagagcattgataatgaacctcgtttgatcccatggcatagcgatgtggtgctttcggttgatttgagtgctgggacgatgcttgtagcttggcagtctgattattag

SEQ ID NO: 1493 - DNA, 1509 bp, M.catarrhalis
atttttatcaaaatttgcttaaaaagctcggttcaagctgtgttaaaatacgcttgggcaaatcataggcagctggtcatgaataaaaacacgaataaaaaatttcgaatttttttagcaaaacttaattataaactgtattcgaatacgctacaaacattgctcatggtatgctttattgtctttgttagtgttgcattatccatatcattattttggagaagcctttatttgcctgagcttagaaaccatgccagttatttatccacggaaattaaactattaacctcagtgggcgataaatggcatgataatcctgaatttatgcaatggctaacagacaatacgcacattgaaatcatcaccaatccccaagattttccaagcatcaccgataaacctgtagttgtttatcttacccaaattatggcagaagaaatatcgcaatcacttggtcgtgaggtggaagtgtattttaaattcaaacccacccccaaactttggattcatgacagcgctcatcctgatatctggattcgtgagccgatgatgtattattcacagtacagcacaggcgttatttacggatttttatttggcttgccactactgaccattatgactattttagttttggtacgaggactaaaccgtcctttaaaaaaattagagcgtgctgcaaacaattatatccttcatggtcacgcaaccaccttacccacccaaacagggcccaatgaaattcgcaaagccaatacagcatttaatcggctctttacaaccctcaatcaagcccaaaaagaacgcactattatgcttgcaggtatcagtcatgatttgcgaacacctttaactcgtatgcggctgactgccgagatgctgcctgatgaatttttccgtgagggtttggtctatgacattgaagatatggatgccattttagaacaattcatctcttttatgaaagatggttctgatgagcctgttaaaccaaccaatttggatgcaatatttaaagaaattttggttcagtttgatggtattcagtttatttacaactcaaccattactcaacctgtgcctgtccgaactttatcaataaagcggttaattgtcaatttggtcaataacgccattcgctatggagagcagccaatacatttgatcgcaaaaatcatacccccagctcagaacacacaaaatgatcatatctttgatcactacccaacactggttttatgcgtcaaagatgaaggtgaaggcgttgctgaagaccaattggagcgaattatgcatccgtttgagcgtggtgagtctgctcgtaccacacaaggcagcggactgggtcttgccatcgtcagtcgcattgctcatctgcatcaaggtgtcgttgaggccatcaatcatcccaatggcgggctacaagtttgtatcaaaatcccgttaatgacccagattaatgatacgccaaatgatgattttgacactacgtcaactaatctggcttaa

SEQ ID NO: 1494 - DNA, 261 bp, M.catarrhalis
aagagagttatcatggtagttattcgtctagctcgtggcggttcaaaaaagcgtccattttatcaagttgttgttgctgataagcgcgcatctcgtgatggtcgttttatcgagaaaatcggcttttttaacccaatggcacgaggtcaagaagttgaaacccgcattgatttagaagcttataatgcttggattgccaaaggtgcacagccaacagagcgtgttgcttctttagtcaaagctttgaataaagctgcttaa

SEQ ID NO: 1495 - DNA, 1797 bp, M.catarrhalis
agaaggcaattaattcacggcattttgtttcgacaaagtgatgcgtgtgaagccagctattgctggctttcattttatcaggcgctgtttgatatgactttggttagttttacagaaagaagtatcttttttagaatttatgcaggacttttgcttgtctgcttatctgttgctttttttgcgtatctattggtagataccattaaccaagaacgggctcagtcttatcgagaaacagtggcaacgggcgttttttatttgattggtcaaggtgccattcatcaagaaaccaacgcccaaaaaaattattggttaaatgatatcagtgcgttatttgggagtaattttgaaattattcccatagatgctatcgaatttaaagccagagaaatgcgtcgcattgaagaggcaaaaactgttgtacggtacgatccttacaccaatcaatcaacattttaccatcgtcttgagggtactgatgagattttgacggtcaaattggctcaggttggtgagcgtcaagtgcgtgccatgaccatttttttgttagatgatttatcgtattttcatggttatgagcaaaaacaggctcgccttgaatatttgagtgaaaaattcagttatccgatttatcaacagtctatcaataatttgcatcttgaccatgatcaaattgccagactaaaacgggatgaattggtcatttcttatcaagatgggattcgaggtcaaaattctaccatgtcgttcattgttgcctcagaggtagaagatatggtaattgtagtcggtcctgtgactttatttaattggtttccgctgaatcttttggcaagtgttgcactgatttgtgttttattgattgcacttggcgtgtatgctttgatttttcctttagaaaggcgtcttcagttgctacaacttggtgttaatcgtgtggctcagggtaatcttgataccaaagttcaagtagtgggacaagatgacattgccagattgtcaatgacatttaatgccatgacagaacacatcaaacgcttgattgaatcacaaagagagcttactcgagcggtatcacacgaactgcgaacacctgttgcacgcattcgctttgcggtcgatatgcttgctgatacagacgatgaagactctcggcagctgcaaagacagtttattgatgaagatattgagtcgctcaatgaattgattgatgagattttgacttacgcaaagcttgaggagggttctccgaagcttgattgggagatggtgaatttgtgtgacctgaccgagcaaattgagcgtgaaaccaatgcattaggcaagcccattcaactgatttgtaaattaccacctgctaaagctgtggcgatggcagataggcggtatctacaccgtgtggttcaaaatttggttggtaatgcactgcgttatgcacaatcaaccatcatgctaagtgctggcgttgttaagggtgaggcgtttatcagtgttgaagatgatgggcatggtatttctgaggaaaatcgtgaaaaagtttttatcccatttgccagattagatgatagcagaactcgggcgtcgggtggttatggtttggggttgtctattgttagtcgaattgcattttggtttaatgccaagctatcggtagatgaaagcccaacgttgcatggtgcaaggttcattatgaaatggcctgcaaagcaagtgggtgttgtggttgcagccgatgagttgactcaagacagagttgaaaaaaccatccatcaaaaaggcagtattaagccagattag

SEQ ID NO: 1496 - DNA, 1182 bp, M.catarrhalis
acttacgcatctttcattatgggaattaggtcagtaattatgacaaaaaattatgcattattatccgtctcagataaaacgcaaatcgttgaatttgcccaaggtttggtagaatccggctttggtattttatccacaggtggtacttttaaactcttaaaagaacatgggattgacgccattgaggtttctgcccatacaggttttgctgaaatgatggatggtcgtgttaagaccctacatcccaaaattcacggtggtattttgggccgtcgtggcattgatgatgccattatgaatgaacatggcattgatcgcattgatatcgttgtcgtgaatttatatccatttgccaacacggtcgccaaagacggtgttgttatgtctgatgcgattgaaaatattgatattggtgggcctgctatggtacgctcagccgccaaaaatcatgcccatgttggtattatcaccagcccaaatgactactcacgcatcctagatgaactaaaaaaccaaggtcatttaagccacaacactcgttttgatttggcagtcaaagcatttgaacacactgccgcctatgatggtatgattgccagctggctaggtgcacgcttaccagtggataaagagacggcacccagtgatgatgccactgcaaccactcaattttcacgcacttttaatcaccaattcaccaaagcacaagagcttagatatggcgaaaacccacatcagtcagcagccttttatgtagatgatcatgcaacagaagcgtctgttgcgactgcacagcaattacaaggtaaagcgttgtcttataataatattgctgataccgatgcggcacttgagtgtgtcaaatcttttaccacgcctgcttgtgtgattgtcaaacatgccaatccttgtggtgttgcaacatcagaaaacggtattttagatgcttatcacttagcgtatgcaaccgaccctgaatctgcctttggtggcattattgcctttaaccgagaattagacagtgatacagcccgtaccatcgttgagcgtcaatttgttgaagtcatcatcgccccaagcatcgctgaaggtgttctagaaattacaagcagtaaaaaaaatgtacgcatcttggtatgtggtgagttgtcacagccgacacagcgggcagcttcaatttga

SEQ ID NO: 1497 - DNA, 198 bp, M.catarrhalis
acttgtaaatccaaacctgatagaacggtggttttaattttaccttcatcatacactttgctgatatttttggcgtgtaaaatggtcgccatgctaatccttattcatatcttaaagtttgtgcaggctgaatttttgacgcccttaacgcaggataaattgtcatcaaaaaacttaataaaaatgatgccgttgtaa

SEQ ID NO: 1498 - DNA, 387 bp, M.catarrhalis
aagttggtacccagcgtgtgcccatcgaaggccgagcttgatgatttgctctttgcttggaaagttgccaaatatgtcaaatccaatgccattgtttatgccaaaaatcatcaaaccattggcgtgggtgcaggtcaaatgagccgtgttaattcagcacgcattgctgcaattaaagcagaacatgcagggcttgttgttgagggtgcagtgatggcctctgatgcattcttccccttccgtgatggtattgataatgccgctgctgctggcatcaaatgcatcattcagccaggtggctcaatgcgtgatgcagaggtgattgccgctgctaatgagcatggtatcgccatggtctttacaggtatgcgtcatttccgccattga

SEQ ID NO: 1499 - DNA, 552 bp, M.catarrhalis
gccgtaccgtttcggccaatggtactaaagccgattcatgaaattgattttgcaggcgtgctatttgaaattttatccattgctcgccgtcatcgcatgagcattccaccgcagcttatgctactgcttaagacgctggttcatgtggaggggctgggtcgtgagctgtatcctgagctggatatttggtcacttgccaaaccaattttaaccgcttgggtcaaatctcaactagatcccatcaaaaatatacaagagctacaagctcgcctacctgaagtgctgctgtctaccacagacttacccaagctacttaaccaaagtctacaaagcttagccactttgggtgctcatcaagatgccctattacatgagatacaatcgctccgagccgatggactcaatgagcgtcgccatgactggattgctttggctgggtttatacttatgctggggatggcgtggtggtcagcattggcaattcatctatatctagccccgatattttttatactggcgattggggtgattctgtggcgtgtgctgctgtaa

SEQ ID NO: 1500 - DNA, 768 bp, M.catarrhalis
ttggtagctttaacccatcagtatttggggaatatgctgcgtggtgttgagcaggctttgtcaggtctgagcgtaggtcagatcagtcagcctgtccaaacaggatttggctatcatatttttaaggggactaaagtcagtaacgatacaccaaatattgcgagtatgcgtgatcaattgatggatagagctgccaaacttaagcgtgatcaagcctttgcagatttatctgccaagattaatacgatggcaactgacggcatgggcgtggctgatattgccaaagaagctggcgtacaagtcaagcaaatcattgcctatccacaaaccaacaatacgactgcattgccacagccagcagtaattgctgctgcttttgatgattttaccattcaagatcaaggcgtcagcccaaatatttctttgggtgagaaaaatgtttgggtacagccaaccaattatgaagcagaacgcccattgacatttgatgaagccaaagcacaaatcaaacagacacttgccaaacaaaaagccattgagcttgcgatggcagatgccaaaaaagtggctgatgaggctaaaaattcaggtgtgaccgctttgatgactacctctgccaatattggtatgaccacacgcatgaaccccttgttaagcccacttgagcttgccagtttattcttaaatcgcagtgcagaggggtatgatgtttgggcagtgcaaaccgaagaagggtgcaagtgtgatcgttggaggtgttgtcaatga

SEQ ID NO: 1501 - DNA, 228 bp, M.catarrhalis
aaaaatgatactatcgccgaaatggctggatttttcaagtcaaattatgacaccaaattggcaaaatggttaaattttatcacgattgctacccaaatgtgtaccaatcttgtaccaatctgttatgtctaccgttatgcccaaaaaccgccatcaaagccttttagcgtacgcatgaacttatggtataatctgaatatgacacgatcaaagggcgtgtttgcttga

SEQ ID NO: 1502 - DNA, 1755 bp, M.catarrhalis
attatgagtacacaaccaaccgaaaaaaatgattttattcgcacaattatccgtgatgacttggcatcgggtaagcatgacagtattttgacacgcttccctcctgagccaaatggatatttgcacattggacatgtgaaatcgatttgcctaaactttggcgtggcaaacgaatttggcggtgcgtgcaatttaagatttgatgacactaaccccaccgccgaaaaacaagattttgttgatggcattaaagaagatgtcagatggcttgggtttgaatgggcaggcgatgtacgctatgcatcgagctattttgatgaattatatggctgggcagtccaattaatcaaacaaggcgatgcatatgtagatttacaaagcattgatgaaatccgtgccaatcgtggctcgtttactgaggttggtgtgccatcaccacagcgtgatgccagtattgaggagaatttggctcgatttgaggatatgcgacaaggtaagtttgctgatggtgaagcggtattgcgtgctaaaattgatatgacgcacccgaatcttaatatgcgtgatcctgtgatttatcgtgttatgcatgctcaccaccatcaaacgggtgatcaatggtgtatttatccgatgtatgattttgcacatccattatctgatgcttatgaaggtattacccactctttatgtacacttgaatttgaagaccatcgcccattttatgattgggtcgtgcaaaaagttggctttgatgtgccgccacgccagtatgaatttagccgcctaaatattgaccacactctaacctcaaagcgtaagctcaagcggttggtagatatgggcgtggtatcaggttgggatgatcctcgtatgccaactgtggcaggtatgcgtcgccgaggctatacacctgaaggcttgagggatttttgtgaacgcataggcattaccaaatctgaggggctggtagatcatcgtatgcttgaatttagcgtgcgtaagtcgcttgaggagacgaccgctcgaggcatggcagttttgcgtcctttaaaggtgaccatcacaaattttgatgatgctgtctctaaatttaatgagcttaaaaatgaaaaaacactggcagaatttgatggtgaagcactttggctaactcagccgaagcatccgcatttgaacatgggggagcgtcaaattccttttaccaaaaccatctatattgatgccaccgattatgagattgagccgccagcaggctataagcgtctatcgccaaataatccagagattcgcctgcgtaacagctatatcctaaaagtcaatgagcataagacggatgatgcaggcaatgtgattgaattgattgcaacgattgatgaacatacactgggtaataaccctgaaggtcgcaaagtcaaaggcgttatccattgggtttctgccactcatggtgttacagctttcgtgcgtttatacgaccatttattgctagaagaagatgaaattgatgcatctttggcacagaatgctttaggggctgatgctgatgcgttttggattaacagacaccttaacccaaattcattgactgtatatcaagcggtggttgagcctgatttagcaaaagcagcggctggtgagcggtttcagtttgagcgtgaaagctattttattgccgatagtgttgagcatacgcaatcttcacccgtatttaatcaaatcgtaagcttaaaagacagctttaagcctgaataa

SEQ ID NO: 1503 - DNA, 258 bp, M.catarrhalis
taccgattgacgatatcggtcatgccaaacactgcccaatcaaacaaaagcaacgcatttatccaatatgtcatgagtaaatgtattaaatgtaaatataaatgtattaaatttaatcgtcaatcattcaatataacccaaaaaatccatcaaccaaaaaaagtaaaagagcaaaacaagcgtaaaaaccaaaacgccgcaccaatgattaaacaatccattattataccatgtcatcaagtgatacccaaaccatga

SEQ ID NO: 1504 - DNA, 240 bp, M.catarrhalis
agcacaattgctgcgttctgctctttaaattgttggataccgcccttttatttggcacaagacagcatcaataaagtctgtgatgatgaccaatctttaagtaatcatcaaaataaatcggatagccttgatattaaggttggatttgatatcaaggcaattttgtctatttgcgatgcaatttatctctatttgctatgcaatttatcaataatagcccaattcaccctgctaatttag

SEQ ID NO: 1505 - DNA, 981 bp, M.catarrhalis
ttaagccaagccatgtcaaattttaccaacaatcacccaaaacgcccaccatttcatcgtattggtgtaatggggcgtgcaggcaaagccagtattgtagaaacgctaaatgaactcattagactactgaaaatgcgtcaattatcgattgtcattgatgcacagacagcgaccattgagggcatcttgattgatggtgagcatacagatgacagcatcataatcacaccacgccacacgatgggtgagcagtgcgatttggtcatcgtggtgggcggtgatggctcaatgcttcaggcggcgtctgtgatggcaggtactggcgtgccagtgcttggtatcaatcgggggcgattgggatttttggcggatattaatccagatgagctgaccgaaaaagtcggacaggtgcttgatgggcaatattggctggttgagcgatttttattaaaacttcaaatcattcaaaatacgaccaatgacaatgcattgacacaagttttacatgaagatattgcgttaaatgatattgtcttacacgcaggcaagtcagttcacaccattgattttaaactaaaaattaataataaagatgtctatcggcagcatgcagatggtctgattgtcgcaacacccacaggctcaaccgcctacgcactgtcagcaggtgggccgattattcacccaacattagacgccatttgtttggtacccatgcatccacacacgctatctgaccgcccgcttgttgttgctggcagcagccaaattatgattaatattcataaagataaccgcacacagcctatggttggtgcagatggtaagacttctgtgcctttggaaaatgaccaaacgctcatcatcgccaaacatgataagacgcttttattactgcacccaaacagctatagcttttatgaagcgtgccgtacaaaattacattggaatttatacagtgaagagttttcactggattaa

SEQ ID NO: 1506 - DNA, 2091 bp, M.catarrhalis
tgccaaccttatcgccaagatacgcatgaagcgatgctcaaacgacaaaatcaccaaatgctcatacggctaggcattgcagctttgggtgcgatgcaggcgatgatgttttcgattgggatgtattttggtgcgtacagtggcattttggttgagcatcgtgattttttgcgttatgtttcgctgtttgttagtatccctgtctttttttattcaggtgtgccattttttatgtcggcttatcacgcactacgcacacgacaaattaatatggatgtgcctgtatcgattgccttaatcttgaccttttttgccagtttatacgccaccatcatcggtgcaggtgagacttattttgactcggtctccatgtttatcttttttttattggcaggacgatatattgaacacaacgctcgcctaaaagcatcaaatatggcatcagatttggtggtgattgagccgatattggtcaccaagcttgatgaggcgtctgatttggttcaagcacttgccaccgaccaagcacaggcagccattgaaacttggctggctaccaaaggcgatatggataaacgcatcagccaaatgggtcaagatgataacgccaaaattttggcccaaagtgtcaaagtcggtgatgtcatttggatcgaatcagggtgtcaaattgtggcagatggcgtcttattatccaaaactgcgaccgtctcccaaagcctattgacaggcgagagcgatttaatcgtcaaaactcgtggcgaaagattggctggcggttctcaaaatgacagccagccgctattaatgctggtaaccgatgatgttgataacagccaaattgcactcattgaccgcttgatgaatcgtgcgatgagcgaaaaaccccaaattgcccaagatgccgataaaatggcacgctggtttgtggcacgcgtacttttattgtcgcttttggtgtttgtggtttggtattttattgataagacccaagcgttgtgggcgacagtggcggttttggtggcaacttgcccttgtgcgttatcgcttgctaccccaattgcactgaccgtggcaaccaatcgcttggcaagctttgggtttttaccaactcgtggtcatacggtacaaactttggctaaggttagccatgtggcatttgataaaccagggccattgacccttgggcaggcaaatcttttggcggtggtgagcgattacccagatgatgatattttggcactggcagcagccttagagattggcagccgccaccctgttgcccaggcgattttgacagcggcacatgggctacatttgcctgctgttcaagagatgagccatcatatcgcaggcggtgtggaagcggtatctcagggcgtgcgttatcgtattggtcatgccagttttgttaccgaccaagcaagcagccagcctgactttgactatggacgctatcaagaaaatctggaggactatcaagccaatatgtcggtcctgttatcagcttggcaagatggcagttggcggctgattgcacggttttattttaatgacccgattcgtacagatgcccatcagatgattgagcaaatcaaatcatcaggcatgataccgctgatgctgacaggcgaccctaaccccaatgccctaaaagttgccaaaacgcttggcattgatcaggcgtattatgggctaaccccagaggataaagtgtcatacatcaagcaattacaacaagataatcacattgttttgatggttggcgatgggattaatgatgcgcctgttttggcggctgccaatgtctcaaccgccattgcaggtgccgcagatctcgcccaagtgtcaagtgatagcgttcttttgggcggtcggctgcactcgatacccaaagccattcatctttcaatcaaaacccaagccatcatccgccaaaatcttaaatgggcattggtttataatgcgttggtgctattgcctgcagcgtttggctatgtaccgccttggcttgcggcgattggcatgtcgttatcgagtttggtggtggtctcaaacgccatgcgtattaaaaaactaagtaaattttaa

SEQ ID NO: 1507 - DNA, 651 bp, M.catarrhalis
acaatccattattataccatgtcatcaagtgatacccaaaccatgaaccaatctgatcacaagccaaacccagacttagccacttttggcgatgatgagctgggtgagtacagtttaatcctaccgcctgcaggctgttgttttcattgtggggaagtgctacccaaagagccgttttttacgatgatatttgataagccacgccctatgtgctgtttggggtgtcagctggctgcccaaagcattgttgaggcggggctatcgcagtattatcttgaccgccgtgagattagcccaacggcaagcttacctgaagcgataaattttgatgcgtataatcatgccgatatcaaagagcagtttgtgtatgctgaaaatggtggcagcaccgctgagctatcggtgaccaatctgaaatgctcagcctgtacttggctgattgaaactcggctaaggtcgcttgatggggtgagggcgtgtcaggtgaatctaacacagcagcgtatgcgagtgaattgggatgatggtatcttatcgattggtgagattttaaaaacggttcattcagttggttatgatgccaaccttatcgccaagatacgcatgaagcgatgctcaaacgacaaaatcaccaaatgctcatacggctag

SEQ ID NO: 1508 - DNA, 507 bp, M.catarrhalis
atagtcagtcagattttgggcgtctattctcaatatcctttggtgttagatgctgcctttgtgccaacacgcacagggtggtatctgtggatgagtaccatagttttggttctactcatctgtttggctgtcggcttgtcatggtggcaatgggtaagtttgggtgtatgtacaggcgtattgattggtttttatgcttatcatcaaagatcaggcatccgtcagatgagtagccgtcagattgatggcgtttggctgttgtcttttcctatccgttcaaaacaagcggcaaccactcaagatgacccaaaagatacacatgtgatccatcaagcttatttacatgatatccgcttggttgatttgggattgagtttggttgtggtgataaatttttatgccatcagcccaagaaggcagccgttaagcgttattatctttgccgatcagaccgattcacacaatttttctaaattatctgcactggcaagactttaccaaaaatag

SEQ ID NO: 1509 - DNA, 369 bp, M.catarrhalis
aaggcgtgtctagtcggcttattcgcaaaaagcagtatccatctatttctaagcagttacggggtggtgcgttgtggtcgcctagctattttgcaggtagttgtggtggtgctccaattgagattatccgccagtatatcgaacagcaaaatacgccacactaaacagcggtcgatgcgtaagcataactatttaagttgccttatatccaccgcccaaagtcgcaggtttacggcaacggaggataaaaaagggctgatggtttcagccctttttgaatttttagtttatttgcttgctagccaaaaacgcccatggtattggcaacatataacaaagcaaatccaagcaaaaacatcaaaccgatga

SEQ ID NO: 1510 - DNA, 633 bp, M.catarrhalis
gttaacagccagttcaaaaagaaaattcaaaaagaaaataagcacatgaacgataaaattaaaattcagcaccccaagccttcagccaaagccaaaaaagcattgatttggattgatttggagatgacggggcttgatacccaacaagatgacattatagaaattgcaaccattgttactgatgatgagttaaatattcttgccgaaggccctgttttagccattaaggttagtgatgtggttttaaaccgcatggatgattggaataaaaaccagcacggacaatcagggctaattgaccgtgtccgccgaagcactataacgcttgctgatgctgaagcacagacgattgaatttttatctaaatgggtggatgcaggtatctcgccgatgtgcggtaattctatttgccaagaccgcagatttttagcacgccaaatgccaaagcttgagcgatattttcactatcgcaacttagatgtttcaagtatcaaagagctttgttaccgctggcgtcctgatattgccacaggctaccaaaaaacaggaacgcatttggcacttgacgatatccgtgattctattcgagagttgcgccactatcaagcacattttttcaaattgcttaattga

SEQ ID NO: 1511 - DNA, 684 bp, M.catarrhalis
ttcgcattacaaccaacatccatgcctaaaaataaactcaaagcctggctgcccactcccgaaaaactacgcaaaaaccgtttgattgcggtctttgcaccatttttggcagaccctcgactttggcagataaatcgcagctctttggggcgtgctgtttatgttggcgtgctggcggcattttttcctttgccaggccagatgccgctggcattacttggcgcactattcacccgagccaatattcccatggcgattgccttgacttggattaccaatcctttaacagccattcctatcttttggctggcatattctttgggcgcaatgctcttgggcgaacccatcattggacttcgtgccattgggataattttgactgattttacactttgggtgactgccgatggtatcaatccattcaccgcacaccgtcatattttttcatggcaagccatggcgattgggctatttttatctgcgattacaaccagtattgtacttggcttggcgtttcgtgctttttggaattatcgcactattaaagattggcaagctcgccacggctataacgccaacgcccccaaatttaagcatcaaaaaggtcataaacagcgtgaacaagacctaaaaaccagatacaaccacccaaaagacgataaaagcgatcatttctccatttaa

SEQ ID NO: 1512 - DNA, 690 bp, M.catarrhalis
atcaacctacagctatcgctctctaagggtcaaaagctcatcatagatgtctttgatggctacaacctaagtctatatcaaatcaacacgcttgagatagtacaagacagccgtaaccgttggtatgcctgcatcaccgtcaaagaataccctaaaacacaatgcggtacgggtagtgttggcatagacttaggtttaaaagacagtgcgaccacttcaaaaggtggcaaactcaccatcaaacaaaccctaaaatatgccaaagagttagccattgctcagcgtgcaggtaaaaagaagcgtgtacgggcaatctacgccaaaatcaaaaatacacgccaagacttaatccacaaattcaccacccaattagtcaaagacaatgccctaatcgtggttggtgacgttaaatcacgctcattcacgaacaagaaaaccaaactggcacaatcaacctatgatgcaggatggtttgaactcaaacgacaactggaatacaaatgcaagcatgcaggttgtcgttttgaaatcgtcaatgagaaatacactacccaaacttgctcgtgttgccgtcaaattgacagcaacagtccgaaaggtagagcaggtttgcgaataagagaatggacttgtgcaaagtgtggcacacggcatgattcagatttaacgccagtcggaacattcttgtag

SEQ ID NO: 1513 - DNA, 237 bp, M.catarrhalis
atcgcagtgcagaggggtatgatgtttgggcagtgcaaaccgaagaagggtgcaagtgtgatcgttggaggtgttgtcaatgacagcagcgaatcccagctttcagccaccgaccgtctgcgtgctgtggcggtgattcgagataatgtttgtgccgaccagttggaggactatgtgcattatttgcgtgaaagcagcgagcttgttatcaaccaagacgcactcaaggcacagtag

SEQ ID NO: 1514 - DNA, 888 bp, M.catarrhalis
actcaccttaaaaataacttgagcagacacatgacaaccaatcaccaaaatgaccaattcaccaatccaaatatcctacccactggcacgccccaaggtcaaagcgaacaacaacgcccccaaggcgaaaagccagccgatgacgagacgacccattttggctatcaaacagtgcataaatctgaaaaacaagccaaagttgccgaagtatttacctctgttgcccgcaaatatgatgtaatgaatgacttgatgagctttggtattcatcgcctatggaaacggtacgccatcagcttgacaggtgtacgcagcgggcaaagggttcttgacattgcaggcggtacaggtgatttggcgaaggtgtttagtcgtgaggtcggtcgctctgggcgtgtggtgttgtctgatattaatgaagcgatgcttgaggttggtcgcactcgtctgattaatgcaggctgtcataatgttgactttgtgcttgccaatgccgagacgcttgagccttttgaggataacagctttgatttggtaaccatcagttttgggctaagaaatgttaccgataaagataaagcactctctgccatgcaccgtgttttaaaaccaggtggtcgtctgctggtgcttgaattttcaaaacctgtatttgagcctttgtcaaaggcttatgatttatactcatttaccgccctacccatcatgggtaagattgtggcaggtgatgccgaaagctatcagtatttagccgaatcaatccgtatgcacccagaccaacaaacgctcaagcagatgatgcaaaatgctggctttgtcaattgtgattatcacaacctaacaggcggtattgttgcggttcatcgtggatttaaggcacgctcatga

SEQ ID NO: 1515 - DNA, 549 bp, M.catarrhalis
attttaattaatcatcaaatttttaaggaatttatcattatgaatatgaaatcatcattagtgctagtgatgctggcaggcttatcattgagtgcatgtaataaaaaagaagaaaccattgttcagcccaatgaacctgttaccgccacagctgatgctgctgtcgttgatgctaccgctaccactggtacgcaccagcctgaggttgctgttgttgatggtgtgggtgttgtattaccacaatcaacttatacaggtactttgccttgtgctgactgctctggcgttcaaactgacctaacgcttaactctgatggcacatttgtgatgaagcaggattatttgggcaagccgaacggtcaagtaaccactcaaggtacttatgacatcaatggcgtggataatcaatatgtcctactacaccctaatgatcatgctgacacgcctccttatttgatttatatggataaagacagtgttcaatttcgtgatttagaaaatggcgaaacaccgacacctagccacaccctgcttttggtcaatccttaa

SEQ ID NO: 1516 - DNA, 1155 bp, M.catarrhalis
ctaaaaactaagccgcccaccgatatgcttatcactcatcgcaaacgcttgttgtcattataccgcatcgcagccaaatatcgcttggatacacattttgctgatgtgccagaatttgcacccattgctcgcctgcttcgtgtgcatcctgcaagcttcggtcgctcacatcagcctttgggcgtcaagcttgcacttgaagaaatggggacgctgtttttaaagttgggtcaattattatccactcgttctgatttattacccccacagattatcgcacaattatccttattgcaagataaggttgccccatttgatgccaaaacagccattgccaccattgaacatgccaagtacggcttaggtcagccgattggggatatctttgctcgctttgatgagatacctttggccgctgccagtgtcgcacaagtacacactgccgccttacatgatggtcgtgaagtggttgttaaggttgtccgccccaatatcaaacaaggcatcatcgcagactttgagctattacggcaaatggcggcttgggcatctgcacgccttgaagcagctcgtgccatccatctgattgatgtggttgaagattatcgccaaattatgctcaatgagctggatttgacgcttgaggccgccaacagcaccaaaatgcgtcataattttacaggctctcggctgatttatgtacccgaagtgtatatgagtgccaaacaggtgatggtatctgaacgcatctttggcgtacccatctcccaaactgacttatttgatgcccttggttatgaccgtgctgcactggccaaaaaaggcttgaccatcttttttacccaagtatttcgtgataacttttttcatgccgatatgcacccaggcaatatttttgttgaaaccatgcctgatgggcgtgcggatgccgaaccacgctatattgggcttgattgtgctattatgggtgagctgtccaaagaagatcagctgattgttgcacgaatgctgttgtcagttatgaatgccaattacaccgcactggtggatatcatttggcaagcaggctggataccaccgtcagcggataaatatgcactgatgcgagatatgagccgtaccgtttcggccaatggtactaaagccgattcatga

SEQ ID NO: 1517 - DNA, 294 bp, M.catarrhalis
cccatgaataaacaagaaattctaaacagtctaacccctgaaattattgataaatttcgtactgccattgagattggtcgctgggaaaatggtgaaaggctgaccgatacacagcgtcaaacctgcatgcaggcggttatggtctgggaacatgagcatttgcccatcacagaacgcacaggctacattcacaggcctatcaaagaagatggaacggttatcggtgaggcatgtgatgttgagcatgaccaccattatcccaatgctgagcatgtggtgaagtttaagagttag

SEQ ID NO: 1518 - DNA, 606 bp, M.catarrhalis
ttgattaacaaccatatggagtatgttatgaaaagattatctttaattgcattattggcggtggcaggttttgctaacgcagcgacttatgagcttgatccttatcacaccaatgcgcgttttagcattgaccattttggcacctcaaccaatgtggcaggcttttatgagttatcaggtttgatgcagtttgaccgtgcagcaggcaaaggctcgattgatatcagcatcccagttagtagcctaactgcgtcttcatcactattcacacaacacctaaaaggggctgatttgttcaatattgagcaacacccaaccatgcgttttgtgtcaactaaattttatttcaaagggacgggcaaaaatcgtcagttacaatcagtgtcaggtaatttaactttgcttggtaaaacgcatcctgtcactttaacagcgactaaatttaactgttatcaaagcccaatgttaaatactgaggtttgtggtggtgattttacgacaaagattgaccgcaccaaatggggcatgaattatttggtagatatgggtatgcctaaagatgttcgtattgatattcaggtagaagctggtaaaaaagctcactaa

SEQ ID NO: 1519 - DNA, 1503 bp, M.catarrhalis
atgatgataaaaaaatccgtgcttgttttacttagctttttggcatttgccaacacatcacccagctatgccattgatgagctggtcattgcccaattaaccaacccatcagcagccaccgatgacaacaagcctgccaacaatgctgatgatacccccattgccagtcaagccacgccgattgatgatgcccaaatttatgataggatttatggcattttttctgaagtagatggattatcatcggtcaaagttaccgttaatcaaggtgttgtcaaattatctggcgaaaccgctaacgaaaaaaaagccactcaagcagtcaaattagccaatcgtatcagtggtgttgtcacggtagaagatgacatcagtcgtactttggatatccaagataatgtcacgcctgttgtgaatgatttggtcaatcaatcaaaagcaggactaaaagcattgcctttattattggtggcattattggcatttgccttggtggcatggcttggcggctggctgtctcgccgtgaaaaactttggcaacgcattacgccaaatccttttattgcagaacttttagcccaaacagttaaagtcatttttattgtgctaggtttgatactagccttgagcttgatgggtgcagaagccatcatcggtacgcttctgggcggtgctggggtgcttgggattgcagtgggttttgcggttaaagataccattgaaaactatatcgcttctttgatgctgagcattcgccaaccgtttcgggcaaaagaccatgtggtcattaacgatgaagaaggcattgtggtacgattgaccagccgtgccaccattttaatgaccttagatggcaatcatttacgactaccaaactcagaggtatttaaagcaaccattttgaattataccaaaaatcctgaaaggcgttttacctttgagctgggtgtggatgccaataacgacccattagcagcgattaaagtggggctagatgccatttatacactggattttgtcctaaaagaacctaaggcggttgctgttattaatgaggtgggcgactcaaatattattcttgagtttagagtatgggttgaccaaagtaaaacagacttttcaaaagctcgcagtatcgccattcgtgaaaccaagcatgctcttgaaaatcaaggctttagcttacctgaaccaatttatatgctaaactttgatcaagcattagaagatgcggttatcaatcttgcaactcatcttgtcccaaccgccccatcgcccaaaacgacgcctaatatttctatcgatgacaccgccccaatcggtgacaccgaacgccaaaaacaaattgccaaggtgcgtgccgaaaaaatactcaatgaaaattgcatgaatgatattttagataccgcacccgatccagaaatatggcacagagttgaggctgaaattcgcaatcgttcaggcgaaaaagatctattgagtaataatagcccacaagaataa

SEQ ID NO: 1520 - DNA, 282 bp, M.catarrhalis
gcggtatcaaacctaccaacccataagcgatacgccatgagccacaaacctaagccaacaccgctatatcaacaagttgagcagaccgccaagcgttattttgagacattgggcgacgctcatactcatgatgtctatgccacttttttggccgaatttgaaaaaccgctgctcatcgccgcactcaatcacacgcacggcaatcagtccaaaaccgcccaaatccttggcatcaatcgtggcacattacgcaccaaaatgaaaacccatcacttactttag

SEQ ID NO: 1521 - DNA, 675 bp, M.catarrhalis
tatatgtcaaaattaacttcggtagtggttgaacataatccatctgctcagcccatcacgcatacggtgatatggttgcatgggcttggtgccagtggccatgattttgaaccgattgtgcctaatcttggtttggcaaaagatactgctgttcgttttatttttccccatgccccaaaaatccctgtcaccattaataacggctatgtcatgcctgcttggtatgacattttggagatgagtttaaatcgtaaagtcgatgtggctcaaatcatatcttcaagtgcgatgattgatgagttgattgatgatgagattgccaaaggcattgatagccaaaatattattattgcagggttttcacaagggggtgcggtggcgtatcataatgttttaaccaattcacgcaagctgggcggacttttggcactgtcaacttattttgccacatttgaacacatccaatcaatcgcagtaaatcatcatattgctgttaagattgaccatggggaatttgatgacattgtccccaaaactttgggcatacaggcgatgcaccacttaaaatcacttggcttaactcccatttatgccacttatcccatggcccatcaggtctgtttgccacaaataacaagtattggcgattggctaaatgccttaattaaaagctga

SEQ ID NO: 1522 - DNA, 726 bp, M.catarrhalis
atttacttgaatttatcccatgatggctttatagtgatagtggacgatgattttatgatttgtcctattatactgacatttataacccacaaaagaaggaaaattgcaatggcattcactctaccagagttgggctacagctacgatgcactagagccacattttgacaaagaaacgatggaaattcaccattcacgccaccatcaagcttatgttaataacgccaatggtctgcttgaaggtactcagtgggcggataaatctgctgaagaggttatcgcaaatcttgaccaaatcccagcagacaaaagaacaggcgtcagaaataatgctggtggtcatgccaaccatagcctattttggaccattttaaaaacaggcacgactttgggcggatcattaaaagatgccatcgtgagagattttggttctgttgaagcattccaagaacagtttgaaaaagcagccgccagccgttttggttcaggttgggcgtggttggtacttgatgaaggttcgctaaaagttgtctcgaccgccaaccaagatagcccattgatgggtgaagcggtcgcaggctgcaagggatatcctatcattggtttggatgtgtgggagcatgcttattatctaaaataccaaaataaacgcccagattatatcaaagctttttgggaagtggttaactgggacgaagcacaaaagcgttttgactcagcaaactaa

SEQ ID NO: 1523 - DNA, 2451 bp, M.catarrhalis
tttgacttgaaaaatccagccatttcggcgatagtatcatttttttattggggttttattgtgtcaaaatccgtaccacgctctttttggcgtcatcagtcagggctgattgtgacagggattttattgattgtcttgtttgttatgatggcggcatttgtgctgtacgccatgcatctaaataccgccgttgtcggtaaatttgaaaatcgcaaatgggatattcctgccaccttatactcacgccctttggtactgcatcaaggtgccgctttatccgccaaagaccttgaatcatggctaaaactgctcagatatagccatgatgacaccagccaaacgggtcgctaccaaaaaaatggccaagtctacaccatttatacacgaggttttcattatggtgatgccgacaaagacccaaagcagctcatcgaagttcattttgatcgcaataccatcaaaagcctaaaaagctccgccccaaataacagcggtatactacgcctagaacccatcaaaatcggtagcatctatcctgataatctagaagaccgcctactcatcacacaagaacaaatcccaaaaccgctcgttgatgccttgattgccaccgaagaccgcaatttttatcaacatcatggcatatcaatgcgtggggttgctcgtgcgttattcaccaatctgacaggcggacaggtgcaacaaggcggttcaaccatcacccaacaattgattaaaaacttttatctggattctgaacgcaccttaaaacgcaaaatcaatgaagctttgatggcggttttattagaaacccattatagcaaagatgaaattttattggcttatatgaatgagattaatttgggtcaaaatggcaagcagtcggtgaatggctttgggattgctgcccagttttattttgataagccgcttggtgagctgtctttggagcagtatgcgttattggtgggtttggcaaaagggcctagccactataatcctcgcaaaaaccccgagcgagcattacaacgccgaaataccgtattaaatagcatgctggcaacaggtaaaattgatacggccacgcaccaagatgccatcaatcgcccactgggtgtggtaaaaacgcctgccatcgctcgcttgcagttccctgatttttttgatgccgtgcaacgagagctaaaaacccactaccgctcagaagacctgaaaaatcgtggtctgcgtatcatctcaacactagacccactcgcccagcaagtcgccgataccgccatgacaaatcagcttggcaaactaagaaaaaaaggcggtcgcactcaaaagctacaaggtgcgttggtcagtgctcaccctgccacaggggagctggttgctttggtggggtcaggtagcgattttactgggtttaatcgtgccatcgatgccaaacggcaggttggttctttattaaagcctgtgatttatctgactgcctttcaatcaggtcaatacaatctcaccacacccgtcaatgacacccaaaccagctataccgtcaatggtcgctcatggacacccaaaaattatggcggtcaatctcatggcagcgtaccactactgaccgcacttgccaagtcatacaaccaagcagcggttaatgtcggtatgcagcttggtttggatgcgtttaaggcacagctgggcaatttatccatcaccaccgatattccgccctatccatctgccatgctgggtgcgattgatttatcgcccatgcagatgctgggcatgtatcagatttttgccaatggcggtgcttatacgcccattcataccatccgtaccgtgatcgatgataacgggcgtgtactacaacgatcccaaccacgccatcagtttcgtgcaccaccgcaagcggtttatctgctgaaccgtggacttcaagaggtcatcaaatcaggcactgccaaagctgccgatagtatcaataaccatctgggattggcaggtaaaacaggcacaaccaacgataatcgtgatgcgtggtttgcagggtatagcggtaactatgtcagcgtggtttgggtgggccgtgatgataatcagcccatcggcttaacggggggttctggtgcattgcccatttggatggattatatgaaacgcctgaatttaacggcggtcaatctgcccctacctactggcgtgacttggcagtggatggatggcagattgggattgccgaccatggagagctgccctgatgccagatggttgcctgtgattgatttataccgcccaagccaaatgagtccttgtgccagtgccattttataccaagagcagatctatcggcagatgcttgaatatggctcacaaggcatcgcagacacaggagatgtgtatatcgaagatgcacccatttatgatgagcctgccgaagatggcgataatccttggtggtga

SEQ ID NO: 1524 - DNA, 1167 bp, M.catarrhalis
aatcttatgaactactcagtatttacctcagaatctgtgagtgaaggtcatccagataagatggcagaccaaatctctgatgcactgcttgatgccattttaacgcaagataaagatgcacgagttgcctgcgaaactttagtaaaaactggtgctgttgtcttagctggtgagattagcacccatgccaacattgatgttgaaacgattgtgcgtaatacagtcaataaaatcggctacaatcattcagatttgggctttgatggctcaacttgtgcggtgattaacatgattggcaaacagtcacctgaaatcgctcaaggtgttgatagacagcgtcctgaagatcaaggtgctggcgaccaaggcttaatgtttggctatgccaccaatgaaaccgatgttctaatgccagctccaattcagctgagccatcgactgatggagcgtcaagctcagttacgcaaagatggcactttgccttggctacgccccgatgccaaagctcaggtgacattgcgttatgatgaacatcatcaacctttggcggtagatgcactggtattatcaacccaacacaatcctgatattagccaaaaacagctccaagaagccgtcatggaagaaatcattaaaaaagtcattccatctcagctattacacaaagacacactatatcacatcaatccaacaggtaaatttgtcattggtggacctgtcggtgatgcaggtctgacaggtcgtaaaatcatcgtagatacttatggcggtatggcacgccacggtggcggtgcttttagcggtaaagacccatcaaaggttgatagaagtgcagcctatgcgggtcgttatgttgccaagaatattgttgcagcaggtctggcggagcgttgtgaggtacagatcagttatgccatcggtgtcgctgaaccaacctccatttcggtcaatacatttaatacaggtaaaattagcaacgctgatatcatcaagcttatccgaactcactttgatttacgcccttatggcattactggcatgcttaatttactacagccaatgtatgaaattaccgcaagttacggtcattttggtcgccaaggcgtagataccgcttttacttgggaaaaaacggataaagcacaattgctgcgttctgctctttaa

SEQ ID NO: 1525 - DNA, 528 bp, M.catarrhalis
tatcactatgaaaggaagtttatgagccaaaatctttggacgcatattcgcactgtgtcagattttccaaaggcaggtattgagttttatgatatcagcccactacttaatcaacacctaaatcagctgattgacgcattgattgatgcgttgccaagcgacatactggcggcaacggatgccttggttgcggttgagtctcgggggtttgtgcttgccagccttttggctgctcgccttgataaaggtttgattctcatcagaaaaacaggcaaactcccgccccctgtccatcgtgaaagctatggtttggaatatggcagtgatacgcttgagatcagctgcgaccttgaccctgccaatgtcttattggttgatgatgtgcttgccacaggcggtactttggtggctgccgataagctttgtaaggcagctggcttaactgcccttgggtcgttggtattgctagatttgactgagctgcatggtgatttgggattaaaatattggtgtgtcttaagtaaatag

SEQ ID NO: 1526 - DNA, 348 bp, M.catarrhalis
aagatgagtgacaatcaagaatttaatgaatcagaatttcaagatcaaatgcatgcattttttgagcgtgctgatgccgtcattacgcttgccaacagccagctttcgccatcatcgcacgcagggcaagtggcagccagcctaaattatgcagcggcaagatttgccatctcagcggcaaccattggctttatcaaaggcagtgatcttgccaaagaaaaagatgacattatcaaattttataccgaaaaatatcaacaaatgctcgctgaaaacttagaacagtatatcgaaaactttgaccaatacactcagcttgccaaaaacaatcccaatccatctttgtga

SEQ ID NO: 1527 - DNA, 933 bp, M.catarrhalis
taccttttctgcagaccaaatttaatctttcatctgacattatccgacggaatttatatgcacctgcctgatcatctgatccagctactcactcaatatctgaccgaacacacccaccaacccatcatcatcgaccctgcggttttggcttatcggtgggttggcggtacatcaggcaatcttgagccgattgagatcagctttggccgtagtttggtggatttgcttggcattgatacccaaaaaactaaactcatcaacaataccaagcagtttttggctcacctgcctgccaatcatgtactgatgacaggtacacgaggtgcaggcaaatcatcactggtgcgggcattgcttcaggcttatcattcccaaggactgcgtgtgattgcggttgccagagatgatttaaaacatcttggtaaaattcgtcatgccatcaaagagtcggtcaatcaaggcaataccaatcgctatcttgtttattgtgatgatttggcgttcaatgctcaagatgagaattaccgcaccctaaagtcaatcttagatggctcacttgatagcgagcatagtcagctacttgtctatgctaccagtaaccgccgccatctattgccacagatgatgaaagataatatcagtatttataatggtcaaactgatgaagtgaatccttatgaaaccattgatgagacagtatctttatccgaccgctttgggttatggctatcatttcagccaatgaaccaaccgttatacttacaaattgttgagcatgaactgacaaaggccaatatcgtctttgatgattttgcccaatctcaagccttacaatgggcgagcagtcgtggcggtcgttctggtcgcatcgcatatcagtttgctcaacattggattggtcaaactcgcctagcccaaggtgttagcggttga

SEQ ID NO: 1528 - DNA, 897 bp, M.catarrhalis
tttatgcagtggcgtggacgaagacaaagcaacaatatcgaagacagacgcagcggcggcgtcaaaaaagtcggcggcgtgagtatttttggcttaatcatcgccatcatcttatggcaggtatttggtatcagcccagagaccactttgggtgttgctcaacaaattcaaggacaagcaaccacggcccccactcatgaaaccgctgatatggcagagtccaaagcgtttgttgccacaattttggcagatactgaagatgtttggacgccaatttttgcccaattaggacaccactatcagccaccaagtttggttttgtttagcggtgctgtccaatctgcctgcgggtcagccacttcagccagtggtccattttattgccctgctgaccaaaaagtatatctagatacacagttttttcgtgatatgcgtacacaaatgggcattacaggcgaaaaaaaccataccgaactgacacgccaagaccaagccgctgattttgctcaagcgtatgtcatcgcccacgaggttggtcatcatgtccaaaccttgcttggtatttctcaacaagtacgccaagcccaaataaaagccaatcaaacggtagccaataatttatctgtacgcttagaattacaagcggattgctttgcaggtttatgggcacgccacaatcatgagcgtacacaatttttacaacaaggtgatattgaagaggctctagatgctgccgaaaaaatcggtgatgattacctacaacataaagcccatggccatgccgtcccagatagcttcactcatggaaccagtgcccagcgtaaaaactggttttataaaggctttgaaacaggtgatgtgcatcaatgtgataccttttctgcagaccaaatttaa

SEQ ID NO: 1529 - DNA, 954 bp, M.catarrhalis
agaccgggtcggctggttttggtaggtactttgataccgatggcttttttgggtgtgggtacctttggtggacacgccattcaaccaaatgagctaattaaagtcggtaatcaggtggtagatgtcgcaacctttcaagcggaggttaatgctgagcgtaatgctttgattgaacagggtgttgatgccagcttgattaatgaacacgcactacagcagctgattttaaagcgattaacggataaagcattgcttgaaaatcaggcgtcatatttgggtatgacggtctctgatgagatgattacgcagattttacaacattatgaagtttttcatgacaatgggcaattttcaaatgatcgttttgcagcttatctgcaacaaaacggactgaccaaagatgttttatttgccatagaacgactgcgattaagcttgcgtcagctgattactggtatcgttggtacggcaatttatccaaatagcgaagtctcaaaattgattgatttgcaattagaggcgcgtgaggtttgggtacatcgatatcattggcaggactatgttgatcaagtgcaaatcagcgatgcacaaattcaagcctattttgatgaacatcaagacaagttaatcaagcctgcgacagtggatctaagctatattgaattagacccaaatgtattgagtgttggtacgcccaccgaacaagagatcaatgcacagtacgccaactaccttcgagaaaatggcataacggatggtcgggagttggcacagattttattgacaggtccagatgctcaaaatcgtgctgccaaaatccaatcaaaactcaatgctggcgagtcatttgaagctttggcaaaagctcattctgatgatccaagtggctcaaatagtggtgtgattggtagctttaacccatcagtatttggggaatatgctgcgtggtgttga

SEQ ID NO: 1530 - DNA, 423 bp, M.catarrhalis
aaaacaaggcgtgccttggtcaaaaaacaaaagcccaaaatcaaaccaaagcaggacaaactcttagccaatgggctaaccagtaccattcatgcaacttatgaattcattcagcaaaagatggatttagaagagattgctgctaagcgtagtttggctgtttcaaccatcatcaatcatgtggcaagtattggtaaaatgatgggtgctgatgccatcgaagattatcgtccaactgatgaagtaatcaccgatattaaagatgcgatgcgtcatttggaggctcaaggcgaatttgccgatgggtttaaaattaagcccatttacgatgaacttcgtgaaaagtatagctataatgaaatacgcttggctttggcgtatattgatacctcaaagatggacgctgatcgtgataccaaataa

SEQ ID NO: 1531 - DNA, 183 bp, M.catarrhalis
tcagcgtttagcatactattgattaatcactttggcactgttgataatgataggctcattgggtacatcagcatgatagccaaaacgaccagttggcacgcctttgatttgatttaccacatccatgccatcaatcacttgaccaaaaacagtataaccccaaccttgtggtgttgggcttga

SEQ ID NO: 1532 - DNA, 690 bp, M.catarrhalis
ataaggattagcatggcgaccattttacacgccaaaaatatcagcaaagtgtatgatgaaggtaaaattaaaaccaccgttctatcaggtttggatttacaagttcaggcaggtgaacgcatcgccatcgtcggtagtagtggttctggcaaatcaaccatgctgcatttgctcggtggattggatacaccaagcacaggcgaggtttggctaaaagggcaatgtcttacccatcttaatgagactaagcgtggagagctgcgtaatcgctatttgggatttatttatcagttccatcatttgctggcagaatttaatgccactgaaaatgtggctctgccattgctgatgcgtcgtgatgtgagtatcaagcaggcaaccgatgaagcaaatgcactgcttcatcgggtaggacttgggcatcgattgcatcatcgacccagcgagctgtcaggtggtgaacgccagcgggtagccattgcacgtgctttggttacgaagcctgccttagtcatggcggatgaacctacaggtaacttagatgatgaaaatgcacaggcagtttttgagctacttagtgagcttcaggtatcttttggtatggcattattaatggtaacgcatgataggcatttggcatcccaagcagataaagtccttgagatgaaaagtggtcaatgggccaattaa

SEQ ID NO: 1533 - DNA, 810 bp, M.catarrhalis
ttaatcaatagtatgctaaacgctgattatttttttaccacaagaccgtctgatattcaggcggtttttgttagtgatttgcacttatcgccaatgacgccaagactaaccaaggcatttgttcatctgctagaagacctaaaaaacttacccaatctcaattcattgtatcttttgggggactggctggatgcgtggcttggtgatgacacctacacacggttatcagacgaccaaaaagccatacattggctataccctgtcattacagcactcaatgccttggcaaataatcatatacaaatccttgtcatgcgtggcaatcgtgattttatgattcgccaaacactttgtgatacttttaagggcgtactcattcaagaaccctatcccatcaacacgaccaaacaccgcattcgcttggagcatggtgatgcattatgcacagatgatacgagctatcagcgttatcgtgccatcatcaatcaccctatgacaagaatggtgttaaatcaattgcccttagcactgcgtaaaaagctggcaaataatatccaaaatcactcacaccatcaaaaatctcataaaccgccaaagatcatgaatgtaaacccatcagcggttgatgcagccatgacagattgcgatattttattgcatgggcatacacatcgcccaaatgtacatcatgatgaccgcaaaatacgcattgttttgggcgattggcgtgatgatggtcgtcacattcatgccgaaattggattgatgattggtgaagatctgcagcttgcacaatttaagtatggttaa

SEQ ID NO: 1534 - DNA, 216 bp, M.catarrhalis
tggatcttttttgaccaaaatactcattttataagcttatcaaaacggcttgttcggtttaatatccgcctgatatgtcattatcagataagtttgatgcataagttatctgatgattctgtgggcaataaaataagccataacagtcagttacggcttattttattgagcggtttgggattatctgctccaaaccatcactcagctgatttttga

SEQ ID NO: 1535 - DNA, 747 bp, M.catarrhalis
caaatttttattgaacaaggatatattatggccaaccctatcatcagccgtacaacacttgccaccagtgccgttgccatgagtgtgcgtggtgttgtcagtaaaaccgcttttttacttagcttagctgccgtttcaggatttggtgtatttttttatgccttatccatcaatgtctcatcatcgctattatatgccatggcattggtttcggtatttgctggcatgggcgtaggcttagccagtgccatgaagccgcatcttgccaaatcgcttgccattccttatgcactgattgaaggggtgctattgggtgcatttagcctaatcatgtaccgatactacccatccgtaccattatctgcattatcagcaacttttatcaccgctgctgttatgttgacgctgtatgccacaggcattatcaaagttaccgaaaaatttcgtgccatcgtaacctcggcggtgattgccattggtattttatatttggtgcagttgggttttcacctatttggttctagcctgcctttattatttgatgggggtatggttgccatcggctttagtgtttttgtgattttgattgcgtcgtttagcttattgcttgattttgacaatgttgaaaaaggcgtggcgtttggcgtggcacaagactatgaatgggtgtatggcatcggtattttatccacattggtttggatgtatatcgaatttttacgcctgattggctatttgcaagaataa

SEQ ID NO: 1536 - DNA, 519 bp, M.catarrhalis
ggatactttatggatatgcctgttgtagaatttgatacgacttttggtcaaattaaaattgaactaaatgccgaaaaagcacccatcacggttgccaattttttggattatgtggagtcaggtcattatgatggtctaatttttcatcgtgtgattgatggctttatgattcaaggcggtggtatggatgcacaaatgaacgaaaaacgcactggcacaccaatcaaaaatgaagcagataatggactaaaaaacaccatcggtagtattgccatggcacgaacttccgacccacattctgccactgcacaattttttattaatgtcaaagacaatgactttttaaaccattcaagcccaacaccacaaggttggggttatactgtttttggtcaagtgattgatggcatggatgtggtaaatcaaatcaaaggcgtgccaactggtcgttttggctatcatgctgatgtacccaatgagcctatcattatcaacagtgccaaagtgattaatcaatag

SEQ ID NO: 1537 - DNA, 987 bp, M.catarrhalis
gtagtaattatgagcaatcagaccattcgttataattatatgcacgaaacctcccccaccaaagttgatttaccccatgatgaaaatgccagccatggcgaccattgggcaattttgaccaatgacattacccaagatgtgccaaattggttacaggcaatgttagataaagcaaccttacccaaaggactttgcccacaaaatagtaccaataatgccaaactacttttgggtatgaatgaaccttgtcatatcaaacaaatcttaaccatcaaaaacggttctccccaagcttttattaatgcttttcctgcggttaatagcccctatggtttaacttgccaaattgagcgtatcattcgctgtgataccacatcagatgccattttgtgcctaaaaacgcctgatggtgcggtcatttatgcatttgaccaactgtatgccgtcaatcgcacagagtatcgtacacccaaaaaatactttgttaattttagtgcattggcgtatcatatcaagccaagcaaccaagaagaaacgattgtcattgaagaccaagaagccattcgccaccaccgcgcttttaatgatattgtcgcaaaaaatggcggtcaaatccctgatgatattgatgaaaaaatccgtcaatggcaaccaacagaccatgaatctggtaagccgtttgcacctgttgagattaatttggggcatatgtgtgcttatttatacggtgaaacctttggtcaagaagatgaagcttggtgtcaagggcaggttttgggcaaatcaagcacagaattttttggcaaaccgatgactttatttgatgtggtcattttgcgtgaacctgatgccgacccgtttgtggtgcgtattgcagctgtcagcactgagcaaacagacgccattcaggtgcatgattatattcaagcgaatatttggctacaagccgccatctatgaagtcaatcaaaaaccgcatcaaaagtag

SEQ ID NO: 1538 - DNA, 2832 bp, M.catarrhalis
gggtttgttatgcctaaatataagctgttatcagccagcatcgctttttcattattgatgagccatcaagcttatgctcatgatgaagcatttgataaactgtctacaaagatagctggccaaagtcagagctggtatcaacatcttgatgcccaggttgttacaccttttcccaaaaagggcactttggaagcagaagttgatcgtaaaatttcttgggatatgcaaaataatacaacagcagaaaggctcgcccttgcagaagaggataaaaatcaaagctttgctcatgttagccatgaatttagaaaatctgccttaaaggagtttgctccgcatataactgatgaacagtttgtaaatatctttaaaaatttagtatatttatcagccaatgctatctatagcgatgattttaatgtaggcagaatgagagcttatgattttattttaaaagacaaatatctgcgtggccgcccttatcaagtgatggatagggaaggcaagtatattgagggttatgaaaatctcaaaacctatattgatagccaaggcagagaaagaaaaaattcatcttatccaagtgggcatacctccaatggttttggtcaagcggttgtgatggcgatggcatttcctgagcgaggtcaagagatattctctcgtgcattgcagtatggagaaagccgagtcattgtgggtgcgcattttccaacagataccatgacttctcgactcgcacgctattattatatggcacagttgttaaatgacgatgagattgctcaagggttggttaggcatattaaacaagccagacagccatttgaagaaagctgtcagaatgcaccattaaaaagttgtctggagatgcttcctcaagatttgcacgaacaatacaaagcttctgattatcaaattggatattatggcacattaaaaagtgatgaaaaagcaagtcgtttaaaaccagaggaaatgcctagtacagctgacgctttattaaggttgcgttttaattatttggatggcgatgcacgacgccaagtattggcttctaccgcttatcccaaaaattcccatgctcacatgggtgatttggataataaaaatcacacatggggcctgatcaatttgccgaaagcttatgatggtatttctcatatttatcaggatatagagacaacgactcaggataagcatttggattttgcaggattttctttggaagatacctggaaaaatgacatctcaggtactggtagactgattttaaatcatccaggcgaattaaccttatctggcaataatacttttgctggtgcaaccgttaagcaaggccaccttaaatttacgggcaataacgcattggctgatgatagttatatcaatcaaggaacaatgagcgttacagggcaattccaatcaaaagtggtgctcaaccatgacgctaagatgatgattgtcggtcaaagtgatcaaccaaccactgttcaagagattgaactgtctgccaaagacagctggatttatgttgccccaaagggtgtttttcaagtcaatgcaaattcccaagaaaataacaccaccaccgattctcaaatcagtattcaaacattgtccggtgtaggtcatgtgatggttgaagaccattctaatttacatattgataagttatctggtgagacgatatttgccatcaatccaagcgatgcacctgtcaagataaatgagctaaaaggcaggcatggtattggtatcccaagccatatatcaaaagataaaaatcatcaaagcttattgaaagttgataacaatcaaggcagtttttatttgattgacacaaataacaatgttgttgatgcagctgagcaaggagcatatgcttatcaattagtaatgcgaccaaataacactttgcagcttagccaatttgccaatgacaatagccctattgcatcatcaatgactaagaccgccttaaataccggcatgggaagcttgtatacattaagtagccaaatgaatcatttaggctcgatgaataacagacaaagtgtttggctaaatcatcgttaccaagaaaataatattaaaagtcacaatacccagtttgatttaaagcttaatcaaacgacattgggagcaggttctaaagttgggcaaacatatcttggggcctatattaacaaaagtgaaggtgatgttgatcatgtttttggtggtaaaaatgatcttgatgcaacaggctttggtgtttatcttaatcgcttattaccaaatcaacaagagatcttcctccaaggcgcgtggcaaaatgtcagacaaaaaatacatgctaaacaagccaatcatgataatttaacagcaagtataaaggataatacctgggcgattgcgttgggtgctcagcagcagatgaaattccacaatgtggatttccaaccttcttttgaaattggccatattcaaaccaatccaaaatcgtttagatatgatcagatgcctaatttgcaaattaatccaaaaaaggcatctatgaccacggtaaatatcggtacaaaaatttccaagaattatgggttgttgcaaccttatttaaaagccaaaatgttctatcaagataccaagcaagatttgaacattattgatatgaataatgaagtatcttggtggtcaacggatttatcgggctttggtttcgcaggtgctttgggcgtgacaagtcaaatcaactctaggttctttatttcaggagaggcgtctgctcaatatcaagaggaggtaaaaacaccaattgaagcaaagctgtcgcttaactaccaattctaa

SEQ ID NO: 1539 - DNA, 6429 bp, M.catarrhalis
atcacatctataaagtcatctttaacaaagccacaggcacatttatggccgtggcggaatatgccaaatcccacagcacgggggggggatagctgtgctacagggcaagttagcagtgtatgcactctgagctttgcccgtattgccgcgctcgctgtcctcgtgatcggtgcgacgctcagtggcagtgcttatgctaaaggtgactatgctgtccaagttgctgacccaataaacgggctaggctctgcccaggcgacaaaggaagcatccgttgctattggtagtctttctaaggcactaggctctcaatctattgctatcggtggtggcaaaccaaataggaatcagccacaggataataacaaggtaggtccccacgccataggtgacgagtccatcgccatcggtggtgatgtaacggctcagggtgatgcctcgattgccatcggtagtgatgacttatatttgcagaagatcaaggatctgagtgaccagggccagacgccctatacaaaaattcaagaagctcttgaaggccatgtagaattaacaaaaatacaacaagaccctaaattacactttagacgcacattcgcacagggacacgccagtactgcagtgggaaccatggcacaggcagtgggtcatttttccaacgcttttggtacacgggcaacagctaaaggcaacttttccttggcagtgggtcttctcgccaacgccgaacaaggatatgcaatcgctattggttctaatgcacaagctaaaagttataactcactagcccttggtgtagatactaaagttgagttgggtcgaggtattgccctaggttataagtctcagatcaatgctggtaatcataataatggggttaatcaaacctataaaccagaaggtgaaacattaagcacaggtgctgaagtcaccaaaaacggtgatcagtatgatatattgtccattggtaacaacgatctcagacgtagaatcatcaatgtcggtgcaggttctcaggataccgatgcggtcaatgtggcacagcttaaagcggtggtgagctgggctgagaagcgtaaaattacttttaagggtgatgataacagtactggcattgagagaaaactgggcgagattttaaccattaaaggtggtgcagataccagagaattaaccgataaaaacatcggtgtggtaaaagataatggtaatggtggtggtctgcaagttaaacttgctaaaaacctaagcggtcttgatgcggttaataccaaaaccctaaccgccacgggtaaaattcaggtcaataataacggcaacaccgccgagctacaaagtgataatttaacctttactaccccacaaacaggtaaaaccgtctacagcattgatggattgaagtttactaatgataataatagtatagtaacagtcggcactactcgtattaccagagataaaattggctttactggggctagtggtgaacttgatgaaaatttaccatatttggataaagaacaacttcaagtgggtaaggttataattaccaaagacagtggtattaaagcaggtgatcaagaaatcaccgaggttaaatctgccattgctgacgcagctaatggacaagtagaccaaagctttattaatcgtttagaaactgctaataacagcaaatcaaaatatgccgccaccatcaaagacctgcatggcttatcacaagtacagctgacctttgcaggtgatacaggcacaacagctaaaaaactgggcgagattttaaccattaaaggtggtgcagataccagagaattaaccgataaaaacatcggtgtggtaaaagataatggtaatggtggtggtctgcaagttaaacttgctaaaaacctaagcggtcttgatgcggttaataccaaaaccctaaccgccacgggtaaaattcaggtcaataataacggcaacactgcccagcttttgggtggtggtttaacctttacccagcccaatataggcggtcaaaactcaggcaaaaccgtctatggcgttgatggggtgaagtttacggatagcagtggtaatacaccgcttgcaggcacaacttacatcaccaaagagaaaattggctttgctaagcaagatggttcacttgatgaaagcaaaccttatcttgataaagacaagcttaaagtgggtgaagttaaaattaccaaagacggcatcaatgcaggtggtaaagccatcacaggactgccctcaacactgcccaacactacctatactgcacctggcgtgcatactgcactacatggcagtacaatttctaacgacgacaaaacccgtgccgccagtatcgccgatgtgctaaacgcaggctttaacttggaaggtaatggtgaagcggttgactttgtctctacttatgacaccgtcaactttatcaatggcaatgccaccaccgctaaggtaacttatgataacaaaaccagtaaagtggcgtatgatgtcaatgtggatggtacaaccattcatctaacaggcactaatggcaagaaaaaccaaattggcgtaaaaaccaccacactgaccacaacaagtgctaaaggtaatacaccaattaactttaatgttaaacctggtgatgacgatgcccttgttaaagccagtgatatcaaagacaatttaaacaccctagctggtgaaattcgcaccgccaaaggcacagcaagcaccgccctacaaaccttctctattactgatgaacacggtaatcactttacggttggtaacccttactctagttatgacacctcaaagacctttgagaccgtcacctttgcaggtgaaaatggcattaccaccaaggtaaataaaggtaaagtcaaagttggtattgaccaaaccaaaggcttaaccacgcctaagctgaccgtgggtagtagtaatggcaaaggcattgtcattgacagtaaagatggtcaaaataccatcacaggactaagcaacactctaaccgatgccaccaacgcaacaacagggcatgtcagtgaaatccagggcttggcacaaggtgcaaacaaaacccgtgccgccagcattggtgatgtactaaacgcaggctttaacttgcaaggcaatggtgaagccaaagactttgtctccacttatgacaccgtcaactttatcgatggcaatgccaccaccgctaaggtgacctatgatgacacgaaacagaccagcacagtaacttatgatgtcaatgtggataataaaacccttgaagtgacaggcgataaaaaacttggcgtaaaaaccaccacactgaccaaaacaagtgctaatggtaatgcaaccaaatttagtgccgccgatggcgatgcccttgttaaagccagtgatatcgccactcatctaagtaccttggctggcgacatccaaaccgccaaaggggcaagccaagcaagcagctcagcaagctatgtggatgctgatggcaacaaggtcatctatgacagtaccgataagaagtactatcaagtcaatgaaaagggtcaagtggacaaaaccaaagaagtcaccaaagacaaactggtcgcccaagcccaaaccccagatggcacattggctcaaatgaatgtcaaatcagtcattaacaaagaacaagtaaatgatgccaataaaaagcaaggcatcaatgaagacaacgcctttgttaaaggacttgaaaaagccgcttctgataacaaaaccaaaaacgccgcagtaactgtgggtgatttaaatgccgttgcccaaacaccactgacctttgcaggggatacaggcacaacggctaaaaaactgggcgagactttgaccatcaaaggtgggcaaacagacaccaataagctaaccgataataacatcggtgtggtagcaggtactgatggcttcactgtcaaacttgccaaagacctaaccaatcttaacagcgttaatgcaggtggcaccagaattgatgaaaaaggcatctcttttgtagacgcaaacggtcaagccaaagcaaacacccctgtgctaagtgccaatgggctgaacatgggtggcaaacgcatcagtaacatcggtgcagctgttgatgataacgatgcggtgaactttaagcagtttaatgaagttgccaaaacggtcaacaacctaaacaaccaaagtaactcaggtgcgtcattaccctttgtggtaaccgatgccaatggcaagcccatcaatggcaccgatggcaagccccaaaaagccatcaagggcgccgatggtaaatactatcacgccaacgccaacggcgtacctgtggacaaagatggcaaccccatcaccgatgcggacaaacttgccaatctggcagctcatggcaaaccccttgatgcaggtcatcaagtggtggcaagcctaggcggcaactcagatgccatcaccctaaccaacatcaagtccactttgccacaaattgccacaccaaacacgggcaataacacaaatgcagggcaagcccaaagtctgcccagcctatcagcagcacagcaaagtaatgctgccagtgtcaaagatgtgctaaatgtaggctttaacttgcagaccaatcacaatcaagtggactttgtcaaagcctatgataccgtcaactttgtcaatggtacaggtgccgacatcacaagcgtgcgtagtgctgatggcacgatgagtaacatcaccgtcaacaccgccttagcagcaaccgatgatgatggcaatgtgcttatcaaagccaaagatggtaagttctacaaagcagacgacctcatgccaaacggctcactaaaagcaggcaaatcagccagtgatgccaaaactccaactggtctaagccttgttaaccccaatgctgataaaggcagtacaggcgatgcagtggctcttaataacttatcaaaagcggtatttaaatccaaagatggtacaactactaccacagtaagctctgatggcatcagtatccaaggcaaagataacagcagcatcaccctaagcaaagatgggctgaatgtaggcggtaaggtcatcagcaatgtgggtaaaggcacaaaagacaccgacgctgccaatgtacaacagttaaacgaagtacgcaacttgttgggtcttggtaatgctggtaatgataacgctgacggcaatcaggtaaacattgccgacatcaaaaaagacccaaattcaggttcatcatctaaccgcactgtcatcaaagcaggcacggtacttggcggtaaaggtaataacgataccgaaaaacttgccactggtggtgtacaagtgggcgtggataaagacggcaacgctaacggcgatttaagcaatgtttgggtcaaaacccaaaaagatggcagcaaaaaagccctgctcgccacttataacgccgcaggtcagaccaactatttgaccaacaaccccgcagaagccattgacagaataaatgaacaaggtatccgcttcttccatgtcaacgatggcaatcaagagcctgtggtacaagggcgtaacggcattgactcaagtgcctcaggcaagcactcagtggcgataggtttccaggccaaggcagatggtgaagccgccgttgccataggcagacaaacccaagcaggcaaccaatccatcgccatcggtgataacgcacaagccacgggcgatcaatccatcgccatcggtacaggcaatgtggtagcaggtaagcactctggtgccatcggcgacccaagcactgttaaggctgataacagttacagtgtgggtaataacaaccagtttaccgatgccactcaaaccgatgtctttggtgtgggcaataacatcaccgtgaccgaaagtaactcggttgccttaggttcaaactctgccatcagtgcaggcacacacgcaggcacacaagccaaaaaatctgacggcacagcaggtacaaccaccacagcaggtgcaacaggtacggttaaaggctttgctggacaaacggcggttggtgcggtctccgtgggtgcctcaggtgctgaacgccgtatccaaaatgtggcagcaggtgaggtcagtgccaccagcaccgatgcggtcaatggtagccagttgtacaaagccacccaaagcattgccaacgcaaccaatgagcttgaccatcgtatccaccaaaacgaaaataaggccaatgcagggatttcatcagcgatggcgatggcgtccatgccacaagcctacattcctggcagatccatggttaccgggggtattgccacccacaacggtcaaggtgcggtggcagtgggactgtcgaagctgtcggataatggtcaatgggtatttaaaatcaatggttcagccgatacccaaggccatgtaggggcggcagttggtgcaggttttcacttttaa

SEQ ID NO: 1540 - DNA, 654 bp, M.catarrhalis
ggcacgctcatgatgattggggtgctgtcgcttgctgtgggtgaaaagctggtcaataccgccatcggcctagacccattgatacagtctgaattaaaaaacttatcaggtaagacgctgcgtgtgatgatgcggtcaccaaatctatccgttgatgtgttatttggtgatgagcgtgtgcgtcttgaacctgcttttgagccgatttttgagccacaaggcggtatttatcccaatccgcctgagtgtaccttaacggttgataatcccaagaatctattaaccctccttcaaaatccaacaggcaatttgccaattcaaggcgaccatcagattttaatgcgtaccaaatacatgcttgagcaatgtcatcctgacatttggtcttggctagagcggttgattgggcaagatgcggttagtcagttgtattttattggtcaagagatttcccctttatcagcccccatcatcaatcacattaagcaagctttggcaagctttgtatcacaccaggcatcttccaatgaaagcgactttatcgatcagacgcttcaggataaaaaacaaaccctgcttcgcctacaaagtgagattgaacgcagtcaagccaaattagcagaaatccaaaatacccttaaccaaaataactaa

SEQ ID NO: 1541 - DNA, 276 bp, M.catarrhalis
ggaaacaccatgaccattcagcccactgatgcacagcgccgtatcatctatcaagctcgccgtggtctcaaagaattggatttttatattgattattatgtcaaatcgcattatttgagtgcagacgcagatgagcagcaggcatttgagacattgttaagttatgaagatccagatttattggtgttttttttgggtcaagaaacgccatcagaggcaggtgttgctgctttgattgacaagatgaaatcacttcgtcatactggcactgtctag

SEQ ID NO: 1542 - DNA, 1359 bp, M.catarrhalis
aatcatttaataccacaaagatatcattcattattggcaacactaaaatttatctttaaccatggtatcaaaccacagttatcgtcaggaacactcatgaccactcaaataaaaagccattatcttggtaggattagtaagattaattggaaggcctttggccctggaattttgatggcatcggctgccattggtgcatcgcatttggtgtcatcaacacaagcgggggcattattcggctggcaacttgccattgtcattattttggccaatgtgctgaagtatcctttttttcgttttggcatcgattatgtgtatgacacaggcgacagtctgattgcaggttatgccaaaaaatccaaagtctatctttgggtgtattttattttatcagtcatctcctccatcatcactttggcggcggttgggctcatgtcagcggtgattttaacctttatgtttccaagtttgggtctaacgcctttaacagcgtcggtcattgtgctggcgatttcttgggtgttgttgattgctgggcgttacaatgtgttagatggcataaccaaaatcatcattttggcgttggcgataaccacggttgcagcggtgtttatcgcagcaggcaaacccaccgtcatggcggtggattttgttgagcctagcccttggaatctggcaagtttgagctttattgtggtggtggtcggctggatgcctgcgccgcttgaattttctgtgattacttctatgtggacggctaaaaaaatccaaactgaccacaccactcacgaacaaggacgattggattttaatgtgggtttcgccacatcaaccatcttagcggtgctttttttggcattgggtgtgtatgttcagtacggttcagggcaagagattcaaaccgctggcagtgcttatgttgggcaattgattgacatgtacactgccaccattggtgaatggtcacggttgttggtggcatttattgcgtttatgtgtatgtttagtaccaccctcacctcaggtgacggttatgggcgtgccaatgctgaatgctggcgattgataaagggtgagcatgaaatcagccgtggtcagttgatattttggatatcgtgggcggtgtttggtgggtttattatcattgctttttttgaaggtcagcttagtaatatgctcaaatttgccatgagttctgcgtttgtgtctgcacctgtttttgcgtggctaaactactctttggtacgctcagaacaaaagctgtcatccggcattcaagcgttgtcaatcatcggtttgatgtttttgcttggatttgctttgttatatgttgccaataccatgggcgtttttggctag

SEQ ID NO: 1543 - DNA, 444 bp, M.catarrhalis
aaaaatccaatcatactcaaacccatgaaaacactcaagctacgcatcaaagacaaacacacaaaccaactaaaccgcctaagcggttcggtcaatttcgtgtggaattatgtcaatgacttgggttacaagtacctacaaaagactggtaaattctttagtgcttacgacctaaacgaatataccaaaggcaacggtgagttattgggcttacactctcaaaccattcaagccatcaacgaaacccatgccaaaagccgaaagcaatttaaaaaagccaaactcaactggcgaaccaaccgacccaatgccaaacacaagagcctaggctggataccctttaaaaagtctgctattaagtatctaagcacaagacaaacaggcaaaaaagcacttaaatcaacctacagctatcgctctctaagggtcaaaagctcatcatag

SEQ ID NO: 1544 - DNA, 1362 bp, M.catarrhalis
tcaaatacaataaatcaagttgacgctatgaaacaagagaccgcccttgcgattttaaagacagggcaaaatgtttttttgacaggtcaagcaggtgcaggaaaaacctatgtactcaatcagtacattgaatatttgcgagtgcgacaaatccctgtcgcagtcacagccagcactggtatcgcatcaacgcacatgaatggtatgacagttcatgcatggtcgggcattggtatccaaaatgagtttgagaaagtcaatctgcaaaggcttgccgcccgtgatgaatatcttgaacgcatcaaaaacaccaaggtactcatcatcgatgaaatctcaatgcttcacagtaagcaagttgataccatcaatcaagttttaaagtattttcgaaaaaatgagatgccttttgggggcgttcaggtaattttttcaggtgatttttttcagctgccaccaattggcgataagggtgaaacatcaaaagaaaaatacgcctttatgtcgcaggcttggtgtgagtgtaaatttcaaatctgttatctcaccgagcagcatcgccaaacaggcactgatgaaaaacagcgttttggcttatctttgaatgatattttaaatcaaatccgtcgccaatcggtgacacagcaggcgattaatatcctgacatccacccaaaatcataccattgacttgaaccgcaccagactttatacgcataatgctgatgtggatgtcatcaatcaaacacagctcaatgaattgactgccaagaccataacttatcgtgccgctaaaatgggtgaaaaacccttgcaagaatcactgtcaaagagtgtgcgtgcccccgatgagctgacggttgcaattggtgctaaggtcatgtttgtcaaaaatttgccccttttgggtgtgtataatggcacgatgggcgaagtggttggctttattggcgtatcaggtaaagcctataaagctactgatgctgacatctctgaaaccgcctatcccttggttcggctcaatactggtggagaggttgctgcagagcctgaagagtggacagtggaggataaggatggcactgtattggcaagttatacccaagtgcctttatgtttggcttgggcgatcacagtgcataagtcccaaggcatgactctagacgctgccgaaattgatttatctaagacctttgagatggggcaaggctatgttgcactttctcgcttacggtcattagatgggctaaaactgctgggttttaatatcaaaagtttattgctggatgaatgggtgcaacgcgttgatcagccgattattgagctgtcttttgagcatgcccaaagcgttttaaatgtttga

SEQ ID NO: 1545 - DNA, 1071 bp, M.catarrhalis
ggaattgtgatgacaaagattttatttttggtgacagggatgacgccacaaattatcaccgaaacgatatgggcattggcatgtgaccctgagttaccccatcaagaacgctttattcctgatgagattcatgtattaagtaccgatgatggtctaaaccaaattcgctctcgtttgtttagtgaaaaacaaggctctaaatttgctcaattccaagaagaatatccgcagcttgccaatatcaattttgatgacagtgatgattatttgcatgtcatcaaagaccgtgatggcaatatcttaaaggatttaaaaaccccaaaggataatgagctggcagcggacttgatttgtcaggggagatttatggatacaccgtttgatgctcatcgccatgaagatggcaaaggcattgttattattgttccttatggtcggctatattacgccccgcattattttgatgagcagacagcggatgcatatttggattatttcttagaaagtcaaatcggtggtaagcccatcaatcaccgcacacacaactggcatcatactgatttgaatatggtgcagtttcgtcacattcattggcaacaagacaccatcaaaatgtatggtaaagtacacaagctaccacgcatctcagcatggtatggcgataatgattgcccttatacttattctggcatcaccctaaacccaaatccatggacagaccgattgctcatgctcaatgatgagcttggaaaaatatgcaaaagacgatttaacagtgtattgatgaactggtatcgctcaggtgaagattatatcaactggcataaggacgacgaaaaagaattgggtaacaaccccttgattgcttcggtaaattttggtgagtctcggcggtttttactgcgtttatgcgacaatcatacgcttaagcttgaactacttttacatcatgggagtattttggtgatggcaggtcagttgcagcatttttggcagcacagcattcctaagcaaaaaaagatactaggcagccgagtgaatttaacctttagaaatattatcggtaattag

SEQ ID NO: 1546 - DNA, 1278 bp, M.catarrhalis
actagcacgattgtatcgtttggaacacagcttatgtttcgtcccttggcgttatttattgggcttagatataccaaagctaagcgtaaaaatggctttatttcctttatttcttttatctcaaccattgggcttacgcttggggttgcagtgcttatcacggttttgtcggtcatgaatggctttgaccgtgaaattaaatcacgcattcttggcatggtgcctcaagcttcagttacctcaacagaaattttgacaaattggcaagaacttgccgaaaaaatcaaaatgcaaaatccagaagtgcaagcagttgccccttatattcaactacaaggtatgttaaccgctgaaggtcaggtgactggaatcgtggtttctggcattgagcctgattacgaaaagcaagtttctatcattgatgagcatatgaccgcaggcaatttggatgatttacatatcggcgagtttggtattatattaggtgagtccattgtctctgacatgggacttaagttgggggataaggttaccttggttttgcctgaagcctcaccctcatcagcaggcgttattccacgatttaagcggtttactttggtgggggtatatcatatcagcagcgaaattgatggcatgatgggttttgtgcggatgcgtgatgctggcgtgatgcttcggttgcccgaaggtgcacaaggtctgcgtatgaagctaaacgatatttttaaagcgcctcaagtggcaaataatgcagcgggcattgactcattgccattattcccaagcgattggacaaccacacacggtaatttatttagtgccatccaaatggaaaaagcaatgattggacttttgttgtttttgattgtggttgttgcggcatttaatatcgtctcaagtcttgttatgctggtgactgataaaaaatcagacatcgccattttaaagacatttggtgcatcacccaagcttattatgcaagtatttatggtacaaggcatgattattggtgtgattggtacagttgttggtacagtgcttggcgtggcattggctttgtcaattaatgatattttattatttgtgagccgtatttttggcgtaagtttatttgatggcagtgtgtatgctgttgattttttaccctctaagattgaaattgtggatgtggtattaattacaacggcatcatttttattaagttttttgatgacaatttatcctgcgttaagggcgtcaaaaattcagcctgcacaaactttaagatatgaataa

SEQ ID NO: 1547 - DNA, 951 bp, M.catarrhalis
atttttaggatgtttattatgtcttggcaacaacttcatctacaatgcccaaaatccgccgtagaacttgccgaagccttatttgatgaggctggtgcggtgtctattttacttgaagatgcgggcgatgagcctttatttgagcccatgcctggtgaagagcctttgtggcgtgatgtggtggttaccgccatctttgacaccaacagcgatgacagctgggcaggcactcattttgaaaacctagccgctaagatcgcaagtgaggtgaatgccacacgattttggctaacatccttagatgataaagactggactcgtgaatggatgagctattatcagccgattcagtgtgcaggcaatctgtggattgtgcctgagtggctgccagcgccagacccagcggcgattaacctaatcttagacccagggcttgcctttggcacaggctatcacgccaccactcggctatgcctagattggcttgccgcccaagagcttagcgataagctggtcattgactatggttgtggctcagggattttgggcgtggcggcactgctgctcggcgcgcgtcaagtgctggcggttgatattgacccacaagcggtactcgccacacgccaaaacgctgccctaaatggcgtcgatgatcggcttttggcatttttgcccgcagagtttgacgcctaccgcacccaaaacccacagcttgccgatgtcatcaccgccaatatccttgccaagccattgatcggctttgccccactgtttcatgatttactcaaaacaggcggcttgattgtgctggctggcctgacccaaaaccaaacccaagcggtcatcgatgcctactcgccttatattacgcttgatgtgccattttgttatgcagatgcccaagactgccattggcaacgcctaagcggtatcaaacctaccaacccataa

SEQ ID NO: 1548 - DNA, 228 bp, M.catarrhalis
tcgtggttggtgacgttaaatcacgctcattcacgaacaagaaaaccaaactggcacaatcaacctatgatgcaggatggtttgaactcaaacgacaactggaatacaaatgcaagcatgcaggttgtcgttttgaaatcgtcaatgagaaatacactacccaaacttgctcgtgttgccgtcaaattgacagcaacagtccgaaaggtagagcaggtttgcgaataa

SEQ ID NO: 1549 - DNA, 228 bp, M.catarrhalis
aggcttggggtgctgaattttaattttatcgttcatgtgcttattttctttttgaattttctttttgaactggctgttaactcacttttggcattgtatcacagtcatcacaatctcgccatcattggccaaaatttccccacaataaccgtacaaccatcgttttatacccaaaaatttgttataattcacgacttaattcgcattacaaccaacatccatgcctaa

SEQ ID NO: 1550 - DNA, 1254 bp, M.catarrhalis
tcaccgatattaaagatgcgatgcgtcatttggaggctcaaggcgaatttgccgatgggtttaaaattaagcccatttacgatgaacttcgtgaaaagtatagctataatgaaatacgcttggctttggcgtatattgatacctcaaagatggacgctgatcgtgataccaaataacccacatcatcgagcaaatgtaccaaaattacgcttggccatcaatggttttggtcgcattgggcgtaatgtacttcgagcttatctgcaacagttaagtacttttggtcatattgaaattgtcgccattaatgatattgccgataaccaaatgcttttgcatttattaaaatttgacagcacgcatgggcgttttgatcaaggtgatcataatgcagcacaggtttcattaacgaccaatcaagataactcatatttgacgatcacaaaaggcgagttattacatcagattcttttgctaagctgtgatgagccaaagtatttgccttgggcagatctgaatgtcgatgttgtgctggagtgcacaggtcaatttcgttcctatgccgatgccaatcgccatcgcacagcgggcgcaaagcaagtgattattggtgcagcaccatttgatcgtgttgatgccagtattgtcattggggtcaatgatcacaagcttcatgctgatttgccaattatctcaggggtgtcttgtacgacacaagctttagtacctctattatctgtacttgatgataaatttggtatccaaagtgctatgatgactgagatccatgccgtaacagcagaccaaagcgtattagaccaagcacaccgtgattttcgccgtgcccgtgccagtggtcataatatcattcccacaacatccagtagcattaatgccaccgaacgagtgttacctctgatgcgtggtaaaattaatgggcattccatccgagttccaacaattaatgttgctgcgattgatttgactgtcaaatttaacaaaacagtgagcttagatcagattaaagatgcattgatgacagccagtcaaaaccagcttttgggcatcatggattattgtgatgaacctttggtatctagtgattttattggtaatagccattccttgattatcgatggacagcagttgatgatggcaggtgagcttgctaagatttatgcttggtatgataatgaatggggttatgccaaccgtttgcttgatatgtgtcaaaagctggcagacttaaggtag

SEQ ID NO: 1551 - DNA, 444 bp, M.catarrhalis
ttggatttttctattttacagttgtctaattgtatgtcaaatgatttaagatgtggtaggcacgttgtttacaatctgcatgtacatttggtctttgtggctaaatatcgtagaaaagtgtttaccaaagagattctagacgatatgcaaggcatttttgaggaagtctgctcaaagtttgaagctcaattggtggagtttgacggtgaatgcgaccatgtgcatttattggtggtttatccgcctagggtggctatttcaagtttagttaatagtttgaaaggcgtgtctagtcggcttattcgcaaaaagcagtatccatctatttctaagcagttacggggtggtgcgttgtggtcgcctagctattttgcaggtagttgtggtggtgctccaattgagattatccgccagtatatcgaacagcaaaatacgccacactaa

SEQ ID NO: 1552 - DNA, 2442 bp, M.catarrhalis
gacgcggcacctttcaatcgcgtggtgaagaccagtgcaatgacaatggctgtcatgatggtaatgtcaactcatgcacaagcggcggattttatggcaaatgacattgccatcacaggactacagcgagtgaccattgaaagcttgcaaagcgtgctgccgtttcgcttgggtcaagtggtgagcgaagcacagttggctgatggtgtcaaagcactttatgcaacaggcaatttttcagatgtgcaagtctatcatcaagaagggcgtatcatctatcaggtaaccgaaaggccgttaatcgctgagattaattttgagggcaatcgcttaattccaaaagaaggtctacaagaagggctaaaaaatgctggcttagctgtgggtcaaccactaaaacaagccacagtacagatgattgaaaccgagcttaccaatcaatatatatcacaaggctattataataccgaaattactgtcaaacagacgatgcttgatggtaatcgtgttaagcttgatatgacctttgctgaaggtaaacctgcacgggtggttgatattaatatcattggcaatcagcattttagcgatgcagatttgattgatgtgcttgcgattaaggataataaaatcaatccactgtctaaagctgaccgttatactcaagaaaagctggtgaccagtttagagaatttgcgtgctaaatatctcaatgcagggtttgtgcgttttgagattaaagatgctaagcttaatattaatgaagataaaaaccgtatctttgttgagatttcattgcatgaaggtgagcaatatcgctttggacagacacagtttttgggtaatttaacttatactcaagcagaacttgaggcactgcttaaattcaaagcacaagaagggttttcacaagccatgcttgagcaaacaacaaacaatatcagtaccaaatttggtgacgatggctattattatgctcaaatccgtcctgtaacacgcattaatgatgaaagtcgtacggttgatgtggaatattatattgaccctggacgccctgtctatgttcgccgaattaattttacaggtaactttaagacccaagatgaagtactccgtcgtgagatgcgacaacttgaaggtgcgttggcatctaatcaaaaaatccagctgtctcgtgcacgcttgatgcggactgggttttttaaacatgttaccggtgatactcgtgcagtacccaactcacctgatcaggttgaagtaaattttgtggttgaagaacaaccttcaggatcatcaaccattgcagcaggctactctcaaagtggtggagtaactttgcaatttgatgtttatcaaaataactgtatgggtacaggtgagcacgtcaatgcttcgttgtctcgctctgaaacccgtgaggtgaatagtttgagtatgaccaacccatactttactgtaaatggggtctggcaaagcttgaatggctactatcggaaagccaagtttgataacaagaacattagtaattatgtacttgattcttatggtggctcattaagctatggatatccattgatagagaatcaacgcataagctttggtctgaatgctgacaataccaagcttcatggcggtcgttttatgggcattagtaatgtcaagcagctgatggcagatggtggcaaaattcaagtggataataatggtattcctgattttaagcatgattacacaacatacaatgccattttggggtggaattattcaagtctagatcgccttgtatttccaacccaaggcatgagtcattctgtagatttgacggttggttttggtgataaaactcatcaaaaagtggtttatcaaggcaatatctatcgcccatttatcaaaaaatcagtcttgcgtggttacgccaagttaggctatggcaataatttaccattttatgaaaatttctatgcaggcggctatggttcggttcgtggctatgatcaatcctctttgggtccacgctcacaagcctatttgacagctcgtcgtggtcaacaaaccacactaggggaggttgttggtggtaatgctttggcaactttcggcagtgagctgattttacctttgccatttaaaggtgattggatagatcaggtgcgtccagtgatattcattgagggcggtcaagtttttgatacaacaggtatggataaacaaaccattgatttaacccaatttaaagacccacaagcaacagctgaacagaatgcaaaagcagccaatcgcccgctactaacccaagataaacagttgcgttatagtgctggtgttggtgcaacttggtatacgcccattggtcctttatctattagctatgccaagccattgaataaaaaacaaaatgatcagaccgatacggtacagttccagattggtagtgtcttttaa

SEQ ID NO: 1553 - DNA, 558 bp, M.catarrhalis
tcttttatccgtttattcataaggaaatttatgtctgtttcaaacattgattttgatttattagaggctgctgatattcaagcattaagtgatcgtggtgtcacattaccactacactataaccaaattaagcattatttgccgcatcgctatccattcatgctgattgaccgagtgaccgcttgtaaacccaatgagtggatcacaggatataaaaatatcagtattaatgaagagttatttaacggtcattttccagataatccaatcatgccaggcgtactacaagttgaagcaatggcacagctatcgggtattttaggtttcatcagtgcagggcagaccgctgatgatggttatctgtacttgtttgcaggtgtggataaagttcgttttaaaaaagtcgttacctcaggcgatcagctggttattcgctcaaaggttttgatgaataaacgagatatttataaatttgagtgtaccgcccatgttgatggtcaattaacttgcagtgctgaaattatgattgctcgccaaaaggtggatggcgtcaaatga

SEQ ID NO: 1554 - DNA, 201 bp, M.catarrhalis
ataaaagaaggggaatgccgccgaaaaaggggtgggcctcaaaggatccccattaaaaccaccttggataaaaacctaatcgaattggggaatttccgattcaagagactaatttccttggatgaaaaccgctttgaacaaaactggagaaaaactagttttgtaaaaagaaccccaaaaaacttcaaatgtacctcaagt

SEQ ID NO: 1555 - DNA, 558 bp, M.catarrhalis
gaggtaaccatgacgattcaccccacagcgattattgataaatctgcgatgatagcggattcggcgatcatcggtccttattgtatcgttggtaaaaatagccaaattggcgcacatacggtattacgcagtcatgttatcattggcgaaaacaccaaaattggtgtgcataatgatatttatcaatttgcagggattggcgaaaacccacaagatctaaaatacgcaggcgagccgacttaccttgaaattggcgaccataatcgcattcgtgaagcttggaccattcaccgaggtacgggtcaagatcgggggatcacacgcatcggtaatcaaaatctgctgatggttaatgggcatatcgctcatgattgcgttgtgggtgatgacaatgttttggcgaataatgtgggcgatgttggccatgcacatattgggaatcatgggataataggggggcagtcttggggggcatcaattttgtcggatcggatgattatagtatgggaagcgggagcaaggcttgaattgaaaaaaaatttttcggccttatggtaa

SEQ ID NO: 1556 - DNA, 1023 bp, M.catarrhalis
tgtcttttaatgccaagtcttcatgaaatgatgactgccatcgaaaaatatcagagcgtgcttaataaagatgatattgatggcagtattaagataacaggcgtggcaaatttatcggcagccaccaagcatcaagttgcttttttggcaaaagcaaaatatttggatgaactcaatcaaacaaacgcaggggttgtgttattatctgaacaattcatcaatgaagcacggacgattaaccctaagtgtttgtatgtattggtcaaagatgcttatttggcctatgcatgcgttagtacattattcaccccttcatgcgtgacaggcattcaccgcacggcaatcgttgcagattcagctgttattggtaatcaagttagtattggtgcaaacgccgtcattggtgaaaaagtggttttggctgatggcgttgtggtgggtccaggtgtcattatcggtgagcgtacccaaatcggtgcaggcagtcaaattgatgctgctaccgttattcatcatgattgtatcattggcgagcaaacacgcattcatagccatgcaaacattggatcagaagggtttggttttgctcctgtggcaacgaaagatggacgacagtggcagcgtattgcacaactggggcgagtaattattggtaatcatgtgcgtattggtagccatacctgtattgatcgtggtgcggtggatgatactgtcattagtgatgatgtgattattgataatttggtacaaattgctcataatgttcacattggttgtggtacagccattgccgccaactgtggtattgcaggcagcaccaaaatcggtaaaaattgcctgattggtggtgcggtgggtatcagcgggcatttgacaatcactgatgatgttaccattaccagtatgagtatggtcattgcaaatatccaaaaatcaggaagttactcttctggtactgttgctatgccttctttaaagtggcggcgtgcagcagcaagatttcgtcaaatgggcgaaaaataa

SEQ ID NO: 1557 - DNA, 1140 bp, M.catarrhalis
attttgcgtccattgtggcttttaaatgatgataaattaatcatcagttaccaagtttttagtaccaaattttgcccaatgatgaagaccgatgaccttatgaatacaatcactcgtgccgaaaaagacctttatcaaaccttatttgacctagctcagcatcatccgatggcgtatgaatggctcaaattattaccagattggttagcgaacattaaaaataaagatcgatatgcacatgcgccatattatgaatcaatcattgataaactgcctgatgttacgcctaatgaaattaatctgaatgccgcttgtattacttcacagattgactttactcacagcgattatcgttgtagtgaagctttgttaaaaaatctcatgccatggcgaaaaggtggatttaaatttgggcaaggcgatcggctgatccatattgatacagaatggcgtagcgatttaaaatgggacagaatattaccatacattggcgacttgactggtaagcgagtgttggatgttggcggaggttcgggctatcatggttttcgtatggttggggcgggggcgagtacggtgattgtcatcgatccgtcttgcttattttaccatcagtttatggcgacccggcactttcttggcaacataaaaaaccgctatgagcagtcgcccattcattttattcctgtggggttagaggagctgccccaagataataatcagtcaggattatttcacagtgttttttgtatgggtgtattatatcaccgtgcatcaccgtttgattgtttattacaattaaaaaatcagctgacaaaaggcggtgagctgatacttgagactttggtggcggatggtgatgaaaatacggtacttgttcccaaaaatcgctatgcgatgatgaataatgtgtattttttaccatcggtatctgccttacagctgtggctagacaaaataggctttgctcaggttcgctgtgttgatattaatatcacaaccaatgatgaacagcgaaccactgagtggatgacctatcattctttagatgattttttggataccaaagatccttcaaaaactgccgagggatatcctagacctaagcgtgcggtgataattgccaaaaaaccatcatga

SEQ ID NO: 1558 - DNA, 930 bp, M.catarrhalis
aaaggtgaaactatggcaggtggtagtttattaatgctgcttgatgacatcgcagcgatactcgatgatgtctcggtaatgactaaggtggcagccaaaaaaaccgcaggtgttttaggtgatgatttggcactaaatgctcagcaggttactggcgtgcgtgctgatcgagagttggctgtggtgtggggggttgctaaaggatcgttgattaataaactgattttggtgcctgctgcattacttatcagtgccatcgcagcttggctaatcacgcctttattgatgcttggtggtgcttttttgtgctatgaaggtgctgaaaaggtagttcataaatttacccccaatctactaccacacgagatggatgatgaaatggcacataccaaaagactcaaagctaatgctgatgaaagcatcgatttggccgcctttgaaaaagataaaattcgtggtgctattcggacggattttattttatccgctgagattgtggtgatttcattgggtgtaatgacggcagcgactttcacaacaaaagcggcagcattatctgccattgctattatgatgacagttggggtgtatggcttggttgccttaattgtcaaactcgatgatatgggtatttatttggttaatcagccctcggcataccgccaagcgatgggtcgtactattttggtatttgccccaaggcttatgaaatttttatcctttgcaggcacgcttgccatgttcttggtcggtggtgggattttggtgcatggtgttggtatcttacatcatcaagctcaagacttggcggcgttatcgggtgtttttggtggtctgaccgaagctttatataatggtatgacaggtttgattgcaggtttgatgattttggtgggtgtgatcggtgttaaaaaattcataaaccaatag

SEQ ID NO: 1559 - DNA, 303 bp, M.catarrhalis
ttttggagtaaaggtatgaaaatttttgcagtaactgccttagcatttgtcactttgatgttaaccgcttgcggtcacggtcatgaaaaagtacatgctattgaccgtgttgaagaagcacaagcagccgctttggccaatgctccaaaagccgaagacatggtttttggtgatgaaggtgtatctacaatgacgaccgagacagctcaagcggatgcaagtgctgatgtcacagctcaagaagatacccaaatggcggatgctaatgcaaccgtagagcctaccgaaactcaagccaactga

SEQ ID NO: 1560 - DNA, 258 bp, M.catarrhalis
ataatcataaaggtgcttggtatgtctgcaatggcgacgctgtttttggtatcggctgagacgattaccacattgggtctgtatgttttattgcctattttcatcgggtttttaatttttatcatgtgggatatctcaaaaaaatcagatgctggccgagcgggaactttttggatttttgtcgctttgggcatgggtttttttggttttcttgccaaacttgtgattgaatttgtgcttggaaaatgggtattgtaa

SEQ ID NO: 1561 - DNA, 774 bp, M.catarrhalis
gtcatgccaaataccaaccacgatactcacgatactttatttaccacaccgcttgataagtcggctcgctttagttttgatgaagaagtggtggcgtgttttcctgatatgattcgccgtagtgtgccaggttatgggcaagtgcttgcgatgctgccgattttggcacgccgccattgtttgttgcgtcaagttagtgatcgtggagcgcgtgtgagtcgtgtctatgacttaggaacatcgcttggggcggtgagctttgctttggcggataaatttgctcctgatgagcttgagattcatgccatcgatatctcagcaccaatgattgagcgggccaaatcggtcgtaggtgagtattatcctgatcatgatattcgcttttggttggatgatgtttgtcaaatggatttgttaccctgtgatttgattattattaatctaaccttacaatttttaccaccagatcagcgactgttattactccaaaaatgccatcacgctttggcagaaggcggtattttgattttgaccgaaaaaactcacctaaccgatgaacaagacgatgcgtggcgagttgagcggtattatgattttaagcgtgccaatggctacagtgatatggaaatcagcggtaagcgtaacgcacttgaaaatgtgctcatcaccgacacgctacacaagcaccatgaacgcttggcacaggcaggttttgagcgtagcttgacttggtttatgtttttaaattttgcgtccattgtggcttttaaatga

SEQ ID NO: 1562 - DNA, 189 bp, M.catarrhalis
ctcaaaaagaagcctctgccaccagtgtacgcctgcgtaataatggtattgactctttgcttatcgaacagcgtcctactcccaaataacccaaataacccaaataacccaaataacccaaataacccaaataacccaaataacccaaataacccaaataactatcatcatttcatcatgccaaaataa

SEQ ID NO: 1563 - DNA, 756 bp, M.catarrhalis
ccgtcgcttgggctaattaacgctcaccttaatttggtatttgattactaccctaatgtttgtataaaaaccatacaggatattcttatggctcaaagaccccaaaaacagccttctgccgtctataaagatgaagtacataatcaaagagtaggtttaagtagcttgctttggattgtcgtggggctattggtggtagcgatgctggcggtttttttgtatgtgtcgcctttatttgatggttttggtcaaagcgcagatcctaaacctgacgctttggttaaacccattaccgccagcgaacctgaaattgaatttgaattttatgaagttctgcccgaacaaaaatttcaaagcattccagaaggcgtgagcatccaagaccgagaagataataccttgcccaagccatcaaccgatgtgatcatcaatcacagcacaaaagcgagtaccgaccagccagctgacatttcaatcgtcgcagaaaataccgctgatgatgagcctaatcaccaaagccaatacatactccaaatcaaaagctatgaaaaggccaaagatgccgatctaaagcgtgctgaagtactcatggcaggtgtggatgccattgtggtacgccaagatacaaaaaatggctatgtgtatcaagttatctcaacgcccatgactcaaaaagaagcctctgccaccagtgtacgcctgcgtaataatggtattgactctttgcttatcgaacagcgtcctactcccaaataa

SEQ ID NO: 1564 - DNA, 219 bp, M.catarrhalis
aaaggtgttattatagcattgattgaggataaaaatatgaaaactattttattaggcggtggctgcttttggtgcaccgagtcggtatttgattcattaaaaggcatcaactctgtcgtcagtggttacgctggcggtgcaggtgatacagcaaactatcaagctgtctgcacaggtgagacgtcttcaccacggggctggaaggaccacgggggtcag

SEQ ID NO: 1565 - DNA, 1140 bp, M.catarrhalis
aaggaaatgattatgccagcacttagaaaagatattgaccctgaaggattattggaattttctgttgtttatactgatcgtgcgcttaaccatatgtcggtgcagttccagcaggtgatgaaggatttatcttttgagttaaagtcactgtttcaagccgatgcacttgccatcgtgccaggttctggcacggcagggatggaagcagttgcacgagctttggcgactgatcaagatgctgtcattatcagaaatggctggtttagctatcgctggacgcagatattagaagcgattggtgttgccaaatctagccatgtgtttaaggcatgtcttcaagaaggcaagaacggtcagtttgtacctgctgatattaatgaggtgaccgcctatatcaaagagcatcggccgggcgttgtgttcgcccctcatgttgaaactgcctctggcatgatgctgtcagatgattatattcgtgcacttgctgaggctgtgcatttggtcggtggcctacttgtcattgattgtattgcttctggatgtatttggctggatatgaaagcgcttggtatcgacgtgcttttatcagcacctcaaaaggggttgtcaagcacaccatgtgctggcttggtgatgctgtcacaggccgccaaagaagctgtattatcaagcacgccgtcaagcttttctttggatttaaaagcttggttaaatatcatgatggcttatgaaaatggtggtcatgcgtatcatgccaccatgccaaccgatggtctaaagcagctgcgggatactttgcttgaggcaaagcagattggctacgataacctaaaacaagcccaaatcaagcttggtcaagagattttggcaacacttcataaaaaaggcgtccacagtgtcgccgatccatcagctcaagcgtatggcgtgattgtttgccatgctttaagtgatgagattcacaaaggtgccgcctttgctaaggcaggtgtccaaatcgctgctggtacaccgcttcaggttggtgagccaagcgattataagagctttcgtatcggtttgtttgggcttgataaattgaccgatattgaaggtacgattgaacgctttaagcatgcagccgatcaagtgtttgtttaa

SEQ ID NO: 1566 - DNA, 1329 bp, M.catarrhalis
cgaactggatttgtcctaatgggattttttgatttattccgtaaaaagtcggtcaatgcaacgcctgcccctgcgtggcaaacgctcatccatgaaccctacacaggggcgtggcaaaaaaatgatgagctaaaacgcaccgatttgacccattttcatgcggtgtttgcctgcatcagtttaattgccgctgacattggcaaattacgcatacaaaccaaatcatcccaaaatggcgtacttttaccgaccaaatcacgcacgcacgccattttaaaaaaaccaaataggcatcaaagctggcagcagtttattgaaagttgggtaagctctaaactcttgcgtggtaatgcgtatgtcttaaaacagcgagacatttttggcgatgtgtggcagatgtatgtgctaaatcctgaccgtgtcaaggttttagtatcgggcgatggcgaggtgttttatcaaatcagcaccgataaattatacggcttaaccgataccactgtgccagcgtctgagatgatacatgaccgcatgaactgcttttatcatccgcttgtgggtctttcgcctttgacagcatgcggcattagtgtgggtttggggctgtccattcagcacacctccgctacgctctttggcaataactctcgccccagtgggattttgtccgtgccatcagacatcagcaaagagaccgcccagaaagtcaaatccgactggcaagccaattactcaggcatcaagcgtggtggcattgctgttttgggcagtggggcaaaatacgaacccattgctatgagtgcaagtgacagccaagccattgagcagcttaaaatgagtggtgagaccgtctgctccgtgtttcatgtgccagcctttaaagtgggcatgggcgagattaaggcaggacaaaaggtgtctgacttgaacgagatttattattcagactgtctgcaacactacatcgaggcgattgaaaacttgcttgatgaacaccttgaccttgaaaaaggcgtggagtgtgaggcggatttgtccccacttatccgaatggatagcaccagccaaatggcgtatctcaaagaaggcacacattcgggtattttatcgcccaatgaagcccgtgccacgcttggcttgccgcctgtggtgggtggtgagtcgccactcatgcagcagcaaaattacagtttagaagcacttgccaaaagagacaacagtgccgacccttttggcaatgcacctacgccaagtgagccgaagaaaactgccaaagcggtcaagccacgctaccgagtgtatgccaccattgacaaggataaatcatga

SEQ ID NO: 1567 - DNA, 309 bp, M.catarrhalis
ccatcgccatcagccatgttgcgtactcaggtaagcagtattatagtgaaacttagcctaccgatgggtacaaccatctatgaagcattgacgcttgtgccttgggtgcatggcgaagagtttgaagatttttggcattgggtacaaaataatttggacaacagcccaaatcataagtcttggtatgtgggtatttttagccaaaaaaaacgccttgataccatacttttggcaggcgatcgcatagaaatctaccgacccttgaccattaatccaatggctaagcgaaaggcactttcaaaaaaatag

SEQ ID NO: 1568 - DNA, 288 bp, M.catarrhalis
atcatgacttttgccacacttgacgaggttaagcaccatttgcgttatgacgataccgacagcgatgagattttacaaatctatttacaatcagcacaaacagcggtcaaaaactacatcacagatgagattaacgatgacatgctgcctgctctaaaagttgccacgcttttgctggtcggttatcttgatgacaaccgaaacggcgagaacggggcagaatttggtaactttttacctgctcctgtccgccaaatgcttgctccttatcgcacgcccactttttaa

SEQ ID NO: 1569 - DNA, 273 bp, M.catarrhalis
ataggagtgtttatgactcattattcagactttattacgccagcggatcgtgcttggcaagcaacttatcaaaaaaataagttagacattcaattgaccatgcccaaagaggtatcgtcattacttgatttttttgatgttcattttcgtgccaatcgagggcagcgtggcataacatttatgggcgtacatattggctatgatgagctagatggtattagtcaaaatatcgcaggttatttgcagtcttttggcttaaaaaaaggccgataa

SEQ ID NO: 1570 - DNA, 351 bp, M.catarrhalis
taccgaagaccacgaaaaaaactaatcgccgacaaaagtcggctttttttgtttaaattggcaggacatttgggcaaaacagtgggcgagcttgaacgcacaatgaccgcccacgagtttgcccagtggcgagcctatgaccgccttgacccaattggcggttatcgtggcgacatacaatcggcggtcatcgcttgtgccatggcagggggtaagccgtctgattatcttatcattgacccaaatcccatgacggacgaggagcgagaagcctatgagctagaacagagaaaagcacagctacaagcccaaatggagcgaacgcttgcgatgttttctgccataggttga

SEQ ID NO: 1571 - DNA, 192 bp, M.catarrhalis
acgcactcgcccacccacccaagaacgcaaacagccaaacgccgaaccacgaaattaaaaaaggggcatgaagcccctgcgtgtcaatcatatatcaccttttatgcaaatttaatgatgttgttgtcaatgaaatcaccgataagcactaagtgtactgaatgcttacctgagttattgtttatatattga

SEQ ID NO: 1572 - DNA, 459 bp, M.catarrhalis
tttaaaccgccaaccaggagaaatctcatggcaaaagttgtagaaaatcttgctgacagcttttttactttgcatgtctcagcagacggtaacgaataccaaaaaatagagcatttgtccaaatgcgaccacccgtccgaagagaaggtattggacgaggtaaccgctaccgatgaccgccgtaccgtcaaagcccccattgattttaaggaggagagtgagattgaatttgaatacgcccttgaccccaaagacaccacacatcagctactgcaaaccagttttgagggcggtaaagagttgcattggcagttaaaatatgtggttgccacgggcgagtcccgtcaatttaagggcatcatctcaaagctgaccaccgataacagcgaccaaaaaaagaaaatccgcaaaactggtacaattaccatcacaggcgatgttaccaaagttacaggttaa

SEQ ID NO: 1573 - DNA, 711 bp, M.catarrhalis
tacccaaagccttgttttatgaaaaatattattatcatgcttagcttgttttcaagcattgcatatgctcaaaatctttatcagtataaagacaatagcggtcagatatttttaacaaataaatctaataatggcaacttttctgcatttactcaaattgaccatgccaaagacgttgatgtttctgatttttttaatgaaaaatcagaaactgattttaggggcagtaaatggacctaccgcaaaacatttaatgaagtagaaagaacttatttaacactatccatgataaaatctaccaatgccgtaaatcttggaattggtcagggtggaaatcaaaatttgcaaatcattattaaaaatagtcatgatacaggcttttataatgatgagattgtaattggtcatgatagtggtttggttgaagtgtgtatgaattcttgttacatgagagcaagatttgatgatgatgaagctcgttggtatcagttggattattttaatcctcatgcttattccattgctccatcagaaaattactcagatgtaaaaatgcacaaggagacgaaactcaaagaagatgattattttttattaaaactttataattcaaattctttggttttgaatttccccaattttgacggtactaatcacacttaccgatttaatttaaagggattaaatcaacaaaaaatggggaataaatga

SEQ ID NO: 1574 - DNA, 1242 bp, M.catarrhalis
gttgggaagtttatgtttgcacaattcaaacgatttttagagcttgaagctgcaggcggtattgtactggcagcggcagctttactggcgatgattattgccaattcaccgcttgacgagatgtaccatgcctttattcatgcgcctgttgtggttcaaataggcacatttcaaattgccaaagatgcccatcattggattaatgacggtttgatggcaatatttttctttttggttggacttgagttaaaaagagaagccttaattggtgagctgtctgatgttaaacaaattttaatgcctgccttggcagcggttggcggtatgattatgccagcgttaatttatgctgcttttaatcagagcaatcctgaacagttggcaggctgggcgattcctgccgctaccgatattgcttttgccttgggggtattaagcttattgggcaatcgtgtaccaaatgctttaaaagtctttttggtctctatcgccatttttgatgaccttggtgcaattgtcatcatcgctttattttacaccagcgatttatctttatcatctttggcggtggctggggtttgttttccatttttgttcattctaaataaaatgaatgtcgtgcgactgacaccttatttattgattggtttggtcatgtgggcggcatttttaaaatcaggtgttcatgccactttagcaggggttttgctggcattttttatccccttgcgtaataaaagcgaccctgaacattcgcccctagaagaacttgaacacgatttacacaatactgtcgcttttggcgtgctgcctttatttgcttttgccaatgcaggcattgggttggcaggaacaggcattgacagtttattacattcagtcccacttggcatcgccgcaggattattcattggcaagcaaatcggtgtgatggcagcggtctttttatgtttaaagcttgggttagcgtccctaccaaaaggcacaaccatcaagcagttgtatggggtatctttgctgtgtggtattggttttacgatgagtttattcatctcaggcttggcgtttggcaacactcctaaggattttgatccacgcctagggattattttaggctcaatcatttcaggcgtgatcggttatatgattttacgaggcaatattccaaatgctgaccatcccgtccttgccaaagatacaggcgaagggtttattcccacacaacacgacgctcaggcttaa

SEQ ID NO: 1575 - DNA, 579 bp, M.catarrhalis
gccctaaaaacagggctttttttggagcaaaaaatgagcagtattaaacacattcaaacccaaattggcacgaccgtcgatggcgtatggggcgataagtcaagacaagcgttaaaatcggcgataaataacggtaagattatcacaatcactaaaaatatcagcttaaatgagttattagccagtaataccgccaaaaaatacggcattgacaacacgccaagccaaaccattttacaaaacttgattgacgccagtgtaaatctttatcagcctgtgcgtgaaattttgggcgtgccaatcattatcacgagcggctatcgctccccagcacttaataaagcggtgggtggttctaaaacttctgctcacatgtcgggctttgcgattgattttaccgctccaaaatttggcacgcccaaactcattgtaccccatattgtcagaaagcttaaagaaaagggcattgggtttgaccaagctattattgagtacccaaattcaccccgttcatgggtacatttgggctacaagcacccaagcgggcggcaaaggggcagtagttttgtgattgggtga

SEQ ID NO: 1576 - DNA, 1407 bp, M.catarrhalis
gttaagggaacttggattatgcgtgcgctgagcattgtggattcactatttttatggctagaaaataccaaacaacccatgcatgtggctggcatttgtgtatttgagttacccaacgatcaagatgaaatcagctttatcaatgtgcttgccaaccagattgactctgatgctattcctaatttcccatttaatcaagtgcttttccataaatttgcttggaaaaccattcgcaaattttatatcgaccgtcattgttatcggcacagcctacaggttggcaaaatgtcggaggcactcgctcaaatctcaagactgcatgaacagcaattggatcgcaccagaccattatgggagctgcatttatttgataatcttgagccagaaacgcaaaacggcactcggcgatttttattgtacctaaaagctcatcatgccatgatagatggcgttgctgcaatgcgtttatttcagcgttcgctatcgcactcacctgatgaaaagctgtctaaaccaatttggcttcgtaatattcgccgcaaagaatcaagctttgtcatggataaaaagccaatcgttgagcattttaaagaccaaattgtaggtctaaagccagtatatcaagagcttaaatctgattatcagcttagccagtccaccgcatcccaaacaccaaaaacgcagtttatcagcagtttgcaagctccgtcatcaatacttaatcaacgcattggtaccagtcggcatatctgtgttctgaccttaaaaaaagcacggtttgtccaagttgcaaaacggctcaatgtcagtaccaatgatataattttggcagtttgttccactgccatcagaaactacctattatctcaaaatgctttgccagatatgccattgattgcttttgtgccgatttctttacgaaaaaatgatactgcgttgggcaatcaaatctcatttattccaaccaatttgggtacaaataaccctgatgccatcgcacgccttaggttgattcatgacagtgtgcaagcaggcaagatgcgcgctgggcgtatgacacaagctgaatttatcaattatacggcagtgcattatgcttgggcagggataaatttggcaatgcgtctttatccagctaagcaggcattcaacctaatcatctccaatatcccaggtgacagtacgcctttgtatttaaatggggcgaagctgacagccatgtatcctgcttcggttttatttgatggtcaagcactcaatatcagctttaccaattatcaagattgcattgactttgggattacggcatgccaaacagccctaccaaatattcaatcattaccatcattgctaacacaagcacttgtcgagtatgaaggcaatgattatagtagcaatcaagtataa

SEQ ID NO: 1577 - DNA, 453 bp, M.catarrhalis
gttcgatttgctcaacgccaatcatcacagggtttttggtatttatctcagaccaaaagcgacaaaacgagctgtacaaatccgcccaaaataaatttatcccttggtcaaacaaggagaaaaaagatgagtaacttacttattatcaatgctgtgatttgctcggttgggttttttgtgggcgtgcatacttttattaagcatttaaaagcgttttctactgaaaaaaccccagtcgtcgaagcgtggcttgtcgctgtcggtatgcttgcatggtcagttttgctgtatgcaagctttgatgaacccatcatcacacggcttgaagtattttctcggctattgtttttgatttattgggtgggcggtattttaaaagttcaaaagcagtgcataaaaatcagacggcatttatcaaaacgaaaagcacaaatcaatttatataagccctaa

SEQ ID NO: 1578 - DNA, 1455 bp, M.catarrhalis
cccaattcagccactaccaacccaaaccacaatcacaaaagcaacccccagtcatggtgcggttgctttaattttacctacaaacggagtgaaacttttatgaattaccaagcacaactggcacaaatcctagccacaatccaagccaaacaaaagcaaattggcgagattatgacaaaatcagtcacaagcggacacacaccaagcgatgatgatgaagtccaaatcacggtattagaaggcgaaatcgctcgcctagaaaagaatgccgaacgcctaaccaaactgattaaatcagtggaaaccgccccaaatcctaccgaaatcggtggtgaaaatccagagcaagcggcggcaagtgccaaaggcgagccaattccccaaaacccagagcagaccaaaagcgtgcaagtagaatctaatttgcccaaaggcatcggctttgcgttgttggtcaaagcgtccaccgttgccaccacatccaaaggcggcatcaccactcgtgaagtgcttcaaggttggggtgcccctgacattgtcatccgtgccgccactcaaaaggcggtcatcggcacaacaactgatgataaatttggcaaagaactcattgattatgccaatttaacgggggagtttattgagcttgttcgccaaaaaaccgttgtggataaaatcgctcctctaatgcgacaagtgccatttaatgtcaaaatcccaatgcaaaccgcaagcggttcggttggctgggtcggcgaaggcaagatgaagcctgtgggcaatcctgaatttggttcaatgactttaagccacgccaaaatcgcaggcattgtactgttatcggacgagcttatccgcttttctaaccccaaagctgatacgcttgtgcgtgatgatttggtggcaaccgttgcccagttcattgatcagcagttttttgaccctgacaagacagaagctgccgaatcgccagcgtctgtgctaaatggcgtaactgccataacagcaacaggtacaaccgccgataagattgacacggacaccaacacactcatcgcccagctggtagatgctggcattagcttagagggggcggtgtgggcgatgagcgaaacccgagccatgcagattagcggaatgcgtgatgctttgggacgcatttattttgagggcatgaatttaacaggcacacgctcgcttaaaggcttgccagtgcacacctctggcagtttgggcgataagattgtgctgattgtgccaagtcaaatcctactggcggacgatggcggtgtggatttttcggtatcaggtgaggcgaccatcaatatgggaacagacgacgccccaaaaatggtcaatctgttccaaaacaacttaactgccatccgtgctgaacgctttatccgctggaaaccacgcatgaccaaagccgtggggtatattaaatatacaggttag

SEQ ID NO: 1579 - DNA, 183 bp, M.catarrhalis
cggtgtaaagctttgtggcttatcagtgatactattccaagagtgactgtgattgctgtttgctttagcattaagcagcgattgcagaccgctgatgtcgctgatagtgtgactatgagacgacggattaaagctagacggcttgccagtgatgctatcccatgcgacagacatgggcactga

SEQ ID NO: 1580 - DNA, 618 bp, M.catarrhalis
atgaccaaagcctattcaaccctacaaattaaatccgtaaccgacacggacgatgaacgccttatcacaggcattgccaccacgccatccaccgaccgagatgatgatattttagagcctttgggggcaaaatttactttaccaatccccttattatcgcaccataatcacagccagcctattggcgaagttatccaagcggaagttaccgcaggtggcattttaattactgccaaaatagccaaaattgacgaagaaggcaagctgaaagaacgcattgatgaagcgtggcaaagcattaaatctggactaatcaagggcttgtctgttggctttaaaatcaaagaatacagctatattgaaaattcttggggcttgcacattaaagaatgggagtggtgggagctgtcaatcgttaccatccctgccaatgctgatagtgtcattaccagcgttaagcagattaaagaggcatttagtttgcccctgcaaccaaccccaaatccaccgattaacccaattcagccactaccaacccaaaccacaatcacaaaagcaacccccagtcatggtgcggttgctttaattttacctacaaacggagtgaaacttttatga

SEQ ID NO: 1581 - DNA, 375 bp, M.catarrhalis
tttgctctttaccaaattacccttgtcattgtgccaaaaatacccataataaaggctgattttatatatgagaacgctcttatgaaaatgttgatatggtcgctgatggttttgggtttggttgtggcatcaaatgcgtatgctgatatcgaaaaaatatacgctcaaagctgtgcaacttgtcatgatagcggtacttttaatgcacccaaaaaaggtgatgttgccatatggcatcgcctaaatcagcaaaagggtcaagaggcattgattaaatcaatccgccaaggcatgccgcagatgcctgccatgggtctgtgccaaaattgcacagatgaagactttgctaagctgattgactatatgagcagataa

SEQ ID NO: 1582 - DNA, 198 bp, M.catarrhalis
tgtgtgtattatataatcaagacatatataatacaagcattattttataaaaatattcaaaaagtttataagttattgattttgattaagattataatgattacgcagtatgtctttcatcaaagcattaaaagattttgtttcattctgcaacgcttgaatgatgtcagcatctttttcattatgaagttgcaatga

SEQ ID NO: 1583 - DNA, 216 bp, M.catarrhalis
acgcaggagtataaaatgagcaaaaacaaaacccccgactatgtattgcgtgcaaatgcaaattatcgaaaaaagcacacaacaaacaagtcattgcaacttcataatgaaaaagatgctgacatcattcaagcgttgcagaatgaaacaaaatcttttaatgctttgatgaaagacatactgcgtaatcattataatcttaatcaaaatcaataa

SEQ ID NO: 1584 - DNA, 513 bp, M.catarrhalis
tacacacatcaagacaaaaccagcacaataaaaggcatcaatatgacaactttataccacggctctcatgaaaacaccgctccagtcatcaaaattggttttgcggcattcttgccagctgataatgtgtttgatggcatttttgcgaacggtgataaaaatgtggctcgtagccatggcgattttatttacgcttatgaagttgattcaattgctaccaatgatgatttggactgcgatgaagcaatccaaatcattgcaaaagagctgtatattgatgaagaaaccgccgccccaatcgcagaagcggtggcgtatgaagaaagcttggcggaatttgaagagcatatcatgccacgctcttgcggcgattgtgctgattttggctgggaaatgcaacgcctgcgtggcgtgattgctagaaaacttggctttgatgcggtggaatgtgttgacgaacacggcgtaagccatctgattgttaacgcaaacatcagaggttcaattgcataa

SEQ ID NO: 1585 - DNA, 270 bp, M.catarrhalis
acaaaatcacaggcgaatgggactaaggagatggcgatgaactcactaaactcaaacaatctatccgagctgatgaacgatgtggataagtgtaaggtgctaattgaattacttgaaaacagttatggtgataacgactggaaattggcacagacactctcggtcataaaagacatcttgacacctgtcattgcagggctgattgatgtggtagatgacctgatggagcaagaagacaaagataaacctgttttgtcaaaagtcgcttaa

SEQ ID NO: 1586 - DNA, 774 bp, M.catarrhalis
agcataacacaatcaaagatagggaaatttactttccttatctttttatttggagctaatatgccattaaacagcgactttcaaaaacccacagtagacgggctaattacgctctttgagcttgacgcaagtaaactgggggctggcattttacgctttcacggtcataaccacgagcataatgatggcgtgattgtctttcgtggcaaagcgtacaacccccaagccctaaatgtaacagggcttgaaatgcgttcagatggcagagcaagcacaccgaccctaacccttgctaataacattgcaggggtacaaggggcggtatctgcctactgtttgcagtttaacgactttgcaggggcaaaacttaccgtcattaccacccttgccaaataccttgaccccatcaattttgacaacggtaaccccaccgcttctgatgaatgtaaagagcaaatttggtttgttgaacaaaaaacatcagaaaatgcccaacaggtaacctttgagcttgccaaccccattgatttggagggtcaaaaaatccctgtacgtgagattaccaattactgccactgggcggttgtgggtaagtaccgtggcgaagaatgtggctatacaggggtggccatgtttgatgaacacgacaaccctaccgacaaccccatcatggacaaatgcggtgggcgtatgaaatcgtgcgtgtgcagatttggcagaaataaacctttgccgtttggcggctgtcctgccagcagtttgattggctcatag

SEQ ID NO: 1587 - DNA, 2073 bp, M.catarrhalis
caattttttaatgggatttttatgacaacaagccgtaaaattttggtaacctctgccctaccttatgccaacggacccattcatttggggcatttggttgaatacatccaaactgacatttgggtgcgtgccatgaaagccatggggcataatgtgacttatgtgtgtgccgatgatgcacatggcaccgcaatcatgctaaaagcacaagacaatggcatcaccccagaagaacaaattgctaccgttaaggcaagtcatgaaaaggattttgcaggatttttgattgattttgataattaccactctacccacagctccgaaaatcaatatttttcccaaaaaatttacaccacactcaagcaaaatggttatatttttaccaaagatgtggaacagctgtttgatactgaaaaagggctttttttggctgaccgttttgtcaaaggcacttgtcctgaatgcgacgcacccaatcaatacggcgataattgtgaagtctgctctagcacctacaatgccaccgaactaaaaaacccttattcaacactctcaaactcatcacccatcattcgatcatctaagcactattttttcaatttaccgcagtttgatgaatttttaaggacttggacaaagtctcaaggacgacttcaaagcagcatctataataagctatctgaatggtttgacgcaggtcttgcaccttgggatatcagtcgtgatgcaccatattttggctttaagattccagatacacctgcagatgagcctgataaatatttttatgtttggctagatgcccctgttggttatatggcaagctttaaaaatctgtgcgaccgtaccgatatggattttgatgaatattttaataaagacagtcaaactgagctatatcattttatcggtaaagatatcgtatattttcattcactgttttggccagccatgcttgaaggtgcaggctatcgcaccccaacagcggttaatgcacatggatttttgaccgtcaatggtgaaaaaatgagtaaatctcgtggcacattcatcaaggcagaaacctatttgacgcatttagatcctgaatatttacgctattactttgccagcaaactgtcagcaaatgtcgaggatattaaccttgatcttgaagattttatgcaaaaagtcaattcagatttggttggtaaagtggttaatattgcctctcgctcagcaggatttattcacaaaaatcatgatggtaaattatcagatgaattgaccgaacccaaactgattgatgagattatctgtgcaggtgatgagattgctgccgcttatgaggcgcgtgagtttgccaaggtcacccgtctcattatggcctgtgctgacaaagccaatgagtatatcgatacccaaaaaccatgggcattaaataaagcaggtaaatttgatgaagttcaaaaggtttgtacagtttcgctgaatatttttcataaactgatcatttatcttgcacccattttaccaaaattatccgaacaagcccgtgaatttttaaatattgacagcttagagtttgatacacgccatcgccatttactcagccatcacatcaacccctttacaccattaatgcagcgtatagataaagataaagttaatgcgatgattcatgactctaaagaaaatcttacccaaacctcaggcactgataacaccaaaaaaacagttttggatgatacggataccgccaaatcggcatacattggtattgatgagtttgccaaagtgactatgaaagttgcccatgtggtcaaatgccaaagtgttgaaggtgccgataagctcctacagtttactttagatgtgggcgaggagcatactcgcaatgtatttagcggtattgccaagttttatcaacctgaagagctgaccgataaaaaagtgatttgtgtaaccaacttagcacctcgcaagatgaagtttggtatctcagagggtatgattttatcagctgaaaaacaaggggtattaacagtcatcacactgcctgacaccatgcccatcggagcggttttggcttaa

SEQ ID NO: 1588 - DNA, 579 bp, M.catarrhalis
aggggtactaatatgcactatattaatttgattgacgattcaggcagatttgattttattcatggcgattttttaagtatgtatgctgatatttctaggtttattaaaatcactgatgaagactatcaaacatacttagcatatagcacatcaccaggtgagcttaagtatgttgagggtaaaatcacatacacaccacaggatacagatcatatcgctttaaagaaagcatggcaagcttgggtttgggaagacatcaaacaaaaacgccataccaacacccacggaggcgtatatatcaaatctgtgggcaaatggtttcataacgatgacagctctcgcacgcagtatctcgctctgcaagtcttgccaaaactgcctgatcacctgatgtggaaaacgatggataacgaatttgtgccaatgaccaaagatttgctcaatgagatcgccatgacgatgctaacagaagaacaagcagatttcgctaacgctgaaaaacacagactagccatgcttgaatctgataacccacttgagtatgactactcagacggatggagtgctatttatgcatag

SEQ ID NO: 1589 - DNA, 378 bp, M.catarrhalis
actgtcctcaagttaaacagttgtcaaggagacgcaatgaaagccaaactaatccactccagacttaaaatctaccgccaaagtgccagccgttctgccacaggggcagttaagatgaacgaatgggagcatgctttgaccgtttgggggcggttaatccgcttatccgataaggacatcatcgcagggcaggcacagagtagccaaatcaccgcacgagcgataatccgatatcgcaccgacatagacaacacaatgcgtgtgcaaaatggtaagcaaaagtacgagatcattggtgagcctttggcagataacaatacagggcgagagtatttgacgcttatgttaaaggaggttcttgatgataggcaaaattga

SEQ ID NO: 1590 - DNA, 456 bp, M.catarrhalis
cattacccaaaattgcaaaccctaaccaaatggagagaatttatgcactatcctgttaccctaacccctgatacagacggcttttgcgttacttttcgtgacattccagaagccatcagccaaggcgataccatcgatgaagccttagagatggcacaagatgccttaatggttgccatggaattttattttgaagataaccgagccgtaccaatgccaagccaagcccaagatggcgagcatttggttagcctgccaccgtctgtatgggcaaaagtgttattgcttaatgaaatgctctgccaaaatgtcagccaagccgagcttgccaaaagaatgggcatcatcccccaacaggtaacccgccttgtggatttgtcgcatgccaccaaaattgatacccttgccaatgcttttgccaaattgggtaagcagttacaggttggtttgacttaa

SEQ ID NO: 1591 - DNA, 465 bp, M.catarrhalis
cttatgaaaaaattacttttgagttctgctgctgttatgatggcaattacaggctgtacaacaccatcaactgttagtgtgccagccaatcaagcaggcgttgttgttgtgccaacagctggtactcatcatcatggtacccaacaccaacatggcgtttatgggcaagacatcacagcggtttatcaatgtgatgaaggtgccaaagttgtggcaaactatcaaccagaaaatgatcgtgcagtattgaccgtcagcgcaccaacttggcacctacacaaccaagagatcgtgatgcgtccagctgttagagcatcaggcatacgttttgttaatgacaccaatccaaacagtgtctatgattggcatgccaaaggctctgaggctttattatccgtcatccttggtgaaacagatcaagaacatacgctacattgccgtaccgactcacctgctttgatgtaa

SEQ ID NO: 1592 - DNA, 630 bp, M.catarrhalis
tgctggaaaaaaataacaggccagctatattatcgagggctatggttttgtctgaaacttggcttgtttttgacctttaatccattgggcagttatacaggtaaaatcggcattccttttccttcaacagacattcttttgttggacgatgaaggtaatcaagttgctcaaggcgaagcaggtgagattgtcgccaaaggccctcaagttatgaaaggctattggaatcagcctgaagagaccgcacgagcgatgacagcggatggttattttcgtacaggtgatattggtgtgatggacgaaaatggttactttaaaatcgttgatcgcaaaaaagacatgattttggtttcaggatttaatgtctatcctaatgaagttgaagaagtgattgcaagccattcaggcgttttggagtgcggtgttattggcgtgcctgatgagcatagcggcgaggtggttaaggcctttatcgttaaaaaagatcctgaattgaccgaagcagatatcaaaacttgggcaaaacaaaatctgacaggctataaacgccccaaaaaaattgcttttttggatgaattacccaagtctaatgtcggtaaaatcttaagaaaagagttaagaaatctttaa

SEQ ID NO: 1593 - DNA, 1461 bp, M.catarrhalis
tgtttggaaaataaaaccatgagtgcattacgccagacccaatcgcagttacagctttatgataccctaagtgccagcaagcgtccatttaaaccgattcatgcagggcaaattgggatttatgtgtgtggtatgacagtttatgactactgccatatgggtcatgcgcgtgtcatggtggggtttgatgtgattgtacgctggcttagagccattggctatcaggttaattatgtacgaaatattacggatattgacgataaaattattcaaagagcctacgataacggtgagaccattaccgagctgaccgaccgcttcatcacagctatgcatcaagatgaacaatttttgggttgtcaatctcccaacatagaacctcgtgcgaccgaacatattgaaaatatgcagcatctgattgatgttttgctgacaaaaaacttggcctatcaaggcagtggcggcgatgtgtattatgcaatcgaaaaatttcctaattatggcaagctctccaagcgtcatgtagatgatatgcaagcaggtgcatcagagcgtgtgagtaccgcagaagataaacgccatccttttgattttgtattatggaaaaccgccaagccgtctgaaccacattggcaatcgccgtggggtttgggtcgacctggttggcatattgaatgtagtgccatgagtacttgctgtttgggcgaaacttttgacattcatggcggtgggcatgatctgcagtttccacatcacgaaaatgagattgcccaatctgaaggtgcaactggtaaaacctatgccaatcattggatgcatatggggtttattaatattgatggcgaaaaaatgagcaagtctttgggtaattttttcaccattcgtgaggttgtggataagtttcatcctgaaacgatacggttttttttattatccagtcattatcgcagtcctgttaatttttcagatacagcactcaaagaaagtcataccgcattatcacgcatctaccaatcactaaaatcggccgaaaactttggcgtcatatcaatcatgccaaatgcttgggagagtgaagcagggcaggcatttgccaaagcgatgaatgatgattttaatacccccaaagcggtgagcgtgctttttagcgttgttactgagattaatcgagccatgaaagcaggcgaataccaaaaagccactcaagaagcatcgacgctcaagacgctggcctcggtgcttaatatcgcccaatcatcgccccatgagtttttgcaagccaatattggtaataagcctgatggcttaagtgatgccgagattgccaataaaatcgcccaaagacaacaagccaaagctcaaaaaaactttgccaaggcagatgcgatccgtgatgagcttaaccgtcaaggcattgagcttgaagatggtcgtatgggtacgacttggcgacggatataa

SEQ ID NO: 1594 - DNA, 510 bp, M.catarrhalis
ccatgcttgaatctgataacccacttgagtatgactactcagacggatggagtgctatttatgcatagaaaagtttatttagcattatataaagggggagctgacaagttctcttatcgtttttatgatgcagtgacacgctttttcacacggggtcaatactcacattgtgagattgcagtacacattcacaacaacatttatcactgctattcatcgtcaattcgcaatggcggtgtgcgtcgcaaatcaatgatgctcgatgacaaatgggacttaatcaagctggatattgatgagtcgcaaatcagacagttttatggtgcgacagaaggatcaggctatgatctcttaggtgctttaggtgttgttttgggattacggcaacatccacacaaatacttttgtagtgagtggtgctttgaagcgatcacaaacaagcaagatggctggcgatttagtcctaatgacttatacgcaataaaatcaattttaactcgccgacattaa

SEQ ID NO: 1595 - DNA, 816 bp, M.catarrhalis
ataatactgaattttagatgttatgagggtaatatgttggatcaattgattattggcagtagaagttttaattcgcgtttgttggttggtacaggcaaatataaagacctaaatgaaaccaaagatgctatccatgccagtggtgccaatattgttacggttgccattcgccgaactaatattggacaaaataaagatgagccaaatcttttggatgtgatttcaccgaataaatacaccattttgccaaatactgcagggtgttttgatgccgatagtgcggtgcgtacttgcatgttggcacgagagctgcttgatggtcataatttggttaagcttgaagtgcttggcgatgaaaaaaacctttatccgaatatcaccgaaacactaaaagcagcaaaggtattgattgatgatggttttgaggtcatggtctatacttcagatgacccaattgttgccaaagagcttgaaagcatgggctgtgtggcaattatgccattgggtagcttgattggctcagggcttgggattttaaaccgccacactctaagcttaattattgagcaaaccaaagtacctgttttggtcgatgcaggcgtaggtacagcatcagacgctgcaatagcgatggagcttggttgtgatggtgttttaatgaatactgccatcgcccatgccaaaaatccagtgatgatggcttcggcgatgaaccatgcagttgtcgcaggtcgagaagcgtttttggcagggcgtatgcctgcacgccatatggcacaagcaagctcaccgcagacagggtacttttttaaatag

SEQ ID NO: 1596 - DNA, 597 bp, M.catarrhalis
ctacaaaggaaacgacctatgtctaatcttattaacttcaattttgaaaaccgccccgttcgtgtagaacttaaagatggcgaaccgctgttttgtttgcgtgatgtagctgatattctggatattcagaatgttagtcaagttgcaacaaaacaactagaccaaaagggggtatataaaatatacacccttacagatggcggtaagcaagagctaactttcatcaatgaacccaacctataccgtgtgatttttcgctccaacaaaaaagaagcggttaaattccaaaactgggtctttgatgaagtcctacccaccctacgcaaaactggctcttatacagtcgcccccgtctatcctgcggtcaatgtcatcaatgcacccgcccccagtcatggcgagctatacaaaacctttatcgccaccgtcaatctacaaggcgtgatgacgatgcgtgagatgggagatgatgaatttgtcgctacttatgatgacttaccaaatcttttgcgttatcgctcttggggcgtgtcagatgaaaaaatggcaaaaatcgccaaagcagcactgaacaaaatcacaggcgaatgggactaa

SEQ ID NO: 1597 - DNA, 666 bp, M.catarrhalis
ttgccatttgatgtgcctattataaacaaaaatgtttataatatcaagtattttatcaacaaaaaagtatattttttacggaatataatcatgaaaaccatccaactacacggcattttagccaaaaaattcggtaaatcttttaacttggcagtgggcagtaccaaagaagccatgcgtgcgttatgcgtgcaacttactggctttgaagcgtttatgatgaacgctcataagcaaggcctgcgttttgctgtatttcacgataagcataatgtgggcgagagtgagcttgacatgaaccacaccgctaagattatccgtgtcgtgcctgtcgtggaaggctcaaaaaaagaaggtgttttagaaactgtcatcggagcggtcttggtcgtggcaggggttgtggttacaggcatgggctttgctcctgcgggggcggcacttatcggtgcaggtattggccttatggtaggcggtatttctcagatgctcatgccaaaggtggacgcccaagacaacaaccaagacggcaacaaagccaacaagggctttggcggagcagtaaccaccatcgcccaaggcaatcctgtgccaattttgtacggcgagcgagagattggtggctttatcatgtcagccagtcagcttccagaagacatgttataa

SEQ ID NO: 1598 - DNA, 183 bp, M.catarrhalis
aatttgcctgaaaacttgtctcatagcgtgattgtgcgtgatgataaaggcgttatcgtgtataatgatggtttttgccaaatgtcagatgaaggttatgactcaattaccaaaaattttattggcggtgacagggggcattgctgcctacaagtctgccatgcttgctcgcctgctgattaa

SEQ ID NO: 1599 - DNA, 183 bp, M.catarrhalis
attataaatgatgggctaaatgaaccaagatttagccacaatatcacccaagacttagccaagttagtaggaaattattatgaaacctgccaaaaaagcaactttagccaaactcactctagcctcaggaattggtcttgccagtttttcagcgtatgctgctgtcactgtcccgacatatga

SEQ ID NO: 1600 - DNA, 219 bp, M.catarrhalis
agcatctgccttctaagcaggtggtcgcaggttcgaatcctgccaggcgcgccatatgcctgcattactatggcggctatagctcagttggtagagccccgggttgtgatctcggttgtcgtgggttcgagccccattagtcgccccatttttcaaaatcccatcaataaattattgatgggatttttatttgttgctatagttgaaattatagggtga

SEQ ID NO: 1601 - DNA, 273 bp, M.catarrhalis
attatacgggagatagccatgaatgaaaaacagatgctagaattcacaaaagatatcgcgtcaccctttgctaaagagttacatgcgcgaagtttagccaatgttggtacaatactttatttatccaaaaaaggcatcattgatttaaatgattatttaaattttatgaacgaattaaaagaaggacttatgcagtcagatgattatgaacaagaaacaaaggaggctattcaggctgagtttgatttttatcgagagcgtctgattggataa

SEQ ID NO: 1602 - DNA, 993 bp, M.catarrhalis
atatggagttttgggagtttgaaaatgcaccataccattgcacgaatgcaaaaattcaataaagaatttacaaacgctaaagcgtgctataaaaaaatgcaacaagcttaccttacgagcaaaaataagtttgcgttttttcccatgcaacacgtatctctgcttgatatgtcaaccgccatcgcttatgagcagacaagaagcgacccgtttagcgaaaaaggcgtaaacgctctaaaaacgcttaatcagttgtacctattcggtacttggcgatatacgctcggcatttattgtcttgatagtgaaatcatcaaagacagcaaagcaatccccaatgacacgcccaccagtatttttttaaatctgcctgagtggtgcgtatatcttgatatcgacagtaccaaaattgccatcacacaagatgacaaaataaagcaaattaaaggattttgggcagtatatgatttgattgaatacaactcaaaaccacaaaaagcaattaactttatcatcgacacggacagtgatgatgatatttacttgccgctgacgcttatcttagatgatgatatgacggtcgagcaatcgctatcttacgctgataataacatcggcgatggcggctcaaacgagcttatcaaaatcttactgccctacctgctttggctatgcgttgccgagcctgagattatgcacaaaggcgagcctgtcagccgtgctaatttagataagccaaaatatcaaacaaataaaaaaacaggcgtatttattccgccaagcgagccgtttatttatgaagtgggttcaaggttaggtggtgaaattcggcactatcaagagcagatagagcaaggcaagcacagacaaacaagcaaaaaacgccctcacattcgtcgtgggcattggcatgggcattggcacggcacagggcaagctaaagaatttaaaataaaatggcaacccgccattttcgtgaacgcaggagtataa

SEQ ID NO: 1603 - DNA, 339 bp, M.catarrhalis
ctaaaggtactagcaatgattactgagcttaagataactgaatttacaccaaccaaagataaggtcatttgggatgtgcgtgatgccgagcagtaccaagaagggcatattgaacatgcggtcaatcatccgcttagtacaattgataaaacgcttttggatgccacaaaaggtgatatttatgtcttatgtggcggcggtactaaggcacaaaaagcagcaaagctcatcaatgagctggataatgaccgtcgtatcattcatttaactggtggtacccgaggggcaatcgccagtggcatggcgattatttctgagcaaccgttagaaagaaattaa

SEQ ID NO: 1604 - DNA, 249 bp, M.catarrhalis
gccgtgatttgcccttgtacgctaaatgcgttggcaatactggctttggtgcttgccacagttgcccctgtcagtgtggcaaatgatgttactaaggcagagtttttagcgatgatgccaagccataccgccccgaccatcgctgccgcactgaccagcgtgcgaaaatgctcagccgcccataagacggcattggcaatgttttggctcatcatgctgttttggttcatgatgtcatcaatgagataa

SEQ ID NO: 1605 - DNA, 735 bp, M.catarrhalis
atgtcaatccgctgtataccggcacatgagcttgagcatcagctcaatgactcagaagccaaagtgttatttattgtagaaaatttcgcccatacctttgaaaaagtggtgaataaaggtcaaattcaacaagtaatcatcacaggcattggcgatatgatgcgtctaaaaggcttgctaattaatgctgtggtgcgtcatgtcaaaaaaatggtgcctaattattgtatccctaataaaataaaatttaaagatatattaaataaaaaatatccatacactaagccaagtgtcggtttggatgatattgctgtattgcagtacacgggcggtacaacaggtgtggcaaaaggtgcgatgctaacccacggtaatttaattgccaatgtcgagcaatgcacaacttatgtcaaatctggatttgaaaaatcccatcagcatggtgaatatatggcggtagcgttacctttgtatcatattttttcatttatggtaacgatgcttggcatgaaaatgggctttgcacttttattgattcctaatgcacgagacttagatgatctaaccaagcaatttggcaaatatcgcccacagtttttccctgcggtgaatacattatttaatgctttagcacatcatgatggttttaaatcattagatcatagtaatcttaaggtatcattgggtggcggcatgtcggtattaccaagcacaggtgatgctggaaaaaaataa

SEQ ID NO: 1606 - DNA, 186 bp, M.catarrhalis
atatttatacgaaattggtataatcgatacagattaagttttaatgagcttaaagctttggcattcatcaatccaaaagttgaacaatacaatcatcacaatcccatatcatcggcagaattttcccacaaaattcgtgaaaatacccctgattctcatataaaatccaacaagcaggcgaaatga

SEQ ID NO: 1607 - DNA, 381 bp, M.catarrhalis
cttaactcgctactgagcgactggagacacaaaatgaaactacttaatatcaaaatcaatgaatttgccgtgactgcaaatactgaagcaggtgatgaattgtacttacaattaccgcacacacctgacagccaacactcaatcaatcatgagcctttagatgatgatgactttgtcaaagaagtgcaggaaatctgtgatgaatattttggcaaaggagaccgtacactagctcgcttaagctatgcaggcggtcaagcatatgacagctacacagaagaagatggtgtatacacaacaaacacaggtgatcagtttgtagaacattcatatgctgattactataatgtagaagtttattgtaaagctgatttggtttaa

SEQ ID NO: 1608 - DNA, 1137 bp, M.catarrhalis
ggctttattggtttttgtgttaaaatatgccaaatctttatcatggtatcaaatatgcttcatcgatatacggtcttttttgtggcgtgtgctttgcctttgatgttcattggtcaagttgcaccaaatatggcacgagaattggatttttggctgctttgggtggcagcgatggttttggttggcttgcctgtcttatttgctgaatttgccttgtcggcgcgttcaggtgatatgccgtggcagggtatgcaaaaactgacccgtgaagcagatgcaggcttagtttggcgaggttttgcgctgctgtctgttgttatctcaatattaatcgcagccaatctctcagggcagattgctataagagcttatgtacactttggttcggtgttacagcagtcaggtattcccatatttggtatggcggcaggcttgatggtcattgcattgatattaagcttattaaaaagtcgtttgctgatggtgggcgtcttgttgattttattgggttcactgttgccgatatatgacagagtgcgtagcgttcctgtcatgaccgaggttggactgcttgagtggtctcgtgcagtcatacttgcacttttgtgcgttggtattggtacaggcttatactggtttgggggtatggcgaccgcaccaagtttgatgactgccaaaaaatctttggcaggctatattttgcctgtttggctcactcagctaatctttggttcaattgccatcttagcaggctcagctttggtaggcgtggcgtcatttgtcgttaccagcctaggcatgttattggttgcggcatttttattatattatgcgtacacacagcttagtacacgctttggcatactgatggcggtggcgatggtattattattggcgattgtgtttagtattattcctgccaatattttattaatcatcattatctgtctaagcttggtggcggttttgatgttgtctattttttcaggatttgtgatgaaaattagccatttaagaaaaacgctgaatatgagtagtgagcttcgatataatacttggcgtgtttttgtacgcattattgtgcctattgccattattgtagcaatcatcggtttggtgcttgaatggattgtttag

SEQ ID NO: 1609 - DNA, 702 bp, M.catarrhalis
gaaattattatgaaacctgccaaaaaagcaactttagccaaactcactctagcctcaggaattggtcttgccagtttttcagcgtatgctgctgtcactgtcccgacatatgacattgaagcaggcaaagccatcgttgaagccaactgtgctgcctgtcatggtcttgatggcatgagtcctgtgcctactcagccaaacctcggtggtcaaaatatcaagtatctttataagcagttggttgattttaagaccaaagcacgccgtaatggtattatggaagctcagctggctggattgactcagcaggatttggcaaatttggcaggttattatgccagtagaaccccttggacaccaggctatggcaataaagcaacagttgccgaagcaaccaaactatacttaggcggtgataaaactcgtggcgttattccgtgttcaggttgtcatgatcccaaaggtgcaggtaatgcgtacgcaggctttcctcgcttaggtggtcagcacgctgcctatttggcaacacaattaaaactgttccgtgccgcaggtcgtgaagatgatgtttcgtcagatacagaggtgcgtaccaacgattctgccaaggcaggtgataaaggcatgatgcagatggtggcatcacgattatcagatcgtgatattaagattttatctgaatatttatcagcacttcactga

SEQ ID NO: 1610 - DNA, 486 bp, M.catarrhalis
aggaggttcttgatgataggcaaaattgaagttttgggcttagatgagcttgataaacagtttgctaaacttgatgataaagttaaagataaagccctatccaaagccctaaatcaagccctaaacccaatacgaaaagatgccaaattttatgcgtctgttgcccctgagccacatacgatgattgtcaaaggtggtcgtagggttgttgttcagcgtgggcttttgcgttcagctatccgaaaacgcaaagttcccaaacgagaaatgggcgagcttggcggacacggcgtggcaatgggtatctatgtcggcaaaggcacaaaacaaaaagaataccccaattattggcattttgtggaatacggcacaagtcaaatgcctgctgtgccatttttacgccctgcctttgataaaaatgtgcaggtcgctgtcaatgcttttgcaaaaaccttaaaagatgaaattgataagattgtcaaatga

SEQ ID NO: 1611 - DNA, 357 bp, M.catarrhalis
aaggtatatattatgagtaaagtagcaacattagcaaccgaattattggcaggtctatccgccatcaatgagccaaagaaaatcaacatcgctgaatttgatggcgacatttatatccgtcaaatcagcgtgggcgaacaagaacaaatcgccaaacacctagaaaaggaaaaaggcaataatatggcgttgtcttttatctttggggtatgtgatgaaaaaggcaatcgcttatttagccttgatgatttggacagcattaaccaaattaattttaaggcgatgttgtcagttattaaagaaatcaacaaattaaatgggctagatattgataccgaagaccacgaaaaaaactaa

SEQ ID NO: 1612 - DNA, 3540 bp, M.catarrhalis
gaaatcatcatggcaaaagttttatcacgcttagacatcttgctccacgccaacaccgccaattatgtgcgtgagatgaaaaaggcgaccgacaagaccaaaaaagaattaaagagcgttgcggactacggcaagcttgtgggcggtcagcttggtatagcttttgcaactttgggcagtgcggtgagcgtctcacacatcatcgccaccgccgaccaaatgcaaaatttggcaagccaaatccgcttagcgacgagcagtaccgagcagtttcatgccgtacaaactgagctaagagccatcgccaatgaacagcggtcaagttttgatgcggttgtggatttgtattcaaactcacagcggtcattgtccgctcttggcaaaagccagcaagatgtcatcaatttcactcgtaacatgaccatggcgatgaatgttggtggcaggtcagcacaggctcaagcggccgctttaacccagcttgggcaagcgttggcgtcaggggtgttgcgtggtgatgagtttaactcggtcgccgaacaagctcccattttgatggatttaattgccaaagagatgggcgtaacatcaaatgccattagagaccttgccaaagacggtaaaatcacggccgatgtggtttataatgcggtggcaaaagccacggacagtctgtccgccatgtccgctaagatgccaaccacggtatcacaagccctacaagtcattaaaaacgagtataattatctcattgatgacatcatgaaccaaaacagcatgatgagccaaaacattgccaatgccgtcttatgggcggctgagcattttcgcacgctggtcagtgcggcagcgatggtcggggcggtatggcttggcatcatcgctaaaaactctgccttagtaacatcatttgccacactgacaggggcaactgtggcaagcaccaaagccagtattgccaacgcatttagcgtacaagggcaaatcacggcttataatgccttgtccactcggcttgtgttactacgcttgacaaaagcccattatattgacttaaccaaaaccgccatagcggccaccgccgtttatgctcgctcattggttggtttggcaacaagttttgacagaaccacgctcgccaccaaagcggcaacgcttgcaagcataggctggacgaaaaccaaacgaagggcgataggcgtgggcattcttgccactcgtaccatcacaggcttgggcggtgcgtttatgtcgcttgggcggatcatcaccgctcaccccattcttgttttgactgccgtcattggggcggtcatcgcacgcactgaaggactaagcggagcaatcgagtcgcttggcgatgcgtttagtgtgtcaggtgtgttggcaatggactttgttggtggtgttgtggacggactggggacggcttggacagtaacggctaactactttgacaatcttattggcggttcggctaacgccacaagttttgcccaaactgcctttgggggattttttgcagggacacacaaaggctttgttggtgtgctgcaaattaccgctcgtgtgtttgacctagcaggggcgagtgtggttacttttacgcagtatgcgtggaaaaatatcagctcgctcggtactgcaatcaccaatgtgttcaaaggcattggtaattttatcgcatttgttcttgagggcgttattaacgatgttacagctaaaatcaactttgttattgatggtgtaaataccatctctggcaaggttggcggtggcacggttgcactgcttggacgggtgcgaatcggtcgcatgaattacggtagtactgattttggctttggaggatttaccgccagcgtcgccaaaaataatactcactacctagaaaaccaagtggtcaatgcctatgacaaagtgcaaagctctgccaaacaagcccatgatgccaatcttggtttggcagggtctatggctgatgtggcaaagggtgcaggcaaagcctcaaaagagttggatgacaattacaagtctcagcttgccgaatgggaacgagctaaatgggatatgagtacgccttttatctcagaacttagcaagattgaatttgaaatcacatcggtaagcggtaagtttcatcgtgccagcgatgacatgaaaaataaccttcgcaagttggctcgtgaaatggacatcgccaaagccaattttgagctacaaggcacatatacagaagccatgcgtcaaattcacctgtccaatgctgatggcagtaaatacctagaaatggcgtatgatttacaagacaccgccaacgccctgcatcttgctgatgaagagcagaaaaagcagattttaagcacgctcgccaccttagaagctgttaccaaggatcgtgaattacaaaagcaaaccagagacagcagaaatgagcttgccttacttggcgtggaagaaggtatggcacgagagcttttcgccattgaacaacagcgtactgaaacgctggggcagtacaatcatttgctaaaagatggacacactgagcaatacaaagtgatagaaatggcggtaaatgccttagaacaagaacaaaagaaaattcttgttaccaaagaatatcacagccttgttcagtctttaaaaacggacgaagaaaaacgccttgataccttaaaatcacagcttgatgtgctaaccatgcacagtcaggtgatgggggcaaatcttgacattgagcgagccaaacagctcatcagtcaaagcgtgggacttgccacacctaccaatcattatgacgagttaaacgccaaaacagcaggtcagtacgccagtctagacacaggattacaagccctgctggataacgagcgactgaccgaagaagagcgtatcaaaattaaagaatggggagcgagtgagcgagccaaaatcgaacaagcccatagcaccgccatgaatagcttgatacttagcgacagcgaagatatgttcggctcacttgccagcattgccaaagacagcctaggtgagcagtctaaagcatatcgagctatgtttgcgattgagaaaggttttgctatcgctcgatctatcatggctattcagacagcgcttgctaatgcttcggcatccggaccatttccagccaaccttggcatgatggcaactgtcgcaagccaaacagcaaatatcatcagcgccattaaatcggtggtcatgcccgtcggtcaagctcacgacggcattatgagcgtgccaaaatcaggtacttggaatttggaaaaaggtgaacgggtgctaccacggcatactgctaaagccttggatgataagcttgataaaatcggcacaggcggtcgccctgtgaatatcgttatcaataactattcaggcgaaaagaccgatgtacaacaaatgccaaatggtgatatgatggtaactatcggtaaaatgattagccataccgttgatgcaaaacttaatcagcgttttattcaagcacgccgacaaggcggtgaattatacgggagatag

SEQ ID NO: 1613 - DNA, 4884 bp, M.catarrhalis
gaaatgaccattcacggtgctaaaaaaggcggcggtaaacaaagacagcccatcatcgcccctgactctgctcaatccaaaacttttatcagtatcatgtatggcttgggtgagggtgagattgcagggcttgcagatggctataagtcagtttatcttgatgatacgcccctacaaaacgatgatggcgagtttaattttgcaggcgtcaaagtggattttcgtgctggcacaaatgaccaagagtacattgatggctttgctgatgtggcaagtgagaccaatgtgggcgtggagctaaaacatggtacgccgtgggttaagtcatttaacaatcttgaccttgacgctctgcgtgtgcgtataaaatggggagcgttgcgtcagcagaaccgtgaaaatggcgatgtggtcggcgtaaagattgattacgccattgatgtcaaaacggacaacggcggctgggtggaagctctaaatacatccatcaatgccaaaacatcaaacgcttatgagagaagccaccgtattgatttgccagacgctcaacaaggctgggcggtgcgtgttcgccgtatcacacctgatagcacctccgagcttgtcagtgatacaatgtacatctctgccatcaccgaggtgattgacttaaaattacgctacccaaacaccgctttattggggctaagatacgatgctgagcagtttagcaatgtcgctaaaatggcggcccgctgtcgtggtcttattatcaaagtgccaaccaattacaaccccatcactcgcacctatgatgggctgtgggatgggcaatttaaaatggcgtacactaataaccctgcgtgggtgtattatgacctatgcaccgccgaacgctatgggttgggttctcgcctgacccaaagcatgattgataaatggagcttgtaccgcttagcccaatattgtgaccatatggtcgatgacggcatgggtggacaagagcctcgttttactgtaaatgtctatattcagtcggcagatggtgcgtttgagctgttatctagacttgctggcgtatttcgtgccatctcctactgggacggtaccagcattgtgctagatgctgacattccccaagacagcatttacagttttagccgtgctaatgtcattgatggtatttttgaatatacaggcacacgagcaagagaccgccacaccgtcgccaaagttgcgtgggataaccctgccaaccattttaaaaccgaatatgaatatgtcagagatgaaaaagccatcgccaaattcggtgtgcgtgtggcggacatacaagcgtggggctgtacaagtaaaggacaagcacaaagggcaggactttgggcgttaaaatccgaacagcttgaaacacgcatggtaacatttaaggtggggctagatggctatatccctgcccctgctaaagtgattgaaatcagtgatgagctgtttgcagggcgtgccacgggcggtcgtgtgcttgcgattaacaaaaccaaaactgtgattacccttgaccgtgccattactgccaaagctggcgacacgcttgtaatcaatggcgatgatggcacaagccaaagacggcaaatcagcggcgtaaatggcgataatgttaccgttactaaaccctttagcgacatcagcgagcaaaatgtttgggtgctagacagtcaagatttagcaacgatgaaatttcgtgtgctgtcagtaaccgctgatgacaatcatgaatttaccatcaccgccgtgcagtataacccagtcaaatatgatgccatcgatacaggggcggtcgcctccgagcgtccgattagcgtcatcaatccaactgtgcaagctccgactaagtcggttaatctgtcaagttatcacacggttaatcaaggcgtaacggttaccacgcttgtcattggttgggagcaggtgacaggtgcggtcaaatatgccgtggagtggcgtaaagacaacggcaactggcaaagcctgccaccaacaggcacaaacagcattgaaatcacaggtgtgtatgcagggcaatatgaagctcgtgtaacggcgatttctgcctttgggcaagcaagcctagcaacgcactcaaatctgacgcagatacaaggcaaacaaggcaaaccgccacgccccatcaaccttagcgtacagggggtattatttggcatgaatttggggtggaatttcgcccgtggctcaggcgacaccaatttcaccgagatagaggttagccctgatggacgcacgcatattaccacgcttggtacttttgcctacccaaccaataagcacgaaatcacgggcttacaaggcaatttacgccagttttatcgtgctagaattgtggataagctgggcaatacatcagattggacagattgggtcagcggcacaacatcagcagacgctgataaagtgctcggcatactgtcaggtcaaattagccaaagccatcttgaccaatcactgcgtacgcccatcggcaaaatcggcacaattgaaagcaacatcagcaaaatcaatgttgatttgcccgagttgaatcaaagcattgctgatgctcaaagcacgcttaatactgctgttgctagtatcgacacagagaaaaagcgactcagtagtgcgattgttgatatcaatacgcttaagcagtctaataatgccaaaacccaagaaatcgctaatctgacccaaacggtgagcggacacacttcacaagtgcgagagcttggcgtaacaactggcgatttatcccaaaaatacagccaagtcaaaacgcaggcgaacaatgcgacatctgaaatcaccgccatcaagcagacccaaggcggacaggcgacaagtgttgagcggataagaagcgagcttgcaaataaagcaagcattgccagtattaatacacttaatcaaagcttaacaacgaaagagcgagcgttatcaatacgcattaacacagttgaaagctctgttggcggtaacagttcaagtattaacacgcttaatcaaagcttaacaaacaaagagcgtgcgttgacaacaaagcaggagcaattaaccgcccagctggcaaacaaagcaagtacagcgtcagttaatagcttaactgaaagcttagcaagcaaagagcgagcactgtcaagacggattaacacagtcgaaagctcagtaagtggtaatacttcaagcattaatacacttaatcaaagcttaacaaccaaagagcgtgcgttgacaacaaagcaggagcaattaaccgcccagcttgcaaataaagcaagcgttgccagtattaatacacttaatcaaagcttagcgacgaaagagcgagcgttgactgagcagattaatcgagctaagtcagaaatgggcggacgcattacgcaaatcagcgacgaaacacgcactttggcggatgctaatagaacgattggtgagcggattaatcagctaaatagtgaacttgcaggtgctgatagcattagcgataacttgcttattaatagtaacagaacgcttgtaacaggtgcttatttgattgcaacttaccgcattagcgaaacgcttgccaacggtgataaggtcagattgacagttatcgccgacatcggcattaaccgcacaggctttatggcgtataactcaaactcggcaggtggctcaaagcttgctgatattacgcagagccaaagcaatagttacactgctgaatttgaatggaatgttggtacaggtggtaataatgagctgcggctttatcacaatgcgtcaaacacaagaagcatttcgacgattacaagtgtaagcttacaaaaaatcacgacaggctcaggtttggcaagcattaaatcaagtgttgccaatcttgaacgaacgctaacaacgacaaaccaaagcttagctgagcggattaatactgtacaaaccaccttaaacggacagacagcgagcattcagcaacacgctcaaagcttgaacggcttatccgcccaatggacgcttaaagtgcaaagtggcggcattgtatcaggcatcggcttagcaagtaataatggcgtgtctgattttgcagtgcttgctgataagttttacattgcaagtccgcaaggcgataaaaagcccatgttttcagtaataacacgcccaaccacgataaacggtacaaccgtacctgccgtggtgtctttgaacggtgacttgataggcagcggtacgatatcgggcgataaaatccgagcaaatacccaaatcactgccccgaatattcggggcggtagtatcagcattggcagtaattttagtgttgatagtcagggtaatttgaatgcaaattctggtgtgtttcgtggtcaagtctttgctgataaaatcacaggtcagatcgatgttgaaagcttaaaaagtagtgcggtggctttgggatatgatatatttatctcacctgatggctggtacaataactcaccgacacagtttgataaagcattcaaagcgtcttatccgtcgcttggctctatcatcaacggcatcggcgaccaaaactatgatgttggtagtatcttgtatgagataagggtgttttgtaaacgagcaattactgtaaaacaaaagttatatgtagttgatgataacttatattgttatattaatggtcgctcagcgtttggctattatgaagatgattatggatatgatgtgccgaggtcttacgcaggtcgtagaaatgaagaaatttcattatcattacaacaagggttaaataccattcaatatataaacaataactcaggtaagcattcagtacacttagtgcttatcggtgatttcattgacaacaacatcattaaatttgcataa

SEQ ID NO: 1614 - DNA, 366 bp, M.catarrhalis
gattgtcaaatgaacgccagccaactcatatatgaaaaattatcggcattggtaaataatcaatgctatcccttatttattccagagcataacccaaacaatccgccttatattatctaccaaatcatcagcaccgagcctgataatactttggacggcatgacagggcatgagtgggcaaatgtgcaaatcgatgtttatcataacgactatgatgactgtttatcactagccgccaaagccatcaatcaattagaccaaatcaaaccgtccatttatcacggtgtgcgatatatgcgtgataatgagagcggattgtttagagccatcattgaatacggtttttggcaaaccttagaattttaa

SEQ ID NO: 1615 - DNA, 590 bp, M.catarrhalis
gaagacaaataattgccatgggtatggcattaaaacatttaaaactccgtaacaaagccaagatagaagatgatttataccgcatattcttctatgattgcccaccgcttgaaaagaaaatgcacaaccctattagtggtaaagccctagatttatcaaaatcagacgaagcggtgtttcgtagagaactgcataaagagctgattaaaaagcgtaagtttgccctgagactgggcagattatctgattataacaatggctggcgactaaaaccccgtgtactatccgaactcctaaaaggcaagaaagcatggggcgatttaatggatgatgattttaccattgacattatgcaaaaaggcgtagatatgcggattggggtggatatttctaccgttaccctaaaaatgcaagccaaccgcattgtactgattgcaggtgatgccgattttgtccctgctgccaaacttgctcggcgtgaaggtgttgatttcattttggatgccatgcaccaaccaatttctgatgatttatttgagcatattgatgggctgtggacgacctatcacaccaaacgaaagcaaaaataa

SEQ ID NO: 1616 - DNA, 1296 bp, M.catarrhalis
ttgtgcgtgatgataaaggcgttatcgtgtataatgatggtttttgccaaatgtcagatgaaggttatgactcaattaccaaaaattttattggcggtgacagggggcattgctgcctacaagtctgccatgcttgctcgcctgctgattaaatcaggctgtcaggtgcgtgttatgatgacagcaggggcgtgtgaatttattacacctttgacatttcaagccttgacggggcaagcggtacatactaagctacttgatgagactgccgagcgtggtatgggacatatcacgcttgctaaatgggcggatttggtggttgtcgcacctgcatctgccaataccatcgcaaaacttgcaggcggttttgctgataatttggtaacaacggtttgccttgcaaccgatgcacccatactcattgcacctgcgatgaatcagcaaatgtgggcaaatgccatcgtccaagataatcttaaaaaattacgccaatttggttatcacatcatgaccccagatagcggtgagcaggcgtgtggtgatgtgggattggggcgcttgcccgaacctgaagacttgtgccagcagattttggcgtttgataagtgccgacatatccagccgtcattattaggtaaaacagttgtcattacagctggtgcaacagttgaaccgattgatcctgtgcgttttttatccaatcactcaacaggcaagatgggttatgctttggcaaatgcgtgttatcatgcaggtgccgatgttattttagtgtcaggtaagcatgtcagtttaaagacaccgtttggggttcgtcgccttgatgtgggtacagcagagcaaatgctaaaggtttgtttgagcgtctgccaaaaggcagatatattcattgcagctgccgcagtggctgattttaaagcggcatcagttgctgaccataaaatcaaaaaaaccaaaaaccagcagaccatgacactacaattaattaaaaatccagatgtgcttgccacaatttgtcatacttatcccgatcttatctgcgttggctttgccgcagaaactcaagatgctaacaattgtgccaaaagcaagctggccgccaaacagttggacatgattgcggtgaatgatgtttcggataaaaccataggttttggtagtgaaaataatgcgatgaccgttttttttgccgaacaatacgaccaaatgccccaaaatctacccaaggcacataaatcaaaaattgctgagcaattggtggcatgtgtggtaaaaatcatgaatcaaaaacaatga

SEQ ID NO: 1617 - DNA, 276 bp, M.catarrhalis
aaaatatacttttttgttgataaaatacttgatattataaacatttttgtttataataggcacatcaaatggcaattaagggtaatcatgaagcgtaaagatttgattggtctgttaagtgaaaaaggggcagtctttaaagagggtgcaaaacataccaaagtgtatttaaatggcaaacaaaccaccataccaaggcacaccgaaattaaagaaaatgtagccaaagccatcataaagcaactaaacgccaattcacaacagacatcagactag

SEQ ID NO: 1618 - DNA, 849 bp, M.catarrhalis
acctttgccgtttggcggctgtcctgccagcagtttgattggctcataggaattaagatgaaattaaccaaacaattaaaagccgacatcatcgcccacgcctttgactgctaccctgctgaatgttgtgggctaattgtggataaaaagtacataccttgcaccaataaggcaaccgatgatgagcaatttatcctttgccccaaagattttgcccgcgcggaaagcatggggcagatacaagccatcgtccatagccaccctgacggcggtgtgttgccgtctgatttggataaattacagattgagctacatggcgtgccgtgggtcatcgtggcggtatccaagcaagattatggcgatgagcctgcctttggcatatatgaaccgtgtgggtacagaccgccgcttttagggcgtgcttatatccacggtgtgcaggattgttatagcttagtgcgtgattattacagccgtgagcttgatattgatttgcctgattttcaccgcagagatggctggtgggagcatgagaaccatgaaccactttatgaacagaactttgaaaaagctggctttgtgactgtggataagtctgtgggtaatttacaaaagcacgatgtcatcttgtgccgtgttggtcggacgcatcatgtcaatcatgccttgatttggcttggcgatgatggagcgttaaaaagcgaaaccacgcctgattgtgtgggtaatgccctaatcctacaccacccctacggacggcagtccgtgcgtgagatttatggcaaggggtgggcagataggacggtgatggtggtgcgtcatcaggcattaagtcaaaccaacctgtaa

SEQ ID NO: 1619 - DNA, 408 bp, M.catarrhalis
atcaagggcttttttaggagcaaaacaatgagtgaaacaactctaaccgaactatcacgcaccgaggcacaggtattacagagctttatcgcacaggtggattattggaaaaaccaacatggcgataaagctgccaccattgaagtcatctactaccctgaggatgacggctttgaggtggcgaacggtgagcctaataacggcgtgctaaaacgcaatcgcaccacggcgtttcgtgctgaccttttagcgtgggcgtccaatcaactgcgtcaactacaaggctgggacaacagccaaacggtcaccgagtttagcttgtcttataaaaatgaccgttatggggtgcgtgctgcccttgctagtgaagccaaagccgatgatgcaaaagcaccaaatgaagcataa

SEQ ID NO: 1620 - DNA, 216 bp, M.catarrhalis
aaatggggctttattttaggagatttcatgcaaatcacatatttaaaagacgcaccgacaggggcggtgggcgagacgcacgatgtgccagagccacaggcaagaatacttatcattttgggcattgctaagcctgctaccagccaatccaaagcagacaagcccaaacgcaaaaccaaaacaaccaccgaaaatagcgaactggatttgtcctaa

SEQ ID NO: 1621 - DNA, 207 bp, M.catarrhalis
atggtcggagtggagggattcgaacccccgaccctctgctcccaaagcagatgcgctaccaagctgcgctacactccgattttatcacttcaagcttctttatcagctcgtcgttgtggtgcgtataatacaactaaggctccaagctgtcaaccactaatttataaaataaaccataaaatctataccttattgattttaatataa

SEQ ID NO: 1622 - DNA, 306 bp, M.catarrhalis
acactgttattaaaagccacgccaagcataacaaccttttggttatatgctcaaaagccaagcaatgatcgaccttggcaagatgaagttaaggcacagatccaatttcatcaaatcggtgatcaagttactgtcaaaaatgtcagaaattttgaatggatcagcaaaaccgactatttgcctagatgggaagtacgccgctatgatttatcccaaattaaatcactggatttgattgtctcaatttgggataacgacaatatcgcacatactttgctttcatttggcttatttgtatgccgctaa

SEQ ID NO: 1623 - DNA, 198 bp, M.catarrhalis
ttaagtgtattaatgcttgaagtattaccacttactgagctttcgactgtgttaatccgtcttgacagtgctcgctctttgcttgctaagctttcagttaagctattaactgacgctgtacttgctttgtttgccagctgggcggttaattgctcctgctttgttgtcaacgcacgctctttgtttgttaagctttga

SEQ ID NO: 1624 - DNA, 2253 bp, M.catarrhalis
accctatcatttgatagggttttttatttgagattacctatgaaaaccttcacttggaaaatgaacatgggagcgtccgccagtgttcatcatgctgttagcaaaacccaatttggtgacggctatgcccagcgtgtaagtctcggcatcaacaatcagcgtaccgattggtcggggtcaaaaacaggcgactggcaaacggtcatcttgcccatcaaaacctttcttgatgaacacaaaggtgtgataccgtttttgtggacaaacccgcacgggcaaaccaaaaaatatgtctgtgaaaattatgaaatcagtcagaaaaaaggcaacttttgggagatcagtcttaagtttgagcaatcaaactcagacagtagcagtgtgccgctgcttgacttcagtaatcaaaacagcggcacaagcacgccaaatttgccgcagtctgcattagatgacatcaataagaagatacaagatgagatcgagcgcagtactcaaaaagatgatgcacatgacaaagcgattcagtcacttaacacgagcaaaacaagcttaagtaaatcgattgatgagattaaagagcagttagcaggcgtttcatcagtgcccatgtctgtcgcatgggatagcatcactggcaagccgtctagctttaatccgtcgtctcatagtcacactatcagcgacatcagcggtctgcaatcgctgcttaatgctaaagcaaacagcaatcacagtcactcttggaatagtatcactgataagccacaaagctttacaccgtcatcccatacacatcaagcaagtgacattactgatctgcacacaatattgtcaaaatatgctactaaagacgaaatcccacggattaatactgatggattgacgattgacacctcaaacttagctactaaatcaagtgttaatgagctgtctgaacaaatcgctacgaaagctgatctatcgcacacgcatacaatgagcgaagttactgatctaagtgctgaattagagcgttatgcgttaaaaacagagctaaacgatatcagtgttgatacttcacatttagctactaaatcaagtgttaatgagctgtctgaacaaatcgctacgaaagctgatctatcgcacacgcatacaatgagcgaagttactgatctaagtgctgaattagagcgttatgcgttaaaaacagagctaaacgatatcagtgttgatacttcacatttagctactaaatcaagtgttaatgagctgtctgaacaaatcgctacgaaagctgatcaatcacatagacatacaattaccgaagtctccgggttacaaggtattttaaacaataagttaaattcaaatgcgtctgctcgttctgctcaaaaactgacaacaccacggcgtattaatggcattgcatttgatggtacacaagatattactttacctacccctactgccaatgtatcttggtcagctatcagcaataaaccaacaaattttacaccgtcagcacatagacatgcgattagtgatattactaatttacagcgtgaattagataataaagcaccaagaaaccacagccacacttggaatagtattactaataaaccagcaaattttacaccgtcagcacatacacaccaatggtctaatatatctaatgtacccagtgcaacaataaataatgcaggtattgtacagctatctaatagtacaaacggcgtaagacaaacgattgcagctactgaatttgctctaaacgaagtgagaaagttgataaactcaagttctagacggggcagtatcactggtgtgttaaacagacaatcgcataggtatttttaccaaagaaggcacggcacaagttctactgatgctgtttactcagatattgatacttttacattccccgatgggaggattgtatgtttagtacgcttagaaggcattaagcctgctttttttgatgtaaataccgcatctgtgggtggttctgatcacacacccgcaaaaatcattaatttacctacagcaatgcctaataaaattatttcagcaattccacaaattacgagttctagcttgggtaatacactaagcagttgtattgtgggttgggattggacttataatattgaccctatcagcggtaatacacgaagtaagtcacaagtaagaattcagtttagtggttatcagggcaatactactaataacaaaattgatcttagcatcattgtagaggggtactaa

SEQ ID NO: 1625 - DNA, 204 bp, M.catarrhalis
ccattcaccacatttaaaatacctgcaggtaacaagtcttcaatcaattcaattaagaccaaaatactcactggtgtttgttcggcgggttttaatacaatgcaattaccagctgctaaagcaggtgcaattttccatgccgccattaaaattggaaaattccatggaatgatttgcccaaccacaccaattggttcatggtaa

SEQ ID NO: 1626 - DNA, 2025 bp, M.catarrhalis
atcatcttcaactttcgttattttaggtgtcatatgtcagtactaaaaaattggatttattctacggctttgggcgtatccattgtcggtgcggtatcagttggcgtagccttaccagcgtctgccaatggtttggcatcgctatttggggataccagccagccaaagtttttgcctgttcatgaagcgtttaaggtttcatcatctcaagtgggtgatgaacttgtagtgaattttgttgttacaccgaagcattatgtgtatcaagaacgcttatcattgacactgcctgaaggagtgagttcagggtcgtggaaatttgataaaacacctaccatgattgatgatcccaattttggtattacgcctgtatttgaagaaaatgtcacagcaaaaattaagctatcaagccaaactggtattcaaaaacagcctgttcagattcgttggcagggctgtgcaaaagctgggctttgttatccacctgaaacgacgaccgttcaaatcagcctaaatgctcatgatgggcaagttgcatctgccagccaaactgcgaccaaacatgatagcgccaccactcaaatagcccctcacaatcaggatgcctcgtctcaaacagcagcatctgccatcactcaagatgaggcagttgttcaagattttgttaaacctgatgagcaatccttggcccaaacacaaacgccacctgtcgatgaaaatggtgaggctgataccaatcaagatatacagataaatgcggtacaaaaaaaccgatttgcgcttgatcatacgctgcccacaatcagtgatgaacgcatatcaccaattttaacgattgggctattgtttttggcgggcatactgcttgcttttacgccttgtgtttatccgatgattccgattgtcgctaatattgttgccagacaacatgccaaatctgatgccaaacgaggttttgcgttatctttggcttatggcgtgggcgttgctagtgcttatggattgcttggggcgttgattgcttggtttggtcaagcacttggcattgcaacttggttgcagcgtgctgaggtcttgataggtgccgcacttttattcgcaatttttgctatatttatgttgggttggattaatattcgcctaccaagtgccatttccaatcagttatccttaaagtctcaagcagcagacaatcgactaggcaccatgggtggtagctacttatcaggtttattatctgctttggtggtgtcaccttgtgtttctgctccgatggcgggtgcgttgaccgttgttgctgcaagtggaaatgtcttttttgggtttgccgctttatttgcattaggaatggggatatcggcacctttggttttattaggtaccgcccaaggtaagtggatgccaaaatcaggtgcatggatgcagcatattcgtacattaggcggatttttactgtttggggtttcgttattattgattgagcgtgtgattttaaatacttggatgcttggtctgtggatgctttggtttattgcagttgctgcttggttgtacttgtcagttggtcgccatcagccactatttaagttattggctatcatacctatgatttgggcggctattttagcctatggcataaccatcggtgctaatgatgcttggcgtccgtggcacgcccaaagccaaagtttgtcagcttaccaagatattcatgccaaaacactcacagaacttgatagcgttcttgtcacccacgataaagtgcttgttgatgtaacggcagattggtgtattgaatgccgtattatggagcgtactttatttactgaccgcccagctgtgatgaatgattatcaggtggtgaagcttgatattacagaaacaactgatgatagccgtgcgattttatcgcgttatcaattatttggaccgcctgctttactgatttatcatcaaggtaagcttgagcgtgttttattgggtgaaacaaaacctgaaacactcaagcaagcgttaatgccttaa

SEQ ID NO: 1627 - DNA, 1218 bp, M.catarrhalis
cagtggccagaaacttgggaaaatggtaagccaattcgtgagacattggcggcagatattccattggcgattgatcattttagatattttgcaggatgtatccgtgcccaagagggcggtatttcacagattgatgaagataccgtcgcttatcattaccatgaaccaattggtgtggttgggcaaatcattccatggaattttccaattttaatggcggcatggaaaattgcacctgctttagcagctggtaattgcattgtattaaaacccgccgaacaaacaccagtgagtattttggtcttaattgaattgattgaagacttgttacctgcaggtattttaaatgtggtgaatggctatggacctgatgtgggagaactgctggcaaccaatccacgcattggtaaagttgcctttacagggtctaccgaagtgggtcaaaaaattatggaatacgccaccgaaaatatcattcctgcaacacttgagcttggtggtaaatcacctaatgtcttttttgctgatgtcatggataaagatgatgaattcttggataaagcactagaagggtttaccatgtttgctttaaatcaaggtgaggtatgtacttgcccatcacgcgctttggttcatgaaagtatcgctgaagaatttttgaaaaaagcggtcgagcgtgttaagaaaatcaaaacaggacatccactttataccgagacgatggttggggcacaggcttcccaagagcaacaagataagattttgggctatattgataagggtaagtctgaaggtgctaaaatgctgacaggcggtgaggtacgatatgatgtcgatggtggctattatattgaaccaactgtctttaagggcgaaaacagcatggaaattttccgagatgaaatttttggccctgtgttggcagtgacgacctttaaagattttgatgaagcgataaaaattgctaatgataccatgtatggtctgggtgctggtgtgtggacacgagatggctcaacggcttatcgagcgggtcgagcgattcaagcgggtcgagtatggacaaattgctatcatatttatccagcacacgcagctttcggtggctataaaaaatcaggcattgggcgtgaaaaccataagatgatgcttgagcattatcagcttaccaaaaatctattggtaagctgttcacccaaggcgatgggtctgttttaa

SEQ ID NO: 1628 - DNA, 1538 bp, M.catarrhalis
  unsure (6),(7),(22),(43): Identity of nucleotide sequences at the above locations are unknown.
acttcnntagtaattatttcgnggttagcacgctgctcatganagcagatatgtcggcgcaactaggaacttggtcagcacgctctggctttatttttgcagccatcggatcggctgttggtttggggaatatttggcgttttccctatgtttcttatgaaaatggtggcggtgcattttttttaccctatttgattgctttggcaacagcaggatttcctttgttgtttttagactatgttatgggtcaaaaatataaaggtgcgccgccgacagcttaccgccgctttatcaaatcagcggaaggtattggctggtggcaagtagcagtttgtaccattatcggtatttattatgcgtctgttctaagctgggctggtaactacacgctatttgcagtgggtcagcaatggggtgaggataccgaagggtttttctttaatacctatctacaaaatgccagtgaattaaccatggcttattcatctcagctattgattggtttggtggttgtttgggtgatggtattattgattttatatggtggtatcaaaaagggtgttgagctatcaaataaaattttcattcctttattaatagtgatgtttggcgtattggttgctcgtgcggtaacgctaccaggcgcaacggtaggtttggataccttttttgcgcctaattgggaaaaaatggcagaccctaaggtttggttggctgcttatgggcatgtgtttttctcgatgtcaattggttttggtatcatggtgacttacgcatcttatctaaaacgcaatgccaatctaacggggtctggtttggtggttggttttgccaactcatcgtttgagcttttggcaggtattggcattttctctgttttgggatttatggcgcaggcatcaggcgtaccagtttctgaagtggtttcaggtggtattggtttggctttcatcgcatttccaaaaatcatctcaaccatgggcgatgctggcaacttggtaggtattttattttttggttctttatttattgctggcgtaacttcaatggtgtcaatcctacaagtgcccatttcagccgttcaggataaatttggctggtcaaaaaatcaatcagttactgttgtaggtttaggttcagccatcatttcgattacattatttggctctcaaaatgccattacatttgtggatgtgattgataattttgtgaataatattggtattgtttttggtgcgattttatctatcatttgggtaacttggtttaatcgcaataaactgcgtggattgattaatcatatcaatgccatctcaagtgtgaaagtgggtgcgatttggtcattcatgctgacgattgtaacgccgattgctttgattgttactttgggcttgacgcttaaatccttattaaccgaaggttatggcggttatccagctaatgtacagctcatctttggctggggagtgattattatctgtgcaattttggcactgatattaccacgaatcaacggccattcatctcatgaaaaataa

SEQ ID NO: 1629 - DNA, 1236 bp, M.catarrhalis
agactttggatgtgggtggttgcctttttgggtgctgctactgcatataccgaatctaccttagctcagatttataaagaaaacgaccgtggtcagtaccgtggtggtcctgcttactactttgaaaagttctttggtggtgggtttggtaaattttatggtattttagtcgccatttcattcatcatctcttgtggattattcttaccaggcgttcagtcaaatggtgttgttaaagccatcacgggcatcacaggtgaaggcactatggtaaatactgcatttggtgcggttggtacaaataccctggtggtaaccttggtcatggttcttattttaggcttaatcatttttggtggtattaagcgtatcgctcgtgtggctgaatttgttgtacctttaatggcattgggctatattttgatggccgtgctgattgttttatttaatatcaaccaactgcctaatatcatcagtctaatcgttggtgatgcctttacagcacaagcaggcttgggggctgcaattggctggggtgtgaaacgaggtgtgtattccaacgaagcaggtcaaggtacgggaccgcaccatgctggtgcagcagaggtagaacaccctgcacaacaaggcatggtacaagctttttcggtctatgttgataccctatttgtttgttcagcgactgcctttatgattttaatgactggcatgtacaacattcaaggcacactgccagaaggtcagttcttggttcaaaatgttgatgcagccaccatcatcagcggacctgcatttacacagatggctgtttctagcatttttggtagttttggtaatacctttgtggcggttgcggtatttttcttctcatttaccaccattatggcttattattatattgctgaagttaatgtggcatatttgacacgctcaattaaaacaacaggggctttatttttcatcaaactggtgcttatctttgcggttgcttatggggcaatcaataactcaggttatatttggaatatgggtgatgttggtgtcggtttaaccgcatggcttaatattgtcggtattttggcgatcttctttatggctaagcctgctattttggcactcaaagactatgaagctcaacaaaaagctggcgtaactaagtttacttttgaccccatcaaactgggtatcaaaaatgccactttctgggaagaacgcaataaaaaagaacaaaactaa

SEQ ID NO: 1630 - DNA, 1164 bp, M.catarrhalis
acagggggtgtaatcatgttatatgacttatttgattatcagctattaaagctggtttggtggctgattgtgggtatactactcattggttttgccatcatggatgggcatgatattggcgtttgtacactgctaccgtttgtcggtcgtagtgatatcgagcgtcgcattattattaatacggtggcacctcattgggagggtaatcaggtttggtttgtgactgcagggggtgcaatttttgcagcactgcctttggtttatgcgacagcatttagtggctattactgggcgttgatcgctgcattgtgggcattattttttcgccctgtgggttttaaatatcgcagtatgataaaaaatgatcgttggcgtcatacttgggattggctattgtttattggttctgcagtacccgccttaatttttggcgtcacttttggaaacttattgcttggttcaccatttcattttgaccaaaatttagtatcaacttattcagggtcgtttattgaacttttaacaccttttgcacttttgtgtggcgtggtgagtgtggcaatgctgacgatgcaaggtggtgtatatttggcacaccgaactaccgaaagcatccaatcttatgcaaaaacagcaaccaatgttgcagcattggctacctcattgttatttgccatagcaggcttttgggtgcaatcactagatggctatttattagttggtgatattgatggcggtgcggttattgatcctttatcaaaacaagttcaaatccaatcaggtgcttggttgaccaatttttatgattatccttggctgtggctattacccgctttgggggttttgatgccagtgatggtgattatcttattaaaaatagaacgcactttgctggcttttattgcctcaagcttagcagttttgggcatcattgcgaccacaggggcagcattatttccattttatatgccatcttctaccgacccacgctcaagcttgacagtttgggatgcaacctcaagccattttactttgcttgtcatgctttttgttgttgttattttattgcctttggtattgacttataccagttgggcttatgcggtgatgcgtggtaaggttactaaagcctatattaaagaaaatgaaaaaacgctatattaa

SEQ ID NO: 1631 - DNA, 1443 bp, M.catarrhalis
cagcttttattatatttaggggactttggtatgattaccgagcatttggttgatatatcacgcctacagtttgcaacaacagcattatttcattttttatttgtgccattaacacttgggatgacttggcttttggtcatcatggaggctgtttatttaatcacaggtaaacaaatctggaaagatatgactcgtttttggggcaaattatttggaattaactttgtgcttggggttaccacaggcatcacaatggaatttcaatttggtaccaattgggcatattactcacattatgtgggcgatgtatttggtgcgccactggttattgaagggttgatggcattttttcttgaatctaccatggttgggctatttttctttggctgggataaaatgtcacggttacaacattttacaaccaccttattgatggctttgggtaccagcttatcggcattgtggattttggtggcaaatggttggatgcaaaaccctgtcggtgctgaatttaattatgacaccatgcgcatggagatggtcagttttgctgaaattttcttaaatcctgatgctcaaaataaatttgtacataccgtatcagcaggctatgtgacgggtgcgtcatttgttcttggtatttcagcatggtatttgcttaaagggcgtgatgttgctcttgcaaaaagaagctttcatgtcgccgctgcatttggttttgcggcaatatgcagcgccattgttttgggtgatgaatctggctactcaattgggcaagctcaacaaaccaaacttgcaaccatggaggcaatgtgggaaacagagccagcaccagcaggctttaatctcattgcagatatcaatgaagcagaacaaaaaaataactggtctttgcatatcccttatgtcatgggcgtgattggaactcggtcaatagatactgagattttgggtattcaagatattaaaaaactcaatgctgaccgtatcatcaatggtgtgactgctgttagtgcgcttgatttgatgcgtcaaaataagctaaatggtataaaaaatccgcaagcactgattgatatttttgaagaacataaaaaagatctgggttttgggctactgttaaaaaaatatacagatgatatggctaagattacgccacagatgctttcaaaagcggttgatgatagcataccaagggtaaccccaatgttttggtcatttcgcctgatggtgggtatgggcgtattaatgcttatcttgtatgggctgtgtttattttttagtctaaaaggcagctttatccataaaccttggctgcttaaatttgccatgattatgattcctgcaccttggattgccatagaagcagggtggtttgtcgcagaatatggtcgtcagccatggacggcatatggatttttacccacgcatttatctgtttaa

SEQ ID NO: 1632 - DNA, 249 bp, M.catarrhalis
  unsure (116): Identity of nucleotide sequences at the above locations are unknown.
ggtcttgctttgtatgaacttgccaaaccgacacccagtaagtttcaaaaggtttgcttgatttggcagagtttgcctgtgccagtcattgctgttgtacagggtgtgtgcgttgncgccggtcttcagctggcacttggggcggatattcgtatcgcagcgatggatgcttgcttatcagtgcttgagactaagtggggtttggttgctgatatgggcattacgcataccgcttgtgatattcgctga

SEQ ID NO: 1633 - DNA, 720 bp, M.catarrhalis
tctgcagcaccaacagttcagacacgccccgaagcaatcgaagctgcccgtaaggccgaagaagccaaaaaggctgctgagatgcttaagaactctgaacaagaaacaaaggatgaaaaagccaaaaccgctgataaacccaccgaaaataaagctgaaaataaaaaagagaataaaaacacccaaaccaaagcacctgtgaaggcgggtactcacgatgttcagcgtggtgaaacttggcagggtattgcgaatcgttacggcatttcggttgccgccttggttgaagctaatggcgtgacacgcaatgatattttaagagcagagcgtcgtatcaagataccatctgcatctcaaatagctcgtttggagcgtgataataaagccagagaatccgcatctaaagacggtaataaaaaatctgacaatcagcctcaatctaagacagataaaaaaactgaatcaaaatctcaaagttcccaaacatctgagcggtacatggttcaagtggcaatctctccagataaagatcgggttgatgaggtggttaaaaagtatcgtgatgctggctataaagtcacaaccagcaatacaagtcgtgggttgcgtatcttggttggtaacgaaaaaacagaagaagaagcaaaagcactgcgtactaagattgccgcagattctcgtgtcccttcatcgggtgcttttgtgcataaagcccaataa

SEQ ID NO: 1634 - DNA, 483 bp, M.catarrhalis
ttatgtcagcctttgggcgatgaagtttatcccaagtataaaacttggtgcgatgaatatttttatcttaaacatcgtcatgagcgtcgtggcgtgggtgggttgttttatgatgacatgaatacagcatccacaaactgggactttatgacatgttttaagttcatgcaggccgtcggtcaaggatatctcgatggcatcataccaatctttgagcataataaacaccaaagctataccgagcatgaacgccaattccaactatatcgccgtggtcgttatgtggagtataatttggtatttgaccgtggtacactctttggtttacaatctaatgggcgtaccgaatcaattttggtttctatgccaccgctggcagcttgggaatacagatatgaacccaagcaagggacgcccgaatttgagttgaccgatttttatctaaaaccccaagattggctaaacttatcagataagccataa

SEQ ID NO: 1635 - DNA, 477 bp, M.catarrhalis
caaaacggagccgccgccatgtttcataaaattaccttagctgctgcatgttttatgactgttattttagcaggttgcaacagctcagggactgccaccgccaataatccacaggttgaagaccgtgccaaactcatgaaagattggcgtcatgccaatgaaggtatgaaggcaatgattgaagacccaagtcgctttgatgccatcacctttaaagagcgagctgattttattgctgataccaatgccaccatgtgggtacactttgaaggagaaatggctcaaggtggtcatgctaaagatgagatatggacagaccctgaaggctttcaaaccaaaatcgaagcgtttaccagctcaattaatgcacttgccttagcagcatcagaagctgcctcggcggctgatgttgaagcaagctatggtgaaatggccagccagtgtggttcttgccataaggcttataagaaaaaatag

SEQ ID NO: 1636 - DNA, 1218 bp, M.catarrhalis
atcaaaaatttggcgagtaaggattttttgatgaataaaatgcttccgaatctggcagatcgagcaatttttaatttgggtttccgaatattttttgcaagtgcggcggtatatgctgtgattagtatggtgctttggctatttgtatatcgtggcggcgtgtttagtgcccatatgagcattgcaccgcaatattggcatggtcatgaaatggtttttggctactcaatggcagttgtggcaggatttttattgaccgctgttggtaactggacaggaaaaaccatgccgagcggacaacaactttatcttatttggttgccgtggttatttgcacgcattattttcattgttttaccacagtttttatggctaggtgtattggcagatattgtatttacgattttatttttaataagtattacaaagcctgtgataaaaaccaaacaatggcgacaaatgggcattttatcaaaaattatcctaatgctgattgcaaatttattctgtcttgcagcaacattaggctggcacattggttggtattatgcactttatttaggggtttttgtgattatcggtcttgtccttaccataggaaggcgggtaacgcctttttttatctcacggggtgtgggctatgcgtttgaaccacgcaataatcactacatcgatcgcatcagcttgattagtttcgtgattttcttcttgcttgaggtttttgcctcacagcagctgcttgccagtttatgtgcgttggtttgtgcattagtacaagcttggcggcttcaagggtggtatacgcgagggatttggaaaaaacctttgctctggagtatgtttatttcgatggcctgcattgtatttgggcagctcatgtattttttgcgaattttccaatttggcatcaccaattcattagcaatgcatatgatggcagttggcggcattggcatactcagtctttctatgatggcacgcgtcagccttggacactcagggcgtagcatccatcaaccaccaaaaacagtgccttgggctatcagtttattaagcgtggcaacagtttttcgtgtgattttaccgtggcttatgccacaacatctggtaatatggatcattcacacacaaatattatggttgatagcctttttcttgcttagcgtcagctacatgaatatatggcgaacacctcgtattgatggcagagcaggatag

SEQ ID NO: 1637 - DNA, 2133 bp, M.catarrhalis
aatatgaatttcttgataattggaagcgaaacagtcatgacggattcagccacctaccgccaaccatataccgccaaagtctttgatgagattttgacgatgcgtcctgacacgccgattttggattgtatcgccagccctgatgatttaaaggcactgacaaacgatcaattgattcagttggctgatgagctgcgtgcgtatttactttactcaacaggcgtaagcggagggcattttggtgctaatcttggcgtagttgagctgacgattgcactacatgctgtgctaaataccccttatgataagcttgtttgggatgttgggcatcaagcttatgcgcacaaagttttgacaggtcgccgtgaacgccttccaagtatccgttcaaaagatggtctgaccgcctttcctgagcgtgaagaaagccagtatgatacttttggcgtgggtcattcatcaacctcaatatcagcagcgttagggatgagtttggcggcacgattacttggcgaaaatcgtaccgtggcagctgtgattggcgatggtgcgatgacaggcggtatggcatttgaggcgatgaatgatgctgtccaacaaaatgccgatttactggttgtcttaaatgataatgacatgtcaatctcagcggcaattggtggtttttcacgccatttggcaaagctatggcagcgtggacttgccatggatattgataagcatggtaatattttgatggtcaaacgcaccatctcctctgatgaccgccgtattcgtcattatttgcatatggcaaacggtgcttttgaagatgtttcaagtcgcctaccgagtaaaatcagcgaaaaaatcagtgagctttttcatggcgttacctcttcacctttgccagataaaattgctgaaaaaattggcgataaattatttgcagataatctatttaaagccattggttttacttatcttgggccgtatgatgggcatgatttacccaaactcatccaagtgcttgagcgtgccaaacagttaaaaggtgctatcttaattcatgtacataccatcaaaggtaagggttttttacctgccgaagctgatccgataggctatcatgctatcggaaagttacccaaagcaggcaaaaatcaagcacccacatctgcaccaactgccaaaaaatattcacagatttttggtgattggttgttgcattgggcaaatattgatgagcgcttggttgccatcacgccagctatggcggaaggttcaggtatggttgagtatgccaccaaataccccaagcgattttttgatgtggcgattgctgagcagcatgcggtaactttggcggcaggcatggcaacttcaggcaaaattaaacctgtggttgcgatttattctacttttttgcagcggggttatgatcagctgattcatgatgtcgccctacaaaatcttgatgttacctttgctattgaccgtgcaggtttggtcggtgaagatggtgcgactcatgctggggtttttgatttggcatttttacgctgtgtgcctaatgtcatcatcgctgccccaagtgatgaacatgagtgccatcagttattgaacacttgttatcagtatgacggtgtggcagccgtacgctatcctcgtggtgttggcgtggggcgtaaggttgatatgacagatgagcattacccgattgggcgggccaatgtggtctggcagtcatcaaactttgatacaaaaagcaccaaaaaactggcagtattatcgttcggcactcgcctaaaagatgctctgaccgccgcccaaagactgtcagaaagtcaagcaatcgcttgtatcgtggtggatatgcgttgggttaagcctttggatgaggcacttattttaaggctgcttgagatgggtgtgacgcatattgctactgttgaagagcatcaaatcacaggcggtgcaggcagtgcggtgaatgaattcatcgtaagcctacaagcgttggttaagctgttaaatatcggtatcaaagatgcgttcattcatcatgccagccatgaagaacagctgttgtattgccgattggatactgatggtatttatcaatctttaagtaatttaatcatcaaaaactaa

SEQ ID NO: 1638 - DNA, 315 bp, M.catarrhalis
gatgtgatgcagcagattgccatgaccgctgagatgatgggtgcaccgattgccaaggattatggactattgacgcatatcagcgatgaccctgtttgtatggcgatatctttgatagatgccatcaagatgcgttcacctgatgtagtacttgcaagcaagcgtgtgatgaataccacgcagcggcaagattatttggcactgtatcaagaaaagctttggcagatcaaactgatgctcggtgccaaccgcaagcttgccatcaaaaaagcaaaagatagcacggtgcaatttattcagcgtcaatttgagtga

SEQ ID NO: 1639 - DNA, 516 bp, M.catarrhalis
tttgagccaaaaaccctaatccagcaggaacatcttatgcaagcacaaatccaagcagtcagagattttttgttaaacttacaacaagccatcgttcacgcccttgaaaaccaagaaaattcaggtggctttgatggtcgtactgataccaaattcatcgcagatacttgggagcgtcccgaaggtggcgggggtcgctcttgtgtcttatcaggcgggcaagtcatcgaaaaagcaggcgtcatgtttagccatattcatatcaagcagatgcctgcttctgcgacagtacgccaccctgagctggttggtgctcaagcacaagcactgggggtctctttggttgtccaccccaaaaacccctatgtaccgacaagtcatgccaatgtacggttatttgttgccacgcccaccgatggtagtgcaccaatttggtggtttggtggcggatttgatttgacacccttttatccaaatctcaatgatgtcaagcattggcatcaggtggcttattag

SEQ ID NO: 1640 - DNA, 312 bp, M.catarrhalis
ttgaagatatgcttaagcaacccgccgaacgagtttctgaaacacccacacttttatcagaaagtgcaacaagtatttaataagacggtaacacagcatttcacgcaacacaagatggatgctttgattgagttttatagttcaccaataggtaaaagtatacacaaaaaccaaatggcgtttaatcgagatctcataaatagcttatcaaatatcgtcatggagatggatgaattgggtacgcccaaagaagagcttgaagcgatatatgataaattgttcccgcaattacatcaaatttttgaaaaataa

SEQ ID NO: 1641 - DNA, 378 bp, M.catarrhalis
agcaggtgtagtatggaaccgatggttgtcatggcggcaaacgcagccaaaaaagtgggtcatgaaattttgcgagcacatcaaaatcgccatcgccttgatttggcggtagaatccaaggggcttgatggcttggttacccaaattgaccgttatgctgaagagctgacgattgctacactcaaagaaagctatcccaatcattcgtatttgggtgaagaatttggcttacaagagggtaagggtcatgatgctgattggtgttgggtgattgatccactagatggcacccaaaactttgtccatggcgtcccacatttttgtgtgtctatcgctgtccaaaaaaatggcgtcactgagcatggtgtgatttatgat

SEQ ID NO: 1642 - DNA, 630 bp, M.catarrhalis
aaatgtttaaggtattttcccttgtataagtttattaccaaagccaaactgccgaccattcatggtgaatttgacattcatatttttgaaaatgacgatggtcaagagcatattttattaagtacagggttacccaatcatacagataaattacttcttatccgtatccattcagaatgcctaacgggcgatgcgtttgggtcactaaaatgcgactgcggcccacagctaaatgctgccatgagtgccattcaatcacatggcgtgggtgcaattttgtatttgcgacaagaggggcgtgggattggattaaccaacaaaatacgcgcctatgctctacaggatcaagggcatgatacactagaggcaaatttattattaggtctgccagctgatgcacgcacttatgagatgtgccaagcaatgcttgcacatgtaggcattaatcaagtggctttaatgacaaataatcccaataaagtcaatgagttaaatgaattgggcatcacagtggttgagcgaattcctctgattgttggcatcaatcaacacaacacttcttatttaaccgttaaaggtgaacgcatgaatcactatatcaatacagatgatttgagccaaaaaccctaa

SEQ ID NO: 1643 - DNA, 450 bp, M.catarrhalis
caggtcggtggtttggttatgatttctaaacaaattgtattgggcattacgctggtcattggtagcggcgtggctttttttgccttggcaaaaaatgacactcaaacaaccaaatcagtacaaacgccccagcagataccaagtgataccaaggtggcaaaacctgtggttcagcctttgacggcagatgtagctaccgaagaaaagctacttgccgaaaagcagcgtgtgcgtgaagcacatacgcttcaaatgcaaaagcaagcggctgccttgcttgaagaccaaaataatgcacgcaaacaagcacttgaaaaagccagttccgaagctaatggacgcatgacgaacgatacccaagcagtttcagcggacagtgctgccaaaagtgagttgatctgcagcaccaacagttcagacacgccccgaagcaatcgaagctgcccgtaa

SEQ ID NO: 1644 - DNA, 1395 bp, M.catarrhalis
gtgatttttgttttaaaagcccaccaaaccaagtacaatagcctaaagtatttgggaatcataattatgacaagaactttaagccagtggctagaatatattggcggcattcatgtgtctgccattgatatggggcttgagcgggtgctgcctgtggcaagttatttgggcattattccgataaagacccaacaagatcagacggacaaaaaaccaatcatttttactgtcgcaggcaccaacggcaaaggctcaaccacgaaaactatcgctgccatttgtgaagcttgtggtctaaaaacagcactgtatcagtcgccacatttggtatcttttacagaacgcatttgtattaatggcaatgaaattagtgaaagtgatttggtggcagcgtttgaggcggtagaaaatgcacgagtggccaaaaatgtcacgctgtcattttttgagatgacgactttggcggcattttggcattttaatcaaaaaaaatgtgatgtttgggtactagaaattgggcttggtgggcgattggatgtggttaatatcatcaatcctgatgtggcagtgattaccaatattggtattgaccatgtggattggttgggtgatgacattgagtgtatcggtcaagaaaaagcgggtattattcgagaaaatattcctgtcatcttgggtgcaaggcagttaccaaatagtgtgcatgaacttgcaaatcgtttgacaaagcatgtgcatcagttgggtgtcaactatgattatatggagcaagatgagacatggattttttcaaatgcagcgttaaccatacaattacccaaaccaaaattatcgttacaaaatgctgttaatgctgttgcagcggtgctagaaagtgggataaaaattcatttagatagcgtgatcgacggacttcatcaggtacaactggcagggcgatttgatcagcgtatcattaatgatcggcattggatatttgatgtggcgcataattcacatggaataagcttttttttggcacaatgggctgatgaatggcataaacacaaaaaaatatatccggatgctaagcttaaggtcatattttcaatgttgggcgataaagatgttgatgcggttcttgaggtgattaaagctgcccttgatgataaaaaaataagcatccatgattggtctgtcgccgcaattaatcatcctcgtgcgatggatttacagacgcttttgggccatgttcatacgcatatccagccatcaaaccttaaaatataccaagatttagcacaagctgcccaaagtgtctcaaccgatgccagcacccaagatttgattgtggtttttggctcttttcacaccatcagcgaaactttggtggcgttattgggcagaccgtattag

SEQ ID NO: 1645 - DNA, 654 bp, M.catarrhalis
ctatttagattggagaaacttatgtcaaaaggacaaaccttacaagacccatttttgaatgctctgcgtaaagaccgtattccagtatcaatttttttggtcaatggcataaagctacaagggcagatcgaatcttttgatcaatatgtcgtattattaaaaaatacagtcagccaaatggtgtataagcatgccatttcaacggttgtacctaccagaaatcctcgcacagaaggcggctctacacctgcacaatccgctggtggatatcaaggcgctaatctgggtgtcatgtctagtggcacttatcaaggcggtggttttgagcgtcaaactcaacgcggatttgaccgtggtggtatgggctatcaaagcagctctcgcccacaaggcggctttactcgtacctctcaaactggttttgagcgtcaaactcaaggcggatttgaccgtggtggcatgggctatcaaggcggggggatgaatcatactggatttgagcgtcaaaattttgatcgttcaggatttgaagctcaaggctttgatggtaaggcctttgaaagcaatgataccaaaaatttcaaccgctcaggttttgacgccaaacctgacccaaaatttaattatgatgacgattttgaaaatcaatcctga

SEQ ID NO: 1646 - DNA, 1206 bp, M.catarrhalis
caaccgatatcggttgggttatctattaccagttatcttattttcatcacacttgattataatttgagccatcacatgagttactctattttttgccaaactaaaaataatgtcttgttagagccgatgttttttggtcaacccgtgaatgtctctcgttatgatcaacaaaagcatccgatttttgagcaactcatcgaaaaacaactgtcatttttttggcgtcccgaagaaatcgatgtctcaaaggatcgtattgattttgccgaactttctacgcatgagcaacatatttttttaagtaatcttaaatatcagactctgttagacagtatccaaggtcgtagcccaaatgtggttttattgcccttggtttctattccagaacttgagacttggattgagacttggtcatttagtgagacgattcattcacgcagttacacacatattattcgcaatgtggtcaatgaccctagtaaaatttttgaagatattgtggataatgaatatattcttgagcgtgcaagtgatatcgccaaatattacgatgacttgcatttgtgtgccaaattatatgatttgcatggtgagggcatttatcagattgatgggcagtctgttgaggttacgctaccaaaactaaaaaaacagctgtatttgtgtattgtcgctgtcaatgtgcttgaagccattcgcttttatgtatcatttgcctgttcgtttgcatttgctgagcgtaaagtgatggagggtaatgcgaaaattattaaaatgattgcgcgtgatgaagcattgcatttaaatggcactcagcatatgatcaatctgatgcgtcaaggcagagatgatcctgacatggttgccattgccgaagcgtgtcaagaagaagcgattgagatttttaaaagtgctgccgaacaagaaaaagcttgggcaaactatttattcaaagatggttcaatgattggtctaaatcgagatattttatgccagtatattgagtttattacaaatactcgtatgtcggctattggattgccagctatttttgaaaccaaaaccaatcccattccttggattaatgcttggctgtcttcagacaatgttcaggttgcccctcaagaaaccgaaattaccacttatttggttggtcagattgattctgatttagatgatgtggatttggacgattttgagctataa

SEQ ID NO: 1647 - DNA, 399 bp, M.catarrhalis
tttggagtatctttcttgaaactttatccaatgaaatgtcatatgaataataaccaaaatgccgttgtattattttcaggcggtttggattcaaccacctgtctgtactgggcaaaatcacaatttaaaactgtcactgcggtcagcttttgctatggccaacgccattcaagtgaacttcatgccgctcaaaatatcgccaaaaagcttagcgttagacatcatgtcattgatattgatatcgcaaaacttggtggctcggcattgaccgatatgaatctatcggtgccaaatcacgatgagtctgtcacctacagcgatgctgatcaggtcgcaccgattacttatgtacctgcacgcaacaccatctttttatcttatgcgttggccagttgctga

SEQ ID NO: 1648 - DNA, 462 bp, M.catarrhalis
cctgctgaatcaaatgctgatgccagtacatcggcacaaacttgttcgggtagagcggtactatcaacaatcattgcattcatcccacctgtttcggcgatgagtactggattatcatcacgagcagcaagtagtttattgatatgtttggcaacttctgttgagccagtgaaaataacaccgttgatgcgttcatctgatgttaaagctgctccaacatcgcctgcacctaagacaagctgtaaagcatcttttggcacaccagactcatgtagccaagatactgccaaatgtgcgattaaactggtttgttcggcaggtttggcaacaacagtattacctgttaccagtgccgagacaacctcaccgacaaaaatagctagagggaagttccatgggctaatcgcaacgaccgtaccaacagggctagacagattaagcgattctgcttcatcagcataa

SEQ ID NO: 1649 - DNA, 324 bp, M.catarrhalis
  unsure (192),(198),(202),(228),(230),(233),(235): Identity of nucleotide sequences at the above locations are unknown.
ctggtaaatccacgcgcgtgcaacagtgcaaccgccaacgcatcgcccaaagccagtgtggctgtggtgcttgaagttggtgcaagtccaagggggcatgcttcttcggacagacccaaagtcagtgcaatgtccgctgatcttggcaaaattccacgcttatcacgactgatgctaattagtggaatgttnagcgtntttnaccgccgccgaaatcgcacgcgcgtntnatntnattcgcccgaatttgagatggcaatgagtacatcgccttgtacgcgacgattcccaaatcaccgtgccctgcctctccagggtgcataa

SEQ ID NO: 1650 - DNA, 558 bp, M.catarrhalis
cggattgcgttcaggcactctcaggtgatcgctacggataatcctatgaatgtgattgacattattatcagcattgttgtgcttttgggtatttggcgtggttttactgttggcatgataaaaagcatggcaatgctgttatcgtggtttattgccttagtggttgcatcaaaaacagcaaatagtttttctcatatatttgccccatggattgacaacccagttttacaagttgccatggcgtttattgtcatcatgctgatcactgttttacttgtcggcacagttgctagcctattatcacgctcatttaaggcattaaaattgggatttttggatcgtattggcggcagtgtatttggtgccgccactggcatgttaaaggttttgattgtcctaagtatcatctctccgatattaatgctaacacctgccgctcagtcatctgtacttgttccaagcctattgccttatgcaccaatggcaaagaatttcttacataaggcatttgatagtacttggaatcagctggaaaatccctataaaaatcaacgatga

SEQ ID NO: 1651 - DNA, 1470 bp, M.catarrhalis
tcgatggacactgacatgaaacatttaacaaaacatcgcctatcagctgccatcattggcgttttattattcattagcccatcagtgcaagcaaatacgacacaccatcacacgctaaccagtagcgagcttaaacttgctgatgatagtattattgatagtatcaatcaattgggtgagctgaccgtcaatattccaaatacacaatattttcaaaccaacaacggtgtgagcgttgcttttacgccattacatgagctgcctattgtcgatatcagcttgtattttaatgcagggtcagcgtatgaccatcaggttggcaaatcaggcacggctaacatggttgcaaccatgctcacccaaggaactgacagcctttctgaagatgagtttgttgctgccaaagagcgtcttggcattgattttaccagtacagcaaataaggataacttaactttatcattaagaagcttgtctgatcaatcattattaaatcaagccgccgatttaatggtcgatgctgtcactcaacctgcttttgatgataagactctacaacgcaacaaaaatcagctcatcaccagtttaaaacaaaaaaagcaaaacccttatcatgtagcttctgttgcttatcatcaagccgtatatgaaaatcatccttatgcacacgcaaccacaggcgatgaagatagtattgccaaaattgatcgtgatgagctgcttaatttttggcatacttttattaatgcaaataatgcgacactggtgattacaggtgatatgaccgccaagcaagccaaatcacttgccaaccatctgaccgccaaattaccgacaggcaagtcgtataaaaatacgctggatttgacaaaaccagttaaggctcgccatatccatattcctcacaacagtagtcaaacccaaatcatcatcggtcaccccaccagtaaagtacgcacggacaaagcaggtcgtcaagagttcagcgatttttcattaggtaatgaaattttggcaggtggtgattttaatgccagattgatgaaaaccattcgagagcaaaaaggctacacttatggcatttatggcggtatggaacgcctcagagcaggtggtaattatgtggttgaattttcaaccgatggcgataaagcagccgatgccattttagagacgctacacatcattaatgagtcgctgaatgaaggcataacccaagaagagcttgaattggtgcgtttgggtaataaaaatggttttgccaatattttttcaagcaatgccagtattcatcgtgtcattggtgcgttatttgttgccgattatccaaaagaccatcttaaccatacactcaatcgcttggataatgccacgataaatagtgttaataccgcacttaattcacgcatcaagcctgatgaatttatcatcatcaccgtgggtaaaaccaaacccaatttgggcaaataa

SEQ ID NO: 1652 - DNA, 1542 bp, M.catarrhalis
tttggagtaactatgtgtggtgtaatcggcgttatggcgcatgaacctgtcaatcaaatattgtatgatggtttaaccatgctacagcaccgtggtcaagatgcggcgggtattgtcaccttaaaagacaatcgcctctatctgcgtaaagataatggtatggtgcgtgatgtattcttaaatcaacatatgacacgcttggtgggcaattgtggtatcggtcatgtacgctatcctaccgcaggaacttctagtaccgcagaagctcagcccttatatgtcaattccccttatggcattgctttggcacataatggcaacttaaccaatgccgaaaaattggcgcgtgagctgtacgaagaagatcgccgtcatctcaatactcagtcagattctgaagttttgcttaatatttttgcccacgaacttcaaaaatttaccaagcctgctttagaatctgatgatatctttgaggcactgactaagctgtataaacgctgtcaaggtgcgtttggtgtggtggctttgattacaggtcacggtttggtggcatttcgtgatcctaatggcattcgtccattggtctatggacgccgattgaccgaaaaaggcatagaatatatggtcgcatcagagtcagtcgcattacaagcgcttggctttgagatagtcagagatatcgcacctggtgaagcgatttttattgatctaaaccacagcattcacacgcatcagtgtgtacctatcgaaaaaggtcaatacacgccttgtatctttgaatatgtgtattttgctcgccctgattctattattgataatatctccgtccacaaggcaagaatgcgtatgggcgaaaaattagccgatcaaattttgcgtgaatggggtgaagatcatgggattgatgtggtcataccgattccagatacctcaagaaattctgcgttagagcttgcggttcgcttaaatgtcaaataccgtgagggctttaataaaaatcgctatattggccgcacctttatcatgccaggtcagcagcagcgcaaaaaaagcgtccgccaaaaattaaatgccgtaccattagaatttaaaaacaaaaatgtgcttttggtcgatgattcaatcgttcgtggtactacctgctatgagattattcagatggctcgagatgcaggtgctaaaaaagtcttttttgcgtcggcagcgccgccagtcatgtaccccaatgtttatggcattgatatgcctgtgcgtggtgagctgatttcatcaggccgtagtgttgaagaagtgtgcgagattatcggtgccgatcgtttaattttccaagacttaggtgatttgatcgaagcggtcaaagacaccaaacacagccaagttgacggctttgattgttcggtttttgatggtaaatatattgcaggcgatattgatgaagtttatttaactgatcttcaaaataaaagaaatgacgctgtcaaagataaaggtgtcaccatcgttgatacacccgttgatatgacgggcgtatctgcagtttaa

SEQ ID NO: 1653 - DNA, 663 bp, M.catarrhalis
aaactggtgacatacgctttgaggatttttatgaagcccatcacatttaaagatggcagccccgcccctgtcaataatatttattgcattggtcgtagctatgctgagcatatcagcgagcttggcaatacaccaacaggcgaacctttggtatttttaaagccaaccacagcactgaccaccgataacaccctaagattaccaggctattcagaagatatccatcatgaagttgagctggttgtttatatcgatcaagatgtggcagatgaccaaattcctgatctaagctgtattgcaggatatgggattgggcttgatttgacagcacgagatatccaaaatgccctaaaaaccaaaggaatgccgtggacaactgccaaaggctttcgccatgctgcttggctatctgtcttaaccaaaggcataccaacaacacatcaattatcactgatggtcaatggcgatatccgccaagacgatagcacagataagcttttatttgatataacttatcaattgaattttttgcatgaaaaatttggcttgcgtcaaggtgacattatttatacaggcacgcccaaaggtgttggcagacttgtcagtggcgatacactcgtcgccaagctcgatacagaatcttacaccattcatattgtctaa

SEQ ID NO: 1654 - DNA, 327 bp, M.catarrhalis
gatcgtggtgctatcgttaaaggtacagtaaaagaagtggatgctaaaggtgcggtgattactttggccgatgaagttgaaggttatttgcgtgttgcagatattgctcgtgagcgtaccgaagatgcctctaaagtcttgagcgttggcgatgaagtagaagctaaaattgtcggcgttgaccgtaaatctcgcaatattagcctatcaatcaaggcaaaagatgaagctgatgagcgtcaagccattaaagagctttctaatacagcagctgaaacacagccaaaaacacttggtgatattttcggtgagcagcttaaaggttga

SEQ ID NO: 1655 - DNA, 1377 bp, M.catarrhalis
agatcacacgccaaaataactgacgatttttttagaacttcattggcgatcttccaaatttttgttacaataagcaccaatgttaaacaaatacttgggggaatgatgaaaattttggtactcggcacagggggccgtgagcatgcattggcatgggcttgtgcaaaagatgatgcagttaagattgtctatgttgcgcgtggtaatgccggtactgctattgagccaaaattacaaaatgttgatttggatattaccgatcataacgcactgattgcattttgccaaacacatgacatccaatttgtcgttgttggacctgaagcaccgctggttgctggtgtggtagatgatttgcgtcaagcaggcattgctgtttggggcccaacaaaatactgtgctcagcttgaaggctcaaaagcattcgccaaagaatttatgcaaaaatatggcattcccacagcgtattaccaagtctttacagaaattgaagccgccaagcgttatgtgcgtgaaaaaggtacacctatcgtcatcaaggcagatggcttggcagcaggtaaaggtgtgatcgtcgccatggatgaagcgacagcttttgatgcaattgatgatatgcttgatggcaataaatttggtgatgcaggcagccgtgtggtcattgagcaatttttatcgggtgaagaagcatcatttatttgcatgattgatggcgaaaatatcctaccgatggcaaccagccaagaccataagcgtatttttgagggtgatactggtgctaatacaggtggcatgggtgcatactcaccagcacctgtcgttacgcagatggtgcatgataaagtgattgagcgggtaattcgccctgttgttgaggtgatgaaggccaatggcacgccttatacaggatttttgtatgcagggctgatgatcgacgagcataacgacccttatgtgattgagtttaattgccgatttggtgatccagagactcagccgattatgatgcgtcttaaaagctctttgacttgcctaatccaagcaggtcttttggggaatttaccaaacgaagctcagtggttggatcaagtggctttgggtgtggttttggcaagtcgtggctatcctgaatccagcatcaaaggcgatatcattacaggacttgatacccaaacagaccgcttaaaaatcttccatgctggcaccaaacaatcaggtgatgccatcgtgactgatggtgggcgggttttatgcgtcacagcactggcagatgatattcaaaccgcccaaaaagatgccttggctgccattgagcgtatttattttgatggcatgcaatatcgccgtgatatcggctggcgtgccatcaaacgctga

SEQ ID NO: 1656 - DNA, 879 bp, M.catarrhalis
tgctctatggcgtgccaaggtgttatcatgacagcgaacatttggatcgtacaaggcgatggtattttatgtacaagcgatggtttgccatttgtgcttaagttgtccaatgtaccaaccaaagccattcatttgggttttgccgaaacgcatcataagcagtctttacttttgtgttcaccaaatcagttgccgattagtcatgccatggatatcaatgatgccatcaagcttgggttgatttttgcttatggtgacggctatgacaccaaaacagtcagaaatctaaaaatagtcagttttcgtgaatttttgactgtgatggataataagatgctaaacttgatggctcgtgcaatcatgctgatcggttggcacaatgaccatcagttttgtagtcgctgtggtgctaagacgacacaccacccccaaggagaacatgctaaaatttgcccaaaatgtcgtcatcatgcctaccctagggtacagccttgtattattgttgccatcactcgcattcatcccaaaacccataaacaacaaattcttttggcgcgtcatcaccaccataaaagtggcatttatggcttgattgcaggctttgttgaagttggtgaaacgctgtccatggcagttcatcgtgaagtatatgaagaagtgggactattgattgatgatattcgatattttgatagtcagccttggccccatccaagtaatctgatggttggctttatcgccaattataaagaaggtcaaatcaacattcagcgtaatgaacttgtcgatgcccaattttttgatattgatcagctgccacccattccaaatcaaggtaccatcgcatgctcactgattcaagcggtggtcactgcctaa

SEQ ID NO: 1657 - DNA, 183 bp, M.catarrhalis
cctaagtattataatgataatcatcatcaaaaacacaacactaaagccaaatgtcacagattatctacattgagtaataaatgcttatcaaatgaaaattttgtcaaacaaaaactgcttaatctctgtcataaatctgtcatgaatcagtcactaatctgtcatgcttgcttgctaagataa

SEQ ID NO: 1658 - DNA, 207 bp, M.catarrhalis
ccagcccttctgataggtttttacttgactttgatagtccagctttcatgcgggaaaaccagccacctttttcgttttcgctcatatccttacctacattttatgattttgttcaatgattttgattgtagcataaatttacccaaaattcattacacaaaaacccttaaaccctatcataacatgcttggggatcggtggtattag

SEQ ID NO: 1659 - DNA, 822 bp, M.catarrhalis
gcaaaaggatattatatgaacacttatacaccgccagaagtttgggattatcaaagtatcaaagccaaaaacggcggcacatttggcggtacaaatcgccccacagcaggggcaacgcatgagcagaagttgcctgttggcgactcgccttatcagctgtattctttaaatacgcccaatggtattaaggtgaatatcttactgcaggagctgaaacaacttggggcaatcacaggctatgatgcctataagattaatatcatggcaggagatcaattcggatcagattttgtcaaaattaacccaaactccaaaattccagcattgcttgatcaaagtaccacgcctgctactcgtatttttgaaagcggggcaattttattgtatttagcccaaaaacataacgcctttatcccaactaatctcaatcagttatcagaactttactcatggctcatgtggcagatgggttcagcaccgtttgtgggcggtggttttggtcatttttatgcctatgcaccagagccaatggaatatcctattaaccgttatgcgatggagaccaaacgacaattggatgtcttagatcagcatttggcaaaccatacctttatgattaaagatgattatacgatcgctgatatggcgatttatccatggtatgggcgtttgtgcttgggagagctttatgtctctgatagctacgatgccgccaagtttttggaagtacatacttatcaaaatgtcattcgatgggcaaaagccattgcagctcgtgaagcagtacaatacgcccaatctcttgagcttaaagtaatttga

SEQ ID NO: 1660 - DNA, 4152 bp, M.catarrhalis
ccaagttatcttgataatatgtttacaattactcagtcaaatgatacccaaattctattggatcatctgattcattactaccagcaaacacaggtacagcgtcaaggcgaggagctgggtgtttctgtttttacaccatttatcgtcattgttccatcgatggtacttggtgattggctcaatcgcagtattgctgaacggcttgggattagcacactttttatgacacaattttggggtcaatatcagtggcagcttattcagcaagtgcttaggattgatgccaatcatcatccttcagatgccttgcaggtgccagaggtggcggtactgtctggttcggtcatgcgttggcggatttttggctttatcaaaactttgtccaatgagcagattatcaagattatgcaagatgatcatcatccgttgtatgattttttgatgacaatttatgacactcagaaccaaagcattccagagcatcggctatggcgaatctgtgaggaggtgtcatcagtttttgtgcgatatttgacccatcgacccgaatggctacatgcatggacccatgacttaccactacctgaatcaatcgatgagatgatcgatactaaggatagatttgccaatgattatagcgatagtgatccaacacccaaatggctgattcagcaatatcacgatcttgaaaaattgttacgatatctgtggcgacagctattttctgaggtctatgcttatcgtgagacacttgaggtgcgattttgggcagtacttgatgggttgcgtggtgaaagtgtggcagctgaagcatataaaagcttgcctaatcacctttatttatttactatccagcaaattcccttgctggagctacaatttttaaaacgcttatcagttcatttgaatgtgcatttattgcattttaatccatcaaagatgttttgggcggatattgttgataaaaactggctggcaacgcagcgtattattaacccaaacttggtctatctaaaagattatggtcatgttttattatcaagattgggtaaagagtcccgagaaacttttgcgatgctggcagatatgtcgggcggtgattattattatgaaaaagaaggggtgaatcgcagattttatgaaacttatcgcacacccaaagattggcaagttgactggcaggatgattttgtatcgccggctcaagaatctaaaagtttattaaatcagctaaaatccgatattttaatgcttgaagatggcgaagctaccaaacaatggtggcaacaagaacttgtatcagccttcaaaaatagtgcgttttgggaacaaaaagttaaaaccaaaagccagttaatgttgcctcttggattggataaaaatgatcaatctctacgcctgcccagtctaagtatccatgcctgccacagtctaaaacgacagcttgaagtggctcgtatgatcatagctcgctatcttaatgagccaaattctgacggtagctgccgaaaattatctgatatcgtggtttatttacctgaagctcaggcggctgaagatcttatccgactgatttttaatgatgatgttggtatggatgggctgaagctacctgccaaaattaccggtactgccagtcgtgaggtagattcgctgatggctgccatcagcgggttttatcggctacttggtgccaaaaatgcgcgtttttatcgtgatgatgtgtatgaatggctgatgacgccagcattgtacgaaagtttggggcttgattttgagtcagtcaatcgagcctgtcaattgctggatgcggctggctttcgccgaggatttgatgctgcacatttggcaatgacactaaatgaagctgatttggattatcgttatagttttagctatgctttagatcgtatcgtggcagggtttttaacaccctgtgattcaccatctccaagctcattgatgcatccgtttaaatggcgtgatgaatcatttcaagaagcaagcttgcctttagagggggtcacattagctgatcaaccgattgttgaggcgctgtgtctgattcatgcaggtctcagagaatttcgtgatgaatatcaacggcttgcacctgtgattgattggcttcatcatatcgagcatcgtgtcatcaatcgctactttaccaaatatcgtgaaaccagtcagatgcatgttattttcaaggtgatgaatggtattgcagccagcatccgtgccaatcatcattatcaccaccatactaagaattctacacaaggcactcaaaacatagagcttacacttgaatttgtgcttgagagtatggcgagtttgctttcctctcaagcggtgagtgctgagccagcaggcacgatcacttttgcgcgttttggggctttaagaaatgtgccttttggcttgacgctgatgctggatatgaatttatcggcattccctaggcaagatcgacaagcgcgcctagatttgatgaaagctgggcttaagcgtcgtggcgatcgttttttagaagatgatgacaatggtgcatttttagatgccatactgtgtagccgtgatgcttgtgccattttttataccaatgtcgccgatgacggcactcagctactgccagcatcaccagtcagtgagttgattgaattttttaaatctaatgtggattgggcagttgacttgcaggcggatcataccaatcaagccgatcaaatacatgctaaacttgcgaccatcgccccgaaattggttcagcagcttttgatttatgagcatgctgccaatgcctttgatgcgtctgtattttatgaaacaaaagagatggtctgtgatgaagatgatttggctgattttttaacccaaaaaattctgcatgccaaacaatcccaaacttattacttgccaccatcgcccatgatggtaaaattgcgtcatttattggatcaagattttaatcaatcacccatcataagcttacctgatgcgacaatttatcagatgcttgcagaagcgttacaaaacaacttacaaggtgacagcgggcaattagaggaagttttaaccatttttggcattcaattaccaaacagtatgccgcttaatcagatttatcatacacttaaaaatcctgccacagcctatctaaaacacaaactgccactactatatgacgcagaagacggctttttagaagagccgctgtctttggacggtttgggtcaatatcagcttaaagagaccttgattgatgccatggcacaaggggtatttgatggcatgcctatggatgagtttgactatcataagctcatagataccatttatatgaacgatgataaggcatcagagtttgctcacattgtacgcatctattatgataatttgctacccgctggtgcaaatcgtttgaccagtttggataatttggttgggcaactggcgaagctgactgacgattttgcacaaaatctaacagatttacaagttaagaagcagcaattacaatattcttcaatgattagtccaaccaaagagcaatatattgcagttgagctaaatcatatcccgctggatattgtcgcaaaattacccatcagctgcgatcaatggttgcgagtgctaccaaatacagtgcgtgcagggcattttttacgcttttatttgcatcatttggcgtggcaagtgagcagacaaaccgaccaaaaagacattgaacaaaatcttggcagcagcttatggcagtttgggcaggctagcaatgatttaaaagactttcatctcaatgatgtttccttattaaagctaaaacccattcataaagagactgctaagcggcaactacaaaatttcatggtcatgggtttattagccaagcagatgcccttggtgctacctttgatgacttcactgaacattgtcgctttgaataccaaaaatgagcttgaatttggtgaaagccagtttaatgattggttgtcaggtcagtatgaagatcattaccaaggtcaatcttggcaaaagatattggatggcctgcagccactgcctgagattaaaaaaggtaaagaacttgcacaagttttatatgctggtttattggatgctctcatcattgacccaaccagtcaaacagtttga

SEQ ID NO: 1661 - DNA, 264 bp, M.catarrhalis
ccatgttatcaaaaaatacgcacacaaaacccagcctacaaagctcaaaaagctaatgcaattgatacttttttgttgtatagtgatacataccgacatttcatgatgctatttcatatctatcaactcaaaaaacacttaagcaaaaggatattatatgaacacttatacaccgccagaagtttgggattatcaaagtatcaaagccaaaaacggcggcacatttggcggtacaaatcgccccacagcaggggcaacgcatga

SEQ ID NO: 1662 - DNA, 453 bp, M.catarrhalis
aatcatccgcaaggcaggtgtatgagcaaacaagcctatgcaaatgcgattgttatcgctttgggcagtaaccatgatgccaaggttgcgtttacttgtgccattaaatcgcttcaagagcttgggcgagtcgtattatcacagcgaatttgtgggcaagatttcactgggcgtagtcagagaatttatcataatgcttgtgcttatattatactgacaaaaactatgcaatatacagacattgaacaaacgctgaaacaaattgaacggcgatgtggacgcaatcctgccaaaaaatgtaccaaatacgattatgaagtggtgatagatttggatattctggcggcaaggtttgatgaacagtggcagatgaatttggcacgactgccactaaaaaaccacgatatacaaggcataaagcaagttgcggcatttttattagaccaaatatag

SEQ ID NO: 1663 - DNA, 345 bp, M.catarrhalis
atcagtcataacaagaaaaataaagattgcgatatgggttgggtgtttactgacgagacacgattttacttgcatgaaaatgaaacactgctagacggcatgattcgtacagaacataaaaaggtacactacgaatgccgacagggttattgtggtacttgtcgcatgaaagtattggcaaccactgggtcaatcactttggttaaaaaaccgttggcaactttagcagatgatgaaatattggcctgttgctgcactttaaacggcacaactaaagtcagctattaccctaaaaatgaaaatcagttgccattatttattgactgtgctgaatacttaccctaa

SEQ ID NO: 1664 - DNA, 1233 bp, M.catarrhalis
tacgcctgtaaaagagtaggctgtatgaaaccaaaaattgctgtgattggtgcgggtgctgctggacttatggcggctgaagtgttgtctttataccctgtatcggtagatgtctatgaacacaaaccaactgccgcacgcaaaatactgatggcaggcaagactggtttaaatatctcgcacagtgagccttttgagacttttgtggatcgttacacgccaaatgattggctgactgggtatttacagtcatttcatgccgatcatatcgttgcgtggatggcatctttgggtatcgaaagctacattggttcatctggcaggatttttccagtagaaatgaaagcctcaaaactggttcgtgcttggctatctcggctaaatggtcggggcgttcggttttattatcgccatcgctgtactcagatatcaggcagggtattaagctttgataaacttgatgctaaggcggagcttattgactctttttgtgctaactatgatgcggttatcttagcgtgtggcggtgggtcataccgagcacttggcagtgatggtgcttggcagcagtggtttgataaagatttattaacacctttatatgccagtaatgtcggcgtgctggttgattggtcgtcttttatggtgccgttatttggtcagccattaaagcgtattcaaatcagtgtagggaaaaagtcgtatcaaggggatgtcatcatcagccattatggactagaaagcggactgatttatcgtctcaatcgggcaatgcgttgctgtcaaaaagaaaatggctttcatttatcggtcgatctgatgcctgataaatctgttgataccattcatcatattttaagccaaactaaaagaaaatcgctgaataccttactcaaaaaagctggtctagatgctgttaaaatctctatcttaagggagtgtacgcctaaggcagattggtcggataccgccaaaatggcagtgcatatcaaaaacttaaccattcaagcgacaggttttcgaccaatagatgaagcgatcagtactggcggcggcatcaaacgcattgctctaggcaatgatctacagcttatcaaagagtcaggtgtattttgtgctggcgagatgcttgattgggacgcaccaacaggcggctatttattaaccgcttgtatggcaacagggcgtgcggcagcttatggcgctttacagtttttaaatattgaccagtaa

SEQ ID NO: 1665 - DNA, 957 bp, M.catarrhalis
aatgtaggtaaggatatgagcgaaaacgaaaaaggtggctggttttcccgcatgaaagctggactatcaaagtcaagtaaaaacctatcagaagggctggttaatgtcttggttggtggcaaacagattgatgatgagctgcttgaggaagttgaagatcagctactggttgctgatattggtgtcaatgccaccaatcgcattatcaaaaatctcaccgagcaggccgcgcgtggcgatttgatttactcgcatgctttgtataaagcactcaaaaccgagttgaccgacattttgacgccaaaagttgcacctttgattattgataccaccaaaaagccctatgtcattttgatggtgggtgtcaatggtgttggtaagaccaccacaatcggtaagcttgccaagcgtttacaaaatgagggtaagtcggtcatgcttgccgctggcgacacttttcgagccgccgccaccgagcagctacaaatttggggtgagcgaaatggcattgctgtcatcgctcaaggtcatggctcagacagtgcttcggtgatttttgatgccatgcagtctgccaaggcaaagggcattgatgtgcttatcgctgatacagcaggacgcctacaaaataaaacgcatctgatgaatgaacttgaaaaggttgtgcgtgtgatgaaaaagggcgacgaaactgctccgcatgagacgatgatcgtgctagatgcaggcacaggtcaaaacgccatcaatcaagtgcaagtattttcagaagcagtgaatttaactggcatcagtgttacaaagctagatgggacagccaaaggtggtgtggtatttaatatcgcccaaaatacggatattcccatccgttttatcggcgttggagagggtattgacgacctacagccatttaagccaaaagattttgttgatgcacttttggaaaaagaagaatga

SEQ ID NO: 1666 - DNA, 2778 bp, M.catarrhalis
tggatgggtaattttatcagggtaatttcaatgacaaaatattataacgatcccgatcacatcgagacccaagagtggcttgatgcatttgaatcggtcataaaaaatgcagacaaagatcgtgcacagtttttattaaaagcactttataacatggctgttcaagaaggtttaccattcaaccgccttgatactgcatatatcaataccattccagccgaagatgagccaacttatcctggcgacttgcacatggagcgtaaaattcgtgcattgattcgttataacgccttggcaatggtcatgcgtgccaaccaaaataatgacgatttgggtgggcatttggcaacttttgcatcatcagcgacactgtatgagacgggatttaaccatttttggcgtgcacctagcgaaaaccatggcggtgatatgatttattatcaaggtcatggtgcaccaggcatgtatgcccgttcattcttagaaggtcgcttgtctgaagagcagctgattaattttcgccgtgaagtcgatggcaagggcttgtcaagctatccgcatccttatttaatgcctgattattggcagttcccaacagtatccatgggcttgggtcctttgatgtcaatttatcaggcccgtaatcaaaaatatctgaccaatcgtggcctaatcaaagatgaggatcgtaaagtttgggcatttttaggtgatggtgaaactgacgagcctgaaagcttgggtgctatctcaatggcaggtcgtgagaagctggataacctaatttgggtcatcaactgtaaccttcagcgtttggatggtcccgtgcgtggtaacggtaaaattatccaagagcttgaatcggtgttccgtggtgcaggctggcgagtgattaaagtcatttggggcgatcattgggatccattacttgccaaagatacctcaggggcactcaaaaaacgcatggaagaggtggtagatggtgagtatcagctctatgaagctcgtgatgccgcctttgttcgtaaggagttttttggtaagtatcctgagcttgaagagatggcaaaacagttcagtgatgaagagattatacgcctaaatcgtggcggtcacgaccccaaaaaagtctatgctgcctatgctgaagccatgaaaaccaaaggtcagccgacggtaattttggtgaaaacggtgaaaggctatggtttgtctactcagattcaatcggtcaataaagctcaccaaatcaaaaaaattgacgaaagtggcttaaaatacttccgtgaccgttttgatttaccattgaccgacgaacagctcaaagaattacctttttatcgcccaagtgaagattcggccgaatataaatatctgatgggtcgccgagaggctttgggcggtcatttgccatctcgtcgcagtggtcacattccacttgagattcctgagctttcggtatttaatcaagttctgcaaggctcaaaaggcaaagagcaatcaaccactatggtatttgtgcgtttattgtcagccctattaaaagataaaggtctaaataaacatgttgtgccgattgtgcctgatgaggcgcgtacctttggtctagaaggcatgttccgtcagcttggtatctattcatcagtgggtcaaaactatgtcgctgaagatgccgatgctttgatgggctatcgtgaagccaaagatggccatatgctagaagaaggcatcaatgaagcaggtgcaatgagtgcatggattgccttatcaaccagctattcggttaatgcgttaccgatgattccaatgtacatttattattcaatgtttggtttccagcgtattggtgatttggcgtgggcagcgggcgactgtcaagcacaaggatttttatttggtgcgacagcagggcgtaccacactaaatggtgaaggtttacagcatcaagatggccatagccatatcttatttggtaccgtacctaactgcgtaacctatgacccatgctatggttatgagctggctgtcgtcatgcacgatggtttacgccgtatgtatgcacaaggtgagcgagtttattattacatcaccttgatgaatgaaaactatgaacatccagccatgcctgagggtgttgaagaaggcattaagcgtggtatgtacctgttaaaagataatggctcaactcaagttcagctactgggttcgggtgtgattttgcgtgaagttgaaaaagcggcacaaatcttgcaagatgaatttggtatcactgccaatgtttggagtgtgaccagttttaatgaactgactcgtgatggcatggcgtgtgacgactacaaccgcctacacccaaccgccgaccaaaaaaccccatgggtaaccagtcaattggcatcacataaaggtattgtggttgcagcaacagattatatgcgtaattattcagaacaaatccgtggatggttacctgacagccgtccatatgtaaccttgggtactgatggctttgggcgttcggatagtcgagccaaattacgcagtttctttaatgttaatgcagaacatattgttgtggcaactttgaaaaaattggcagatgaaggtgacattgatgttcgcttggttcaagatgcgatcaacagttttgatattgacgccgatcaagcaccagcatggcagcggcagcctcaatatgatttcttcccagatgcaccagcaccaaaggcaactcgtgagccaaaccctgtgcctgaactggtcgaagatgacaatcactga

SEQ ID NO: 1667 - DNA, 1182 bp, M.catarrhalis
aatcgctacaactcatcgttaaaatcgtgtatcattaaccatattttaatgcgtataaggaatgctgtcatgagccaaactactcagtctttgcctgttaataccgatgaaatcaaaggctatcgcacccaaattgatgccattgatgagaaaattcaaacgctcatcaatgagcgtgccaaagttgctcagcaagtggcagttgccaaaaaaaaccacgaaaatcaccccatcttttatcgccctgagcgagaagctcaagtattaaaatcagtcatggcgcgtaatgaaggcccgttatctggcgaaaagatggcacgcttgtttcgtgaaattatgtcggtatgccttgagcttgaagagccacaaaaagtggcttttttgggaccagttgggacattcacccatgcagcagcactaaagcattttggtaaagcagccacgacagtatctttgacaaccatcaccgatgtatttcgtgaagttgaagcaggcagtgcgatgtacggcgtggtgcctgttgaaaactcatcagaaggtgtggtgaatcatactttggatgcatttttaagctcaagcttaaaaatcattggcgaggtggagctgccgattcatcataattttttggtggcagagcatacccgtgttgagagcctgagccgtatttatagccatcagcaagcattggcacagtgtcgccactggctggatgtcaatttcccaaatgttgaacgagtggcagtttcatcaaatggtgaagcggctcgtcgtcttcaaaatgaatggcattctgcagcaattgcaggtgatgtggctgttgctgaatatggtttacataaattatacgaaaatatcgaggataatccgggtaataccacacgatttttaatcattgggcgagaagacattgcaccatctggtcaagacaaaacctcaatcatggtctcaagtccagataaagcgggagcgttgattgagattttggaacctttacgccgtcacggagtatcgatgaccagtattgagacacgccctgagcgtccgaataaatgggcttatgtattttttattgatatgaatggccatatcgaagataagcatgttgctgctgcgatcgaagatatcagaccactagtaaaggatttgcgagtgttaggctcttatccaaaagctgttttataa

SEQ ID NO: 1668 - DNA, 1224 bp, M.catarrhalis
attttatcaaaggaatttatcatgagtcaattttttgctcgattaactcctaagcaaaagcaatatttagcaaccattcaaacgccgtattatttgcttgatgagcgtgccattattgacaaccttagcgtcacgcaaaaggtttgtcatgagtctggcgcaaaagcgttacttgcactcaaatgctttgccacttggggggtttttgagtccatgcagccgtatcttcatggcacaacttcctcgtccttaaaggaagtgcgactgggcaaagaatgctttggcggtgaaacgcatgcttatagcgtggcttatgccgatcatgaaatcaaagaagttcttggttactgtgataagattatttttaattctattaatcaattaaaaagatttgggcaattggctcatgataaaaatattcccgttgggcttcgcctaaatcctcaaaccagcaactcatcatttatcattgcagaccctgccagaccatttagccgtttgggcgagcatgatgttgagagcattatggcgatagctgatcagattactggtgtgatgattcataataattgtgagaacactgattttgaggcatttagccaaagtttgaccgatatagaaaaccgctttggtgagttatttcatcgcttagaatggatcagctttggcggtggtatccattatattgaccaaaattatcctttagataaatttatcaataggcttaagaattttagcgaaacatatggtgtacaaatttatcttgagccaggggaggcgtcagtacatcaaggtgctgttcttgtgaccagcgtgcttgatgtgatgtataataataagccgctggcagtggttgatgcttctattgaggcacatatgttagatttgcttatttatcgtcaatcttcgccgctggcttatgtcaatgaaacaacctatgatatcacaggtgcagattttgatggcacatcggcagatgaaacctcagtaaggatctatggcaaatcctgtttggcgggtgatatttttggagattatacgcttaatgaacctttaaagattggtgacaaagtcgcttttggcaatgccgctgcttatacgatggttaagaaaaattggtttaatggcgttgatatgccatcaattgtgattattcgccaagatggcgaaatcatgattcaacgccaatttgattatgaagattataaggccagtctgtcctaa

SEQ ID NO: 1669 - DNA, 747 bp, M.catarrhalis
tttaataaaaagccaccatctacggctttttatgattggtcacaaggatattttatggcaattacctcacccatcattgtagctgttgataagcataatttaaacgatgcactatccttggcggacagcttagacccagcactgtgtcgcctaaaagtgggtaaagagttatttactgtatgtggtatccaaatcattaaggcatttcatgagcgtggctttgaggtctttttagatttaaaattccacgatatcccaaataccacagcacaagcagtactttcggcagctgatatgggtgtatggatgaccaatattcatgccatggttggcactgatacgatgcgtttgtgcaagagccgcttacaagatgggggctatgatacattattgattgcggtcactgtgctaacttctatgacgcaagctaatttatccgagcttggtattcagcgttcggtgagtgagcaggtacgccatttggcaggattgactcatgattcaggattagacggcgttgtttgctcagctcaagaagcacagcttctgaaacaaaaatttggcaaacagtttagactaattacgcccggcattcgcttggtcgaggatgctaaagatgatcaagctcgcatttgcacaccagctcaagcactacaaaatggctcggattatttggtcatagggcgttcaattacaaatgcatccaatcctaatgataagcttcatacaatcttagctggtatttga

SEQ ID NO: 1670 - DNA, 2322 bp, M.catarrhalis
cagcgtatgaaaaatccaatggataatacaaaaaagccgttgtttgagcaattgtgcgtaatcggcttggggctgattggtgcatcatttgtacaagcggtacacaatgccaatcatcggcttaacacgcctttggtgggtcaaatcactgccgctgataccaatcaaaaaagtatcgatgatgcgttggcggcaggcgtgatttcaagtggtagcacagatattttcagtgcagtttgtggctctgatttggttatgattgccacgcccgtcaaaagcatttatccgatcatgaagatgctaaagcatgcgatagatttgggtgatttggctagtcatgccatcatcacagatgtgggcagcaccaaagtatcagttgctaaagcggctgatgagatttttggtgcgtaccatcattttattggtgggcatccgattgcaggtgcagaaaggtcgggctttgacgccagaaatggtgagctttttgtacagcataaggtcattttatgcccaagcactcatagccatgcagccgattttgctaaaattgccaaaatctggcaggcaatcggtgctaaggttatacaaatgagtgcatcacgccatgatgagattttggcttataccagccatttaccacatttgcttgcttttagtctgacacatcagctggcaagccatgatgataatttggatatttttcgttatgcagcgggtgggtttagggattttagtcgtattgccgccagccatcctgtgatgtggcatgatatttttatcgctaacaagcctgcacttttaaatgcattagatgaatttgtgaatcatttacaagtgtttcgccaaatcattgatcaagaagattctgaaaaaatgtttgattggctcgccaccgctcgtcatgctcgccgtcattttgggcatatgctcgccaaaaaaccgatgcacaaacctaatattgttattactccagatgccatcaaggatactattatgaatcaaagttatcatattcggccacaaaatgctatttcaggtgtgattagtgtcccaggagataagtcgatctcacaccgttcaatcatgtttggcgcattggctgatggtgtcactcatgtgacaggatttttacagggtgaagatgcactggcgacactgcaagcatttgctgatatgggcgttaagattgagcgaaatagcgataaagttaccattcatggtgttggtattgatggtctaaaagcacccaaaactccgctatatatgggtaattcaggcaccagcatgcgtttattggcaggaattttatccgcccaagcctttgatagcgtgatgacgggtgatgtcagcctatctcagcgtccgatggagcgagtggctgtaccactgcgtaatatgggtgccaaaatccaatcaacgggtaaaaaaggcacagcacccttatccatcacaggctcacaaactctaaatgccatcgaatatcaattgcctgttgcttctgcccaaattaaatcttgtctgattttggcaagtctatgggctaagggtaccacaaccatcatcgagcctgaagtgagccgagatcacaccgagcgtatgctaaatgcctttggttatcctgtgcaagttgatgggtgtaaaatcagtgtgacgggcggcggcaggctgacagctacagatattattgtgccagcagatatctccagtgcagcattttttatggtgctgggtgcaattggaggcggtgagggactgaccattgaaaaagtgggcatgaacccaactcgcacaggcgtcatcgatattttaaccttgatgggtgctgatatcacagtgatgaatgaagctgtcgtaggtggcgagccgattgctgatattacagtgcgaccttctgatttgcatggtattgacataccagagcatttggtaccacttgcgattgatgaatttcctatattattcatcgcagcaagctgtgcgtatggtgtcaccaaactgactggtgcaaaggagctgagagtaaaagagtctgatcgcatccaagtgatggcagatggcttggcaacacttggtattgattctaaagtgctagaagatggcattattatccaaggtaaaggcatccaaggtgagaaaaacgccatctttggcggtggtgtgattgagagtcatcacgatcatcggattgcgatgagttttgcggtggcaagcagccgcgccacagatgacattatcattcaaggcaccgagacagtcaataccagttttccaaattttgccgagcttgccaatcgtgttggtctgtctattgaggttaaataa

SEQ ID NO: 1671 - DNA, 624 bp, M.catarrhalis
  unsure (3),(9): Identity of nucleotide sequences at the above locations are unknown.
aanacgctnaacattccactaattagcatcagtcgtgataagcgtggaattttgccaagatcagcggacattgcactgactttgggtctgtccgaagaagcatgcccccttggacttgcaccaacttcaagcaccacagccacactggctttgggcgatgcgttggcggttgcactgttgcacgcgcgtggatttaccagtcatgatttcgcactctctcatcctgcaggtgcgcttggacgcaggcttttgacgcgtgtatctgacatcatgcataccgatcatttacccgttgtacatcatcaatcaagcttgaatgaaactttattagtcatgaccagtggacgcttggggcttgctgtggtcgttgatgatgatggtaaagtggttggtatttttaccgatggggatttacgccgtaaattggctgagcataccaatctgacggttgaaattcagacactgatgaccaagacgccaaagtctgttgatcagcagatgcgtgcctctgatgcactgagtttgatgaatgaaaatgccatcagccagcttttggtacttaaagatcgtcaattgattggcgtaattagtattcatgatatactaaaagctggcatcagctaa

SEQ ID NO: 1672 - DNA, 321 bp, M.catarrhalis
tttgtgattgaggtaggtcgtatgcaagcggtaataaataaatctaatttgattgcaaatttggcatcagtctgtgaagagttagaagaagatgttgttgatgaagcagtacgcctaatgattgcgatgatggttaatgagttggtgtatgatgggcgtattgaagttagaggttttggtagcttttgtttacatcaccgttctgcacgcattgctcgtaacccacgcacaggcgagagtgtctctgttaaggccaaagccactccttactttaagcctggtaaggcactgcgtgaatcggtgaatttggttaatgactga

SEQ ID NO: 1673 - DNA, 648 bp, M.catarrhalis
atggaagttgagattatcaaaattattctagcctttatcgtgctgattaacccatcggcagctttggcaatgttcgttaattttacgcatggatacagttatgaggataaacgccgtgttgcacggattgccagtgcaacagtgtttattgcgattgcatttttttcattatttggtgagatcatgttgcgtggtttgggcatctcgttggggtcgtttcgagttgcaggcggtatcttgctatttttgattgcacttggcatgatgaatgatggtaataatcctgtcaaacccaatgaagatgagctggaattatcccagcccaaggcaaaagatccaagctctttgactggcattgccgtggtgcctctggcgataccaatgatggttgggcctggcggtatttccactgtcattatctactcatctcaagtaagtggtattgtgggaatgtcgctcatcattgttgcaggtttatgcatcagtattttatgctatttgtctttaatggcagcagggcggattagtaaattgcttggcgatactggcttaaatatcatcaatcgtattatggggattattttagcagctgtggcgatagaaatcgttgtggcaggtctaagaaccatttttccaaatttattataa

SEQ ID NO: 1674 - DNA, 2220 bp, M.catarrhalis
atctgtcatgaatcagtcactaatctgtcatgcttgcttgctaagataacggcattcaccaagccagcttactatggcaagcctaaggaaatacagatgaataacccacacgattttatcgaagactcaaacccaaccagcaacccaaactttgctgatatcctaaatcaaaccgtgtcacgccgcaccattttaaaaggtggtgcaggcttgacggctgctgccatgtttggctcattgcctttgatggcgagcacaaattccaccacggcaccaacgaaaacaaatttggcacgcccaacaaaacttcaattcaaagccgtacctcattatacaggcaatgacatgaaagttgccgaaggctacacggcgcgtgcatttttgcatttgggtgagccgctgatcgatggcatcgaagcgttccgtgacaaccgcgaacattcaggcgaatcatttttgtatcgcatgggcgataaccacgacggtatgcatttttatggcatggtcaacggcaaatttgatcccaatcaatcaaatcgtgctttgttggcaatcaaccatgaatataccaacgaaaatctacacccaatgggtttctttacacaggaagataacaatgccgcgccgatttatcgaaaaaaacgccttgctatggatgtgcgtcgcgatgctaacgctcatggcgtgactgtggttgagctaagaaagacaggcgatcgctatgaaatggtcaaaaactcaccatttaataagcgtttttcaagtgcaacgacggtagattttgcaggtgcagcagcaggtagtaaaatgcttatcaccaaatttgacaaatcaggcaaaagcacttggggcatcaataaccaatgtggttcaggtatgtcaccatggggcacttatctaaccaccgaagaaaactttttaaatgtctttgcacgcggtgaagacaaagccaaaatcggcacccaagcagatgtcgcactggctcgctatggcttaaaagaaaacagcacaggcggcggctatttgtggcacactgctgacgataaagaaggcattgtaactgatgaattcagtcgctgggaagccactgccaaagccaatgacgcaagtgctgattatcgtaacgggtttaatggctttggatacatcgtagaaattgatccatttgatccaaaagctcgcgcagtaaagcgcacaagcctggggcgctttgctcatgaaaactgtgcctttgtaccgcctgtcgctggcaagcctgtggtcttttatatgggtgatgatgcgcgcggtgagtacatttataaatttgtctctaaagccaaatggtcaccaagcgatgtgggcaaaggcctaaaagcaggcgataaatacatgaacaatggcacgctgtatgttgctgtgtttaatacagatggtacaggtgaatggcgtgagctgtcttatggtaaagtcaatcataaagattatccgttcaaagaccaagccgatgttgtcatcaatgctcgcttggcagccgacagcgtaggcgcaaccaagatggaccgtcctgagtggatctcggtcagtccgatcacaggcgaagtttatgtgactttgaccaacaactcaaagcgtacagttgaagctaccgatgccgccaacccaagaagctataacaacaaaggcaaccaacatggtcatatcgttcgctggcgtgagcgcggtgagcataccgcaacagcgtttgattgggatgtgtatttgtttgctgcgccaaatgatttgactgagcaaaacttatccaatctatctgctgaaaatgacttgtcttctccagatggcttgtattttgatccacgtggtgtcttgtggattcaaacggatgacagtgcttataccaaaactaccaactgtatgctacttgcagcgctgcctagccatgtgggtgatggtaaaatcatgaccacaaccacagggcgtaatacgcctgtgggtgcaatggcgactaatgataccctaaaaagattctttgtgggtccaaaaggctgtgaggtcacaggcatcaccatgacacctgacttcaaaaccttattcatcaatatccagcatcctggcgaagacagccctgatgtgacttggggtgcggttccaagcggacgcgtaccgcgctcagcgacagtcatgattaccaaaaatgatggcggcgtgatcttaggcgaatcattacaaaacatgggctaa

SEQ ID NO: 1675 - DNA, 2142 bp, M.catarrhalis
ctgtttaaagaagaagaaaaatccattatgcgactgcccgaaacgaccagagccgaacgacaaaccaaccaacttgctcgtagaattcaagaaaaagcccagctgacaggcgtgaatgtctcaggaacacaaatctccagtcaagcatttgagatggtaaccgattttgagccatcgggcgatcagccaaaagccatcgccgagcttgtaaaaggtgttgaagcggacatgcgtggtcaacttttgttgggtgtgacaggttctggtaaaacctacaccatggcaaaggtgattgccgagtgcggtcgtcctgccatcatcatggcacataataagactttggcagctcagctatatggtgaatttaaggcattttttccgaataatgccgttgaatattttgtcagttattatgattattatcagcctgaagcctatgtaccagccagcgatacttttattgagaaagattctgccattaacgatcatattgaccaaatgcgactgtcagcaactcgtgccttattagagcgacgagatgccatcatcgtggcatcagtatcggcaatttatggcttgggtgatcctgaaagctacctaaaaatgttgcttcatattgttgttggtgatcgagtgcatcgtgatgcggtaatcaaacgacttgttgaattacaatacgaacgcaatgaactggattttgggcgagggacttatcgcattcgtggcgaaactttggatatttatcctgctgaaagtgaaagcttggcagtacgcatacagatgtttgatgatgaaattgaaaaaattacttggtttgaccccttgacgggtaaaaatatcaaatcagtaccacgcattaccatttatccaaaatcacattatgtcactccaaaagataagctagaagctgccagtgccacgatcaaagaagagcttgcccaaaggctagaatattttcgtgctaatgataaattcattgaagcacaacgcatcaaagagcgtacacagtatgatcttgagatgattgggcagcttggttattgtaatggtattgaaaactactctcgtcatctgtcaggtcgaccagcaggtgaagcaccgccaactttatttgattacattccctcagatgcactgctgtttattgatgaaagtcatgtgactgtgcctcagattggtgcgatgtataaaggcgataaaagccgcaaagaaacgcttgttcaatatgggtttcgcttgccgagtgctatggataatcgacccatgaaatttgaagaatgggaaaaaatttccccagcgaccatttttgtctctgccacgcctgctcaatatgagcttgaaaaatccgaacaagtggttgagcaggtcgtgcgtccaacgggtcttgtagatccgatacttgaaatccgccctgtattaacccaagttgatgatattcttggtgaaattaacctaaaaaaatcactcgatgagcgggttttgattaccacactgaccaaacgcatggcagaggatttgaccagctatttaaaagaatacggtattaaggttgcctatttacactctgatattgacacagttgagcgaatgaaaatcattcatgagctgcgtacgggtatttttgatgttttggtaggcatcaatttgctgcgtgaaggattggatatgcctgaggtttctttggtggcaatttttgatgccgacaaagaaggatttttacgctcagaacggtcgctgattcaaaccattgggcgtgctgctcgccatgtgaatggcaaggcaattttatatgcagatacaatcacgccaagcatgcaaaaagccatcgatgaaaccgaacgccgccgtgccaaacaaattgcatttaatcaagaacatggcatcacaccaaaatcagccagtcgtgccattaccgataagattgataccggtgatgacgaaacttctgaagtggtgcagattgttttatctcaagcattggcaggcgtggatgaaaacatcctacattcgccaaaactactggccaaagaaatcgctcgcttagaaaaacaaatgcaggcattatctcgtgagctaaaatttgaagaggctgccaaagtgcgtgatacagtcatcgcactcaaagagctgttagttcaataa

SEQ ID NO: 1676 - DNA, 1044 bp, M.catarrhalis
tggtttaaggaagtgtttatgccttatgcactgttgcgtccgttattatttagtatgaatcctgagcaagctcacgaaaaaacgcttcagatgcttgaatctgccaacaaagcacatcttttgggttttgtgtatgctaagcaggcgctaccgactgagtgcatgggtatttctttattaaacccagtgggcttggcggcaggtctggataaaaatggggcgtatattgatgccctaagtgagctgggatttgggtttttggaaattggtacggtcaccccaaagcctcaaatgggtaacgacaaacctcgtttattccgcatcaaagaagcgaacggtattattaatcgaatgggatttaataatcatggcgtggatgtgatgattgataatattgaacaggcaaagtatcaaggtgttcttggtatcaatatcggtaaaaatgccacgacgcctgttgaaaatgcacttgatgattatatttattgtcttgagcgtgtttatccatatgccagctatatcacgattaatatttcaagccccaataccaaaaatttgcgtaatttacaaagtggcgatgccttatcacaactacttgatggcataaaaaactgtcagttacgcttagccaatgactatggattttatgtacctttggcattgaagattgcacctgatttagatttaagtcagattgatgacatttctcgcacagtgattgattttgagattgatggtttgattgcaacaaataccaccttatcacgcacaggcgttgaaggttttcgtcatggagaagaagcgggtgggttatcgggtcgccctgtcaatcaccaaagtacgctgattttatcccaatttgcagaccgtatcgctgataaagtcgatttgattggcgtgggtggtattgagacaggcgaacttgctgtcaaaaaacttcatgcaggtgctaaggcggttcagttgtactctgggctaatttataaaggtcctgggcttgtgacggattgcgttcaggcactctcaggtgatcgctacggataa

SEQ ID NO: 1677 - DNA, 534 bp, M.catarrhalis
aaagataaactcatgaatgaaatttaccaaaaagccaaacatatcaaactttttgccatggatgtcgatggtattttgtcggatgggcaaatcatttataattctgaaggcatagaaaccaaagcattttatgtgcaagatggtttgggtttgcaagcactcaaacaatcaggcattattttagccattatcacaggccgaagctctgccatggttgatagacgtgccaaagaacttggtatttcacatattatccaaggtcaaaatgataaattgactgctttggtggggcttgctaagaagcttggtattgagctatcacactgtgcctatatcggtgatgatttgcccgatctaaaagctgtgcgtgaggtaggttttgggatcagtgtacctaatgggtgtgagcagacccgagcagtttcagattatatcacaaccaaaactgggggtaatggtgctgtcagggaggtttgtgagctgattttaaaggcacaaaataactttgatgcattcattgcaacatttcagtag

SEQ ID NO: 1678 - DNA, 1425 bp, M.catarrhalis
atagaaatttgctataatgcaaccattgataaccatattatttattgcatcacaacaatgagccaaccactgaataaactcaaaacttcgcctttttcacgccgtctatcgattgcaaaaacttctttaaatatcggtaaaaattgggcaaagtccagcatgaacggtcttttgatgaccaaagaagagcgagagattgccaagcatactttaatgcaagaacaagcggattatttggtcggtgagcttggtaaattaaagggttcggtcgtcaaagtcggtcaaatgcttgcactatatggcgagcattttctacccaaggcagtcttaaatgccttgcatacactggatgctcaaacgacgccgctgtcttggcatgtcatttatgcgacacttaaagcagaacttggtgagcaaatcgctgactttgatatcgaccgcacacccataggtacggcaagcttagcacaggttcataaagctgtacataaatacagcggtcaagatgttgtacttaaagtacaatatccaggggttgccgattcaattgattctgatttatctatctttaagcatttattaaaaattaccaatgcagtaccacagaccaaagcattggatgcttggtttgaggagatcggtgagcttttgcaccgtgaagtggattatcggcttgaggcagaaaccaccaagcgttttgctcattatttggcagatgatgagcgttatgttgtgccgacaatttatgataattatagtactaaccgattgatttgcatgagctttgaagcgggtatttcgttaaatgatccaatcatcaccaccctaccccaagaccgtaaaaatgcacttggacaagccgccatcgaaattttcatgcgtgagttatttgaatggggtgagatgcagaccgatccaaactttggcaattatttggtgcgctatgaagatggcattgataagcttatcttattagattttggggcaatcaagcaatttgacgatcatcttttgagtatcgcgtatgggctgattagtgcaggctatcatcaagacaaacaacagatgatggcagccatgacaggctatgctttttttgatcagttaaacggtaaacccaaatctgatatagcagaagtatttttgatggcttgcgagccttttgctcatgcgcaggcacttaagacacgccatggcggtcattcttcacatttagatgagcaaggcttatatatttggtcaggtagcgatttatatgccagagtaatgaatgccgccaaaaatggtatgcagtcgcgtgaatttagcctaccacccaaagaaatgatgttcatcagtcgtaaatttattggtgcttatgccttattggtggcactgaatgcacgcaccgacagtgacgcactggttaaaaaatttattaattaa

SEQ ID NO: 1679 - DNA, 201 bp, M.catarrhalis
ctgtatccatgcgtaaaattaacgaacattgccaaagctgccgatgggttaatcagcacgataaaggctagaataattttgataatctcaacttccattcattcctcggtacagcaaatttatatcgattatggctacttattttatcatgctttggcagtgtttgtattaatgaaaggaatttacctaaaaaatagttga

SEQ ID NO: 1680 - DNA, 753 bp, M.catarrhalis
aggattttgtgcgaattttttggtctatgcagagactttgagtgtgatataatgctttatttgccgaaaattagattgtttatgattcatcatgacacaccaagccatcgttttgaccgtttatttgacgccaaatttttacatgcaccaaaaactgtccaagaccaagacagacaaaacatttttcaatcactgaccgcaaacacaccactttttttggaaattggtgcaggtaagggcaagcatgccatgcaatttgctggcttaaatgcagacaagcatttgatcgccattgaaagaactcgtgaaaaatttaacgcatttcaaaaacaagccgctcttggtgaattgaataatttaaccttcgttcatgctgatgccattaccttttgtgtacattttattgcacccaattcgcttgacggcgtatttattttgtatccaaatcctgaaccgcataataaaaatcagcgctggcttaatatgccattttttgaatttttattatctcgtctaaaagctgggggatttgtcaggattgccagtaatattgagtcttatattgatgaggcgtgccagctgttggacgaagtttggcgactgccttataccaagtatgccattgattcaacatcagcacgcacgcactttgagatcaaatatttggctcgtggcgagctttgtcaagaaattattctcaccaaacctgcctgctatcagaccagatttgatgatacgcctgtaaaagagtag

SEQ ID NO: 1681 - DNA, 2094 bp, M.catarrhalis
gtggtagcgtggtggtggctgaatttgaggatattcatgccgccaaagcttgggcagaagcagatccttatattatcgcaggcgtgtatcatcatgtcgatgttaggccttttatccaagttcttcctaagtagtatgaggcaactcatgacagacacgctaaaaaccgctgatatcgtatggaaagaagatcacaatggttgtcttatccccacatcacgggattttgatgatatctatttttcacaagctggcggtttaagcgagacttaccatgtgtttattcatggtaatcggttaaccgaacgatttggtcagttaaccaaaaacgagcgttttgtgattgccgaaactggatttggtacaggattaaactttttggcagtttgtcagctttggcaaaaaatagccccaaaatctgctcgattacactttatcagcaccgaaaaatatccgctcggtcatgatgattttgcacaagcattatctgcatggcgtactgacgacagttttggcgattgggtagatgcgttgattcaggtttatccactgcctttggcaggatgccatcgactgcatctgagcgaaaagattactttggatttatggtttggtgaggctttagatacccttaatgaaattgccaataatcaacatgagcatagcatacgcattgatgcttggttcttggatggttttacccctgccaagaatccagatatgtggagtgatgcattatttaaggcgatggcacagctttcacatcgcaagacgacagttgcaacctttactgcggcaggatttgtacgccgtggcttgattgatgcagggtttgacatggttaagtcagcaggctttgggcgaaaaagacaaatgctatgcacagcaccaatgccaaatcagcctaccttaaaccattatcagataggttttaagcccaaaaagatcgcaattatcggcggcggtatcagcggcgtaagcaccgccgctgccttgagccaccgtgggcatgtggtgcatttgtttgagcctgatgatattatggcaggtgcgtcaggtaatccgtgtgcattattttcacccaaactaaccttgctggatcatgccaccaatcacctgcctacggtcagttttttgtattcatatcgccattataaagcaatgaatttgtactcacaaatatttgatcagattggcgttcttgattttttattacccagtcaaaaaactgccaaaaaaagacaagcactgattgatgaatatccaaagtcgttaatcagtacccactatccacaaaaagacagttctgcacttggccaagatctgcgacaaacagatatcgttgcacacattcccatgggcggtattttatacccgattaacattgccaagttactaaaaaagcattttatacatcacccttttaaggtcgtacgctttcaagagcaagaaaatagggtggtattgacagcttttgatgggcaaagtcatcaaaatttcagctttgatcaagtcgtgatcgctgcaggatttgccagccatctcattgataatcggctgtttaattgccgaaaaattcgtggtcaagttacttggcttgctcttaccaacggcgatgatccaaaaaagccaactcaagcgaccaacgccatcaaatacgacggttatagcaccgagttttttgactctaagagccaatcaaaatccttactatttggcgcaagctttattcgcaataatacagaaacaaagctaagcgatgatgagcatcttagtaactttcaaaaatttagccaagctttgcccaactattgccagtctttaaatatctctaaagatactcattttgaaggtcgtgttgggattcgtgcccaaacgccagattatcaccctttggtcggcaaactttccgatagtgaccatattttttgtctgtacggcatgggatctaaaggctttagctttgcccctttttgtgccgaaatattggctgatctgatggatgggggcattttgcccatgtcatctaagctattggcgaaactatcgccaaaccgtgatcggctaaacacgcccatccaagaagaagattaa

SEQ ID NO: 1682 - DNA, 465 bp, M.catarrhalis
atctatcggtgccaaatcacgatgagtctgtcacctacagcgatgctgatcaggtcgcaccgattacttatgtacctgcacgcaacaccatctttttatcttatgcgttggccagttgctgaagtgacgcaagcatccgccatcatcattggcgtaagttcggtagattattcaggatatcctgactgtcgccctgactatatcgctgcctttgaaactatggcaaaccttgctaccgtttcaggtaggcaaggcaaccacctatccattattgcaccattacaaaatttatcaaaagccgataccttaacgcttggtatctcattgggtgtggactactcaatgaccgtttcatgctatcaagccgatgcgttgggccgtgcgtgtggtcactgcgacagctgccatctgcgtagacaaggatttatggatgctaagattgccgatccaacacgctatcaataa

SEQ ID NO: 1683 - DNA, 918 bp, M.catarrhalis
tccatctaccgattgattatggtaattgctatggcaaaaacagtcacaaccacgccaaaagggttactgacagtgttatctgcttttttgatttggggctgttttccgctttatttcaaagagctgatagaatatgatgccatagaaatcatcgttcatcgtgtggtttggacttttgttatcttacttgggattaccataatcacaagacgctttaggtggattgatcaaatcaaaaagcagcccaaatggctgtttttaacctttcttgcttctgttttaatcgcaacaaactggttggtttatgtgtgggcagtaacgcacgatcaggtacttgaagcaagcttaggctactttatccaccctttggttggcgtgctattttcgatgctaatattcaaagaaaagctgcggttgatgcaaaaactcgctgtactactggccgccgccgctgttggcattcagattgtatggatgggcgggttgccttgggtgagtatgttattgccactgtcatggggactttatggtgttattcaaagacaaacgccttttgatgcacttgatgggttgtttcttgagacagcattgcttgtacctatatcactgatttggttgcaattttctcatgttgccagctcatcgatggcgttttgggtgtcatctgagatttggcttttgatgttagcaggtccagtgacattagtgccgctgcttttgtataatatatcgaccaagctggtacagtttaataccttatcttttttaaattacttaacgccaagcttgatatttttattggctattttttattatcacgagccttttgatgccaagcgattgttggtttttgtattaatttgggtcgggcttttgatgtttagtgcggatatgtttaaacataaaaaaggagcataa

SEQ ID NO: 1684 - DNA, 3627 bp, M.catarrhalis
cagtttaaccggttcttatattttcattttgtgagttactttatgtttaactttacccacactcaatccaccttacgagacgccattaccagtgcttatcgattagatgaagtcaccgcagtatcaaatttattagaaactctaaacttcaataatgatgaaaaatcacacatcagcgatttggctcgccgattaattacccaagttcgaaccaaccgcagcaaatcctcgggcgttgatgcactcatgcacgaattttccttatccagcgaagaaggtgtggcattgatgtgtttggcagaagccttgctacgcattccagatacaaccacacgagacagactgattcaagataaactgtctgatggcaattggaaaagccatatcggtcatagtccatccatgtttgtgaatgctgctgcttggggtttggttttgacaggcaaactcacccaacctaccagcgaaaaagggctaagctcggcattaacccgtgttctacaaaaaggtggcgcaccatttattcgtgcaggcgttaaccatgccatgaaaatcttgggtaaacaatttgtgactggtcagacgatccaagaagctttgtctaatggtaaagagcgtgaaaagcttggatatcgtttcagctttgatatgcttggtgaggcagccatgaccgctgaagacgctgatcgctattatcaagattatgttactgcaattcatgcgattggcaaagattctgttggtcgaggcgtttatgatggtaatggtatttcagttaaattgtctgccattcacccacgctattttcgtgcacaacacgcacgcgtgatgaatgagctgttgccacgcctaaaagccttgtttgtacttgccaaagaatacaatatcggtctaaatattgacgctgaagaggctaaccgtcttgagttgtcattagacttgatggaaaaattgatttctgatcctgatttagcgggatttaatggtattggttttgtggtacaagcatatcaaaaacgctgcccttatgtgattgattatttgattgatttggctcgtcgcaatcatcaaaaactgatgattcgcttggttaaaggtgcttattgggatagcgaaatcaaatgggcccaagttgatggcttggatggttaccctgtatatacccgtaaggtacataccgatgtatcttatttagcctgtgctaaaaaattattggctgctcaagatgtgatctatccacaatttgccacgcataatgcccaaagtttagcaaccatctatgaaatgggtaaagataaagaatttgaatttcaatgcttgcacggtatgggcgaaacactgtatgaccaagttgttggtgataataatttgggtcgtcgagtgcgtatttatgcgcctgttggtactcataaaacgctactggcttatttggtacgccgcttgctagaaaatggggcaaactcctcttttgttaatcgcattgttgatgagcaagtcagtattgatgaattggttgaatcgcccattgatattgtcaaagccaatggcatctctcaaaatccactcacgccaccacctcgccatatttatggtgatcgcaaaaactcgcttggattggatttaaccaatgaacacacacttggcagattagaagacttaatgcaacctgccagtcagattgattttaatgtctcttcattaacggcagtagatgtcagccatcagcctgctcatactgtcttaaatccaagtgatcatcgagatgttgttggtcaagtttcttttattgatccaaacagcgtaccagatgttatcaccacagctttaaacgcccaaacaaattggcagactgtctctgctgccgaacgagctgccattttacgccgttttgcagatttgatggaagactctgctcatatggcactattgatgatggttgccgtccgtgaagcaggcaaaaccttattaaatgccattgctgaggttcgtgaagcggttgatttttgtcgttattatgctgatgaagcagaatcgcttaatctgtctagccctgttggtacggtcgttgcgattagcccatggaacttccctctagctatttttgtcggtgaggttgtctcggcactggtaacaggtaatactgttgttgccaaacctgccgaacaaaccagtttaatcgcacatttggcagtatcttggctacatgagtctggtgtgccaaaagatgctttacagcttgtcttaggtgcaggcgatgttggagcagctttaacatcagatgaacgcatcaacggtgttattttcactggctcaacagaagttgccaaacatatcaataaactacttgctgctcgtgatgataatccagtactcatcgccgaaacaggtgggatgaatgcaatgattgttgatagtaccgctctacccgaacaagtttgtgccgatgtactggcatcagcatttgattcagcaggtcagcggtgctctgctttgagaattttatgtgtccaagaagacattgctgatcatgtggttgcaatgattaaaggggcaatggatgagctgattgttgataatcctgccgccctttcaacagatgttggacctgtgattgatgaagaagcacaaaaaaatctacttgaacacatcaacgcactcaaacaaattgcaccttatcatgaagttgccatcgcatcagatgcaccatcaacctttgttgcaccgattttgtttgaactcaaagatctatcacagcttaaaaaggaagtttttggccctgtcttgcatgttgtacgatttgctgcccatgagctgaatgatttgatagacagtatcaataaaaaaggatacgccctaacccacggtatccatagtcgcattgatggtacgattgatcaaattactgaccgtatccaagcaggcaatgtttatattaaccgtaatattgttggtgcagtcgttggcgttcagccttttggtggacatggtatgagtggtacaggtcctaaggcaggtggtcctttttatcttcagcgtctaagtcagctgacaaactggcaaaaaccgacggttgatacgccagcgagtattgatcatacagcactaagcaaagtacagcggttagcgcacaagcttttgacatctgataatgagaaggcaaattttgatgctgtcgcacaacaagccatcaactcatctttaaatcaagcttcggtcatcctaccaggcccgacaggagagactaacaccctaagttggcatgcaccaaaacaagttgctttatatggcggatcacaatcccaagcactagacgccttggcaatcttggcagccaatggtatcatcactcaagttcgcccatctcatgtactggcagagcatgccaatgagttaattggtgtcctaaaagttgttgaagaacctgcggtgaacgctaatgatatcatcattgcattatcaacaatgcctgctgatgaacaagttagtattgccaaactagatggttcaattcgccgtatcattgatgccaccaatgggcttgatattgcaagactgtatcatgaggtcagccaaagctataatacaaccgctgcagggggcaatgccagcttaatggcttcggcgtaa

SEQ ID NO: 1685 - DNA, 219 bp, M.catarrhalis
agcaagcttaggctactttatccaccctttggttggcgtgctattttcgatgctaatattcaaagaaaagctgcggttgatgcaaaaactcgctgtactactggccgccgccgctgttggcattcagattgtatggatgggcgggttgccttgggtgagtatgttattgccactgtcatggggactttatggtgttattcaaagacaaacgccttttga

SEQ ID NO: 1686 - DNA, 867 bp, M.catarrhalis
tcaaatttaagatcgaatcatatggataacactcaaacaacccacctttcttctcagttgcacaatgcccaaatgataaaaaacggcaatgacacaactttttatcatacagataacgcacaaacggacacgatgagtcttgaaaatcaatttgatgccaaagacagtagcagttggtttaatgaaaccttgctcttaagttggcaacaaacttttggcaatatcaagcatggctatgtcaaagcagctgataatttggttgatgagcttttggtcacactcacccaaaagcaagttaatgatgctttgtataattttgttacaaaaaatgttgggctgttgcataatttaaaattggatattcatgacaactggcttagattgacttgtacagtcgatatcatgggtctatatacaacagtggccagtaattttgagctggttcatctacagctagatcgccacactcagcggttggtgcttaagcaaatcggtgatacagatgtgattgagctacacagtaagcagtggtataaagccccagctgcacgacttggcgtgggcttataccgtacgctactacgcaaagatccattaccttttattttgaataaaattaaaattaaaggcattccatttactgggcataaaggcaatatcatttatcttgacattggtcgatggctaaaaaataatgatatgatcatgaaaaatctaaaaaaagttcaaatcaatgatggttacttaaaagcacaacagctcttattaaaggttcagccaaattttggtgatatcttaagctttggcgatcctgatgctgacatcattaccgaaaaagacaacccaaaacaccaaaaagcagattga

SEQ ID NO: 1687 - DNA, 546 bp, M.catarrhalis
gttttttcaaggttttatatgaaagctgattttgtaattacaaaatacttatttttatcgtgcatagtcagtataccaatgattgcttcagcattgccttctgataccaatcagccgatccgactattggccgatcgtgcgacttatagcgaacgcactggcgtaaccacttattcaggtaaagtgacgattgagcaaggcacattaaagattgctgccgataatttgaccgtgaatcttgataccaataatcgcagcattaaatcagcggttgcaacagggcagcctgccaccatacaacaagtcgtaacccaagaaaagggattggcaaaaggtcaggcaaatcgcattgattataatgctgtcagtgggattgtgacgctgacaggcaatgctaaactcactcaagctggatcaagtttttctggtaatacgatccgttatagcttgtctgttggtgatgttgaagccaatgctggtggtggtcagcgtgtagaattggtctttccaccaagcgactcaaattctcgtagtgggttacgctaa

SEQ ID NO: 1688 - DNA, 501 bp, M.catarrhalis
gctgctaaaagacgatgcatttgtcaatccaaaagtggatttgcaggttcaagtatgatcagtcaaaccctatccttacacagtgaagcagatacccaagcacttgccaaaaaattggctcagatgaacttatcgggcagtgtgtggttgtcaggtgatttgggtgcaggcaaaacgactttggtacgctattggctacaagctatgggtcatcaaggtgctgtcaaaagccccacttacacgctggtagagccttatcaaatcaatcttcaaggaagattaaagcctgtttatcatgctgatttataccgcttaaatgaccctgaggagcttgattttattggcttttatgaatattttgatgaaccaaacagccttgttattattgagtgggcaagccgtgccagtcaggttttacccaaacctgattatcacattgatatcattcgccatcttgatgacaaaagagtcgttaccttgatgggccttgaggaagtttaa

SEQ ID NO: 1689 - DNA, 1083 bp, M.catarrhalis
  unsure (748): Identity of nucleotide sequences at the above locations are unknown.
gccatcatgagtatcaatcgccccatcacaccacctaacagctggcaaaaatttggagatattcactggtatccttctgatctgtcagaacatctatttcaagccatcattgatatcggtgaaggtattaagctttgtgtggaagcaggcggcaaccccgagcatccaccaatgatctttattacaggccttggctcacaaatgatgttttggtcagaccagtttttaaagcgatttattgatgctggattttttgtcatacgctttgataatcgtgatacaggcctatcaagtaaaatccaaattgatggcctaccaagactcaataccttcaaaatgatgctaaaaatgcaggcaggtctatccaatcgctcagagccagttgcctatactctaacagatatggcagaagatgcagcacgcctaatcaaaaccatgcagcttcataatgtcaatcttattggggcttcgatgggtggtatgatcgcacagattgtggcagcacgctatcctaaatatatcaaaaatttagtactgctattttctacatccaatcgggcatttttaaggccgccaaaccccaagcaattcatgacatttgtccgtcgccctgaaagtcattcagaaagagatatggttcgccacagcgtatggtttatgacagcggttggatcgcctggccatttggacatcaaaggtacgcgtgccattgccgaaaaacgctaccaaagaaattttcatccattangcgtctcacaacagctgactgctattttggcatcaaggtcgatattacgctttaccaagcagatccgtgctaatactttggttattcatgggaataaagatggtttagttgcaccaaaccacggtaaaattcttgccaaagtcatttccaatgctcgttttgtattggttgatggcatggggcatgacttaccaaactattactacccttatttgaacgggctaattagtgaacactggccaagcttaacgcttgatggtgtggaaggccacattcatttcgtaaaaactggtgacatacgctttgaggatttttatgaagcccatcacatttaa

SEQ ID NO: 1690 - DNA, 615 bp, M.catarrhalis
tgcacttttggaaaaagaagaatgatggcaaaagcagttagcactaactatcatccaccaagttttttacctgatttgccaaccatgcacctaactgccagtcacggtaagctgattttacttgattggcaagatatcaaaacccaaaaactgctcaatcaagccaatcagcatgcggtatttataaaaccatcccaattagatatcaatcagcccgatcaggcgattcttttacagaccaccgagcagcttaatgagtactttgatggtactcgcaggaactttagcataccgcttgatttttcttatggcactcaatttcagcaacaggtttgggcggcactgttgacgattgattatggtcagaccatcagctatgccaagcttgccacactcattgataaacccaaagcgtttcgcgcctgtgccaatgccaatggcaaaaatcctttaagcctaatcgttccttgtcaccgagtggttgcatctgatgggggtttgggtggttatacaggtggtgttgccattaaaaaagcattattagattttgagatggcgtgtcacttaagcaaaaataaaacaccgactgattttgattatttatgctataattag

SEQ ID NO: 1691 - DNA, 2061 bp, M.catarrhalis
tatatggcaggggatattattagccgatatgtgaccgatcgcattcaagacaatcatcaatggtatgccaaaaaacaggttttggctgctgaatgtacactaagattactagactttgagctatatcatatcgtgcaggatgcattattatttcagctcaatcaagggcataccatactgcatatcaatgatcatgatgatttgaataatcgccatggattaaatggcatgatacccatttggcaacaaaaaatcatggattcatgcctgacagtgataacgcacgcattggcaaatgagggcatggactgggcagcattttttgatgcttatcatcgctgtgcagatgatactatcaagataaaacaatttgttaatcatgccttaaatcattttcgtcagcaagtatctttgcttgatcacacagtgatggaaattgagcaattatctgcgttatttttgtccatgctgcgtatttactatgtcttatataaaaacgccaatactttgaagcaatttgtgagtcttttgcataacaatactttttttggagatattttggcatcaaacattcaaagcataccaacaaatacgccaccgatttattttagtgatcaagcaggtggactgtatttatggacaagtcgtgcctaccttgctgaatcacaactgatgacgcatatcttgcgtatcagtcaggctgatgtgccgatatttgctcttgatcagctaccaaatagcctaaataccgagcagcgtgacgcaatcaagctggtctcaaaacaagcgttttgcctaattacgggaggtcctgggacaggcaagacctttacagttgcccaaattgtcatcgcactcaatcagcgtgatgagcataaaaagatgcgtttggggcttgctgcaccgacaggtaaggcagctcagcgtatgagtgaatctttgcttaaatccctagataaggcgaacgatatacagctgcccaagcctaagaccattcaccgcctgcttggtattggggcaaatggcagcccacgctatgatgccaaaaatcagctgccgcttgatatgcttattatcgatgaagcttctatgcttggcacggagctggcaagtcagctatttgctgccatcgccacgggttgccgtgtgattctacttggggatacgcatcagctggctgcggttgatgctggtgcggtgttggctgacttatgccgaattgaacgcctaaggcatttgcgtgtcaatttgacagcatcaaaacgctttacggacacatcaggtgttggtcaattggcaaagctgattaatgatgatcgtcaaaatatacactttgatgaaatacaacaattaatcaattgccataccaagattgattttcatcccatcacccatgccctaatgtacaatgatacctaccaaaagcttagccaagactatcaggactattttttagcaagtaaacggcttcgctttagttttgcaaaattatctagccaagatgcaattgatagcgtcaaaaaactatttaagatattagatacttaccgtattctttgcgcttcacatcttggtacatttggcgatgatcagatcaatgattatttaagcttagctcatcgagcagttcaaaaaatcccaccatcagtatcgccttggtttcatggtcgtgtggtgatgattaccaaaaatttatatgatttgggtttatttaatggagatatcggcatttgcttatggggttcatcaggtcttagcgtgtactttgaaggcgaggctttgcgtatggtggcggttgatatgttaagtgataccgttgtgagtacggcttatgccatcacagtgcataaatcccaaggttcagagtggcaaaaagtcgccattatctttgatggcaatagcgaacgcctgctgtcaaaggagcttatttataccgctgttactcgagcaaagtcagcggtacatatctacagcacgcatgacgcactcatcaatgccatcaatacgccgacagttcgacaaactgggctggataaagtgagtgatggtcagcaatcataa

SEQ ID NO: 1692 - DNA, 312 bp, M.catarrhalis
ttcgtccaaggagaaaacatgccgttatttgtcattattggtcacgatgtcgctgacagcctagatcaacgtaccaaagccagacctgcacatcttgaacgcttaaatacgctgatggcgcacaatcggctcattcttgctggtcccacgccgatcgcacatggagagtctgccatgagtggtagcgtggtggtggctgaatttgaggatattcatgccgccaaagcttgggcagaagcagatccttatattatcgcaggcgtgtatcatcatgtcgatgttaggccttttatccaagttcttcctaagtag

SEQ ID NO: 1693 - DNA, 420 bp, M.catarrhalis
ctaaacaaagggttaattatgcatattattttaatcatcctattggtgctggcatttgcttattctttggcacttgtcgttctcaataatcaagcaatcgctgttaatttattattttcaagtgttgcaaatatgagcttgggtttagttttagttgcaacaatttttttaggcattttgattgggattttgcttgcactgttattatttcgtgtttttcaaaataagtgggaaatcagtcgtctcaaaaaagaaaaagcatccattcaagccaagcttagtgaagccaatcttcaactggcacaacaagctgaagaaattcgcagattagaacttgagtatcagacaaataagccaaccttggctgatgctactttacaacaagttaccaatgatggctatcatcatccaaatttataa

SEQ ID NO: 1694 - DNA, 1245 bp, M.catarrhalis
ggaatgtttatgactcagcttgacccaaattggcagacagatgcacttgatctaagtcttggttattttgagcagactttggcagttcgaggcggttatcatcgcactgatgaaggcgagcataacgaagctatttttacaaccagcagttatgtgtatgccagtgccgctgatgcagccgatcatttcaatggtaataaaaaaggcaatgtctattctcggcataccaatccaacagtcagagcctttgagcgtcgtttagctttacttgaaaatggcgagcgagctgtcgctaccgcatctggtatgggtgctattttgaccatgtgtttggcatacctaaaagcaggcgatcatttgctttgtgctaagcaattatttggctcatcgatcgcactctttgatggttattttcaggggtttggggtagaggtcagctatgtagattgttttgataatgaggcatgggcagcagcgatacgccctaatacccgtgtgctttattgtgaaagcccaagtaatcctttggcacagattgccgatttgcgttacttgtccaagcttgcccatgcacacgatgccttattgattgttgataattgttttgcaacaccagccatccaaaagcctttagagctaggagctgatgtggtcattcactcagccaccaaatacattgatgggcaagggcgtatcttgggcggtgcgcttgttgggcgtgatgagctgatggaaaaagcatttggtgtggtgcgtacaggcggcatcagcttgtcaccttttaatgcttgggtactcttaaaagggcttgaaacgctatctctacgcatgaaggtgcattgtgacaatgccaatcaagttgcccaatttttagccagtcaccctaatgtcaaaaaagttcatttttcaggactgtcagaccacccctcgcatgagcttgccaaatcacagcataccgcacttgaagtgactgggggagcatttggggcgatcattggttttgaagtggctgaccaagcatcggcatggcaagtgattgatagcacccgtatgattagtattactaataatttgggtgatgccaaaactaccattacccatcctgccaccaccacgcattttcgtatgacgcctgagcaacgtattgaagcaggtgttcatgatggtttgattcgattatcggtggggattgaagatgctcgtgatattatcaaagatttggcacatggcctagataatatttag

SEQ ID NO: 1695 - DNA, 1146 bp, M.catarrhalis
ggaattcttatgacaaccaccccaaaacctaagacggcgacaacaagctcaacgactgccacaaccgttcccaaaaaaacaacatcgactcgtaccaaagtatcgaccgctacagaaaccaagccaaagccatcaaaagcggaagcgattatgacacaaacggtgggtcaattagaagagttacttgagcatgctacccctgaggagttggcagaatttggtgaagcgctcaaagaataccttcccacaactcatgtcatcagccaagttcgtaccgataaatcacgagatactcagctttcggataattggcgtgaaggcggttatccctacaaatatcgcttaagtcgtaaaaattacgaagcccaaaaatacaagctacaaattgaactgttaaaactccaacatcatatcaaaaccactggtcaaaaacttgtcattatctttgaagggcgtgatgctgcaggcaaaggtggcaccattaagcgatttatggagcatttaaatccccgtggtgctcgtgtggtcgctctagaaaagccaaccgaacaagagcgtggccagtggtattttcaacgctatgtgcagcatctgccaaccgctggtgaaatcgttttatttgaccgctcttggtacaatcgtgcggttgtagaacgagttatgggcttttgtacggatgaagaataccgtatttttatgcatcaagtgcctgaatttgaaaagcatttggtagaatctggcattcatttggtgaaattttggttttcggtcagtcgtgaagaacagcgtgtgcgttttgccagccgtgaaaatgacccgttaaaacagtggaaactatcgccagtggataaagcctcgctcaataaatgggacgattatacacttgccaaagaagctatgttctttaatactgacacggcagaagtgccttggattgtgattaaatctgactgtaaaaaacgcgcacgcttaaacgccatgcgttatgtactcaataaattaacctacgaaaataaagacatcgctcaaattggtaatatcgatcctttaatcgttggtcgtgcaggtgcattgtatgagatggatgaacgcacagacttgactgtcagcactcaattacccagaaaaaccacaacaaccaaataa

SEQ ID NO: 1696 - DNA, 609 bp, M.catarrhalis
aaaaggcttatcatgcgaattcgcaaactgtttaaatttgaaaatgcacacattgtgcgtaattgttcatccgatcgctgtaaacgatccatacatgggcatagttatgaagttgaactgattttggaggcacatcgccttgatcacggtcaaatggtttatgattttgggctattaaagcaccatatcaaagatatcatagacagttttgaccacgccatcactttttgggatcaggacgatacacgctatatccaagcttgcaaggactttagtgcgcgttggataagtttgcctgtatcaccttcagccgaacagtttagtcgagtgattttcttttgggcagatgccattttgaatcaaactgtcatgcaaaacggtgaacaagatatcagcgtttattctgtcattgtccatgagacagcgacaggctatgctcagtgctttaagcaagatgttgaaaatgaacaaatgggcgtacttagcttagctgattttgagtttagtgagcaagttaaatcagagtggagcgaccctcagatgtatgataagctgctaaaagacgatgcatttgtcaatccaaaagtggatttgcaggttcaagtatga

SEQ ID NO: 1697 - DNA, 1422 bp, M.catarrhalis
ggatatactatgaaactcatgccattggcttttgtgattggtgcggcggttggcttatctgcctgtcaaagtcttgaccatacccaaaacgctatctcaaccacaaaaaccccaagcacccaagcagaacatcacgatatttatacccaaaccttaaaaaatggtctaaaggtcatcatcaaacaagacagccgagcgcccattgtgatgacccaagtttggtatgatgtgggttcaagtgatgagcctattggaaaaggtggtatttcacattttttagaacacatgatgtttaaagatgccaaaggtgtcagtcatgacgactatcaacgcctcattagtcattttgggggtgagttaaatgcctttaccagtgatgaatttacggcctattatgaaagcctgcctgccaatcaatttccattggcactacaaatagaagccaatcgcatgaataacctcatcttaaccgctgaggaggttgccaccgaaaaacaggtaatcaaagaagaacgccgcctaaccacagacgacaaacccaccgccaaagctcatgaagagtttttggcaattgccctaccaaattctcccaaaggtctccccatcattggtagcatgccagagattgaagcaattacggtaacagacttgcaaaattggtatgatcaatggtacgcaccaaacaatgcaacattagtactagttggcgacatcgaccccaaaaccgccctgccttggatcgaaaaatattttggcactctaaaaccatcatcattaccaaaacgcaccccacttagccagccaagtcatcgtggctatacgcaggccaatagctatcaaaatgttaaagtaccaagcttaatcatggggtttaatgtacctactttaggtagtcgtactattaaaaatcataccaaagaagctcatgcattatcactgcttagcgatattgctgatggcggcttatcagcacgttttgagcgtcatctgattcgcaaattacaaatactaaatagcgtttctattcgctataatatgctctcaaaaagtgatgatttatttaccattattgccacacctcgtgagggtgtcagcttggcagatgctgaagctgccatattagcagagcttaatgccatcaccaacgatcaaatcacggatgatgaactggcccgtagtcgtgcaggcttgttatcatctttggtgtttgccaatgatagtatcgccaaacaagcctctaatttaggtgctttgtctgcgttggggttgcctttagatactttagatactctcccaaaagcattggacaaagtcagtaaatcagacatccaagctgtgggtaaaaaatatctgaccaaagacaatctaaccacggtttatgtattgcccaaaaatacacaatcgccctcagacactcattaa

SEQ ID NO: 1698 - DNA, 738 bp, M.catarrhalis
ggcctgaatatgacaacagtattatcgatgcgtcacttgggtaagcgttatggtcaaagatgggtggtcgaggatgtctcttttgagattgagcaaggtcaagtggtcggtatcttaggtcctaatggtgcaggcaaaaccacaagtttttatatggtgatcggtcttgtgcctatggataaaggtcaggtaattttaggtgaccaagatatttcaaaaaatgccatgcatgagcgtgctgccaaaggtatcggttatctgccccaagaagcttctatctttcgtaagctgaccgtcgaacaaaatatcatggcaatcttacagacacgcaaggatttaacacaaacagagcagcgtcagcagcttgaaaagctgatggctgattttcatttagagcatgtccgccattcgttgggcatgagtgtatcaggcggtgaacgcagaaggtgcgagattgcacgctgtttggcatcaaatcccaaattcatcttattggatgaaccatttgcaggcgttgatccaatttctgtgagcgatatcatgcaggtcatcgaaactttgcgtgagcgtgggattggtgtactaattaccgatcataatgttcgtgaaacactgtcaatttgccaaaaagcttatatcgtttctgaagggaaagttatcgcccaaggtaataaagatgaaattttatttaatgagttagttcgtaaggtctatcttggccaagatttcgttgcttaa

SEQ ID NO: 1699 - DNA, 360 bp, M.catarrhalis
atgagcgatattgtgttcatacaagggcttaatattgatacggtgattggtgtctatgcttgggagcgtgtcatcaaacaaaggctcatcatcgatgcgcagatggtctgtgatatgacgcgtgccattgccgatgatgatgtggcgtatgtgattgattataaagccgtttgtgaggatattgaaaaattgtgccatgaggtgcaagctgagcttttagagaccttggcggataagattgcgcatcatgttttgaccaattatccatgctgtgaaatcacactgaccatacataagcccaatgccatcaagcaagctgatagcgtgggtattaaaatcatccgcaaggcaggtgtatga

SEQ ID NO: 1700 - DNA, 1278 bp, M.catarrhalis
gagtgcaacatgacaaccaagactaaaaaagcacatcagcatttagaagtaatcagacggcttgaagctcaaaattatatttttacccaagatccaaaaatcatcaccgaggctgttaagttggaaaatggcacagcatttgataagctatttatccgagctcaaaaaattgacagcgatgcacgcattatgcagatattatcagacacacagcatggtatcttaagtgtcatcagactgatttatctgctttattttatcttcgctctcattggcgttgcaagtctgcttggcactcaagcgattaactttttttatttgatggtagcgttattaggttggcatacgctttctttggtttggtggctgatatcacttgcattttcgcaccgcccatcgatgcttagcagcgtcgtggaacatatcgcccttaaaaataagctgattgagaagctaagtgcttgtgataaaaacatccaaaaagtttgttttagcgtcttaaatgatacaatcaaacccatcaagcgatggcagattgccagtatcttacacggcgcttggctatttggcttaatgggtagcattttgggtatgctgggcttatttttattcaaaagctacagttttcactgggaatcgacactgctgaccgatcatcattttgatcgtttgataacgatcatcggctatattcccagtcagttggggattgtgttgcccagtgcgtcaagtcagacacctgcacaatttgccatattggcgatgacaagcgttatcatctatgcgattttgcctcgtttggcagcatatttatatagtcgtatcaaagcacgccaacagtttcgtattgataccaaagcaccctattatgccaatttgatgaatttttatcgtcaaaccatcattaatgcagatgactatcagtcgcctaagcctacaacgattgcacctattgtattaagcgatcgattagttattgctgcacttgaaaagccttattatcatcatccaattccaatcaatgccataaaagattttggcgtgattgatacacacgcacaaataaagatgctacttgcagacgctttgcacttatcggcacaaatttatttaattatcaataccgataccgtacctgatcgtggcatagtgcgtaaagtagaacgattagctagccatcaatttggcattatagcgatgcttgttggtgagcagatacacgatgatgcttggaaagtggcgctaaatgaacgccgtatccccatatttaatcactga

SEQ ID NO: 1701 - DNA, 1119 bp, M.catarrhalis
ggaagtttaatggatctgccgcattatacagatttgccaaataatagtgtcgtttgcttgatgtctccgaccgccagtggtaagacagatttggcgtttaagctatatgatacaggcaggtttgagctgatttctgttgatagtgcactgatatatgaaggcatggacattggcacggctaagccaaccaaagatgagctgaacgcttatccacatcatttggtagatattttgccgcccacccaaagctacagcgtcgcaaattttgtgcaagatgttgagcgattgattggcgagattcatgcgcgcaataaaatccctattttggtcggcggaacgatgatgtattatatggcactgcttgatgggatatccgcagtaccgcaaaccaatccaataatccgcaatcaggtcaaaatttggcacgatgaaatgggtaataaagcgttatatgattacctaaaacaacatgaccccgtgatttgtcaaaaactcaaagtcacagacactcagcgtatcacgcgtgccgttgaggtacacttacaaacaggtaagccgttaagccattggcaatcaacaccaaagctggcaatcagccaccacccaaaatggcactggtacgctattattgttatgccagatagagcttggttgcatgagcggattgaacaaaggcttcaagtaatgtgggcggatggatttttacaagaagttatcggactaatcaagcagcatccaaatctgacggccgatatgccagcactgcgtgctgttggatatcggcaggtgcttgattatttgattgcaattgatcatgcctgtgtcactgcccatcttgggcttaagccttattatcatgctcaaaaatccaagcaaaaccaagaaattaattcaattcatcaagattttaacaaaaaatctaaaaaaaccatgacaaatacaagggatttggcttgtcaagatatgaaaaataaggcattatatgctacaaggcaattggcaaaacgccaatatacttggctgaagcaattggcacagacagacaaaccaaccaaaaataacttaacaatagtatcatttaatagcataaaacaagtagaacagcaatttttgcaataa

SEQ ID NO: 1702 - DNA, 1326 bp, M.catarrhalis
ttactatcaatcatacgagcaaacaccatgagccaacttaatatcgcttataccgacggcgcctgtaaaggcaatggaaaacaaggcgtatctgcaggcggttggggcgtgtatttgcattatttcaatggcgatgagcggcatctgtggggcggtgagcctgatacgaccaataatcgcatggaattgatggctgccatcacagctttggaggcaacgcctgcacagattcctctgcaactttggacagattcaggctatgttaaagatggcataactcagtggattggcggttggaagttgcgtggttggaaaaaagcagatggcaagcctgtcttaaatcaagacctatggcaacgattggatcagctgacccaaaatcgcatcattgattggcaatggatcaaaggccatgctggtcatgctggcaatgagatggcagaccaactggccaataaaggcgttgatggttttggagatgagaccctccccaatcccatcgttcacaatgacgaaaattttatgataaatacacccaaaccaaaacacccctatgcttacaacaccatccaaaaccctgattatgatggtgataccagtcgtaccaatactgatttttggccaattttacccaagcctgacaatcgagacgcacccgaaagacagctgatcatggatactgaaaccacaggttttaatgaagctggtggtgatcgtatcgttgaggtcggaattgttgaattggttgggcgtaaattcacaggcaatattttacatgtgtacatcaatcctgaaaaacacatggatgatgcagtcatacaagttcatggcatcagtaatgcgtttgtcgcagataagcccaaatttgctgaagttgctcagcagatttatgagtttatggcaggcagtgaggtcattgcgcacaatgccgcctttgatatgaaatttttaaacatggaatttaaccgtgcaggtttaagtaattttgcaaacagtgttaaagttaccgatacactagcactcgccaaacaaatgtaccctggtcaaaaaaacagcttggatgccctagtaaaacggcttggcgtcggtcaaaaagatcgtacctttcatggggcgttgcttgactcggagatcttagctgaggtgtatttggcgatgacaggcggtcaaatcgcaatggcaattgacgatgataacactggtggcagcaatactcgtagtacaggatctgcattttacgatttatctcaatatgcagactcactggcactttctgagtctgacattgaggctgatgctctatggcgtgccaaggtgttatcatga

SEQ ID NO: 1703 - DNA, 3957 bp, M.catarrhalis
gataccgcaatgactgataccatcttaacgataccgccaacaccgcccaaaccctctgaacaaattgccgccttacaatgcacgcttgagcaggcttatttgattgaagcttcggcaggtacaggcaaaacttggacgctgacggggattattctacggctattaattgaaaaaaaatatccacctgagcgtattattgccacaacttttactcgggcggcggcagctgagatgcaagagcgtatcagtgagcggctgcacagcttttatggcttgatgcgttggttgcaaggtatgctaagcactcagcctgaatggtttaatcagactgcacccatagagcaaattattacttatgccgatcaggctgggtatgatgccgccgatccaattaatgagcatttactcagatttatcctatctcagcaagcaaccttcttaaacgaagtggtttatcgcacagggcttttattaacttctttagataaactatttgttggtacgctagatagccttgctcaaaaatggctcaatgaatttgccgcccaaattgggcatcagtctggcatggagattttaaataatgccgaacaaaaagttgccgccatcgtccatgatgagatgcgtgccgaagaagttaggcttaagcacgcccagcctgaattttatcaaatctttaaagcattttatccaaattttttcagccaagtggatgctgttgtcaagattgttaataaagcgattaatttttattctgcacccattgacgagcttatgcctattaatacagacataagcttggtcaaagcgatgattgatcaaattataacaacagattttacaggatttacaccatattttgacgccaattttcgcaaacaagtagcaatgaatcagagtttaggctttggcaaactgattcaatatctgccaaatttgctgtctttaatccaaaaacacggcgtgctatttgttcgttttgtggataatgatgcacttaagctgattgatgcaatcataaaagcaatggataaagattggcaaatttttaataaaagtgccaacccaagcgatatcaatcaatttttggcgttgccacttcaggctctcagcgatattgccaatgtttatttgacgctaagtgaacaaaccaatctataccatacgcacatctgccgacacattatcctaagtgcaaaaagtcagattgcccaaaggcttgagacacatggtcagaccacatttacgctacaaatggtaagattaaatgaggcacttcgtaatagtcctgcactggcacggcagattcgccatcattatcctgtcgctttgattgatgaatctcaggatattaatgggctacaagttgagctgattgagctggtttatctcaatgagattgccaattatcacaaaaatcttatccgctatgagcaaatcggtggcgagaagccaaaactgccacggggatttttattgttagttggagatcctaagcaggcaatttatcgctttcgtggtggcgatgttaccaattataatttaattaagcattatggcaaccaagatttgctcatcaaagcaccattgatgaatcaatcgctgtctttgacggtcaatcgccgttcaagcaaagcactgattgaggcactcaatgcatggtttgacaataatcatcaagatgctgtcgccaatcatgccaatttaggtcaagggattttttatcagcagatccaagcacataaagacggtggcggtatccattggcaatctgatgcttatgccgattattatggtaaatatcccatagcggtgttgcattttgaccatatcgaagctggtcaaaaagctgcacaaagggctgagcaaattgctcggcatatcaataccattttgcaaggtgatcatacgctacatggtcaaaagatactgccaaaggatattgctgtacttggacgcacagctgatacgctagataggataaaaagtgaacttgatcagctcaatatcccagccatcattcccaaagagatgaatatctttatcactcaagctgcagatgatcttttggcgttaattggtgcgatactacaaccaaatcacagcgaaaacttgggtaaatttttggtatcaagcttggttggcatgacgcttaagcaagcaataaatatcattgaaccaaatgatcagcaggctttggataatgacttatcagaaactcaaaatctaaaaactcatcttttagcctacctaaaaaaatcatatgaaaaatggcaaaaatttggtgtatcatcagcacttgcttatgcgcttcaccattcgcccattgattatgatgatgacaaatcgccttggcttaaggcagccactcaaggcgagcgttatttggtggaccttgaacggctggtggctttggtcagtgagcaatcgcagctgcacgagatgcgtatcattgcttggtatcataaacagatgaacgctgatgttgatagccacaataagcgtcccattctaccgagcgaaagcggtgttaatttgatgaccattcataaatcaaaagggcttgaattccccatcgtgtatgtcataggcatggatgaaaagccaaaaaatgaaaatgggctgacaatctacccttatactaatcacaattttcagcggcgcttaagcttaagccaaggcaatttgattgatgaaaattattattatcatatcaatcagcaggagttgattgatgaaatcagacgcttaggctatgtggcattgacgcgtgcttctgaacagctatatatcgtgggtggtgatttatccaaaaaaacttcaaaagaaatgcctttgtatcaatggcttgactgtgcaggtgaaaaaacactgagcctaccagatcggctaaaaggttgggtggactggatagatctgaccgaagcggatttatttagccaaccttatcaaaccaagctgcccaatcttagcaccaaaaattatgcaccttgggatatggtgatgaccaaaacccagttttttggagaatataagaccagctttagtgcattaattactcgcttggataagtctgccatttctcctgatgaagcagatattgatcagttgtctgtactgactgacatggccgcatctgatcagtttgatgacattcgtaccagcttttttaagggcagtttggctggtgattttttgcataaagtcatgcaatttttaccgacagatcgactggcattggcatctttgcacgatgctcatcgtatcatcagcggggtgatttatgaacaaggcagaaaacttgggattgctgagcgttatttacccactcgccccgctcagcagattggtacacgcatcaattctaacgagcatcaagccgatgatcataccaagttggttgcttggatttatcagcttgcatacgcaccttttagagcatctcatcgctcattaatgtctctgccaatgactgtacaactgcgtgagcttagctttacactggggcttggcgatacctttagtatcactcgcctaaatgaggtgtttaaagcacatagcgacaaagacctagtattgcttgacgatgactatcataccatgcgttatcgttatttacgaggtgagattgatttggtttatgagtgcgataggcgattttttatcgttgattataaatcaaattatttgggtagcacgcctgatgagtatcatgatcacgccatggctgcagtgatggataaggtcggctattggctacaagctgctatttatcaagtggcattgcatcgacttttaaagattcgattaaaagactatgttggcaatgaagcagcttatttgggtgctgttgaatatgtctttttgcgtggcgttcaagagggcaatgagaagacagggcatttatgttggcagccgccattatctttgattttagcacttgatgagattttataa

SEQ ID NO: 1704 - DNA, 519 bp, M.catarrhalis
gcgacccaaatgaactttcgtatgttaagtgtgttgggtgtcatagcattagcggtggcagtgtggtttttttatcaagaagatatcgaggtgaaacctgccttgcctgaagtgccgactgtggattctgaagttacccaaatcaaagccattcaaaccgatcctaaaactggtgcaacagaatacacactgaccgcagattcattgattcaaaacgccaatggtcaagatgaaatgttgggtgcaaccattcactggcaacctcctcagggcgaaacctatacgctgactgccgaccgtgcgacacttgaacaaaacagtggcgatttgcgactatctcaaggatttcggttggtgcgtgcagccactgctgctaagcctgaaatgattattgaaggcttgaatattattggcaataccaaaaatcgtactatatccagccgagaccctctaacagtacaacagggcatagatcgctttaaagctcagggttttcgggccgttctacaaactggttga

SEQ ID NO: 1705 - DNA, 690 bp, M.catarrhalis
ttcaataaaattgatcaaatcaatttatcacaacaatttatcacaacaatgcctttactgtttaatgatcaagtaaaggcaaattttatgtttaatcagcttatgacaatccaaacaattcatagacaccctttgccaccattcacaccacccaatgcatgtgtgatgatgcttggcagctttccgccaccgcctgagcgttgggcaatgccattttattatccaaattataataatgatatgtggcgtattttgggtttggtgttttttgatgatgctaagcgatttattgatagcacgcataaaacctttgatcaagatgctattgagcaatttttgactaagacgggcatcgccatcggcgacacagccgaacaggtgatccgccaaaaagacaacgcttctgatcagtttttacagattgtcacaccagcagatattgaaaagacgctcaagcagttgccttggtgtcatgcattcatcaccacaggcaaaaaagcgactgaagttttatgtcagcaatttacaagccaaaaaataccaaacattggcgagcaagtacagctattgattgccaaccgtcgcattgatttatatcgcttaccatcatcatcacgggcgtatcctttggcgattgataaaaaagccgatttttatcgaaaggtttttgagacattgggcgtgctttaa

SEQ ID NO: 1706 - DNA, 1053 bp, M.catarrhalis
tatttcaaaatacaagtatatgacacaatgatgacagataataagctacaaaaatcccttaaaaatcaacatattttatcacagcccctatctattgggggtttaaaaattgagaatagaatttgggtagcaccgatggcaggggtgacggataacccttttcgaaggctctgtaaatcctttggtgcaggtcatgccgtcagtgagatgattattgctgatacagcattatatgcacgcaaaaaatcgttatatcgagccaattttgatggcgaaattgcacccatttctgcacaaattgcaggggctgagcctgataaattggcacaagccgcccaatttcaagttgccaatggtgctcagattgtcgatattaatatgggctgtcctgccaaaaaagtctgccgtaagctcgcaggctcggcattgcttcaggatgaagatttggttaggcggctgcttgacagtgcggttttggccgttgatgtgccagtcactttaaaaactcgtttgggatttgccaatgggcaagaaaatattttaaaaattgcacaaattgctgaacaagcaggcgtggctgccattaccattcatgggcgtacacgagaggatttttatacaggtcaggcacgctatgagctgattacccaagtaaaaaaggctgccaaaatccctatcattgtcaatggcgatatcgatagcccacaaaaagctttggatatccaagccaaaacaggggcagatgctgttatgattggtcgagctgctcaaggtaaaccttggctgtttcagcaaattgcccattttgccaatactggcgaactcttagcgtcgcctacggtcggtgagattcatgaagtggtcttgaggcatctagatgagctgtatcgcttttatggagaatattcaggatgtcgcattgcccgtaagcacatcgcatggtatacaggcggtctgcccaactctaacgcttttcgtgacgccatgtatgcgtgcgagactaccaaagagcagtttgaggtcgtggataaattttttaagacaatttcttaa

SEQ ID NO: 1707 - DNA, 1440 bp, M.catarrhalis
ttggtaaaaatgagattatttttggaagtatttatgaaaaatcagtctgccacccattgggcattatctgtcatgacaatcagtgtgcttttaagtgcctgtacttctcatgtgacacatgagcgtgcaccaatcaaagttgtgcaggttacacccaatcctgcacaggttgcaccgcctgctcaagtgcctactcaagctttgaccaaagtacctacctcaaccgttcagcctacgaccgccaaacctgcatccgttgtggtacaaaaatcggtcgtcgtacaaaaaccagcccccaccaacacacccagcatgaccacccaaagtcattatgctacctttgctgaatggaaacatgattttattcatcgtgccttggcaaaaggtattaatgccaatagtttaaatgcattgatgggtaatgccacactcaatcagcgtgtgatagagttggatcgtagtcaagctgaattcaccaaaatgccctgggaatatgtcgaatcagccgcctcttcaaatcgcatcagccaaggcagatccaaattaaatgaaaatttgagcatattaacctcagctgaatctatctatggcacaccaaaagagattaccgccgccatttggggtatggagtcatcatacggtgctggcatgggtagtatggatttggtcagtgcgttatcaagcctagcgtatgatggtcgccgccgtgagtttgctgaaaaccagctacttgcgatgcttttaatgattgagcgtggtgatgtggcagcatctcagctaaaaggctcatgggcaggaggcatgggacatactcaatttatcccaacgacatggatacaagagagtatcgatggtgatgccaatggtcgaaaaaacccttggaatcgccaagatgccttaacttccactgcaagttatttggcaaatgctggctggattcgtggcttacagcctttttatgaagtgcgattaccaactgggtttgactttttacagctaaatagcaagcgtagccttgatgcgtggaaggcattagggctggtcagtgcaagcggtgaatattttggtggcgtacatgaagcacaattgtggctacctgctggtcaatatgggccagcattgctactcaccaaaaattttgaggtcattcgtgtttataacaattcctcaagctatgctttgggtgtttctttgcttgccaaaaaaattgccggtggccatgatcttgttcaatcttggccacgtcatgaacagccattatcacgcacccaaatcatcaatttacaaaaaaacttaactgcacaaggctatgacacccaaggcattgacggtgtcgctggtagtaatacccgccaagcatttgcacgctggcaagctgctaatggtcaaataccagatggattcatcagccagcgtacggctggtcatttggtctggtaa

SEQ ID NO: 1708 - DNA, 762 bp, M.catarrhalis
ttaatgaaaatcatgggggaggtcattccaacttgggtattaatgggtgctgtggttttggcattttgtgcaggtattttaaatacaactgccttaatgggtatcacccatatttcagcatcacatgtgacaggcaatgtcagtttatttgtggtttcaatgcttagcaatgactggttaaattttaagttattattaatatccatcgggtctttttgggtaggatcggtattaagtggtgctatcattggctcaagtgaactcaatatccaccaaaattatggctatgccatgcttttagaggtgctgatgctgtgcttgagcctttggatgtatttattgacacatcattttttgggtcaaatgatgattgccatggcgtgcggactccaaaactcaatggttgcaacttatcatggcacagtcattcgcaccacacatttaaccggtatcacttcagacttgggcgctacagtaggtaactggttggttggtcggcacgtcagcttgcataaaatcattttacatagctcgctgtggtgggggttttttattggcagtatttcagctgtacttttatataattacatcggatatctatcgatgattttgccaatcatgatcattttgatcgccgctttattttatcatcaaatgggcaaattatatactcaaatattaagacttgtacgcctaaaactgatccaaaatcaacgaaaaaaacgccgctcaaaacctcatcattccaagctatccacttaa

SEQ ID NO: 1709 - DNA, 1260 bp, M.catarrhalis
ggaggattgatgtctcaggcaaaaaatgtactcatcattggtgcaggtggtgttgctcaggtggttgcacacaaatgtgcgatggcaaatgatatttttggggaaattcacatcgcatcacgcaagattgacaaatgtcaagctattgccaaaaatgtcgccaaaaagggcagttttaagcgtgatgccgttttgcatactcatgctgtagatgcgatggatcatcacgctgtggctgaattgatccgcaaaacaaatacagatatcgtgattaatgttggctcaccatttattaatatgagtgtgatggatgcgtgcatcgaaacaggtacgcattatttagatactgccatttatgaagatccgcataaaatttgcgaaacgccgccttggtatgaaaattatgaatggaaaaaacgagaagccttcaaaaaagcaggtgcaaccgccatcttgggtgtgggatttgatccaggtgttgtcaatgcatacgcacggttgggtgttgagtattttgataaagacagcgtaaccgatattgatatcattgatattaatgctggtagccatggcaaatattttgcaaccaattttgatcctgagattaattttcgtgagttcactggcgtggtttattcttggcaaaatagccaatggcagaccaaccaaatgtttgaagtcaagcggacagatgacttacccatcgtcggtattcaaaacagctatctaagcgggcatgatgaactgcactctttgcacaaaaacttaaatgtgccgaatatccgtttttggatggggtttggtgatcattatatcaatgtatttggcgtgctaaaaaatcttggtctcttatcagagcagccgatcacaactgccgagggtctagaagtagtgcctctaaaagtcgtcaaggcggttttacccaatcctgccagtcttgccgaacattatacaggtaagacctgtatcggcaataaagttaagggggaaaaagacggcgagactcaagaaatatttatttataatatcatcgatcatgaagacgcttatgccgaagtcggtagtcaaggcatttcttataccgcaggtgtgccgcctgttgcagcagcacttttgatcgccagtggtgaatggaatgtaggtacgatggtcaatgttgaagagctagatgccagaccttttatcaatctactaaataccatgggtttgacgacacgcattgctgataaagatggcgatcgattgttagcattcggctaa

SEQ ID NO: 1710 - DNA, 1632 bp, M.catarrhalis
aaacgcctgattgacccaaaattgccaattttgcttggctttgctacaatagtatctcaccaaaattatgccaaaattatgccaaaaaacaccactataaagcatgttgaagcactgggcagcacccttgatgaccctgaaatgctattaaataaacatcgtcaaattgccgaaagttttgaagcgaagcttgccaaagaagcagtttttgatgagaattttaataatttggcagatgctcatttgtctttatcggattatttgacagcagtcaaaatggtgattgatgacagttttgatcatgaggtttgggtgcgtgctgaaatccgtgccatgaacactaaaggcggtcattattattttgaattggctgagactgatgatgttgatcaaattaccgcaagctgccgtgcaactttatggcgatttcgtgccaagacagtgatgagtaaatttaccaaaatgacaggtcaaagcctacaagcaggtattttggtcttggtaaaatgctcggcgagttttcatgccaattatggttttagtctaaacattagcgatattgacccaaattatacgctcggtgagatcgctgctgcatatacacagatgaaaaaacggttgagcgaagaaggcctgcttcatttaaataaaaaacacgccataccatttgatattcgccatgtcatcgtaatcgcccctgaaaaggcggcaggtttaggcgactttcgtgccgaagccgatcggctcgccttggcaggtgcttgccaatttcactatcattatgccacttttcaaggcaatcatgcgcccaatgagatacgccttgcaatttctgagggtatgaataattttaaaaatacctatgatactttgccagatttgttggtcattattcgtggtgggggtgcggttggcgatttggcttatttgaatgattttgaattagcggctttggtggcagaatgtccgattcctgtttgggttggtattgggcatgagcgtgactcggtaattcttgatgaggtagcacatagcagttttgataccccatcaaaagctatccttggtatcgagtcgcatttggtcaaaatgacgcgtcaagcggtcgctacaatggagcgtttgactaaaatgaccaatactcatctaacaatggcccaagcaaatagccaaagacaaattgagaaaatccaaagaagcagtttgcacgccgtcaatatggcaaaaaaagacaatttatatcaactaagccacataaaaagtaccgcaaaattccgccatcaccaagaaaaatcggctctaaccgccctacttgctcagacccaaaaatcaagtttggcgattatatcgcaagccaaacataccacaaaaatccaccttgatcagcataatattctatttgattatttatctaaactaaaaaaagactgtcgccatttacaaagtttgattttaattcagcatccaagccgaatgctaaaaaaaggctatacactcattcataatgctcagaccaatgaaagtattcatagcaccaaaacactccaacaaaatcagtcagttaagataacctttaaagatgggacagtcagtgcagtcatcaaagatatcagtacacacaaaaacacttaa

SEQ ID NO: 1711 - DNA, 1680 bp, M.catarrhalis
gagaatatgatggaaatcaaagcccccgatttgggtgttgaatcagctgaagttgctgaaattatggtaaaagttggcgatagcgtcagcgaaaatgacaatatgattttggttgagtctgataaagcctctgttgaagtgccatcaactggtgctggtgttatcaaagaaattcatatctcggtcggtgatcgcatctccgaaggagatttgttgttcactcttgacagtgatcaaagtggtgatgctcaaaaaactgactcaaaatccgacgatgaacctcaaacaaaacaatcagctaaagatgaagatgatatatctatcggtgatgataagcaaacagacgatcagcctgacttaaatgaatcagctggtagtcaaacgcatcatttaccagaccttggcgtagatagtgccgaagttgctgatattatggtggcagttggtgatgaaattaccaaggatcaaccattgattttggttgagtctgacaaagcctcggttgaagtacctgcaccagttgatggcgtgatcgaagaaatcttaatcaaagcaggcgatagtgtctcaaatggtcaagcgtttattacgattaagagcaagggcatttcagccaaaaaatcatcaaataaagagcaaccagccgaaaaaaccaaagaagaagataccaaagctaaccaagcggcagtatctgaatcaaaaaacaagtctgtacaaagcccacaaaccaaactgccagaagctgtcgtaaacgaaaaagctcgacatgtttacgcaggcccagcggtgcgtaaacttgcgcgtgagcttggtgtggacatcagtgctgtgacaggtacagcagctcacgggcgaatcttaaaagaagacttatttggctatgtcaaatcagtcatcagcggttctaccagtcaagcaaaatctggcacgaccgaggtgcgttctggtttgccaagcttaccagatatgagcaataaagagatttggggcgagcttgaaatccaagatctcactcgtctacaaaaagtctctattccgcagctaaactacaatacctatctaccacaggtgacgcagtttgatcttgctgatatcacagataccgaaagcttgcgtaatgagcttaagggtgagtttaaggcagagggcattggtctgactattttggcatttattgttaaggcggtggcatatgcacttacccaaacgccgaaatttaatagccatttatcggatgataatacacaaattattatccgcaaatcggtaaatatgggtattgcagtagcaaccgatgatggtttgattgtacctgtgatcaagaatgctcaagataaaggtatcaagcagattgccattgagattggtgaacttgccaaaaaagcgcgtgataaaaaactgaccgccaaagacctacaaggtgcaagctttaccatctcaagtcaaggcaatcttggcggcacagcctttacgccacttgtaaattggccacaggtcggtattttgggcgtatctgaagcatcgtatcagccaagatggaatggcaaagaatttgagccacgactcatgttgccattatcactgtcttatgaccaccgtgtgattaatggtgcagatgctgcggtctttactcgccatattgcaaaattgttggcagatccgcgtcgtattttgttatga

SEQ ID NO: 1712 - DNA, 834 bp, M.catarrhalis
gatatcatgattacatacacgacagaacgcttagacaatttacccatcttatttcagccattaaacttacaaagcttaagcaatgctgatcgtcagagcattgccgctattgatgctgctttaccgcaaactcaatgcggcttatgcggtcatcatgatggctgcctgccttatgcttatggcattgtcatgcacggtgaagcaattaatttatgtgtaccaggcggtcaatccgtaaccgataccattgcaaatatactaaacaagcctaccaagcctgctaccccaagccaatggcaaatcgatccactaaccaaccgacccaaagaagtacgggccatcatccaagaagcggactgtattggttgcaccaagtgcatacccgcctgccctgttgatgccatcgtcggtaccgccaaacatatgcacagcatcattaccgatctgtgtactggctgtgagctatgcttagccccctgccctgtagattgtattgatgtcataccgcacttgcgtcaattaagtgatgctgacagaatcacagaacaaaatcatctgcgtcgccgttatcatcagcatcttgaccgagttgccatgaccatcgaacaaggcacaaagccggttgtgagtaccattgaatctgccatggtgaatgtacttaaccaacgccaaaatactgaaattgatgaaatccatgccaaaaatgcaattgctgcggccaagctgcgtacccaaattaaaaaacttaataaacaattaacactcaaagctgatgcagacctacaaaataagcttgacaagctaaatgctaagcttagtgaactacagccctga

SEQ ID NO: 1713 - DNA, 315 bp, M.catarrhalis
ttttggtggatattgagttcacttgagccaatgatagcaccacttaataccgatcctacccaaaaagacccgatggatattaataataacttaaaatttaaccagtcattgctaagcattgaaaccacaaataaactgacattgcctgtcacatgtgatgctgaaatatgggtgatacccattaaggcagttgtatttaaaatacctgcacaaaatgccaaaaccacagcacccattaatacccaagttggaatgacctcccccatgattttcattaatcatcacctgttgtctaaatcagcccttaccgtatga

SEQ ID NO: 1714 - DNA, 1134 bp, M.catarrhalis
cgaatttgcgtaaagtatgcactatctgtttatttagtttggtttggatttattatgataacattgcttaaaaaaacaacactgctggcaacagcatttggtatcttttttggcttaactgcttgctcaaacaataccaaaacttccatccaaaatactgacacgacagccagtagtacagaagctaatcaagatccaattgagcttttgaatgtttcttacgatgtgtctcgagatttttataaagcgtataatgaagtttttataaatcattatttgaccaactacccaaataccaaaattaagatcaagcagtctcatggtggctcaagtaagcaagcactttcggtaaaaaatggactgcaagcggatattgttaccatgaatcaaggctctgatattgagctattggctgatgccaaattggtggatggcaattggcgacacgcattcccaaaccatgccattcctttcaccagtactatcgtatttttggtacgagaaggcaaccccaaaggcattaaagattggaatgacttggcaacaagtggcatagatattatcatcgccaacccaaaaacctctggtaacggtcgctatgcgtttttgggtgcttatggctatggcttgaatgcttatcataatgacgaagctcaaactcatgcgttcgtcaaagcacttttaagccatgttaaagtatttgaaaatggtgggcgtgcggcaacaacaacctttgcccagcgtggcatcggtgatgtcttaatcacctttgaaaatgaagccaatgtgattaagagtaaatttggcaatgtggatattatttacccaagctacacagtgaatgcagaaaatccgattgctgtggtgaaatctgttaccgacaacaaaggcacaaccaaagctgcaaccgaatacctcaatcatctgtacagcgatgaagctcaagagcttgccacgaagtttttcttaagaccaagcagccccgatatcctagccaaacacgccgataaattccctgtcatgacaaccttttttcctaatgatgtctttggagactgggcaagtatcatgaaaacttattttagtgatggcggcttatacgataagcttgccgtccaagctcaaaatcagtaa

SEQ ID NO: 1715 - DNA, 414 bp, M.catarrhalis
  unsure (234),(256),(270),(271),(273),(370),(372),(375),(377),(403),(407),(413): Identity of nucleotide sequences at the above locations are unknown.
aatatgctattattatggcctgtttttttgatgaatgaaatggcaatgaaacaaaacaaccttgcacccagtgattacatccaagatgctattgacgcaatccgtaccgaacagcgtgctttggagttgttgattgatgagcttgatgagcgttttgtcaatgcatgtcaaacgattttaaactgttctggacacgtggtcgtaacaggcatgggcaaatctggacatatcctngcggggcggctcgcacttttgnatgtgttccggttnngnacgaccgttatgcaccctggagaggcagggcacggtgatttgggaatcgtcgcgtacaaggcgatgtactcattgccatctcaaattcgggcgaatnanatnanacgcgcgtgcgatttcggcggcggtnaaanacgctna

SEQ ID NO: 1716 - DNA, 237 bp, M.catarrhalis
aaaaggttttttggggataaaaaggtttataccggccaaaggtttaatattggggcgggtgtttgggaccttgaaaggggggttatttttattcgggggttaaaaaaggtttccaagggtaagggttgttcccttttaaaaaagttccgcaagttggtttttagaaggtcgttaagaaaatttggttccttattctacgggggggcgttggaaattttaagaggtttttgtttctaa

SEQ ID NO: 1717 - DNA, 213 bp, M.catarrhalis
acagactcatacagcgttgttaatctttttacgctgacgacaatagcaagatggaaccacctgatcccttcccgaactcaagaagtgaaacgtcttagcgccgatggtagtgtggttcgcccatgtgagagtaggtcatcgtcagcaccttattttaaacccctctttgcagaagcaaaggggggttttgtttgggggttgaatcagtcttaa

SEQ ID NO: 1718 - DNA, 1008 bp, M.catarrhalis
tataaacaaggatttttattcatgaaacaacctgtacgagttgctgtcactggtgctgctggtcaaattggctacagcttactattccgtatcgcatcaggtgaaatgctgggtaaggatcagcctatcattttacaattacttgaaattcctgttgaaaaagcacaacaagcactacaaggcgttatcatggaacttgatgactgtgcttttccattattagttgatgtcattggtaccgatgatcctaaagtagcatttaaagatgctgattatgcactattggttggtgctcgcccacgcggtcctggcatggagcgtgctgacctgcttcaagaaaatgcaaaaatctttactgttcaaggcaaggcgcttaatgaagttgcaagtcgtgatgttaaagtattagtcgttggtaacccagcaaataccaatgcttatatcgccatgaaatcagcacccgatttaccagccaaaaatttcaccgccatgctgcgtcttgaccataaccgtgcgttaacgcaagttgccaaaaaaacaggcaaagctgtcaaagacatcaaaaaattaatcgtttggggcaaccacagtccaaccatgtacgctgattatcgctttgctaccattaatggcgaatcagtcaaagagatgatcaatgatcaagactggaatgctaatacattcctgccaaccgttggtaagcgtggtgcagcgattatcgaagcgcgtggcttatcatcagctgcttctgctgccaatgcagccatcgatcatatgcgtgattgggcattaggctcaaatggtgaatgggtaactatgggtattccatctgatggctcgtatggcattcctaaaggtatcatgttcggcttccctgtgactaccgaaaatggtgaatatcaaatcgtccaagatttgcaaattgatgacttcagccaagagcgtatcaatatcacactaaacgaacttgaagaagagcgtgccgctattgatcatttattttcttaa

SEQ ID NO: 1719 - DNA, 258 bp, M.catarrhalis
aaggagatagtcatgttaggtgatatagaatataccatgaacgagctgtttgctcaattaggtcttgaaagtagcgatgaagccgttgaaaagttcattgcagaaaatcaacttgatgaagaaactaatctaaaaaatgccccattttggaatgactcacaaagagcatttatccaagaagagtggaaaaatgatgctgtatgggcaatggtattagatgaactaaataccagattacacgaagaacatcaatcctaa

SEQ ID NO: 1720 - DNA, 1200 bp, M.catarrhalis
gtcagcggtacaagatctttggacgccattggtgaagcgattaataaaaatggcaaagtgattgttacagggtgtttgggtaaagacgccgaaaaaattcgcaccatgcaccctgccgttttggcggttacaggtgctcatgcttatgaagaggtcatttctgcggtcaatcatcatgtaccaaaaccgatcaaatcaaaagaatacgacccaaaaattgatttgattaatgatgcaggcatcaaacttacgcccaaacactatgcctatgtaaaaatttctgaagggtgtaatcatcgctgcactttttgtattatcccatcgctgcgtggcgatttggtcagtcgtccaatagacagcgtcatgaaagaagcggttgcacttaaaaaatcaggcgtcaaagaacttttggtcatctctcaagatacctcagcttatggcgtggatttaaaatataaaactgtattttgggaaggttggccgcttaagtctaaattttatgatatgtgtgaggcgatgtcaaaattaggcatttgggtacgattgcactatgtttatccttacccacatgtggatgcagtcgttcaaattatggcggacagcatgacagcttctgctggcatgggaggtttattgccctatttggacattccatttcagcatgccagtcccaatgtactaaaagccatgaagcgtccagcgatgagcgaaaatactttagagcgtattcaagcatggcgtgccatttgccctgatatcgtcatacgctcaacttttgtggtaggctttcctggtgaaaccgacgaagcttttgagtatctgcttgactggctgaccaaggctcgcttggatcgtgttggctgctttacttattcagagattgaaggtgcggtggcaaacgatttacccaatcctgtgcctgaatcagtcaaacaatctcgttatgaacgcttgatggcattacaacaaaaaatcagtgccgaaaaacttgccgaaaaagtcggtaagacattggttgttttggttgatgagattgatacagaagaaaatattgccatttgccgaagctatgctgatgcacccgaaattgatggtcatgtctatgtggacaatattgatgcaacagtcaaagcaggtgatatgctgacagtcgtgattgatgaagcaagtgactatgatttgtttgcaagctttggttag

SEQ ID NO: 1721 - DNA, 423 bp, M.catarrhalis
tttttaccagctattttaattcgccagtatcattcgagccaaacaactatgtcaagcccaatcgtatttcatccaaaaacagttcacccaaaaaccaaccaccaaaatacaccactgcccagcgaacctgcctaccatcacaaggcaaaccataaccaaaaccgcagtatcgaccaaagcggtgcggtggcgacatccacatcaaatggcactccaaaaattggctttgtatcacttggctgccccaaggcattggtggacagtgaacgcatcatcacagagctgacttatgagggttatcaagttgccaatgattatgatggtgcagatttggtcgtggtgaatacctgcggatttattgagtcagcggtacaagatctttggacgccattggtgaagcgattaataaaaatggcaaagtga

SEQ ID NO: 1722 - DNA, 729 bp, M.catarrhalis
ttatattcgtattttaaaaaacaaacaaccaaagtttttttggcagaaaatgttagcggtatgcttgctaatagacattcagacgctgttaaaagtattttaaacatgtttgatgattgtgggtatgatgtgactgttaatatggtgaatgccaaaaactatggtgttgctcaagaaagaaagcgtgttttttatattgggtttcgtaaagatttagccattaactttaacttcccaattggttcaactgcagaagacgataacaaaattacgctcaaagatgttatttgggatttacaacaaacagctgttgcagcgttagataaaaatcaaaccaatcccaaagccattaataacaatgaatatttcattggcagtttttcacccatttatatgagccgaaatcatgtcaaggcatggcacaaacaaggttttactgtacaagcatcagatcgtcagtgccaactgcatccacaagcgcctaaaatgcaaaaatacagtaccaacgattttcgttttattgttggcaaagagcatctatacagaaggatgaccgtccgagaagtggcaagaatacaaggctttccagatgactttaaattcatttatcaaaatgtcaatgacggttataaaatgattggtaatgccgtaccggtgaatttggcttatgaaattgccatcgccatccatgattgcctacaaaaccatcaagccaccaaccacctataa

SEQ ID NO: 1723 - DNA, 462 bp, M.catarrhalis
ttgcctacaaaaccatcaagccaccaaccacctataaaattaaataaagtgataaattttatgaaccaaacgaagcttactaaggtgcgtgctgataaatggctatgggcagcacgattttttcgcaccagaagccttgccaaagaagccatcgaagcaggcaaggtacatatgaacggtgctaaaatcaaagtcagcaaagagctacaagtcggcgatacactcaccattcgccaagggcatgcgacacgccttgaagaaaaaacaatcatcatcaaagccctatctgaaaatcggggtaatgctacccttgcagcgacattgtatgaagaaactgatgcaagcaaaactcagcgtgcttttatggctgaacaaagaaaactgcttaatttggcgcgtccagacagccggcctgataaaaagcagcgtcgagaattaaataaatttaaacaccattggtag

SEQ ID NO: 1724 - DNA, 225 bp, M.catarrhalis
tgcgttcactgtccaccaatgccttggggcagccaagtgatacaaagccaatttttggagtgccatttgatgtggatgtcgccaccgcaccgctttggtcgatactgcggttttggttatggtttgccttgtgatggtaggcaggttcgctgggcagtggtgtattttggtggttggtttttgggtgaactgtttttggatgaaatacgattgggcttgacatag

SEQ ID NO: 1725 - DNA, 759 bp, M.catarrhalis
aggtgcattatggcaggtcatagtaaatgggcaaatatcaaacatcgcaaagccaagcaggatgctgcaaagggtaaaatttttaccaaaattatccgtgaaatcgtttcagccgccaaatcaggtgatccagaccctgccaataaccctcgcctgcgtgccgttctagaaaaagcaaacgccgccaacatgaccaaagatgtcatcaagcgtgcgattgagcgtggtgctgggggtggtgataatgacaatatggaagagattacctatgaaggttatggtattggtggcgtagcggtcattgttgaaaccatgactgataatgtcaatcgtactgtcggcgaggtgcgtcacgcctttagtaaaaatggcggcaatctgggtacttcaggttcggttgcgtatttatttagtaagcgtggcgaaatcatctttcatgatttaagcctagaagatagcatcatggagattgccttagaagctggtgcagaggatatcgaaaacgatggcgaaagccttttggttatcacctcgcctgcagattttggtactgttgttgatgcactgattgctgctggattgacgccaaatagcatggaggttaccatgtcgcccagtacgacagcggacattgataatattgatgatgctcaaaaagttcttaaaatgattgacatgcttgaggatttggacgatgttcaagaggtttataccaatgtcaattttagcgaagcggtcatggcaagccttgatgcttaa

SEQ ID NO: 1726 - DNA, 258 bp, M.catarrhalis
tgtatgaatattatcagtttatttagtggttgtggcggtcttgatttgggatttaaaaaagcaggatttaacattgctgttgctaacgaatatgataaaagtatttgggcaacctttaaagccaaccatcataataccaagttgattgaaggcgatattcgccatatcttagaagaggattttccaaacgatattgatggcattattggtggaccgccttgtcacgtggtcagaagcgggtgctttgcgtggtattaa

SEQ ID NO: 1727 - DNA, 216 bp, M.catarrhalis
aagaggattttccaaacgatattgatggcattattggtggaccgccttgtcacgtggtcagaagcgggtgctttgcgtggtattaacgacgctcgtggtcagttattttatgattatattcgtattttaaaaaacaaacaaccaaagtttttttggcagaaaatgttagcggtatgcttgctaatagacattcagacgctgttaaaagtattttaa

SEQ ID NO: 1728 - DNA, 1557 bp, M.catarrhalis
aataaaggaatactcatgcttaccccctatgtccgtaccatcttacaagccactgtttatgatgttgccattcataccccccttgaacctgccaccaaactttccaaaaaatttgataaccacattcgtctaaaacgagaagatttacagcctgtttttagttttaagttacgaggtgcttataataaaatcagccaattatccgacgctcaaaaacaaaaaggcatcatttgtgcatcagcaggtaaccatgcccaaggtgtggcatattctgccaaccgtttgggtattaataatttaattatcatgccaaccacgacgcctgatatcaaagttcaggcagtcaaatcctttggtggtacggtgtatttgcatggtgatagcttcgatgaagccaaccgctttgcgatgcataaagctgaaactgacggcatgacttatatcgcaccttatgatgatgaactggtaattgcaggacaaggaacaattgggcttgagctgacacagcagtggcgtaatattgattatgtatttattgcttgtggtggtggcggtctgttggcgggcgtagcagcttttttaggagaagttgcaccacatattaaggtggttgctgttgagcctgaaggtgcagcttgcctaaaagccgccctagcatccaataagcgtgtccgcctaccgcaggtatctttatttgctgatggcgtagcagttgcccaaattggcgagctgccttatcaaattgccaaattatcaaaatctgatggctcaggtactgtgattgagcctgaaatcgtcacttgtactaacgatgaaatctgcgctgccatcaaagatatttttgaagaaaatcgctccattgttgagacggcaggtgctttatcagtagcaggtatgaaaaaatttatccaaacgcacaacctaagtggcaaaaactgcgttgccatcatctcgggtgcaaacatgaactttgaccgcttgcgttatattgctgagcgaaccgaaatcggtgaacaaaaagaagcaatttttgcggtacaattgcctgaaaaaactggtgcatttttggatttttgtcgtgtactacaaggacgaaatatcactgaatttaattatcgtatggacgccactaaccccaatactgcccatgtttttgttggtatcggactaaaagaaggtcaaaaagaacgcatcttaattagcgatactttggtaaaaaatggctatacagcttatgacttaaccgatgatgaggcggccaaaacacacattcgttacttaattgggggccatgccaatctagcagatgagcaattatttagagttatttttcctgaacggcccggtgcactactcaattttttagaaaaattgggccaagatttcaatattaccctatttcattatcgaaatcatggtgctgccgaaggacgaattttggtaggattgcaggccagtcatagtaatagccgtcaaattctagacgcacttactgatattggctacgaatgtcaaggtttaacagaagatgtgggttatcagctgtttttgaagtaa

SEQ ID NO: 1729 - DNA, 384 bp, M.catarrhalis
acaccattggtagctactatgaccataccacgatcgattctttttgtttgtttgggtaatatctgccgaagtccatccgctgaagctgtcatgcgtgccaaactgaccaattttttgcctgatgtttatttggattcagcaggtacagcgggctatcacattggcaatccacccgatccacgcgccatcgccactggtgagtcacttggttttgagttaagtcggcttcgtgcacgccaagtttctttggaagatttttatgaatttgagctcatttttgcgatggatgacaccaatttatcagacttacaaactcttaaaactactgccatgatgcatgctaatggtcgagatatggcaaagcccagaacacctgatccataa

SEQ ID NO: 1730 - DNA, 234 bp, M.catarrhalis
ttgaccccatggaccaccgctgatccttccagccccgtggtgaagacccaaagagcatgggcgcatgatgttcaggtcatgattgaagggcctgggcatgtacccatgcatatgattaaacaaaacatggatttgcaattggatgtgtgtaaagaagcgccattttatacgctgggacctctaacaactgatatcgcacctggctatgaccacatcacatcaccagtgcgatag

SEQ ID NO: 1731 - DNA, 471 bp, M.catarrhalis
ccacatcacatcaccagtgcgataggggcggcgatgattggttggtatggtacagcaatgctgtgctatgttacgccaaaagagcatttgggtctgcctaataaaaaagatgttaaagatggtatcattacctacaaaattgccgcccacgctgctgatttggcaaaaggacaccctggcgcccaagtgcgtgacaatgccctatctaaggctcgctttgagtttcgctgggaggatcagtttaacttatcgcttgatccagatacggctcgctctatgcatgatgaaaccatgcctaaagaagcccataaatcggcacatttttgttctatgtgtggccctaaattttgctccatgaagattacccaaaatgtccgtgactatgccaagggattggatgtggaaagaggactacaacaaatgaaagaaaaatatgaagaagaaggcagtaagctgtatcacgaactatga

SEQ ID NO: 1732 - DNA, 222 bp, M.catarrhalis
cttatgtcggtcttttcatattttgaaaaacgtttacagggttttcctgatattagcccgcccacccatacccattcggtggcgttatttatttatgcctgggctttgggatatcaggggtgggggatagttgattacagcatccacagccaagggcgggtgttcattggtcatatgggtctgcgaggattggggcaaatgggtgactggggtagtgcgtaa

SEQ ID NO: 1733 - DNA, 759 bp, M.catarrhalis
atgaacataaaaactttcagcttagctgtgatctgtgggctaacgaccaccgcatacgcccaaagcttaccgattgatcatgatgccagcctaagacttggcgtcaatgcgacttataatgcgaccgcttatcatgccaaagatcctgtttttatcatgccccaagctttttatgataataatcgttggtatatcgaaggtgctgaagcgggtttttacccttataaggataacaagcaccatgtgcgtatcggcttaacttatgatggtcagagctttgaccccaatcatgccaatgccatagaacttaagcagcttaataagcgtcaatggtcagcactcgcccatgcaagctatctttatatcaccccttacggtggtctaaaagcaaaagctgccaccgatgtgcttgatcggcatgatggtcagactgtcactttatcgcacctaagccgctttaataaagatgcttggacggtatatccagaatttggtgcaacttggcacagtaaagattacaatcagtactactatggcattttagatgccgaggccttaaaaaccaatcataccgcatatcaagccgattctggttggtcgccctttgtgacagcgacagtcaattatcaagttacaccaaaagtcagtgcatttgttaatcagcgtatcgaatggctatcaaatgcccaaaaaaatagcccgatgactgacaataaaattgacagtaaaactcggctgggtctaaattatcatttttaa

SEQ ID NO: 1734 - DNA, 837 bp, M.catarrhalis
tttttattcgatgtcggctttgggcggtttgttgaacaaaataagcaaataaaccgagtggttaatcaatcacaatttataccaattctcattatagattatattttatatttaaaatcaaaaagttatatctatcctaaaaatcatctgcctagttttatgcagatgattttttgttttacttgtaaatgcttatcagattgcaaagcgttcgcggttcaatatccctacaaagctaagatagacgatttgaaattttatgataagatagtggccaatatagttaccaatcgctatttaaaacagtgttatcaatttggtatattactaaggagttttatcatgaaatcatctcaaaaagtcattgattatcttaactttttattaggtggtgagcttggtgctcgtgatcaatacttcattcatgcacaaatgtatgcggagtggagttttggtaaattatatgatcgtatttatcacgaaatgcaagatgagacaggacatgcacagttattaattcagcgtatcttgatgttgggcggaaagccaaatatgcaagtgggcgaaattcagattggctctgatgtgccaagtatgctaaaaagtgatcttgagctagagtatcgtgttcaagaacatttaaaagagggtatcgcattgtgtgagacagagcgagattatgtgacacgagatattttgtgcgttcagcttgaagatactgagcaagatcacgcccattggcttgaaaaacagttgcgtttgattgatttgatgggtctacaaaactacctacaaagtgtgactgctgaagttgatcagcagggcaatgctcactaa

SEQ ID NO: 1735 - DNA, 489 bp, M.catarrhalis
ttgggagtgattatgaaaggtaataaagaagttatccgtgcgttaaatttggtattgggtcagtcactcattgcgatcaatcagtattttttacatgcacgcatcaccaaaaattggggcgtccatgagcttaatgaagtattttataagcaatccattcaagagatgaaatggtctgatgagcttatcgaacgaattttactgttagaaggtttaccaaacctacaagatcttggcaagcttttgattggcgaagatgttgctgagattttggtatgtgatttaaagcttgaaaagcgtaaacatgatatattggtagaagcgattggtatttgtgaggatcatcgtgactatgtatcacgagagattttggtgaagctaaaagatgaaaatgaagagtacgaagattggctgaccacgcaacaagaactgatcgaagatatgggtattcaaaactatatccaattaaaagctcaagataatgattaa

SEQ ID NO: 1736 - DNA, 1422 bp, M.catarrhalis
ttttttacccaaaattttgagaagagcatgaatccacatcacgcatttttacaagcattatcaaatactctgcccactttaagcatcaaaactgataccgaatctacccagcattgggggcgtgattggacagtgcattttgatactcattgccaagcagtcatttttccaaaaacaactgaagaagtgtctgtgattgtcaaattggccaatgagcatcaaacccccttagtgccaagtggtggtcgcactggtctatccgctgcagcggtggcgacaaaaggcgaggtggtgataagttttgataaaatgaaccaaattggtcagttttatgaagcggaccgtatggttgaggttgacgctggtgtcatcactcaatcattacaagaatttgccaaaaatcaaggtttgtattatgccgtcgattttgcttcatcaggttctagccaaattggtggcaatatcagcaccaatgctggtggtattaaggttatccgttatggtatgacacgagatcaaatcttaggtctcaccgttgttacaggcaaaggggatattttaactttaaatggcggtatgctaaaaaatgccacaggctatgattttcgccatttattcatcggtgcagaaggaacacttggttttattaccaaggcgttaatcaaacttgaaaaacagccaatcaatctaaccgccatggtgcttggcgtgacagagtttaacagtgtggtgactttactggctcaatttggtcaagcattgactttaacagcatttgaattttttgaccaactggctgttgataaagtcatcgccgcaggtcataccaaagcaccctttgagagccaagcacccttttatgtactactagaatttgaggccatcaatgatgatgtgctggatttggcgatgggcgtgtttgagcaatgtgccgaagaggggctaattgttgatggtgtgatgagccaaagtattgggcaacttcaagaactttggaaattgcgtgaaagcatctctgagaccatctcggcattcaccccttataaaaacgatatttcggtattaatcagccatttggcagactttatcagcgatattgaacacatcgtcacagccaattatcccgactttgaaatctgttggtttggccatattggcgatggcaatttacatttaaatattctaaaacctgccaatttgaccaaagatgaattttttgaaaaatgccaaacggtcaatacttatgtgtttgataccgtgcaaaaatatcaaggttctatctcggctgaacatggcgttggcatgaccaaaaagccatatctaacctacacacgcacccagactgagattgattatatgaaagccatcaaagcggtatttgaccccaatggcatcatcaaccctgggaagatttttgattaa

SEQ ID NO: 1737 - DNA, 1479 bp, M.catarrhalis
tacaaccctaaaagtagaaaaatttgctataatataaataattttgaccataaaaaaagagcattcattatgacctccccaatcgcccaaaaatctgaactgctttgtcctgctggcacatttaagaacatgcaatatgcttttgcttatggggcagatgcggtgtatgcagggcaagcccgttactctttgcgggtgcgtaacaacgactttgatgaagaaaatttggcaaaaggcattgcctacgcccattcgcttggcaaaaagttttatgtggtggtgaacattcaagcacacaacgccaaattaaaaacctttattgaagacattcgccctgtcattgaaatgaaacctgacgcgcttatcatgtccgatgctggcatgattatgatggtgcgagaagctttccccaatcaagtcattcacctgtcagtacaagccaatgccgtgaactgggcaacggtgaagttttggcagcagatgggcattagccgtgtgattttaagccgtgaattatcactcaaagaaattgagcaaatcatcaaagaagtgcctgacatggaggttgaagtttttgtgcatggggcgctgtgcatggcatattctgggcggtgcttgctctctggctatatcaacaaacgagacgccaaccaaggcacttgcaccaatgcctgtcgctggaattacaacacttataaagcggtggagaatgaaacaggcgatatcgtccctgccaacccagaagtgttcgtccccagtcaaggcgagattagcaatgtcaacctaaatggcgatgccgtcatggacgatgattatgtagaaaaaccgtccgatgaggttgtactcattgaagaacaaggtcgcaagggtgagctgatggcgatgtatgaagacgaacatggcacttatatcatgaattcaaaagacttgcgtgcggtggagctggtgcctgatttggtcaatatgggcgtgcattcgttgaagatcgaagggcgtaccaagtcgcattattatgtggcacgcaccgctcaggtctatcgccgtgccattgatgatgctttggcaggcaagccatttgataccagtctcatcactgtgcttgatgggcttgccaaccgtggttataccgaaggatttttacgccgtcatgtgcattctgattatcaaaattatgactacggctcatctaagaccgacaatcagcagtttgtcgctgaagtggcggacatcagcgatgagcgtttgactttgactgtcaaaaacaagctgatggtgggcgataccattgaaatcatgactccgcaggggaatgttagctacacgctaactgagatgtgggataaaaaaggcgaggcgattgatggtgcgttaggctctggttgggtgtgtcaaattgccaatccctttaaggatatggataaagacgtgctaaaatttgccctagtgatgaaaagcgtgagtgaggcgatttatagctaa

SEQ ID NO: 1738 - DNA, 614 bp, M.catarrhalis
ctaagcggtgattgttatatgcagttaaaatttatggatttttgttctggcataggtgcagggcgtctgggtctagaaaatgcaggcatgtgctgtgttgctcatagtgaaattgatttgaattctgacctaacctatcaattattttttaatgattactcaaatttgggggatttaacccaactaaattcagatgacttacctgattttgatgtgatgcttgctgggtttccttgtcaaactttttccattgttggaaaaagagcagggcttgatgataaccgtgggcaaattatttattatctgacagatattttaaagcaaaaaaaagtctctttttttatcttagagaatgtcaaagggttaattaatcacaataaaggtgaaacactgaactttatcttatcattattgttagaagctggctatgatgtgtatcatcaagtattagacagccaatattatggcgtaccacaaatgcgccaacgggtttattttgtcggcatcagaaaagatattaagcacatgccttttaaatttccacaaccaattttatcaaaaccgattgatgactttttaatgtatcgacacgccggggatggaagatatacgtc

SEQ ID NO: 1739 - DNA, 678 bp, M.catarrhalis
aattaccttatgtcaaccaatactcatatcttaaaagaatattttgacccaatcaagattcgtgagcatcaacttggtcatactgtgaccgtgggggtgagctaccactttaccagccttgaaaaacaagggctatctgccttacttgccaaactgcccttagtagatgaggcgcctgtggcgatggatattgatttatcttgctttgtttatgataaggcatttaatatcttggagacgatttggtatggtaatttgcgtaatgccaatgaatctattcgccatcatggcgatgccttggtaggtgctaaaagctttgacgatagtctaattcagcaagaacaaattcaaatcaaattggataaattactcaaagaggcacatcatttggtttttgtgctgagtagttatcacaatcaaccgctacaaaaagccaaaaaaggcatgctatactttggtgataaagaaacgcctaaggcatttagtatcagctttgaccaaatcgaaccagactgccaatcattggcggcttggcaattatcttgttatcgtggagattgggagttaagtgcaccgatggtcgacatcaaacttaccaagctttctgataaatcacttgatacgctcacaaatgcagtaacaacccacattcaatctgcacaatctaaacggtggtaa

SEQ ID NO: 1740 - DNA, 1533 bp, M.catarrhalis
ggattgattatgaaaatctctacaactgcacgtatcttgacgctctcagcgctggcgattggcatggcagcttgtagtagcattccaaagaaaattgacacatcggcaccgattttggcggtgcctaatgtgcctatgaaggatggctatcaagtctatgatgctgacaccatcagtgtggcgcaggcaccaagcgtggcatcactacgctggcaggaattttatacagatcctaaacttgcagctttgattgagcttgctttacaaaataacaaagacttgcaatctgcggtcttagccgtgcaatcagcccgtgctcaatatcaaattaccgaagctggcagcgtgccacaagtcggctcaaataccagtgtgacacgccaagcgaataaccgtatcgatgccaatgcttcaaccaattatcatgttgggcttgcgatgagtggttatgagctggatttatggggcaaagttgccagtcaaaaacagcaagcactacatcaatatttggcaaccaacgccgccaaagacgccgttcagatttcaatcatctcaagcgtcgcccaaggttacgttaacttagctcacgctttggctcaaaggcagttggctgagcagacgctaaaaacccgtgaacatgcgatgatgattacccaaaagcgttttgaagcggggattgattctaagtcgccaagtctacaagcagcaagttcgcttgagtcagcacgattggcagtatatgcagcagataccagtatcttaaaagccaaaaatgcgttacagctgctgattggtcgtcctgtaccaaacgagctactaccagcgatagatgccagtatgcatatgggtcatattaccacacagacattgtttagtgcaggtttgcccagcgagcttttatattatcgcccagatattatgcaggctgagcatcgcctaaaagcagcaggtgcaaatatcaatgtggcacgcgctgcttattttccgtcgattcgtttatcatctaatgtgggatttagtagtaacagtttgaataacttatttgaatcaagtgctttgggctggtcttttgggcctgcgattagcttgcctatctttgatgcaggcagtcgccgtgccaatcatgagatggcgcaaagtgctcagcagtcggcattggtggaatatgaaaaagccattccaaatgcctgtaaagaagtgtcggatgttttagctgagcgtgcaactttaggcttgcgtcttgatgcccagattcgccttcaggaggattaccgtcagacttatgatagcgcttatgcaagatttcgttctggattggataattatctgacggtactggacgccgagcggtctttatttattaatcagcaaaatatactacagcttgagcttgccaagttagtcagccaaatccagctataccaagcattgggcggcggtgcaagcttaactgctgagcaaatcacagaatttaatcgtcagcgtgaagccatgcgtccagccatgctgatggatgacgaaaaatcccaatag

SEQ ID NO: 1741 - DNA, 663 bp, M.catarrhalis
acctattatctcacgcttatgatgacaaataaacgcatcagccttgccccaatgattgattataccaccatggattttcgggcatttgcaggcttttttaacccaaatatccatctttatactgaaatgattagcaccagtgccatcttaaaaggtgatgccaagcatcatcttcggtgtcatccgaccgagtcgcctgttgtgttgcagttgggtggctcaaatccagacgagatggctaaagcggttcgtgtaaccgaagcacttggttttggatattgtgaatataatatcaatgtcggttgcccctcagatagggtgcagcacaataaaatcggtgcatgtttaatggcagaaccgcaagtcgtggctgatatggtgcgtgccatgaaaaatgaaaccgacaaaccgattaccgttaagcatcgcattggtattgatgactgtgatagctatgaatttatgcgtgattttgtgcagacggtggcagaggcaggttgcacgcattttattacccatgctcgcattgcttggcttcaaggattatcacccaaacaaaaccgagaaattccgccattaagatatgaagaggtttatcggctgaaacaagatttccccgatttgaccatcgtcttcaacacggggctggaaggagccgctcca

SEQ ID NO: 1742 - DNA, 1512 bp, M.catarrhalis
  unsure (1501),(1502): Identity of nucleotide sequences at the above locations are unknown.
aatatgctcgcttttttgataggagctgtcatgacaatcacgcctgtttataccacattcacccccaccaaaacacccataaaattttttatggctggcttgacttttctaatcgctcatatcagccatgccgatgatggtcgcaccgacaatcaagagccaatcaatcaagaaatagccacccttgaacccatcattaaccatgctcagcctgagttattgtcccatgatgcattaacaccaaaaatagaaccaatactggcacaaacaccaaattctgccgaagatacgctcatcgccgatgaggcgttactgcttgataaccctgatttgctcaatcacgccctaaattctgctgtcatgaccaaccatatggcaggcgttcacgcattattgcccatttatcaaaaactgcccaaagaccatcaaaatggcattttacttgggtatgccaatgccttggctgctttggataagggcaacgccaaaaaagccattgatgagctgcgtcgcatcatcgccatcatgcctgaatataatgtggtgcgttttcatctggcaagggcattatttatggacaaacaaaatgaagccgcccttgaccagtttaataaattacatgctgacaacttgccagaggaggtgcggcaggttgttgggcagtacagacaagcgttaaaacaacgagattcatggacatggcaagtaggcatgaatctggccaaagaagataacatcaatcaaacccccaaaaacaccacgcaaggtcaatggacttttgacaaacccattgacgccatcaccctaagctatcaattgggggcggataaaaagtggtctttgcccaaaggggcatatgtgggagcgaacacccaaatctatggcaaacatcatcaaaatcacaaaaaatacaacgaccattggggcagactgggggcaaatttgggctttgctgatgccaaaaaagaccttagcattgagacctatggtgaaaaaagattttatgggcatgagcgttataccgacaccatcggcatacgcatgtcggttgattatagaatcaacccaaaatttcaaagcctaaacgccatagacatatcacgcctaaccaaccatcggacgcctagggctgacagtaataacactttatacagcacctcattgatttattacccaaatgccacacgctattatcttttgggggcagacttttatgatgaaaaagtgccacaagacccatctgacagctatgagcgtcgtggcatacgcacagcgtgggggcaagaatgggcgggtggtctttcaagccgtgcccaaatcagcatcaacaaacgccattaccaaggggcaaacctaaccagcggtggacaaattcgccatgataaacagatgcaagcgtctttatcgctttggcacagagacattcacaaatggggcatcacgccacggctgaccatcagcacaagtcttcaccacggggctggaaggagccgcgccatannggagctctat

SEQ ID NO: 1743 - DNA, 327 bp, M.catarrhalis
gaaactactatgaaaaatttaaccaataaactgttggctggtgtgctaagtgctgctgttttgttgcctgccgttggtatctctaccaccgcagttgctaacgaccgtattaaagcacaagcttatggcgacagcaactttgcccaaaatcgtcaaaaagccattcaaatgcttgctgctcgtggctatcaagtcggcgatatagaagttgatgactttttaggcaagcctgtctttgaagtagaagcctataaaaacggtgctgagtatgacatcgttcttgaatacccatcacttaaaatcatcaaagagcagcgtgattactaa

SEQ ID NO: 1744 - DNA, 2700 bp, M.catarrhalis
agacttaacatcacgcacgtggcactggcaaacacaacggccgataaggcggtggcaacagataatacataccttgttgttgtcttggatgaaactgttgtaacagcgaagaaaaacgcccgtaaagccaacgaagttacagggcttggtaaggtggtcaaaactgtcgagaccatcaataaagaacaagtgctaaacattcgagacttaacacgctatgaccctggcattgctgtggttgagcaaggtcgtggggcaagctcaggctattctattcgtggtatggataaaaatcgtgtggcggtattggttgatggcatcaatcaagcccagcactatgccctacaaggccctgtggcaggcaaaaattatgccgcaggtggggcaatcaacgaaatagaatacgaaaatgtccgctccgttgagattagtaaaggtgcaaattcaagtgaatacggctctggggcattatctggctctgtggcatttgttaccaaaaccgccgatgacatcatcaaagatggtaaagattggggcgtgcagaccaaaaccgcctatgccagtaaaaataacgcatgggttaattctgtggcagcagcaggcaaggcaggttcttttagcggtcttatcatctacaccgaccgccgtggtcaagaatacaaggcacatgatgatgcctatcagggtagccaaagttttgatagagcggtggcaaccactgacccaaataaccgaacatttttaatagcaaatgaatgtgccaatggtaattatgaggcgtgtgctgctggcggtcaaaccaaacttcaagccaagccaaccaatgtgcgtgataaggtcaatgtcaaagattatacaggtcctaaccgccttatcccaaacccactcacccaagacagcaaatccttactgcttcgcccaggttatcagctaaacgataagcactatgtcggtggtgtgtatgaaatcaccaaacaaaactacgccatgcaagataaaaccgtgcctgcttatctgacggttcatgacattgaaaaatcaaggctcagcaaccatgcccaagccaatggctattatcaaggcaataatcttggtgaacgcattcgtgataccattgggccagattcaggttatggcatcaactatgctcatggcgtattttatgacgaaaaacaccaaaaagaccgcctagggcttgaatatgtttatgacagcaaaggtgaaaataaatggtttgatgatgtgcgtgtgtcttatgataagcaagacattacgctacgcagccagctgaccaacacgcactgttcaacctatccgcacattgacaaaaattgtacgcctgatgtcaataaacctttttcggtaaaagaggtggataacaatgcctacaaagaacagcacaatttaatcaaagccgtctttaacaaaaaaatggcgttgggcagtacgcatcatcacatcaacctgcaagttggctatgataaattcaattcaagcctgagccgtgaagattatcgtttggcaacccatcaatcctatcaaaaacttgattacaccccaccaagtaaccctttgccagataagtttaagcccattttaggctcagacaatcaagtcatttgccttgatactcaaggtcatgaccatccacaggcttgtaacgccaaaaacagcacttatcaaaattttgccatcaaaaaaggcatagagaaatacaaccaagaaaacaataccaagattaattatcaagccatcattgaccaatatgataaacaaaaccccaacagcaccctaaaaccctttgagaaaatcaaacaaagtttggggcaagaaaaatacgacaagatagacagactgggctttgatgcttatgtagagctacgcaaagaatgggcggattggaccaataaaaatagccaacaaaatgccaataaaggcacggataatatctatcagccaaatcaagcgactgtggtcaaagatgataactgcaaatatagcgagaccaacagctatgctgattgctcaaccactcgccacatcagcggtgataattatttcatcgctttaaaagacaacatgaccatcaataaatatgttgatttggggttgggtgctcgctatgacagaatcaaacacaaatctgatgtgcctttggtagacaacagtgccagcaaccagctgtcttggaattttggcgtggtcgtcaagcccaccaactggctggacatcgcttatagaagctcgcaaggctttcgcatgccaagtttttctgaaatgtatggcgaacgctttggcgtaaccgtcggtgcaggcacgcaacatggctgtaggggtctttattacatttgtcagcagactgtccatcaaaccaagctaaaacctgaaaaatcctttaaccaagaaatcggagcgactttacataaccacttaggcagtcttgaggttagttattttaaaaatcgctataccgatttgattgttggtaaaagtgaagagattagaaccctaacccaaggtgataatgcaggcaaacagtatggtaaaggtgatttgggctttcataatggacaagatgctgatttgacaggcattaacattcttggcagacttgacctaaacgctgtcaatagtcgcattccctatggattatactcaacactggcttataacaaaattgatgttaaaggaaaaacctaa

SEQ ID NO: 1745 - DNA, 522 bp, M.catarrhalis
acgctgtcaatagtcgcattccctatggattatactcaacactggcttataacaaaattgatgttaaaggaaaaacctaaaacccaactttggcaggaaacaaacatactgtttgatgccattcaaccatctcgtaatgtggtggggcttggctatgatgccccaagccaaaaatggggaaccaacgccatatttacccattctgatgccaaaaatccaagcgagcttttggcagataagaccttaggtaatggcaacattcaaacaaaacaagccaccaaagcaaaatccacgccgtggcaaacacttgatttgtcaggttatgtaaacataaaagataattttaccttgcgtgctggcgtgtacaatgtatttaatacctattacaccacttgggaggctttacgccaaacagcagaaggggcggtcaatcagcatacaggactgagccaagataagcattatggtcgctatgccgctcctggacgcaattaccaattggcacttgaaatgaagttttaa

SEQ ID NO: 1746 - DNA, 198 bp, M.catarrhalis
ttcagccatagttgggtcatttacattaaagcgcatcacctaagatcctttggtattaaactaaagatcaacactcaccgtcacctgtttggaaccggtataagttttccaacatttacctcatcccccggtcaatgtgcgcatatcgagacaccgatatcaaccatttaccccatcattggcctaggacacccctga

SEQ ID NO: 1747 - DNA, 189 bp, M.catarrhalis
ggcgatgatggtataggatatgtagatgtagcaagctatgtgagccgcagcatgtattctgtagcatatgtagagtacgctgacgactatgttcatggtatgtctcatgtagcagttaatgcaggtgctggcgaatgtgtacaagcatcaggtgtcagcttagttgtagcaggtgcaatagattggtga

SEQ ID NO: 1748 - DNA, 903 bp, M.catarrhalis
caaaatcaggggaattcccaaatgaccacccaaaattcagcactcgccgccagactcagtcgccaaaagcgacttgacggcgcttttgtttggacaaccaaactgtctgcactgcttgtacttttaactttaggcggtatcatgctgtcactagtctttggtgcaataccgagtattcgcgaatttggtttaaatttttataccagcagtaactgggatccagtcgctagtcagttcggtgcgttggcaccaatttatggcacaatcgttacctccattatcgcggtcgtgattgccgtgccagtcagttttggtattgctgtctttttgacagaactttgcccaaacttcctaaaaaagccattgggtatcgccattgagctgctggctggtattccatcgattatctatggtatgtggggtttgtttgtctttgccccttggttcggtgataccgtgcagccatggctaatcaatcatttggcaggactgccgatcatcggtcagatgtttgttggtgcgcctattggtatcggtcttttcacagcaggtttggtacttgccattatgatcattccattcatcgctgcgaccatgcgcgatgtgtttttggtggtgcctgatttgctaaaagagtcagcgtatggcatgggtgcgactacttgggaagttgttaccaaagttgtgctgccttataccaaagcgggtgtggtcggtggtctgattttgggcttgggtcgtgcgcttggtgagaccatggcggtgacttttttgattggtaacacctttaatatcaatacaagcctatttacttctggggtatcgatcacctcagccttggctaacgaatttcctgaaggtcttcaccacgaggcgcccagatccgggcattgtaggaggcga

SEQ ID NO: 1749 - DNA, 183 bp, M.catarrhalis
gcagcacctgtctttaatcaagtgttaatcatcgcagacactgcaggagattgtcctatgccagctgctgctgtcatcatagtactcgaatgcgcagacaatcatgatcaagtagcaggtgtagttagattctatgtctgggcaaacgccaatggtgatcagtcatcgctagatggtacatag

SEQ ID NO: 1750 - DNA, 1434 bp, M.catarrhalis
tatcaagccatgacaatgacaaatttttctgcaataaccatttcttgctttaaggcgtatgatgtccgaggtgagctgggtgtgacgcttgatgagcatatcagctatcgcattgctcgtgcctttgcccaaatcctaaaatctcaaaacaccgccgagcatcctaccatcgtcatcggctcagatattagaccatcaagccatagcctgaaacttgccgccatccaaggcataacagacgctggcgtggatgtgattgaccttggtatgacaggcaccgaagaggtgtattttgcgaccagtcactataacaccatcggtgggattgaggtaactgcaagccacaatcccatcaattataatggcttaaaaatggtgcgtgaaaactcacgccccatcagtgccgatactggattggccgaggtgcgtgcattggctgaaagtggtaattttattcaaagtaaaaaaggcagcatcacccaaaacaccgacaaaaccgcttatattgataaactgatgagctttattgacacgagcaaatttctccccaaaaaaatcgtcatcaacagtggcaatggctcggcaggtcctgtcattgatacccttgaagtacgcttagcaggttcaccgattgagctgcttaaaatacatcatcagcctgatggtaactttcccaacggtatcccaaaccccatgatcatcgccaatcaagccgctacccgtgatgccgtcatcgcacacaaagcggtctttggtgtggcatttgatggggattttgaccgttgttttttgtttgatgaaaacggacgatttattgatggcagttatgtggttggtatgctggcagcgtcatttttacaaaaatatcccaagcagaccatcgtttatgatccacgcgtcatttataacactcaaaatgtcatcaaaaagatgcaaggtacgcccgctcttagtaaatctgggcattcattcatcaagcaagtcatgcgtgaaacaaaagccatctatggcggtgaaatgtcggcacaccattattttaaagactttttttattgtgatagtggcatgattccttggctgctattaattgagctgttgtcagtcacaggcaagtccttggcagagcttgttgatgattacattcaagatttcccaagttcaggtgagcgtaattttaggctggataaaactaatgctgccaccatcagccaaggtctggaacaaaaatacgcccaccttaatccccaaaaaaataccttagatggactgagcttggattttggtaattggcggtttaatttgcgttcaagcaataccgaaccgctcatccgcctaaatgtcgaggcatgtggtgatgccacactgttaactcaaaaaaccaaagaaatcatcgactatctccaaaaacaaggagcaatcgccaccgaccattga

SEQ ID NO: 1751 - DNA, 885 bp, M.catarrhalis
cttttatacataataacaaggaaagctatggaatttaccgtcattattttggcactggttgctttggtagtattcaccatttataaaggcgtaaaaatggtgtcgcaaggcgaaaaatggatcattcagcgtttgggtaaatatcaccaaacacttgagccgggtctgaattttattattccttatgtggatgctgtcgcctataaagtaaccaccaaagacatcgtacttgatatcccaagccaagaggtcattacgcgtgataatgtggtcatcatcgccaatgcagtggcatatattaatattgtgcagcctgagcatgcagtctatggcatcgaaaattatgaacatggcattcgtaatttggtacaaacatccttacgctctatcatcggtgagatggatttggatgccgccttatccagtcgtgaccaaattaaagcacagctaaaacacgccatcagtgatgacatttctgattggggaattaccctaaaaactgtggaaatccaagacatcaagccatcagcgaccatgcaattggcgatggaggaacaagcggctgctgagcgtcaacgccgtgccaccgtcacccgtgccgatggtcaaaaacaagccgccatcttagaagcagatggccgcctagaagcctctcgccgtgatgctgaggctcaagtcgtcttggcgcgtggttctgaagaatcgattcgtctgatttctcaggcaatggatggtaaagatatgcctgtggtgtatcttttgggcgagcaatacatcaaagcgatgaacgagatggcaaagtcaaataatgccaaaatggtggtactgcctgccgatattttaaatacggtcaagggtttggtgggtgataaatttaaagtctaa

SEQ ID NO: 1752 - DNA, 1242 bp, M.catarrhalis
agtcaaagctcaagccttattcgccttatctgtgctacaatagacaaaaacttcagccaaaatcagactatgactgcccttcatttccatctgccaaccttgagtgaaaaattcactattgccatgatcggattttttgcatttttgcaagtgtattcagttcaggcgattttacctgtactgatgatagatcttaaggcaactgaagttcaagcaggaatggcggtaggtgcgaccgtgcttgccattgcactgatatcgccatttatgggtatgctgtctgatgctgttggtagaaagccattcatcgtaagctcattacttatgctcgctctgccaacagcactgattggcatggcaagtagtatccatgaagtgattttttggcggtttttgcaaggggtaagcgtgcctggcattacggtagttttgattgcttatatcagtgaagaatacagctcaagactgacaactatgatgtcactttatgtatcagggacggtacttggtggttttagtgggcggttttttgcagggcatttggagcattttattggttggcgttatggctatatagtgatggcaatatgcacattaatcggtgcgatttgggcatataaatccctcccccgttcacaaaattttaccacccctgagaattttcgtactgcatttgccacattattctcacacaccaaaaatcttcatgtcatctgtagtggatttttgggagcgtgcgttttgtttagtttggtgggctgttttacattcatcaatcttcatttatcagaaagcccgtatctactcacgcctgccgatcttgccaatatttttgccatttatttgattggtatggtcatcacaccattatccacacgcgtggtgatacgctttggcatgacctcaacgatactgttggctatccttgtttctatcacaggcctattaatgacattgtttatgcctttgggtatagttattatgggactaactttaatgtcctctggtgtgttcatcactcagtctgcaaccatcagctatttgaccagccatgtcagcgagggtcggtctttggcgtcagggctgtattatatgggttattatggcggtggcttcattggtgcttgggcgtgtgccttagcttatgcccaaggcaaatggctttggacagttgggctaatcttggtggttcagctgattgctttgggcgttgtgaccttattcatgcgtaagcacgcttag

SEQ ID NO: 1753 - DNA, 1089 bp, M.catarrhalis
tttatgagcccaacaactttaccactgccttggcagccacccgttttacacgctgattttaaaagtacgcctaatgactttatcgttactgagattttggacatcgaacactcaggcaacggtgaacatctgtggctacatatcaccaagataaatctaaataccacctatgtcgtaaagctgcttgccaattgggcaagtgtgcctatgcgtgatgtcggctactctggactcaaagatcggcatgcaataacgcatcaatggtttagcattcggctacccaccaaggcgataccaaagacttctttggaaaattttgccaaagcatatctgaatgatgacgaatcttttatacttaaccatctgatttggcatagccgcaaactcaaccgaggtacgcacaaatacaatcattttgccattcgcctgcgtcatcttaatggcgatatcaataccatagatgagacacttgagcgtatcaaatctggcggcgtgccgaattattttggtgaacaaaggtttggcatcgatggtaaaaatcttgacaaggctcacagtttttttgaaagccagctgatgagtgatcagccctatcgtccccacaaaaaatttgccgaaaaagatggactgatgatatcagctgccagaagtgctctgtttaacgccatgctaggcaagcgtgtggctgatggcacatggaatcaggcacttttgggtgatgtttttaatttggagggcacaggttcaatttttcaaaatatgccaacggatgatgtgaaaacccgtatcaaacagtgtgacattcatccaactgcaccactcattggcatcggtgatcggcgtgactgcggcagtgttcggatgctttatgatacactgcttaatcatcatcacaaccaaacactctaccaaggattgataaaaatcggtgccaaattggcataccgcccacttcggctgatggtgtatgatctgacttggaatcggtcaggcgatgagttatatcttgaatttagactacctaaaggtgcatttgctaccgttgtgatttctatgattgcccaagagtatcagtcaaaggatagttaa

SEQ ID NO: 1754 - DNA, 513 bp, M.catarrhalis
tttttgggtgctaatcatcggtgtgagtgtcagcacgattttggtgctattgacctcggcaggctcatatacttggctaagaaaacttcaaaaatctcatgctcaaaccaccaaaaaccaaggcagataagtcagatggataaatttgtaacactgtaccagacgctgtctaccagtccatttttactgctgatgcttttgatgggtgtatttgagctgacaatatgggcaagaacacgcttcaaccagccgttgattaacccaactttggtaacaaccattggtggtatcttgattttaaaatttgccaatatcaaatggcaggcgtttgaacaagccagtagctatatcaccttttggcttcagcctgtggttgtgtgtttgggcggtgcctttgtatattcaatggcaaaaaattcctgtgcagtggttgccgattttggtgtctcaatttgtggcaagtcttgttggtatcgtctctggtgtgtggattgtacgggcgttgggtggtag

SEQ ID NO: 1755 - DNA, 1344 bp, M.catarrhalis
ttaaataatcagccaattttgccaaattattctataaaaatgctaaaatattcacttttaatctccaagacaagcaggaaaaatgatatggcacagactcaaaagatggtattgattgttggcggtggtcatgtcggcttatcatttgctttattgttggcacatcatggcattaaaagcacacttgttgagcatcatcgttatccgaccattgagcctgatgaagataacgcacgcacgcagtatttagacagccgtaatacagcactgtcacgccgtactgtgcaaatttatcaagaaattgggctttggacgtatcttcagagtcatgcatgccatattgaccaagttaacatcagtgagcttggcagctttgggcatgccaccttaaataaagatgaagaaggtgtggaaagctttgggcaagtgatggaaaatgcacatttaggcaggcagttgttattggcagtcaaggatagtcccttgatcaacttatatgatggtgcaagtgtgattgatatcgctcaagatgaagctcatgcaagcattacagtaaaatttgatacaggtcaaatcaaaaccttaacagcgccacttgtggtggcttgtgatggacagcattcggcggtgcgtcaacgattgaatatcggtgttgatattcatgactatgagcaggttggtatcgttggtgtggtacaaactgacaaagcacataaacatacggcaattgaacgctttagtgaggctgggcctttggcggtgctgcctttgacagatggtatgggcgatggtggcacagggcagacggcaggttatcgccgctcggtggtgtttatttgtccaaaaggtgaagaaggacggtatttaagcgatgatgagtattaccttcagacactccaaacagtttttggtacggcagcagggcgatttgtggcgacaggtaggcgtggagcatatccactgaccaaagtgctggtacatcgtcaggtgtcaggtcgttttgtcattatgggcaatgctgcccatacgctacaccctgtggcaggtcaaggatttaatttgtgtctaagagatgcgtatacactggcaaatatgctggcaaaagcggttgccaaagaaggcagtcaggtggatttgggacaatatgatcgcttgatccgttatgaaaatgctcgccaaaaagaccaaaaacgcgttatcaaattctgtgatactgtcgttggtagcttttgccaccccaatcctgtgatgagatttgtgcgtaatgtgggcttgatttgttttgataaagtgccaggcattaagcctttggtggcaacttatgccatgggacttaagtcttga

SEQ ID NO: 1756 - DNA, 210 bp, M.catarrhalis
ccaagatgtctcagaagcattggcttatctgatgaacacacgcctaaaaatgaacttttggcactcaagcacaaccaagagcttgccccaaaccacattgataccgaaaatttatccacacttgagcgagatttattaaaagatgcgttacaagttgtgaggcaatttaagcaccatgtcagtagccagtttaatctacactatgcttaa

SEQ ID NO: 1757 - DNA, 222 bp, M.catarrhalis
ctttggtcacactggcaggcggacgataagacggtgattttatttggtaaaccaaatgggggtatggtttgtttagcctgcttacaatttagctatacttttcgatgctttaaggtaagttacatcattgccacattgatggcatcgttcaaagcatcatgtcttggtaggtcaggcatccccaaggatttaatcatgcctgccatggtcaaatcaacatag

SEQ ID NO: 1758 - DNA, 528 bp, M.catarrhalis
tacactgccaatcatcaaaggcaagtgcttgaaaaagcaacagatattatcttttttgatgataatgccgccatcattgaagcacaagatagtattgatactttgtatatcatcatcaaaggtatggtcaaagaaattgatgccagtggcgagatattggcactgtatcacccttcagatagctttgatacacgggcgctgtttggacagtcttatcggcatagttttattgccgttgaacaaagtttattatacgccatgcccaaaaccatcatccgtacactcatcgaagaaaacagcgaatttggtgcttacttttttgccaatattgccgataagctcaaaaatcaatcagatcatcgccgtgaaaatgagctggctggattattcactgccaaagtgcgtgatgcttatcgctcatatgatgagttgtatgatggctcaattggtttgattgccgctaccaaaatcatgcagataaataaatccaaatccttactcatccaccacgatggtaaatcggtctag

SEQ ID NO: 1759 - DNA, 726 bp, M.catarrhalis
tatatgagtgaagcgatcaccgcccctgaagatgatctaacagtcatcacgacccatgcacgcaccaagacagatattagccatatccatgagtttttaggttgtcgcacctcggagcgttggctaaacttggcatgtgaacatctaccactgctactccaagatcatgccaactgtgaaaaaaaggcagcaggcacagcgatgaatttgatttttcgttatgaatttcatcgcactttacaagagcgtttggctcaattggtgcgtgaagagatgctgcactatgagcaagttttatcattaatgaaagagcgtaacattgattggtattatctgcctgcaggtcgctacgccaaggggcttttgaaacacaaacgcacccatgaacctgctgcaatggtagatgtgctgattattggtgcattcattgaagctcgatcgtgtgagcgatttggggcgttgtcagaggttattgatgatgaaaaactggcacgctattataagtatttactcaaatcagaaagccgtcattatgaagactacttaatgttggctcgctccatcacagatgacagtattgatgaacgggtggctttttttcgtgacattgaatgtgagctgatacagtcgcctgatgatgagctacgctttcatagtggcacaccaagcgatactttgatggcaaatggtgtgccaccaatcatctcatcgcccaacaagttgtaa

SEQ ID NO: 1760 - DNA, 606 bp, M.catarrhalis
tctacactatgcttaaggtgcgttatgtttgataaattaatacatcactattatcgccgtcagcttaaagataaacgctatgaatttttgtatgacacgcatcctgatgagttggtcagctttgattgtgagacaaccagtcttgatatctctgaagcccaaatcatctctatcggtgctgtcaaaatccgtggcaatcgcatcttaaccagtgaaacctttgaaattttaatcaagcctgagggcatgatacaagcaaccaatgtcaccatccacgggctaagacccaaggacttaagtggcggtgtcaaggtagattttgccattgagcaatttttgcagtttgtgggtggacgaccgcttgtgggatattttttggaatatgatgtggtgatggtgaataagtttttaaaacccatgctgggtatcaaactgccacagccaaaaaatgaagtgtctcgtctgttttatgcccaagaaaccaaaaccaaatactatgacagctatgttgatttgaccatggcaggcatgattaaatccttggggatgcctgacctaccaagacatgatgctttgaacgatgccatcaatgtggcaatgatgtaa

SEQ ID NO: 1761 - DNA, 579 bp, M.catarrhalis
ataatgtctattaaatcagatcgctggattcgtcaaatggccgaaagttatggcatgattgagccgtttgagcctgagcaggtacgctacaatgcacaaggtcaaaagttggtcagctacggcacctcaagctatggatatgatgtacgctgtgctaatgaatttaaggtatttaccaatgtgcattcagccatcgtagatcccaaaaactttgatgatcgcagttttattgacatcattggtgatgaatgtatcattccaccaaattcatttgctttggcacgcactgttgagtattttcgtatcccaagagatgtactgacgatctgtttgggcaaatccacttatgcacgctgtggaatcattgtcaatgtcacgccacttgagcctgaatgggaggggcatgtaaccttagaatttagcaataccaccaatttgccagcacgcatctatgctggtgagggtgtggcacagatgctatttttccaatcagatgctgatgatgtgtgccaaatttcttataaagatcgtggtggtaaatatcaaggtcaaacaggtgtcaccttaccaaaaacctaa

SEQ ID NO: 1762 - DNA, 468 bp, M.catarrhalis
tgcgttgatattgtccgtgatggcattgatatgcaaatgatgcagccttatgctgagcgtttttctggcattttggcggagtttggatatccaccttgcttaggtaaaattatggtcaataatccatcatggtgccaatcggtcagtgaatttaagcaaactgtaggcagctggtacaaaaaccccacgcctgatcatatgatgaatttggcaatttttatggatgccaaatccgtcagcggtgatgaagcactacttaaagaagtacgcacgcacctaagtggctatttggacagcgatgtggggatgctgatgagttttgcacgggcagttaatcagtttgatgaagatgggcgtggattttttgcacaaattttgggtcacaaaagcacaaaatggatattaaaaaatgggaatattccctgtggtgcatggcactcgtgcattggcactcaaagcaaaaattag

SEQ ID NO: 1763 - DNA, 1482 bp, M.catarrhalis
aaggcactcatcatgtatcattttccaacgcccatctatacagcaaatgcggtcaaagactggcagaatcgttgggttgggctcggtaatcgtagttttgggctgatgcagcaagccgcactgatgatgtccaatacactaaaagctcatctaaagcctgatagctctatctgtatttggtgcggcgttggcaacaatggcggtgatggttatttacttggggtatacttgtcggagtattatcatgtgtccatctaccctgccctgcctgctaagagtgatgatgctgtttgggcttatcaagatgtaattgctgctgatttacctattttacagtcgcctatcgaagcagatatacatattgatgcattatttggcgatggtttgacacacccattggatgatatttggtgtaccatcattgagcagtataatgccataaaaggtaccaaaatcgctattgatataccttcagggctacatcctgatactggtatacctctgccctgtgcaacacaggtggatatgacactgtgcctaatggcttataaagctgggttattcatgggttatgccaaaaactatgttgggtgtattatcaatcatccgttaattcccactgatgtgttacttgagccaattgctatcataaataaccgcttacccagcctacccaacagaaccagacatagcaatcatctacataaaggcggcgcaggttcggtcatggtcattggtggctctgcactcatgggcggtgctgccttgatgagtgctgaagctgccattcaagtcggtgcaggtcgagtcacggtcatgacacatcccaatcaccataccgccatcatcagcaaaagccccaacctgatgcttgggcatatcgataagattgaccaaacacagcttactgagatgactgcaatatgctttggcatggggcttgggcgtgatgactgggctaagagcatttttaaaaagtggctggcaatactaatgacacaccatatgccaatcgtactcgatgccgatgcactatggcatttggcaaatcagccaccatctcgcctgcctgatcactgtatcggtacaccacatcacgccgaagctgggcgacttttgggtatcagtgcaacacaagttgaagccgatcgtatggctgccattattcagctacaaaatcactatggcggacagtggattttaaaaggagcgaattctttgagtattgatactttgggcaatatcagtatctgtaccttgggtaatgctggcatggcaaccgctggtatgggcgatgtattatctggtatgctggcaggtctactcgcccaagatgctaccttaccctttgctcaaattatcgctttgcatgccagaagcggtgatatactaagccaagagagtatcagtgttgatgtcaataagatgggtaatactgccgccaaactgctcaaaaccaatgccataccctctgataattag

SEQ ID NO: 1764 - DNA, 387 bp, M.catarrhalis
ggatatgtcatgatcttaaaggcgataatgattgtatttgggtgcttatttctgggccagctcatcgtaggtttatttgatttattgctgccaccgagcgtcgttggactgattttattatttttggcattgcaggtaggcatagttaagcttgccaccatcgaaaaacttgccaaagtattcatggattatttggtgctacttgtcgtacccgcttgtatttctatcatgcaatatctagacatcattcgagatgatttttgggtgctaatcatcggtgtgagtgtcagcacgattttggtgctattgacctcggcaggctcatatacttggctaagaaaacttcaaaaatctcatgctcaaaccaccaaaaaccaaggcagataa

SEQ ID NO: 1765 - DNA, 552 bp, M.catarrhalis
aatttgccaatatcaaatggcaggcgtttgaacaagccagtagctatatcaccttttggcttcagcctgtggttgtgtgtttgggcggtgcctttgtatattcaatggcaaaaaattcctgtgcagtggttgccgattttggtgtctcaatttgtggcaagtcttgttggtatcgtctctggtgtgtggattgtacgggcgttgggtggtagttatgatagcatgatcgcaacggcagcgaagtctgtgacgatgccgattgccatcgaggttacccaagctttgggtgggattgttggcatcacggcggcaacggtgctgattgcaggcgtggtaggtcagatttttggtgtttggatactttataaatcaggcatgagattgccaatgggcatggggttatcacttggttcggcatctcatgcgcttggtacggtacgctcaatgcagctgggcgggcgttatgtggcttatgcgacattgggtctgattttaaatggcattatgacagcatttttagcaccagtactggtaccttggctggtatcatga

SEQ ID NO: 1766 - DNA, 2070 bp, M.catarrhalis
gtgctgattgtcgccaatcgcttaattgtcaaatataaggcaaccatgagtaagctaaatcctcgccaattagaagcgttaaatcacacccaaggtccgctacttgtactggctggtgctggctcaggaaagacatcggttatcacccaaaagattgcccatttgatcgaaaattgccgcattcctgccgatcgtatcacggcagtgacttttacaaataaagcggcgcgtgagatgaaatcacgcgttcaaaagattttatctcatgaaaaatctcgtggattgactgtttcaacatttcaccagtttggtctgcaatttttacgctatgaattaaaacacacatcattaaaacccaatttttcaattttggatgcagatgactgccagcgtctgcttgcagaactgatggtgcgtgataatttaagcggtgctgaacgccgtgaactggtgcatgaagccatcaagaaaatctctgattggaaaaatgacctcattgcacccaaagatgccgctgaaacgctcgatgaccctgaagatcttggttttgtgcatttgtatgaattatacgagcgtaatttgcgagcgtataatgcggtggattttgatgatttgattgccatgcctgtgcgtatcttaagggaaagtcatgaggtcaaagataaatggcaaaatcgtatccgctatctgctggtggatgaatatcaagataccaacaccgcacagtatgagttaattaaactattggttgggcgtcttggacgatttacagtcgtgggcgatgatgaccagtcaatttatacatggcgaggtgctaaacctgaaaatatggcacttttaaagcaagatttccccaatcttgaggtggtaaaattggaacaaaactatcgctcaaccaatcacatcttgggtgctgccaatgcggtcatcgccaataatgagcatatgtttgaaaaatcgctttggtctgataaaggtgatggtgaaaaaatccgtgttatcacttgtaataatgattttgatgaagctgaacgagtcgccaaagaaattttgacgcatcgactacgcaataaccagacttgggataaatatgcggtgctgtatcgcagcaactttcaggctagggcattggaagctcagctaagacagcttgagattccgtataaattatctggtggtacttcattttttgcgcgtaccgaaatcaaggacttgatgggttatcttcgtattattattaatcctgatgatgatgcggcatttttgcgagtgattaatacacctaagcgtggtatcggttctgtgacacttgaaaaacttggactgtttgcacagcactgcggcacatcgctgcttggtgcgtgtactcgtgcaggtgttaaggacgcattgggtgctaaggcaggtgcgatcattgaatcttttggggagtttattaattattatacgcatcagctacatgataatagcgatcctatgcccttggtgcgtcagatgattactgagacaggttatattgactatgtcaaagaaagctccaaaaatccccaacaagaaaaggggcgcttagataacattgaagccttatacttaagtatcgctgcactgattaatcgagctgatgatgagcatgataagaccattgatgctgtgattcgcaagatggttttgttggatatgcttgaacagcaacaagaagaagaaaataccaacaaagttaatctgatgacgctacatgccgccaaaggtcttgaatttgattatgtctacatcattggctgtgaagaaaaactgttaccgcatgtcaattcaatcatgagtgctaatatcgaagaagagcgtcgcttaatgtatgttggtatcaccagagccaaaagtgagctgactttattgctatgtaaacagcgacgatctggagcggattttaaggcggtgacaccctcaagatttcttgatgagttgccagcagagtatctatctggtgctgttaccaaaaaagaagatcctaaaaaagtcgctgaaaactatctggcaaatattcaagcgatgcttgctgctaagaaaaaataa

SEQ ID NO: 1767 - DNA, 555 bp, M.catarrhalis
atcggtctagtaaccgagtcggcatttcgtgatgccttcattcactcatcaggcacgcttaaccccaatgatgccacacatctgtgggcacattttgatttggtttgtgccgatgccgatgattttatgttcagtgctttattaaaaatgatgaatcatcgcattcagagggtggtcgttaccgccaatggtgatcccattggtgtacttgaacaaattgatattttggcatttttgtccaatcacagtcatttgattgccgaaaaattggaagttgcaaccaatttggatgctctcacccaagtggcatcacagatgaaccacaccatctcagcactctacgccaatggcatgcaagccaaacaattagcccagctcatgcaggtacttaatagccgtctgtttgaaaaagcatggcaaatgattgcacctgccaatcttgtcgccaatacttgtttggtcgtgatgggttctgaaggtcggggcgaacaagttttaaaaaccgatcaagataatgcgttgatattgtccgtgatggcattgatatgcaaatga

SEQ ID NO: 1768 - DNA, 309 bp, M.catarrhalis
ggtaaaaaggttgttatgagtgatatttattttgagcgtcagcatggtttggattttgaaagtgccagaacgaaagcacaagcatggctacaagaggccgaaaatcagtttgggctaaatatcaactatatcaaaggtaacaaccaagacaatgcaagcattcataaagcaggtgtcgatgctcaagcaactttgactgctgataaaatcacctttcaagctaaacttggactgtttgccaaacctctaaaaggtgtgatcagttcaggtatcaaagaaggcttagataactatttcccccaaagctga

SEQ ID NO: 1769 - DNA, 462 bp, M.catarrhalis
acggtatggcaaaatgagaattttaattgtttggataatcgtatgaaagcacaacaaggatttactctcatagagctaatgattgtcatattaatcatcggcgttttggcgatgtttgccatacctcaataccaaaaacgcgtcgttaccgcccaagtaaatcgtgtcatgatggaaaccagccaactgcgtacggctgttgagatgtgcttgcttcaaggtctcaacgctgaaaattgtaaagcagatacaataaatagtgacttgatgcaaggcaacaagccaactgttactttaccaaatgaaagcaatactgaaagcaccattaaaactgtttttggcggtaatgccgccagtgccctacataataaacaattaacctggaagcattcatctgaaaaaggttggaaatgtgaaaccgatgtagatgatgattttagaccaaaaggctgtagcaaataa

SEQ ID NO: 1770 - DNA, 2652 bp, M.catarrhalis
tttaaaagaggatatgctatgtcgcaaatgctaaccgaatacagagcccatgtcgctgagcgtgaagccttaggcgtgccaccacaaccattaactgatgtccaaactgccgatttgattgaactcctaaaaaaccctccacaaggcgaagaagagtacttgatagacttgcttgaaaaccgtgtgccagcaggggttgaccaagccgcttatgtcaaagccgcctttttaaatgccatcgtcaaaggcgagaccagctccccactcatcaataaagagcgtgcggtatatctattaggtaccatgttaggcggctataatgttgcacctttggttgaactgcttgatgatgatgaactgggtgagatggctgccaaagcactcaaaaaaacccttttggtctttgatgcttttcatgatatagaagaaaaagccaaagcgggcaatgccaatgccaaagccgtgctagaatcttgggcagaaggcgagtggtttacaagtcgtcccaaagtgccagaagagatgaccatcaccgtatttaaagtcactggcgagaccaacacagatgacctatcacctgcccaagatgcgtggagtcgccctgacattccgctacacgccaacgccatgctaaaaaatgagcgtgagggcattcatccagaaaaaaatggtgaggttggtcctttgacccaaatccaagagctgcttgacagaggtcatcctgttgcctatgtgggcgatgttgttggtacaggttctagccgtaaatcagcaaccaactctgtattgtggttctttggtgaagagattccccacattccaaacaaaaaagatggcggtgtgtgtttgggcggtaaaattgcccccattttctttaataccatggaagatgctggggcgttgcctgttgagattgatgtaaccgagatgaacatgggtgatgagattaccctaaaaattgaccacgcaaatgcaactgttgccgcctttaaagatggcacacaaattgccaaatctaaactaaaaacccctgtactgctagatgaggtgcgtgctggtggtcgcattaaccttatcatcggtcgcaacttaacaagcaaggctcgtgaatccttgggtcttgaaccatccactctatttcgcaccccagagcaacctgccgatactggcaaaggctttaccttagcccaaaaaatggtgggtcgtgcctgtggtctaccagaggggcaaggcattcgtccagatacctactgtgaaccgaagatgacaaccgtaggctcacaagacaccacaggcccgatgacccgtgatgagctcaaagatttggcatgtctgggcttctcatctgaccttgtcatgcagtcgttttgtcataccgccgcttatccaaagccgattgatgtggtaacacatcacaccctacctgattttatcatgaaccgtggcggtgtcagcttacgcccaggcgatggggtgattcattcatggctaaaccgcatgttgttgcctgacaccgttggtaccggtggcgacagtcatactcgttttcctattggcatctcatttccagcaggttcaggtcttgtagcgttcgctgctgccactggtgtgatgccacttgacatgccagagtctgtacttgtcaaattcaaaggcaaaatgcaacctggcattactttgcgtgatttggttcatgccattccttactatgccatccaagcgggtgatttgacggttgagaaaaagggcaagaaaaatatcttttctggtcgcatcttagagattgatttgactgagatggaaaacgacttgaccgttgaacaagcgtttgagttatccgacgcttctgctgaacgctctgccgcaggctgtgccatcacggtatcagaagaaaaagtggcagaatacttacgctctaacatcgtcatgctaaaatggatgattgccgaaggttatggcgatgctcgtacactggctcgccgtgctgaaaatatgcaaaaatggcttgacaacccaagcctactaaaagcagatgctgatgctgagtacgccaaagtatatgagattgaccttgctgacatcaaagagccaatcctatgctgtccaaatgaccctgatgatgccaaactgctctcagaggttgcaggcgataagattgatgaggtattcatcggttcgtgcatgaccaacattgggcattttcgtgccgcaggtaagctgttgcaagaagtaccagcgggcagcctaaccactcgcttgtggattgcaccacccactaaaatggatgaacgccaactgatggatgagggttattacaacacttatgcccaggcaggagcaagaaccgaaatgcctggctgttcactgtgcatgggcaaccaagcacgcatcgcacccaactgtaccgccgtttcaacatccacccgtaatttcccaaatcgcttaggtcaaggggcaaatgtctatctggcatctgctgaacttgcctctgtggcatctgtactgggcagactgccaactgttgaagagtatatggggtatgcaggtaaactagaatccatggaggcggaagtttataactacctaaactttgaccaaatgggtgaatatactggcagagctgatagaattgatgttgcacagctgaactaa

SEQ ID NO: 1771 - DNA, 2112 bp, M.catarrhalis
ggtttgttgaccgctcaaaatgtcatgacggatgagcttgctgaacgggtgaataccgcctcacccaagtttgagcttgaagagatttatcagccttatggtccacgcagtcgctctgtggctgcacgcgcaaaattggcaggacttgaaccaattgcacatgctgttttggcaggtcaaagcccagcagaagcacttgagggctatgtatcacctgagacgctgaccgatgataaaggcgaaactttcgaggctgattttggtgattttgataaacaaatcgtcggcattcaggcgattattttggatgaatgggcgacagcattggacttattggacaaggtacgcactggatttaatgccacggcaagcattcgctctgaattaatcggtgaagaaaagcgtgaagtgggcgaaaaattcaaagactattttgagcataccgaaccatttgccaagctatcaaatcaccgcctgcttgctatgttgcgtgggcgtcaacaaaatgtattggtgttacatgttgatggtgaagatgaaccatttattgagatgatcatgcgtcattttgagattgacccaaaagctgctaatggtgaatttttgaccgagaccgccaaaaaactttggctggttaagtggcgttcacagattgagcaccgcctcttaaccgagcgtcgcttggcagcagaggcggatgccatcgctgtttttgcagagaatctcaagcatctacttatggttgctccaacgggtcgtaaggcgattttgggggtggatccgggctatagtcatggcgtcaagatggcggtgattgatggcatgggtgaggtgttggcaactgatacggtctatccttttaagccgcaccataaactggccgaagccaaagatcgcattgagacgctgattaagacgcatcaggttgaattggtcgctattggtaatggtactgccagccgagaaagtgaagagctggtgaaatcaatcattcgtgaagcttctttatctactcaggcattggtggtctcagaggcgggtgcatcggtttattcagccagcgaaatcgcctcccaagagttgcctgatttggatgtgtcggtgcgtggtgctgtgtcgattgcacgccgcttacaagatccgttatcagaattggtcaaggttgagccaaaagcgatcggcgtcggtcagtatcagcacgatgtcaatcaaactgagcttgaaagcagtttagacaaggtaaccgaagactgtgtcaatgcggtgggagtggatgtcaataccgcaagccctgcaattttagctcatatctcagggcttaataaaaatgttgcccaacaaattgttgagtatcgtcgtgcacatggtgcttttactaaccgtgaagcactaaaaaatgtaccacgcttgggcgtcaaaacttttgagcaagcggcagggtttttgcgtatcaaagagggtgatgaaccactggacgctactggtgtccaccctgaaagctacggattggtatatgaaattttaactcagcatggtaaatcactagatgaggtgttgggcaatgagagcttgaccaaagcgcttaatgacagttcggataattttagccaattggcaacagttttaaatgagcttgccaaacctgcacatgaccctcgtggagagtttcgtactgccaagtttcgtgatgatgttaatgaaatcaaagacttaaaagtaggtatgacccttgagggtgtcgtgaccaatgtgaccgcttttggctgttttgtcgatgttggcgtgcatcaagatggcttagtgcatatctcagagctatcagatggttttgtgaccaaccctgctgatgttgttaagcctcaagatattgttacagttcgggttatttcggtggatgaagtgcgtgggcgtattggctttagtatgaaatctgaaaaatctgccaaagctaatcagtcagccaaggcggataaagcagacaaatcggcaaatcataagcccaaagcagatcgcaaacctgctcgccaagacaaaccaaaatctaccgccaaacctgccaaaacgatgggcagctttggtgcgctgttacagcaggcaggattgggtaaataa

SEQ ID NO: 1772 - DNA, 678 bp, M.catarrhalis
agacccatcgcttttgctactgccttgagtgcttgtagtcagcccaccgctggcactgagcaaacaactgcactaagcacacaaaatgcacaagagacgcagcacgcagcacacgcccatcacgataccagcatgccgatggctgcacacaccagcgagtacatgcagtcgatgaacaccatgcacgatgcgatgatggcagctgccaccaaagctcatgccgatgtcgctttcgttgaagggatgatcccgcatcaccaaggggcgatacagatggcacagatcgagctaaaatacggcaaagatgccgccatgcgtaagcttgcccaagacatcatcgatacacaacaaaccgagattgaatttatgcaaaattggctgaccaccgcccaagataaagatgccatcgatgccaatagcgagcacgccaaagcctatcttagcgacatgagtatacatgatgcgatgatgacaggggtacatcacgaagatgctgacatcgcctttgcccaagggatgattccgcatcaccaaggggcgatacagatggcacagatcgagctaaaatacggcaaagatgccgccatgcgtaagcttgcccaagacatcatcgacgcccaaaacccagagattgcactgatgaaacagtggctcggcagtcgtggtatcagccaataa

SEQ ID NO: 1773 - DNA, 795 bp, M.catarrhalis
attaccctctctttagccatgaaaaaactctatgatgaaaaaaaagttgtttatcttcagagcttgagctgccaccctatttttgcaacaaccaataagaaactttcaatttcggcagcaacgattcactactaccccaaaggcagtttgatttatttgcaatatgctaaagtgcgttatttatattttttattagaaggtgcaatccattgctatcgtcagcagcccaatggtcaagaaagcctaataaacagatttgatacaaataaaactcatatccatcaggtacagatgatcaatgaaagcctgcctaatttaaaagtagataagtgtgatgaaaaacaagatgagatgcttgcgtataatcaatataactcgtttggaaaaaatagctgccatcagttaaccgccaaagcttcacaaaatagctatgttgccattttacccattcatgaaataaagaaaacattcaacaactcgtctttagctacgatatttacttggtatgcagagcaaatgtatgagcaaatctcgacacagtttttattgtatgatttattaagcctgaaaactgcacaagcgaaagtagcttattatctattatgccatgctgacaataacagcaaaatagagatatccatgagtcaaaaaaatcttgcaagcctactaagtatccgtgctgaaacactcagccgaactttgcgatctttgataaatcagcaaattattagcgtaaatggtgtacaatacactattttaaaatccgaacacctagaacagatagtggaacaatga

SEQ ID NO: 1774 - DNA, 246 bp, M.catarrhalis
tttaaaatctcaaaattaaaatttgcttcttgttccaaaatcttagacttaagtgccttgaccgtgggtgattttgagataacaccgcaatactcaggcattgacttggcaatgtttgcagtgccaattttttctgccatttttatgatatcttctttatcactggtaattaaagggcgtaaaatcaatgtagatgatgctgcatcaatcgcattaagattggttaatgtttggcttgccacctga

SEQ ID NO: 1775 - DNA, 720 bp, M.catarrhalis
tcatttttatcaaggtttggtataatcatgaacctaacactgtcgcctgatgagatggcagtcatcaaactgtcctatcaaatcgcaagcgtgagccttttggtcaacctattgccagcgattgccatgggttggctgttggctcgcaaagatttttttggcaagtctttgtttgaaacccttgtgtttttgcccttagttctgccccctgttgtgccaggctatattttgctggtcttatttggcaatcaagggatcatcggacaatatttatcacagttgggctttgatttggcatttaattggaaaggggcggtattggcatcagcggtcatgggctttcccttgatggtgcaatcggtacgccttgccattgaattggtggataaacaccttgaactgaccgccatgtcattgggggcaagccgtttacaggcattttttcagataaccttgccactggcgggtgctgggattgtgattggggcgattttatcgttttgtcgcagtttgggcgaatttggggcaaccatcacctttgtgggcaacatatcgggggagactcgcaccttgccattggcgatttatagcctactacaacaacctgacagcgacgcccaaatcatgcgattgttgatgttgtcggttggggtggcgttttcggcattatggttgtcgcagtggtatgcccgttatcaaaaaagaaggcttgcacaatga

SEQ ID NO: 1776 - DNA, 429 bp, M.catarrhalis
atctcccagtcagtttttgcttcccacgcagggtcagtggcagcggtgaatgggtggataaatgggtgcatgtctgatgtgttgatgtcttctttttcgtaccatgtggcggtgggcagtacaatgtcagaatacaaacatgtgctggacattctaaagtctaaggtggttaccaaatcaattttacccgttggggcattttcaacaaagtcaatttcgttgggtttaaagccagtttgtaccgtttcatcacccaataagccattttttgtccctaacaagtatttgagcatgtactcatgccctttacctgatgaacccagtaagtttgaccgccagataaacatattgcgtgggaaattttgcggattgtcgggttgttcggcagcaaaacgcaatgacccattgtgcagactttcaaccacataa

SEQ ID NO: 1777 - DNA, 780 bp, M.catarrhalis
cagcgacgcccaaatcatgcgattgttgatgttgtcggttggggtggcgttttcggcattatggttgtcgcagtggtatgcccgttatcaaaaaagaaggcttgcacaatgacacaaaccgcacaaacacaaaccgcacaaacatcaaaagataaccctttgatatttgattgtcaatttcagctagtgcttggcaggctggatttatccgttgatttacaatcatcacagcctgtcatggggctatttgggatttcaggctctggcaaaaccagcattttacacaccatcgcagggctaaatgccccaaaaaatggcagtatccgtatcaatgggcaaacctggtttgatggcgaaaaaaaaatcaacatacccattcagcagcgacgagtgggcttggtgtttcaagatgcccaaattttcccccataaatcggtgatgaataatttgctatttggctatcacaacattgatgatgaccaaagacgctttcaccctgatgaaatcattgagctgttaaaattggggcatctgacccagcgtatgcccaccaaactatcaggcggtgaaaaacagcgagtgacacttgggcgggcgttgctttattcaccaaatttgttacttttagatgaaccattatccgccctagacagcattcacaaacaagagattttgccattttttgagcagattatccgcaccactcacattcccatgctgtatgtcagccatgacaaatcagaaatccagcaactgaccgatgagatttattacttataa

SEQ ID NO: 1778 - DNA, 801 bp, M.catarrhalis
atgacatctgccacagacatgaaactgcttaaagtcatcagcttgctcatggattaccctgaacacgagctgtttatcgatgataacttagaccaatgcaaacagcttgtcatgcaaagccgtcttatcagccctgaggtgcgacaagacatcgccaccttaattgaccagatggctgcactcggtgagctagaagcacaagccaaatatgacagcctatttgagcgaggtcgttccttatctttatggctatttgaacatgttcatggtgaaagtcgagaccgtgggcaagccatggtggatttaatggctcaatatgacatggctggatttgagattaacgcaaaagaattgcctgactatctaccgatgtatttggaatttttatcccaccaagccaccatcaaccatgatgagatgcagattcgtgaagaaattgccaatattagccacattgttaccttattggcggctcgcttaatggataaaaacagccactatgttggtctatttaaagcattgttgcaaatcgcaggtgaaccactgagtgtcattgaccaacagcttgccaaaatgcacaaagacaaccaacctgctgatgacaccaccgaagcgattgacaaagcatgggaagaagaaatggtggattttttaggagcagaacaacaaaactgcccatcaaaccaaaccaaacagcgtatcgcaaacctacaaggtgaacacgttcaacgccaagccgaagttcctgtgcattgggttgacttcaaccaatccgccaaagccaccacacaaggagtctga

SEQ ID NO: 1779 - DNA, 672 bp, M.catarrhalis
ctgatttatgctaaaaccaaatcaactctgggggtgtgcatgcatgtaacattaagtgatttgttaaataacaaccaatattgggcgcagtcactgacagcgcgtgatcctgactattttccaagactctcaaaggcgcagtcacccaaatatttatggatcggctgctctgacagtcgtgtgcccgccaatgaagtggtaggcgtcatgccaggagagctttttgtgcaccgcaatgtcgcaaatatggtagtttcaactgatatgaatttgttatcggtgttacagtttgcggtagatgtacttagggttgagcatattatcgtatgtggtcactatggttgcggcggcgttaaagcggcgcttagtcagcaagaatatggtctgatagataactggcttagaccgttgaaaggaatgcgttaccaatatcgtgaggcttttgagggtttaactgataaagaggagcttgatttattatgccaaatcaatgttaagcgtcaggtcactaatgtttgccatactaccatagtgcaaaatgcttggtatcaaggcagacaactttcggtacatggctggatttatgacatgaatagtgggctgattgaggacttgggcgtgagtattagtaacgcacaacagctggcatcggcatttatctattcgcattaa

SEQ ID NO: 1780 - DNA, 2034 bp, M.catarrhalis
gaacctgattacaatcaatcattttttactcaaacagcagatcttggctttttgggggtatgtatgttaaataaccgacttagtggctttttgccaaaatcgctttcagtgcgtgcttggctggcagttggcgttattgtattttttgcgacagtcacagccagcacttcagcagtcttagcctgggtatcaaaatctgatgctcaagcactcaactctgtcggatcaattcggatggcaacttatcgcattaattatttattaacaaccaataccactttaccaattgatgatcatgtaaaacttgatcctaccttatcgatcaatcaacaactgattgatgatatgcaagcgcgtttgaatgtgctgtatgcatatcagaatatgcctggcaataaggacactgagatagatagccaaactaaaacaattcaacaccattggttaaagatgctaaagcctgctttagtaaataatgatagtaccgcagtattagtggcgtctggtaaatacattaaagaagttcacgagctaactaaaaaaattcaggttcgcagtgaaacccgccagcactggcaacaagtattacaaatgtctgcgcttggtatcatcttattaaccctattattaggtatgtatgagcttcggcgtaatgtactaagacccattcactttctcatagacagtacgcagcatttcagacgcggtcatcatgtgcctgcgctggtaactggctatcaagagtttcaaacgcttagcaactcattcaatgatatggcagataccattagcgaacatcaagccaagctcaatcaagaagtgttaaacaaaactcggcatcttacccaagctaaccaattgcttaaactattgtatgatttttccaatcagctcaatcaagagcctgttacattatctaagctacatcatttacttgagaatttttcaaagataaatccaagttttgggtttacattatgcttgcatgatcacctaaaattaaatgaatctagcacttcaggacctctcttgaaaaatgacactgtgcttgtgtcatctaaagatagcattagtattcacagtcactctgttgaagaattgcaaacaggcaaaaccgatcttttgtcgagtgaaatttgttctacaggcaactgcgatcaatgcgctcttaaagccagatctacgacaagaatttatccaatcagcgcccaaaacaactactggggcgagctgatggttcatcagcagtctgaagaagatgataccaccattaccaaagaacttgtacaagtgttggtaagtttagtaagcctagtattcaccatccaaaaacaacgtcagcaagagcatcaattaatacttttagaagagcggaacaccattgcccgcgaactacatgactcattggcacagtcattgtcatatctaaaaattcagctttctatgctaggtacgcacgcgcgccaactttctgacgcagctcaacaaaaccaaaatgatacgctcatggatcataatgaagccatgcttcaagttttagggcaagcacgttcagggcttgatgctgcctacattcagctgcgcgagttacttgtgacctttcgcttaaaaatagaatcgggcagttttgataatgccattgaacaggcctgtgacgaattttctgcgaaaggtggttttaatattacattagataatcggattttaagccaaaatctaagtgctaatgagcaaattgacttattacaaattattcgtgaagcattatccaatattcagcgccatgcatacgccaaagaggtaactgtcagcctttatcaaaaaacacatttagacactgaacagcgtatttatctggaaattggtgatgacggcgtgggtttaccaaagcatattgatgaacaacagcatcatggattaaaaattatgcaagagcgcacgcacagtttgggtggcgagtttgatatcagtcaaaacaccccaaagggcactttggtgcgtatttggtttttacctaaattttatgagaactag

SEQ ID NO: 1781 - DNA, 564 bp, M.catarrhalis
ataatgagttatgataaagatattgaatttcagggtgctgaaattttatcgttcttgaaaaagggtatgattgaagatgctttaattttatttgataaattcaaagaaaatcattgtatttttgatatttcagaaagctcaaaatggaactggcttcatcaaattttactaagtcctagttctgatagttacaagactggcttatcagtgaaatacctcatcaaccaaggcattcctatcaatgcccaagatgtttatggtatgaccccattacactatgccatgcgttcaaagaatgctgatgctgctatcgccttgctggaggcaggggctgaccctaatattcctaataaagatggattgagacctttatccatggttggctataccaaagataggttggatgtacttgaactgatgctcaaaaaaggtggtaatgttcataacattatgggcgatggctctaatagaactattttggaaagttggttgccaacagaaaatgaagagcaatgggtgtttgatatctataatttaatgaaaaaatatgctcaaaatttttag

SEQ ID NO: 1782 - DNA, 543 bp, M.catarrhalis
ataatgagttatgatatgagcggtgtggagattttagatgcattatgtttaggcaatattactcttgctgaaaatttattaaaacaacacccacaacacaacttactcgctgtcaatagcgataaaaaaaattggcttcacaaagtcacggattctatgaatcctgatgagccaccacctgtcaccatcagctatcttatcaaccaaggcattcctatcaatgcccaagatgtttatggtatgaccccattacactatgccatgcgttcaaagaatgctgatgctgctatcgccttgctggaggcaggggctgaccctaatattcctaataaagatggattgagacctttatccatggttggctataccaaagataggttggatgtattagaattaatgctcaaaaaaggtggtaatgttcataacattatgggcgatggctctaatagaaccattttggaaagttggttgccaacagaaaatgaagagcaatgggtgtttgatatctataatttaatgaaaaaatatgctcaaaatttttag

SEQ ID NO: 1783 - DNA, 810 bp, M.catarrhalis
tttgatacatatcctatgatgaataccgataccaaaccccaccccaaaaccgaattatgtgatgcagaactgatgcgttatagtcgtcaaattttattagacggatgggatattgaatcacaacttaaaattaagcaatcatccgtttcactaattggaatgggtggtttaggttgtatggttgctccgattttagtgagagcgggtgtgggtgaagtgcatttatttgattttgataccatagatgacagtaatttacaaagacagctgttgtacactcaagcagatattggtttaccaaaagcacaaatagctaaacaagcactgatagaacaaaactcttgggctgcagtccatagtcataatattgcactcaatgatgatactataaaagaaaacttaatatctattaaatcagacttatggattgattgcagtgataatttcgatattcgtcaaacacttaaccaccattcgatcataaccagtacagccctactttcattgtccgccattggcgaaactgggcaagttgcactttttgagccaaaaaaaacaggctgctatgcatgtttatttggtacttcaatgagggcagcccaaaactgtgcaacttctggtgtcttagcaagcacggtggcggtgatcggtgcacttggtgctgacatcgccttacattttctcggtaaagatcaaaataccttaaaagatacgctgatggtatggcaaggttctcgtgccaattttcaaaaaatgaaatttaccaaaaacccctcctgccctatttgtcaaaaatctatcgcgctataa

SEQ ID NO: 1784 - DNA, 420 bp, M.catarrhalis
caactgagatataagataatgaaaaacatatactttataataaagttatttgtattatgcagctttgctgttattgcctatataagcattgtgttactttcttatgaaagttattattattgcaatgataaaaattgtttgacatttgttgagacaataaaaggaagggatttggttgttaaggtttatgataaaagaatttatagtagattacagatgaaaaatagctcttatatggagttttatccagaatttattccttattttgaagaagacaataatgggggatttattgtacacagtgattctgagccaaaaattgcaataggagatatgagtaatataagatttgttttgtctggatacgaatgctgcggtactccattttataaattgaattattatatgataatattttaa

SEQ ID NO: 1785 - DNA, 705 bp, M.catarrhalis
aatcatcagtacataatgaggcaggaaatgaatactctacctaaatttattggcactctgaccaccgtacgcacaggtaaaattgagccgtttgtgcgtggcgtgagtgctattaataaaattcccattgatggcagcatgaaagttgatttactgggtctagatgcagacgaacaagctgagcataaatttcacggtggaccactcaaagcagtgcatcaaatgccaatcaccacctatgatgtcatcaatcaggcgtttggtttgaacatccctgttggctcactcggagaaaatttaaccgtcattaccgataagataccgatggacgaacgctcggtatgcattggcgatatctatcaattcggtgatgcagatgattgcgtacagcttcggctagtgcagcctcgccgtccttgttataagatcaatgatcgattaaacactccaaacatatcttcttttgttagtcatcaaggcattgctgggtggtattatcaagtgatcaaaacaggcatcattaagcctgacttatccgtctaccttatcgaacgcccttttgaatacgccactttgcacactctttggcaaatagtgaatcaaaaaagcaaaatcgatgccgctactgccaatcagtggctgaacattgattgccttgagagcagctggaaacaaaaaatttttaataaaaccctaagaccctaa

SEQ ID NO: 1786 - DNA, 189 bp, M.catarrhalis
aagaattttcaaacaccaacaaagggggtgagcatgactaccacaaccgaccggctcgatcgtctagtgaacgaactttttcgcaaatttgaagaaatgtgcaaacagcgatttgagcaagaaacccacaaatctcagacagatgacatcttcaccacggagctggaaggatccgcgctatgcgtctca

SEQ ID NO: 1787 - DNA, 1347 bp, M.catarrhalis
atgaataatcaactcaaaggtggtcgtcgcatcgatgactggcgtcctgaagatgaaaaattttggcaaaatggcggcagccgtgtcgctactcgaaatctttttatctcaattcctgcactattgcttgcattttcggtctgggttatctggagcgtgattgtagttcgtatgcctgaagttggctttcaatttgataaagcgcagctgtcttggcttttggcactacctgccttatctggggcaaccatgcgtttattttatgcgtttttagtacctgtttttggtggtcgccgctggacgacactgtcaacagcatctttgcttatacctacaatttggttgggtttggctatacaaaaccctgaaacttctttcaccacatttgcaatcatcgcactattatgcggtttcggcggtgccaatttttcatccagtatgtctaatatctcatttttttaccctaagtctaaacaaggtatggcgttaggcttaaacgcaggtttgggtaatttaggggtatctgtactgcagtttgttgtgcctgtgatcatcggattttctttatttggtgcattggcgggggatggccaggttactgaatctggtaaagttttatatttacaaaatgctgcttttgtttgggttattccaattgctattatgactgtacttgcatggtttggaatgaatgatttaagcaacgccaaagcgtcatttaaagaacagtcaattatttttagaagacaacataattggatcatgtgcattctttacttggcaacttttggatcttttatcggctttagtgcggcgttccctatggttattaagcagtcgtttcctgagatcgatcctctaaaagttgcctttctaggtcctttggttggcgctctatttcgtcctgtaggtggttggttgtctgataaggttggcggtgcgtgcgtcacattctggaattacattattatgacaattgctgtcatcgcagttatgtttttccttaaaaatggtaattttacaggctattttgctgggtttatgttgctatttatcaccactgggattggtaacggctcaacgtttcgtatgattcctgtgatctttcgaaccatgcatgaacgcttacactcccctgatgctattacacaagcacgcaaagaatccgctgcagttgtaggtttttcggcgggatttgcggcatatggtggtttttttatcccaaaaatgttcggttcaggtctgggggtaaatggcaccttccttgtactaattgcattttatattatatgtatcgctttgacatggtggtattattcacgcagaaatgccccatatccttgttag

SEQ ID NO: 1788 - DNA, 999 bp, M.catarrhalis
gatcatgatcatatgatgattgttaagggtcgttttgagggcttgggtggatatccaatgagtacccaagaagatgtattatcgctgatttcaggtggttttgattctagtgtggcaagccatatgttcatgcgtcgtggtagccgtgtgcattattgtttttttaatttgggcggtcaggcacatgaattgggtgtcaagcagatggcctatcatctatggtctcgctattctttgtcgcataaggtatggtttattacggtagattttgaacctgttgttgctgagatattaaaaacgattgatgatggccatatgggcgttgtcctaaaacgcatgatggtaaaagctgccagtcagattgctcaacaaataaagatccaagcactggtaacaggagaggcgatgggtcaggtggcaagccaaacattaaccaatcttaatgcgattgatgcagcatcatctacattgattttacgccctttaattaccagtgataaagaagatatcataaaaatggcagaaaaaattggcactgcaaacattgccaagtcaatgcctgagtattgcggtgttatctcaaaatcacccacggtcaaggcacttaagtctaagattttggaacaagaagcaaattttaattttgagattttaaattatgccatacagacagccaaatttagtgatatccgagatttgaatattcatgaaaaaattgtgactgctgaagtggtgcaacacatcacatcacagcaggtggtattagatattcgtatgccagatgaagtagatgacaagccacttaaggtagatgctgccgtgattacgctgccattttataagttgctatcagaatttgatcaacttgaccccaccaaaacctatttgttatactgccaacaaggcgtgatgagtcgattgcaagcagcccaactattggcaaaagggcatcataatgtcaaaatatttaaaccatcatcaccccaaagtggtctgtag

SEQ ID NO: 1789 - DNA, 438 bp, M.catarrhalis
aggtctgcccaagtctttagaagttggcataatacgaatattatcgcttttttgagccaaattctctatattcaatactttgatgagcttagcagaatcattatgttcatctgcgcatatattttgaattgtttgttgagtcggtatataggttccaacgctcataagacctctaataatggttacaatgaaaatatggataataaaatcattatccaaaataaagagtctattcaccatacttctttaggagaatgcaaattcatcattttaaagacactttctggtgataaaaaaccacaaagacaagaatgcagtctttgtggcaatggcacagtattttattattgttgttattattccgtattacttactgagatctcttttggcggacaatttgataacgcctgccaagataccaaattggggcagaaatga

SEQ ID NO: 1790 - DNA, 852 bp, M.catarrhalis
ggcatcacacatcgtccttggtgtcaatccttggtgtcaaaaagtaacgcccaaaccccacaaccacagaacaaacaggagcatgttatgacagcaaccatcaaatcagccatcaaacctttattcatcgccatgatggtcatgggggcaacatcagcccatgcagaccttaccgtgtatgccgctgccagcatgaccaatgctgttgaagacatcaataagttgtatgaaaaaaaatacaacagcaaagtaaaaacttcctttgccgcctcatctacccttgccaaacaaattgagcaaggtgcgcctgctgacatttatatctcggcaaacacctcttggatggattatcttgccaaaaaagataagattgttagcagcagctacaaaaacctattgggcaaccgcttggtgatgattacccccaaaaacaaccccgtcaagaccaacatcaaaatagacaaatcctttgacatcggtaatgcctttacaggcaagctatgcactggcaacaccgccagcgtgcctgtgggcaaatacgccaaagaagccctaaccaacctaggttggtgggacaccatcgggccacgtttggtagagaccgaagatgtgcgtgctgcactaaactttgtgaaccgtggtgaatgccagttgggcattgtctatgccacagatgccaaagtggtcaaaaatgtgcaagtgattaacacctttccaatcaccacacacacgccgattgtctaccccatcagcatggtcaagcaaagtcgtgaagcccagcagtattataactttttacagaccaatgaagccaaagcggtttattacaaatatggttttagtgtattgtaa

SEQ ID NO: 1791 - DNA, 585 bp, M.catarrhalis
cccacaggacatcttatgtgtaacttatgtaatgaccctaatcatcaaccacaagccaaaaaatccgataaaccatttactcccttaaacatcgctgtactaacggtatctgatactcgcatactggacgaagatacttcaggaaaattcttggtagatagcctagtggaggcaggtcatgtattggttgaccgcaagctgaccaaagatgatatttatcaaatccgtgcagtgattagtgcatggatcgctgatgaacgcattcatgccattattaccacagggggtacaggtttttatcatcgtgataacatgccagaagcagtcggcgtgctatttgataaagaagtgcaaggctttggtgaaatgtttagatacttatctcatggcgaaatcggaatgtcaaccctacaatctagagcagtggcaggcatggcaaacaacacagtaattttttgcttaccaggatcaacaggagcatgtcgaacaggctgggagggtattatcaaacagcagctggataaccgaactcgtccttgtaactttgtaccacatttaatgcgtcaaaatccatcgcatggctaa

SEQ ID NO: 1792 - DNA, 777 bp, M.catarrhalis
aaattatgcaagagcgcacgcacagtttgggtggcgagtttgatatcagtcaaaacaccccaaagggcactttggtgcgtatttggtttttacctaaattttatgagaactaggaataacatggttttaaagatttttaccgcagccaatcctgcacgccttcttcttgtcgatgatcatccgatgctacgtcgtggtttggcagatttattaagtctagaaaaggatgttcaagtcattgctgaagccaaccatgggatggaagccctggatattctaaatcaagaaattgtagatcttgtgattttagatcacaccatgcctatcttaaatggcattgaaacgctcaaaaaaatacgggagttgggtattcaaaccaaagttctattatttaccgtatcggacaatagcaaagatgttcaagatgcgcttcatttaggcgttgatggctatctactcaaggatatggagccagagcaaatcattactgatatacgtaagattttgtgcggtgaattagtcatcagcccaagtcttgcaccgattttagcacaagctatgcgtaaacctgttaaaactgacagcagtcacgagctgacagagcgcgagatccaagttgctaaaatgattgctcaagggatgagtaataagatgattggtaacaagcttggtattgctgaatccacagttaaagttcatgtcaaacacattcttggtaagattggcctgcgtacgcgcgttgagattgccgtttgggcggttggtcattatcagtga

SEQ ID NO: 1793 - DNA, 216 bp, M.catarrhalis
tttaatgaaaaaatatgctcaaaatttttagcagctgagcaaacaggtctgacccaaactcaatttaatgactttattaattctcatcctgattatttcagacttgaaaacgtatcggataatatgggtcatcgcaatgagaaacctggcaatggtgatttacaagacatcatcaatgatatcaatgaaattaaacgcaaaagaggtattagataa

SEQ ID NO: 1794 - DNA, 201 bp, M.catarrhalis
tttaatgaaaaaatatgctcaaaatttttagcagctgataacaacacccacaccctaaacaccgctcgccttaccgcaggtgctatcgccctactgtatgactttgatgtggatacagcggtaaggcggtggagaataatgctgtttacattaataagggtaaagcgatcgaagcggatcagaataaagcaaatgagatga

SEQ ID NO: 1795 - DNA, 603 bp, M.catarrhalis
cacaagatgaattggcggttgctgtcaatcatcagattgccaattggcagactaaggttagcaatggtgatatcattgccttcattccacctgtcgctggaggttaatatggctcaaaaactacatcaaggctcatcaaagatctcattaagccatgaagctgcctaccatgtggcaatcactgatggatttgccttattagacacctttatcgatgagaagaagctaaaaaaaggtttgcttgatgaccgctgtggggctttagtgacctttgaaggttgggtgcgaaaccataacaacagccgcccagtagagaagctcacctattatggttatgaggcattggcacttaatcaaggaaagctattgatcagtgaagcctgtcaacgttttaaaattgaaaatgccatcgccatgcatcgcatcggtgatctgaacataggcgatatggcggtgtggataggcgttagcgctcatcatcgctatcccgcctttgaagcttgtcagtggttgctcgacgccatcaaagcagacattcctgtatggaagcaagaattttataccgacagcaaccaaagtttatggttaagtaataatggttaa

SEQ ID NO: 1796 - DNA, 1017 bp, M.catarrhalis
tatgcaactgacagtgacactataaatgataatatatctcataaacttgccgcaggtttaacaggctgtctatctgccaaagcggcaggaaatcgttgtgaagcaggcagcatcggtgctgtcgttggtgagatgtggggtgattatcaagtagatgacccaaacaccctaacccaagcacaaaaagacaaactcatcaatcaagccaaactgattgcaggcatcaccgctgtctttgctggagaagatgtcaatgtggctgctggtgtggcagcggaggcggttcaaaataatgctttagtaaaatctgatgacataaaaaacttttatctgcattataatacattttgctcctctggatcttcagcagcttgcgatgcaatcatacatcaatggaaatatgtcagctatgaacatgctggcatgacttctcaggaaatagtagcatgggaaaatagcgttacacaaattattgagcattataatcgtcagtgtaaagataatacctgtcgtaatcatttgagatctcaaaaatatcgatatatgattgaacatgcgggtactcctgagtatttgtatcaattggaaagctcgcttattgcttatattcatggaccaatggctgctgtaactgctgcaggccatcaaatttcaggttctgttgtagaagcttataatgcggtttcgagacagtcggttagaggtggtagtcgaacgcaagtaaataattcagcgaaagctcaaaagccgttaagtaatactagcagtaattatcagcaaaccaacaagaaagcagttgaggacttacgacagggggtattccctgggaagggtgagattggccaacccagagaaatgcaaaaaagtacagatccgaataaagcagcagatgattttgcccaacagtttttaggaagaaagcctaccgctgatgattataaacagggtgctacgatgaataataataattgccaagggtgttggagggcacaaactcccgatggtacccctgggtga

SEQ ID NO: 1797 - DNA, 591 bp, M.catarrhalis
gccatgagtttatgcgctgtcttaattttagcagggggagagtcaactcgaatgggacaacccaaagcacagcttgccctacctaacaaaagtacggtacttgattttcatatcgcttgtgccaaaaaattaaacttacctatttttttggcagataacggtaaaaattccgcacatgatccactcattacgccacttaaagattatttgccttgcaatgattcaggtaaaggtgcaggtcctttatccggcatcactgctggcttacaggcggtagaaagcgaaggctatattttgactgttagctgcgatcatttgctagcgattgataaaattgctgatatattaaagtttaccagtgctcaagttggctatctatacgcaaaaaaagactgccccttattaggggtttaccacaccagtattctaccaatattacttgattttctggctcagggtggtcgctcagtcatgcaatttttagaccttgttgaccgccaaacttttgatcttaatgatgatttacactctttgactaactttaacacacccagtgaatttgccttagctttggaaaatttttatgactga

SEQ ID NO: 1798 - DNA, 201 bp, M.catarrhalis
aaaatgacactgtgcttgtgtcatctaaagatagcattagtattcacagtcactctgttgaagaattgcaaacaggcaaaaccgatcttttgtcgagtgaaatttgttctacaggcaactgcgatcaatgcgctcttaaagccagatctacgacaagaatttatccaatcagcgcccaaaacaactactggggcgagctga

SEQ ID NO: 1799 - DNA, 276 bp, M.catarrhalis
ggtaaggcttgtactgtcaagcaagacagcaccgccttggtaggtgccattaccgttaatacgatgatcacccttgaccacatcgctgacaatgcctttggcaatcaaggtgctgtttgtggtggtttgattgccttgaacatagatggtggtgtgtttggcggagttaatttgactgttgttgacaatcagatcgctgttagcttggatttggatgttggcctgactggtgatattggtatggtcaagtgtttgctggcctttagcaaagcttga

SEQ ID NO: 1800 - DNA, 405 bp, M.catarrhalis
atggtgatgtgtagattatgccaccgccaaaaacaagactgtgaagcaggcagcattggtgctgccatcggtgagatggttggggattggttagttacagaaaaactcaaacaaggcattgaatcaggtgagataaaactaggctcagatgagtacaacaaacttctaaatactgtcaagattaccgcaagtgctatattggatataccttatgatgattttcaaaaagccagtggctctttacatgctggcggcatactgggtcttataagacacaagacaactgggtgtacttatggtacacatcctaggtatggtgaaattgattatcaatatctaagaagtaaatatggttacgattttaaaattaaaaatggagcaagaaactcgacctataagaaatag

SEQ ID NO: 1801 - DNA, 234 bp, M.catarrhalis
aactttgatcgtgatgttcgcaagattaagctgacaacaaacttggtagaggttttggcttgccttagtcgcagtgaagctttgcctgctaaatacaaggaccatgcactaactggcaattggcaaggttggtgtgattgtcatgttgccaatgacttagttttgatttataagattgatgatgggattttgcatttggctcgattaaattcccattcagaagtttttggctaa

SEQ ID NO: 1802 - DNA, 1566 bp, M.catarrhalis
gctgtcgctaggtcaaggaaaattaaaatgaaaattcgctcacaagttggcatggtgttaaaccttgataaatgtatcggttgccatacctgctcagtcacttgtaaaaatgtttggaccagccgagagggcatggaatacgcatggtttaacaatgtggaatccaaacccggtatcggttatccaaaagaatgggaaaaccaaggtaaatggaaaggtggttggatacgcaatgcagatggctcaattaatcccaaaattgggggtaaatttagagtgcttgccaatatttttgccaacccagatttgcccatgatagatgactattatgaaccatttgactttgactaccaacatctgcataccgccccaattggtgaacatcagcccattgcacgccctcgctccttaattacaggcaaacgcatacaaaaaattgaatgggggccaaattgggaagagattcttgggtcagagtttgctaagcgtcgccgtgataagaattttgatgacatacaagctgacatctatgggcaatatgaaaacacctttatgatgtatttgccacgcctatgtgagcattgtctaaacccaacttgtgtggcatcttgtccaagtggggcaatttataagcgtgaagaagatggcatcgtgctgattgaccaagacaaatgccgtggctggcgtatgtgcatctcaggctgcccttacaaaaaaatctattacaactggaaatcgggcaaatcagaaaaatgtatcttctgttacccccgtattgaagcaggcatgcccaccatctgctctgaaacttgtgtcggtcgcattcgctaccttggcgtattattgtatgatgcagacaaaatccacgaagttgccagcctatcaaacgaacaagatttataccaagcacaacttgatattttcttagacccacatgaccctaaagtcatcaaacaagccttacaagacggcgtgccaatgagcgtcatcgaatctgctcaaaaatcccctgtctataaactggcagtcgattggaagcttgctctgcccttgcacccagaataccgtaccttgcctatggtgtggtatgtgccaccattatcacccattcaaaacgccgccgaagcaggtcaagtgggcatggacggactgattccagatgtggacagtttacgcattcctttaaaataccttgccaacatgctcaccgcaggcgatgaagagcctgtacgcttggcattaaaacgcctgcttgccatgcgaagctataaacgcctacaattggttgaaaaacaagatgctcaagaagtgttagacgctgttggcttaagcgttgcccaagtggaagatatgtaccgctatcttgccattgccaactatgaagaccgttttgttatcccaaccgctcaccgtgaagaagccctaagcgatgcgtttgctgaacgcaatggttgtggctttacctttggtaatggttgtacaggaggtaatgacacccacatgtttggacaaaagaaaaataataagcgtgattttatcaaaaccgtacaaacatgggagctataa

SEQ ID NO: 1803 - DNA, 525 bp, M.catarrhalis
tgtggatacagcggtaaggcggtggagaataatgctgtttacattaataagggtaaagcgatcgaagcggatcagaataaagcaaatgagatgactaaagatattattagtaatagaaatgctggatggagatttctaagaagcaaaaggcaagccgacctcttataccaattaaataccagcaaagatttggaagttcaagttgatgttaatgatttaggtgaattaaaaataactggagatttgtggaaaaccctacctgatggccgacaaacaattattgtcagaccaaccacttataatgtatgggcggtcacaggaagcctgacattagtaagaagaaccgatggaacctatggtgtttttaatggtacctatgattttgaaatgcataattcaggtattctagcaatccctagaaacattgagacggttgtaggttctccaaggtgcgcagcaacgagtgggtgtacaggatatcaaattaaattcaatggtaattttgataaaaataaaataaaataa

SEQ ID NO: 1804 - DNA, 276 bp, M.catarrhalis
ataaaactggggggaaatctgattatgtcaaataacttaactgttactgtattatatttcgccagtcttgccgaacaggcaggtatagatgaagaaattttaacaacctcgcattattatcttaatgatatttattcttatttattagataaatacgattttaatttaacacaagatgaattggcggttgctgtcaatcatcagattgccaattggcagactaaggttagcaatggtgatatcattgccttcattccacctgtcgctggaggttaa

SEQ ID NO: 1805 - DNA, 183 bp, M.catarrhalis
aatgggatggggagatgttgggcgtttggtggtgttttggatattcataagcatggtgaatctttgaattgttattacgattgtcgaaaaagtaatctgctgattaaatcactatttttaaaatatcatctcatcaaaaatgaaatagcgtttgtgtggtcattgttccactatctgttctag

SEQ ID NO: 1806 - DNA, 519 bp, M.catarrhalis
tcaatttttatcaaccgccaatcaagaagaacacccatggcaatcagtgcaagaaatcaacttaacgccaccatcaaacacattcaatcaggggcagtcaatgatgtcatcaaacttagcttaaccgatggcgatgaattaacagccgtgattacctcggagagtaccaaacgccttaaccttgctgtcggtggcagcgtggtggcgatttttaaagccccatcggtcatcgtcgcaacagatgatgagctgattttatcgtctcgcaaccaattgcaaggcacggtggagagcatcaccgacggtgcggtgaatgccgaaattaccatcaaaaccgccagcggtacagtgattagtgccatcatcaccagccaaagctgtcaaaatctaaacctagccgtgggttcgcctgttactgctttaattaaggcatcacacatcgtccttggtgtcaatccttggtgtcaaaaagtaacgcccaaaccccacaaccacagaacaaacaggagcatgttatga

SEQ ID NO: 1807 - DNA, 1284 bp, M.catarrhalis
aaagagcctatcatgacaacaaaatctaccattgtactcatctcgtcgaccgttgcatttacgatatgttttatgacttggatgatgtttgctgttttgggtatccctattcagcaagcacttgacttaaatgaaacccaatttggattacttgccgccacgcctgttttgacaggttcgctagttcgtttaccgctgggtatcatgacggataaatatggcgggcgcattgtatttttcgtcttaatgttagcgacagtattgccgatctttttaatggggtatgctgatcaatattggcaatttttgttattaggcttgtttgttggtttgtcgggcggatccttttcggtgggtatcgcctatgtagccaagtggtttgaggcagacaagcagggctttgccatgggtgtatttggcgcaggtaatgcaggttcagcgattactaagatgatcggtcctgccattatcgctgtaggggcgtccacagcagccagtgctgcagaaggctggcgttttttacctaaagtttatgcaggtattatgctgattacagccataggtttttggttttttagttatgataataaaacgcatcgtactgccagtaatgctactcttgccagtcaactggctgttctaaaggataagaatgtttggcgttatagccaatattattcgatcgtttttggtggctatgtagcactggcgctttggatgaccaagtattatgtcggcgaatatggttttagcctacaaacagcagcatttttggcagcgtgttttagtttgcctggtggggtattgcgtgcactgggtgggtggctgtcagataagtattcggcacacacagtcacttggtgggtactttggtcatcgtttttgctactatttgccttatcctatcctcaaacattcttgaccattcagacagttgagggggaaaaaagcttttatattggcttaaatgccatcgtctttactgtattgattttcttgctaggtattgcctttgccattggtaaggcatcggtatttaaatatttgtctgatgaatacaaggataatatgggtgcagtatcaggtgttgtgggcttggcagggggtcttggcggctttattctaccgattatgtttggtgccgctgtggatatcacaggtattcgttcatcggcgtttatgatcatgtttggtgtggtgtgggtgagtttgatttggatttatttatcagaggtcaagccaaaaatagaacaagaccatcaatcaaaaaccctaaaattatag

SEQ ID NO: 1808 - DNA, 1329 bp, M.catarrhalis
gcaaaatatatatcgtggctgatttattataaatttataaaaggaaaacacatgattagtgtagatgagcttcaaaaatcaattatcagtcgcgtggacgagtatttgaatattgataatcctttggtatccagacagagggtagtactggctttaaacgatgcacttaatcacatattggcagttgatattaatgcgaatctcgatataccacgccagaatgtttcggcaatggatggatttgccttggttgcacaaagccaactacagcagggtgatggttttaccgtcataggcgagtcttgtgcaggcacgccgtttagtggcgagattttgcctaatcaagcggtgcgtatctttacaggagcggttgtaccagagggttgtgatacggtagtgatgcaagaacatactacttttgatcaaattaacataactgataaatctcagccttattacattgtactaaccaagcctgctaaagccagtgccaatatccgctaccaaggcgaagagattgctcaaggcgataccttgcttagtgcaggtaagcgtctgaatcccagtgatattagtctactgtctagcatgggatatgatgaaattgaagtgttttcaccacttagaattggtctaatagccacaggcgatgagctggtttccattggtcagccattgagtgatttggctcagatttataattcaaacacaccaactttaaaggcactattaagaaaattgcctatcataatcaaggattatggcattgtcaaagatgtgtttgatgagacttatgaagtggtaaagtgtgccattaaagaatgtgacataattatctctagcgccggtgtttctgttggtgactatgattttttaaccgaagtggtgagaagcttgggtaaaattaatcactataaagttgctatgaagccaggcaagccgtttgtttttggtgaatttgctgctgatgcgcgtaaagtgttatattttgggttaccgggcaatccactttctacagtggttggctgtattaactttgtgcgtccagcactatggcaggcactaggggcaatagatgcacctcttaccttacatctgcctgcgattacgacggcaaacatcaagaaaagtgtaggtaggcgagagtatcagcgcggctattttgaaatgggtgaaaaaaaattacaagtcacaccatcaagtgcgcaagactcgcaccgcatcaaacaattgtctcaagccaactgtctaattgtgcttgatgaaaatagtgtgggtgcgaataaaggcgagcaggtgataattcagctatttgattgggtggtgtga

SEQ ID NO: 1809 - DNA, 1095 bp, M.catarrhalis
gttattgtcatgaaaaactctttattattccaaccggcgcagccagcccaccaagcgacggattgttttgacacggtattttatggcaatgagtttaccctagcaacatccaactcaacagaaaaattgactgataactttcagcgtaaactaacctatcttagactttccatcactgatttttgtaattttcgttgtaattattgtctacctaatggctatcaaggcaaacgtcctaataacgagctgacacaacaagaaattgctactttattggcaggatttgctgctcttggcaccaccaaagttcgtctgacagggggtgagccatctatacgccatgatttgcctgacttgatcagactcatcaaaaatacagagggtatcaagaccgcgtgtatcagctccaatggctataaattaggcaaacatctatccgcttggcatgatgcaggcttagataaattaaatctaagtattgacagttttaatcccacaacatttcataaaattacaggatatgatggcttgcctactctacttcgtgatattgataaactcttatactcaactagcatcaccttaaagctcaacggcattttgatggcacataccgcctatgacaatcttatggcagcactggactttgtcaaagatcgccccattacttaccgtttcattgaatttatgcaaacatcagataatagccaactgttttttgccgagcatactagcagtcagcatatcaaaacctatttaatcaagcacggttggagggctcaaatgcgtgcaacggatggtggacctgcaactgaatacagccaccctgattatgtcggtaaaattggtctgattgaaccttattcacccaaattttgtgatcattgcaatcgcctacgtgttagtagtcaaggtcaagtgcatctttgcttgtttgatagccaaaattacgacattcgtccttatctgacacaaggtgacacccaggggctcattcaagctttacaagccttaatgcctatcaaacctgaacatcatcacctgcactctgccgacagcggcatgatgtataatttatccttggtaggcggctaa

SEQ ID NO: 1810 - DNA, 747 bp, M.catarrhalis
cttcaaccaatccgccaaagccaccacacaaggagtctgattatgaacacaacaaacccagaagattggttacatgtctttttatttggcatttatccctacatcgccttgacagtgtgcatctttggttgttgggcaagatttgatttgtctcaatacacatggcgtgcaggctcaagtcaaatgctgtcagataaaggcatgcgattggcaagcaatttatttcatattggcatcattgtcgtattgcttggacatttttttggcatgtttaccccccattttatttatgaacgcatcatcaccgcaccacaaaaacaactgatggcagtgattgttggtggcattgcagggataatgtgcttaattgggcttatcatgttaatttggcgacgttttaccaacccacgcatcagccacacctcaacttttagcgataagatgttactgttaattattttgcttcaattggtcatgggacttgcaaccatttggtcatatccgacgcatcgtgatggtgcattgatgttaagcttggcagggtgggcacaaaacttggcgatattacgcccagtctacgccgcttcattggtagaagatgctggactggtttataaaatgcacatgttcttaggcacaaccttaatcttacttgtgccatttactcgcttaatccatatcatttctgccccaatttggtatcttggcaggcgttatcaaattgtccgccaaaagagatctcagtaa

SEQ ID NO: 1811 - DNA, 474 bp, M.catarrhalis
gggcttacaatgagaaaatatataggattttttatattattcccattaatttttacaataattgtttattcgtataaacaaatcttttttttaggagaaactcggcttaatggtgattattatgccattgagatggataatacattttttgagtacctatcgctaaaaaatgaaaaagtaattggagcaatcataaaccgcacagagtataacaatattcacttgataatttataccgaaggaaaaatatgcgatgaaccacaaggtagtatgtttgagtactttccaaatgatattatgtatgcgattttagacaatactggaaatctactggcatttaataatatagaggactatcactcctatatatccttaaaaaatataaagattggaaatttgcatattaacataaaagatttgtttaaaatagaacaagcaaatcaagcagcaaaaaagtcaggttgtatttactga

SEQ ID NO: 1812 - DNA, 309 bp, M.catarrhalis
attatgacaatgaccaatttgaatattcgcattgatgacgatttaaagaaccaagcaaaggtgattctggacggttatggcatttcaccaagccaagcggtcaaaatgctgttcttggaggtcaaaatgctgttcttggaattggtggcaacttgcaaatttcccctaagcttaagctatcaagctgactaccaaccaaatgctaagaccatttctgcaatgcatgaactggacaatggtggtggtacgctatacgccaatcttgatgaatttttggcggagcatggcgatgttgcaaatcaagcctag

SEQ ID NO: 1813 - DNA, 507 bp, M.catarrhalis
ctttggaaaatttttatgactgatttagatcaccacaccctaactcatctagacgccaatggtgatattagcatggttgatgtttcaaccaaaatagtaacccagcgcagtgccaccgcaagcgctcaggtaatttttccttcaaatatctatttagccatcaaaaacactgatggcctgacaaaaaaagggtcaattacccaaacagctcatcttgcaggtattatgggtgctaagaaaacgagcgatttaatccctttatgccatcagttaccccttgatagtgtcaagctaagctttgaatataatgatgcaaaatgtgccatcgttgtgacagcggctgtcaaggtagctcacaaaactggtgtagaaatggaagccttaacagcagtatcagtagcttgtctgaccatctatgacatgaccaaagcaatgagccacgacattatcattaccgatgtttgtctattaaataaaactggggggaaatctgattatgtcaaataa

SEQ ID NO: 1814 - DNA, 210 bp, M.catarrhalis
ctgtcagaaataacattggcaaatgcagaaccgctacagccaagccaacaagcgatggttaatggcgcaagctttgtcatcaaagagatggaaagccaagttggctttttaccaagaccaccacccaaattgcctgattttccctgtgctttcgttatttcagaaacaacaaccaatcttcctaggttcttattaaaaataacacggtag

SEQ ID NO: 1815 - DNA, 198 bp, M.catarrhalis
aaaaatgagatattagacatactggatgaaaaattggcaccgccgaaaccgcataatagtgcgatgattgcaaatgtggtgaaagaagtttcagggttttgtatagccaaacccaaccaaattgtaggtataagcaaagatgctgttgacagtgtcgtccagcggcgaccaccaaaaacaggtactaaaaacgcataa

SEQ ID NO: 1816 - DNA, 1158 bp, M.catarrhalis
gtatgctgctttgggctggtgatattacaagggtttgctccttttcaaggcgtggttacgcccttttattggcatggtcatgagatggtgtttggttatgctttggcagtgattgcagggtttttattaacggcagtcaaaacatggacaaatcagcccatgccttatggctggcatttgggggcgatatttggggcgtgggcggtatctcgctttatctggtttgggcttcatgtcacacctagcattgccctgttcatggcggcttttgtatttgacatgatattttggggcatgactgcttttgctgtcatcaaagcggtgtgggctgttcgccaaaaacgtcaaattggtatcattaccaaacttttactattaggtttgactcaggttgctttttatgtgggcgtgctgataaatcatcacaacacacagcaaatcgccttatattttgccttatatttggtgattggtgtagtgtttaccattgcacggcgtgttttgccattctttattaccaaaggcatcagcgtcaatcatgatggcacaccaaatggcatgcagcttgaacaaaaaaactccgatctactggacaggctcaatttatttggtttttttggatttatcatttttgatttgttcatcaaacagcccatgattgctggcgtgtgtgcgttagtatgtttgatggctaatttggcacgcctaaaaaactggtatcaccacgccatctggcaaaagcccctgctgtggtcactcatcattgcattttttggcatgacgataagtttggcgatgtttgtactttatccgattgccacacagttaaattggtttagctctgttaatatccacacgcttggactccatggtttgccggtgtttggcactggactgatgccgattgccatgatggctcgggtgtcgcttggacatactggcagaaatatccatcagccccctgccactgtgtcattaatgttcatgttgatgattttgtgtggcatatttcgtgtggtcttaccgctattttttaatgatagttatatgccgctcatgttattatcacaagtattgtggatagcgtcttttgtgatattttgtctttgttatgtgggcatcttagtaaaaccaagaaccgatggactttttggatag

SEQ ID NO: 1817 - DNA, 228 bp, M.catarrhalis
gtcaagtgcttgctgaatagggatacccaaaacagcaaacatcatccaagtcataaaacatatcgtaaatgcaacggtcgacgagatgagtacaatggtagattttgttgtcatgataggctctttttaaaagatactaaaaacagattttatttggatatcaaaatctctccaaataaatcagctttacaaaagtacacaagctataataaattgaaatttttttga

SEQ ID NO: 1818 - DNA, 1110 bp, M.catarrhalis
agaagtatggtgaatagactctttattttggataatgattttattatccatattttcattgtaaccattattagaggtcttatgagcgttggaacctatataccgactcaacaaacaattcaaaatatatgcgcagatgaacataatgattctgctaagctcatcaaagtattgaatatagagaatttggctcaaaaaagcgataatattcgtattatgccaacttctaaagacttgggcagaccttcatctgatgctcaatttatcaagcaagcattagataaagaaatttttgacagcaccaatctaatcgcctcaagccaccaaactttaccaaatatcactgtaaatggcgtagcaatagaccccaaagcagtagctgccgaagtgcagtatcatcctgctaatagccaagaagaagcattatttttagcagctcaagccttagttatgcgtgaattactgcgtcaagaagtgattgggtgcttgggcgagagggcgtggctagagaatgaagaagctaccatcgctaagctgttagagcagcaagtcatcgccaaatctccagacaaggcaagctgtcagaattactatcatgctaatcaagttgaatttgttagtatgccaataatgacgcttcgccatattttgcttgcgtgtccaccacaagagggtgaagagcgcattgaattaaaaaagcaagctcgccaattgatcgatcggcttaatcaaagccacaatcgagatagtgattttattgagtttgcatgtcgatactctgcctgcccttcaaaagatgatggcggtgaactgggtgtattacaaaaaggcagtaccgtgcctgaatttgagagtgccgtatttgctttgccagttggtatcagtattaatccgattgaaacgcgatatgggatccatgtgattgaagttctacaaaagcaggagggtaggcagctgagctttgaagaggcatatcctatcattgaaaatcatcttaagcagcagtcatttcatcatagtttgtgtgactatttatttgaattgagccaaaaggctgatattattggcattgagcttaagatgaatgagcaaaatatatatcgtggctga

SEQ ID NO: 1819 - DNA, 5220 bp, M.catarrhalis
aattcaaaggtcttaaaacaacaaggacagtccaccatgaatcgcttttgctaccgtgttatttttaataagaacctaggaagattggttgttgtttctgaaataacgaaagcacagggaaaatcaggcaatttgggtggtggtcttggtaaaaagccaacttggctttccatctctttgatgacaaagcttgcgccattaaccatcgcttgttggcttggctgtagcggttctgcatttgccaatgttatttctgacagtcaagcacctgtctttcaaagacccatcattgctgccgccaaaaacgaccgtcagcaaaccgttgcccttgttcaaattcaaaccccagttcagggaatatctcataataagtacacacaatttgatgtacccaatcaaggtattgttctaaataatgctcgtacaggagcaagcacccaattggttggtgcagtagctgccaatccttttttaaagcaaggtgaggcacacaccattgtcaatgaggttcgtagcagcaaggcaagccaattggcaggctccatcgaagttgctggacaaaaagccaatttggtgattgccaatccatcaggcattacagttactggtgctggctttattaatgtgcatgaagcaaccttatcgacaggtcaagcaatcaacaagcaaggacatattcaccacactgtcaacaagggtgccattgtcatccaaacaccaaagagtgcgaatgtggccactcaaacaacgactaataatattggtcttggtggaccaaacaaaaacgccgacttggtaaatctgtacagcaagaccgccaacattaacgctcaagtacaggcagaatatgccattaccaccgttaccggaaccaaccagatcagtgatgtaggacaagttacgcccatcaccagtaatcaaacgactaccaatacaacaaaacccacgactgccattgacatcaagtccctaggtggaatgacagctggcagcattagcttggttggtaccgataagggctttggggtaaatcaagcaggtagtctaaatgccaaacaagccattaccatcaccgcagatggtaaaattacccactctggccaatcaagtgtacagcaaggggtggtcagcctaaaaagtaacaccgcagtgggattgaatggctcaaccagtaataaaaccaccatttgggccagcaaagacatcgccatgagtgcacctaccatcatggccaaccatgcctctttgaacagtgccagcaacatcacattgcaggccaaacaagagcttggcacaaacaacacaacaattcatgctggtaaaaagattgaggcaattgtctttgacaatccaacaccaaaaaacacaaatggtacggccagcttcaccaacacaacctttacaacccaaggggcgttgaccactgccaacttgcaaggtaatttaacacacaaccaaagcatcattgatgccgcaggcaatgtctcaagctttgctaaaggccagcaaacacttgaccataccaatatcaccagtcaggccaacatccaaatccaagctaacagcgatctgattgtcaacaacagtcaaattaactccgccaaacacaccaccatctatgttcaaggcaatcaaaccaccacaaacagcaccttgattgccaaaggcattgtcagcgatgtggtcaagggtgatcatcgtattaacggtaatggcacctaccaaggcggtgctgtcttgcttgacagtacaagccttaccttaaatggtaggctcattgccagaacgaccaaatcaccactactcaatagcaacaaaaacgcacaagtgctcaacggttctttatccattcaaacggaccgtgcgcttaccctaaacagcacaaatcacaatttagccatcggtggagatattagcctagtcagtcaacaaggcaagcttaccctacaaaacaccaatcccgttaccaatggcaatcaagcgcactataccttaaacgctcatcaaggcaatcttactttgcaaggcagtgaagtgcaactacaaggtgtcaacctaaagtccaaaaataacctcactgtctatgccaccccaagtattgtactgatggatggggttaagcgtgagtttagcaataaaaatcaaagtgggagcgatcaaaagcgtgccttggaggcaaaacttgatgaagccgccaggctaagtcttaccacaagagccgatgcattcaccaacaccaaatccagaattgaaaaccagttaggcattttaaacagcaactcaactggctttattcacaccccaaccaccttagtctcacaagctggtgacattggtgtgtatgccaaacaaggcattctttcacaaggcgccttacttaacgccgtaagtggtaacattaccctagaggcgcaaggcgtgctaccgtttgcctaccagcaaacaaccaagtcatcgcagtcaggcagctcaaaccaatctgatgccgaaacccaaactgacaaggcggcctccatcatcttaacaggcagccaaaaccgttatgaaatcggtcaagacggcaatgaccaccaccgccttttaagctttggttcaccaagcatgttaaccgctggtagagacatagacattcgtgcaaccaaagcagccactgacaagcaagatgagacaccaactttggtcttgcaaggcacaaaagcaaaagccaatggtgcaattgacattcgtgccaatcatcacctactgcttgatgttggtatcgattttgaatatagttatgataaaaccacacgcaagcacggcagatggtatagacgtaagtacacgacaacagaaaccaccaacgaatgggtggatgctgacgttgttgaactaacggcgggtgatttacgcttacaaacaacaggtaataacagcaataatgatcaaaagcaccatctagatatctatggcgctgaactcaacactactggtaacatcacactgggcgccagtggcaatatcaatctgtacgctacaaaagacactcacaccacccaacaaaacaaccagaccaagaaaaaattcctaggtattaagactggtaccagtaatagcaaatacaactttagtcaaatcgctgccgtaccagcttccttatctgcgcaattcatcagcagtcgctcaaaaggagataccctgcttgaaggcacgcgctttgagtacctcaaaggcgcacagatcagtgccggcggcaaaattcggctattggcagccttaagtgagctacaaaccgccactcaacgagaggacaattgggtcgtatggcagcgcacccaaggcgaaggtcaacacactcagacagcccaactgccaagctttacaggtacagcagcccccatgtttgaagctcaaggtggtctaaatatccaaatccccatatctgaaaaagatgttcaaaaaagacagctcaaagatgaaatcatcacccttgccagtcaaccacagtacagctatctaaacgatctggtgaatcgcaatgatgttgattggcagcaaatcatcctaaccgacaaagactgggattataagcagcaaggactgacccctgctggtgctgcgattgtggcgattgcggtggcttatgcgacaggtggcgtaggtacagctctgacaagtactgttgcaacagcaacaggcagtaccaccctaggcaccatgacaagtgctgcctttagctcattggtaacacaagccagcatcagcctaatcgataaccaaggcaacatcaagcaaacactcaaagacttaggtagtaaacaaaacatcaagcaaatgacctttgccattgccagcgctgggattggtagcaaaattaaccaaacactctcaaaaagtcttggtgtgggtgatatagccaactctcacaattttagccataaaatcagcaaaggtatcgctaatgccacttcaactgcgctgcttgaaagtaccatatatggtaccagtcttgaaaagtcattaattaaaaatctgcgtggtgaagttgccaatgctgtcgccagtgaggtctttaccgattatgtcaaaccactggataaagataccctaatagataacattacccataaacttgccgcaggtttaacaggctgtctatctgccaaagcagcaggaaatcgttgtgaagcaggcagcattggtgctgtcgttggtgagatgtggggtgattatcaagtagatgacccaaacaccctaacccaagcacaaaaagacaaactcatcaatcaagccaaactgattgcaggcatcaccgctgcctttgctggtgaagatgtcaatgtggctgctagtgtggcagcagaggcggtggagaataatacttttgcagagatgtatcccaatgaatgggatgaaatcgtaaataatactgacggctcttacagtcttgagttgcatgaagccatcagtcgtaacaagcagtacatcttaatcggtactagctttattcctgttgtcggtgatatccaaggctttgtagaggctcaaactgtaggcgatcatgtttttgcaaccataggtcttatacctggtttgggggatgtagctcaaaaagctcataaagcaaaaaaagcctatgatactgccaaatccgccaatgatgtgaagggcatgaaaagtgccattcaagagggtgtggatgttttaaaacaaaatcaaggcaaggcaggcacccctgtcgtcagccaaccagtctcaggtgttcaagcacaaagacagatacgaagtggtcaagcaaatatagctggctacactatagacaaaaatggtaggttgcacaataaccgtggacagtttacttctgacccaaataatcctagggtatcaaccaatctaatccgcccaaacttaagagctaaattaagaaggcaagttgatgctaattatattagactaccaaacggcaattatcaacataaggatactagggagattgttatatcccccacccagtacggccatacctatggacgtgaacacagacggcttgttctggcagctgagcaaacaggtctgacccaaactcaatttaatgactttattaattctcatcctgattatttcagacttgaaaacgtatcggataatatgggtcatcgcaatgagaaacctggcagtgatgatttgggtgaaatcattagacatatgaatcaatttaaacgcaaaagaggtattaaataa

SEQ ID NO: 1820 - DNA, 3816 bp, M.catarrhalis
cttggtgtttcgattgtcgctagccagctaagctctttttacaacaacgaggaaagcaaaatgagccacttactcgaccaactgcggttttttaaaagaaaacaaggtgaatttgccgacggacatggtgaagtccgtgatgaaaaccgtgactgggaaaacagctatcgggcacgctggtcatatgacaaagtggtgcgttctacacatggggtgaactgcacaggttcatgctcttggaaaatctatgtcaaaaatggtctggtaacctgggagacacaacagacggactatcctcgcactcgcccagatttgcccaaccatgagcctcgtggctgtcctcgtggggcaagctatagctggtatatgtattctgccaaccgcttaaaatacccaaaagtgcgtaaaccattattaaaattatggcgtgaagccaaagccaaacataccgaccctgttttggcatgggcaagcattgttgaaaatcctaccaaatctgctgaatacaagtcaaaacgaggcttgggtggttttgtacgctcatcttggcaagagtgtgcagaaatcattgcagcagccaatgtttacaccgctaagacctttggtcctgaccgcatcattggtttttcacccattcctgcgatgtccatgctcagttatgcgtcagggtcaagatatttatcgctcataggtggtgcatgcttgtcgttttatgattggtattgcgacctgccgccagcttctcccatggtttggggtgagcagaccgatgttgctgaatctgctgattggtacaattccgattatatcattgcgtggggttcaaatgtaccacaaacccgtacgcctgatgctcacttttttaccgaggtgcgttataaaggcacaaaaacggttgccattaccccagattatgccgaaattgccaaactttgtgacctatggctgaacccaaaacaaggcacagatgccgccttggctcaagcattttgccatgtcatcatcaaagagttttatctgaaatctcaaagtgattacttccaagactatgccaaacgctacacggatttacccatgttggtggtgcttgaagaaaaagacgataagtttaaagcagggcgttttttacgggcatctgacttaattgacaatttaggtcaagaaaataatcctgaatggaaaaccatcgccatgaaccaaaatggtgagcttgtttcaccttatggctcaatcggttatcgctggggtgaaacagggcgttggaatttggaaaataaagaaggtcaacataatggcgacgtggatttgactttgtcattaaaaggttctggcgagacggcaagcgttggtttggactattttggtggtgatgaacacccctattttaccgctgccgctggtgatgccattcagtataaaaacattccttgccataccatcagtcttgccaatggacaaaccgccaaagtcgccaccgtttttgatttgatggttgccaatttgggggttgataatgggcatggtggtcaaaatgtcaccgatgattacaatgatgccaacatcgcaggtacgcctgcttggcaagaaaaaatcactggtgtcagtcgtgaaaaggtgattcaaatcgcccgtgaatttgccgaaaatgcccacaaaactcaaggcaaatccatggtcatcatcggagcaggcatgaaccactggtatcatcttgacatgaattatcgtggtgtgattaatatgctgatgctctgtggctgtattggcaaatcagggggtggctggactcactatgtgggtcaagaaaagctcagaccacaatctggttgggcgcctgttgcgtttggattggattggcacagaccaccacgccacatgaatggcacaagctttttttacaatcactcaagccaatggcgacatgaaactgtctctgcccatgaattgctttcatctcatgccaataaatcgcaatttccagagcatatgctcgattacaacattaaagctgagcgggcaggttggttgccatctgccccccaattaaaccaaaatccactgaccattgccccccaagcaaaagccaaaggcatgagtgttcaagattatgtggttgaaagtctgcacaatgggtcattgcgttttgctgccgaacaacccgacaatccgcaaaatttcccacgcaatatgtttatctggcggtcaaacttactgggttcatcaggtaaagggcatgagtacatgctcaaatacttgttagggacaaaaaatggcttattgggtgatgaaacggtacaaactggctttaaacccaacgaaattgactttgttgaaaatgccccaacgggtaaaattgatttggtaaccaccttagactttagaatgtccagcacatgtttgtattctgacattgtactgcccaccgccacatggtacgaaaaagaagacatcaacacatcagacatgcacccatttatccacccattcaccgctgccactgaccctgcgtgggaagcaaaaactgactgggagatttataaatacatcgctaaggcattctctcgcctttgtgttgggcatttgggaacacaaaccgatgtggttaccttacccatgcaacatgacagtgccgatgaattggctcaaccctttggtggcacagattggaaaagtgcaggtgaaaaacccatacccggcattaattgcccactcatcaaagttgtggaacgagattatcccagcacctatgccaagttcacttctcttggtcctttaatggacaagcttggtaataactctaaaggcattgactgggacaccaaagaagaagtgcaacaattggggcagttaaattatcgcattcatgatgacagcgtcgccaacacacgccccaatatgagcagtgtcgtcaatgccattgaaaccgtactgatgcttgccccagaaaccaacggtcatgttgcggttaaagcatgggcagaattatccaaaaaaacaggacgtgaccacactcatttggcaaaagccagtgagcatgaaaaaatccgctttaatgacattgttgcccaacccagaaaaatcatttcaagtcccacatggtcagggcttgaatctgacaaagtcagctacaacgcaggctacaccaatgtgcatgaactgattccatggcggacaatcacaggccgtcagcaattttatgttgagcacccttggatacaagcctttggcgaacaaatgcaacaataccgtccgccaattgacaccaaaaccacccaagcatttaaaaaatatcaatccaatggcaacaaagaaattgtgcttaattttttaacaccacaccaaaaatggggcattcacagcacctattcagaaaacctattgatgctcaccttaagtcgtggtggtccaattgtttggataagtgagattgatgcccaaaaagcaggcattgaagataatgattggattgaagtctttaatgccaacggggcaatcactgcccgtgcggtggtcagccagcgagtcaaagaaggcatgaccatgatgtaccatgctcaagaaaaactggtgaatatcccaggttctgaaaactcaggtactcgtggtggtattcacaactcggttactcgcaccatcttaaagcccactcacatgattggtggttatgcccaattctcttatggctttaactactatggtacggttggttgtaaccgtgatgaatttgttgtggtgcgtaaaatggcaaatattgactggctagagggcagggctgatgatgaattgccacgcccattacccaccactttggactga

SEQ ID NO: 1821 - DNA, 474 bp, M.catarrhalis
ctgaacttgttcgctatgaaaatactcattgacgccgacgcactgcctgtcattgccaaagagctcatcatcaaaaccgccaatcgcacccaaacgatggcggtatttgtggcaaatcggatgaccaaactgccaccatcgccatttttatcgtatgttgtggttggtgctggctttgatgtggcggatgaatatatcttacagacagtgcagcccaacgatttggtcatcacaagcgacattccgcttgccaatgatgtgctagaaaaaggggcaaaggttttgaccccacggggtgaggaatttcgcaaagataacatcaaacccagattaaatgcccgagattttatggagtcgcttcgtggtacgggtgtgcttgaccccaaaagcatgggcggacaaaaaccatacagcaacaaggacaaaatcgcctttgcaggtggtctaaataggcttgctcacgcgttaccctag

SEQ ID NO: 1822 - DNA, 1218 bp, M.catarrhalis
acttcaaaaaccacgccaaaaccgcgattgaaccatgatgaaaccatgattgaacaatggaatagagagttcgtcttacaacgcctactcgctttgaccttgcttgttatcttgattgtactgtgctttaaagtagtgcgattttttatcgtgccagcattatgggcagggattttggcatatgttacctttcccatttatactttttttcacaccaaagtccgtctaagccccagttttagtgcgtttttgatgactttttgcatctcgctcatgattggcgtaccgcttattgtgggtgtgttctacctacaacatgaagtgctaagttttgttggcatggtaattcgtcgcctacaagcaggatatttagatttacccagccaaatcaaggacctacctgttatcggacagacgattaaagacacgctttgggagattaacaaaaaccctgaaaccacgatggaggcggtgcgtgcttgggtgcagtcgcatttgtattatggcaaaatggcctttgatgcggtgctaaaaaaccttgccaaacttggcatggctctgatgacgttgtttttcttttatagagatggtaaaagtttggtacgccaaatccgtcaagccatgcgtaacatcatcggcgaccgcattgatgattacattgactcggtaggagcaaccacacaagcggtggtgtatggcattggattgactgccttggctcaggcgattttggcagggatgggctatgcttttaccaacgctcccaaccccattttactcacactcatcacctttgtggtggcactcatcccctttggtacgccctttgcatggggcggtgtggcggtgtggttattatcgcaaggacataccaccgaaggcattggacttggcttatggggaattttagtcatcagctgggtggataatttaattcgacccatcgtcatcagtggtgcaaccaaaatccccttcatcatcatctttattggtgtacttgggggcttgacggcatttggttttgtggggttgttcatcgggcctgtggtgcttgccattggcttggcggtgtggcgtgagtggataagtcagcacaaaaatgagatttttattaaccaagcaagcggctttgtggtcgcagatggtaaagcgttattggctgataccaaccccacccccagcaataaacaacaacctaacttaactaaggatgactaa

SEQ ID NO: 1823 - DNA, 1986 bp, M.catarrhalis
attttatttaatgtagccaataaggaaaccgtgatgattgatcatctttcttttaaaacgactaaggccaaaagtcttcatactcaaaatatcgcccaaagaacgctcaaagcggtggctcatacataccgccctctatcaatggcgattgcactgatgggcttaagcagcatcgccaccgcccaagaatttagccaaaccgtattttttggtgatagcctaactgacacaggacgcttggtgcagattggcaaaaacagtctggcgtcttctgtttttaatcaagcccaaccatcgtttacgaccaataccgatccagtttggtcaagcatattggcaaaatcttatggacataccgccgatgccaatgatggaacaaccttaactggtacaaactatgccgttggtggtgcaagaactaaagaagatgtggtcaaaaatgcacctgttccttttttcaccattcctttatttaccatcccatcagcacaaacccaaatcaatcgctacctgaccttaaataatcatcaagccgaccccaaagcattgtatactgtttggacaggtgccaatgatttgtttgaggcagccaaagcaccaacccagttgcaagcagccgaaatcattaccaccgctgccaatgaccaagccaatttggttgggcagcttgggcaagcaggtgcaaaacacattttagtacccagtcttcctgatgttggcgtcacgccagaatacgcccaagatccgaccaaatctgccacagcatcattgtctgctcatatctacaaccaaactttatatcaaagtttaaacaaccaaaccaccaatgtcattgctgccaatacctttgccctactcaaagaggcggttagtaatccagcaggatttgggtttagtaatgtgaccgaacctgcttgccaaaacctagatgccaatttatcatcgttagcatgtaaaccaagcgactggcaacaaaccgctgcgaatgctaatgaaacttatgcgtttgctgataaaattcacccttcagggcgtacgcatcgcattttggcacaatattatcgctctattatcgatagccccaaccaaatgggtcaactaccccagcatctgattaaacatggtcaacaaagccagcaacaattggtacgccgcttagacagtcttaacaatcatcaacaatcgctatggattgatggcagcatcagcaatcaatcgcttgatacacgcaataaaatagaccgccctaccatcaaacttggacttgatattgcacgacctaaccagcatacaggggcatatttaacctaccaacaacaagattatcatctaagcgattctataaccgctgatgtcaaacaaacaggcattggtttgtatcatcgccatgattttgatcacttacgcatcagtgccaaccttggggttgaccatttaagtacacaaagcttacgccaaatcatgtgggacggtgagaatcgcaaccatcaagcacatgccacaggtcagcgtcgatatgcaagtgtacaaggcagctatggatttacccaaaacaatgttacctatcgtccttatgtcggtattcatgctcaagatatcaagcagaatcgcttctttgaaaatcaaccaaatctatcaactgctctaagttttaagctgcctgaccatcagtctttgcaagctgatattggcgttaatattgattatgccatgaatgataaactaaaccttttggcaggattgggttatcagcatgagtttaaagacaataacaaaactgttgagacagctgtattatccaaccgtgattatcatcgcagctttgtcacaaccgtgccctttgataaaaagcacacaacgcacgcacatttaggtgcaacacttgctttgggtaataacactcatttgaatgctggcatacaagccaatcaccaagatcatgatacaaaagttggtggatttgtgggtgcacaaatggcattttaa

SEQ ID NO: 1824 - DNA, 825 bp, M.catarrhalis
cattatcataaaaatggtcgctggacttttataaccaaggccgttatagtggctaaatttatgggtgattggtttatgccgattaagcctgatttattgcaaattttgtatcaagatgcgtgcatggtgattatcaataaacctgcaaatatgttggtgcatcgctcttggctggataaacatgaaacttgttttgtggtgcaaactttgcgtaaccaaatcaatcaacatgtctaccctgtacatcgtcttgatagaccaacctcaggcgtattggtctttgctttagacagtcagacagcaggattattagccaaacaatttgagaatcatcacatccaaaaatcttacttggcggtggtgcgtggtattattggtactgggcggattgattatgcactaaaactacgccttgataaaattgccgataagtttagcaatcccaataaagcatccaaatctgccataactgattatcaggttcttgccacaacacagcaaccatttatatcgtgtcggcgttttgatagttctcgatattctttggtttgcttaacaccaatcacagggcgaaagcatcagttgcgtcgccatatgaagcatatttttcatcccattgttggtgataccacttatggcgataaagtgcaaaatcgtgctgtgcttgctcatattggtgtcaaaagactgttgttgcatgctcatcagttacagttttgtcatccgttatatgatgagatgatccgtattgttgcacccttagatacggccttttgtcaagtaatgacagcgtttgggtggtctgatgtggacttgatggcttaa

SEQ ID NO: 1825 - DNA, 660 bp, M.catarrhalis
tacatcatgaataaaaccctatttttatttgtgccagcaacacgccttgattgggtatcaaaagccaagcaatctaaagcaaatgccatcatcattgacctagaagatgccgtaacagatgaccaaaaaaatcacgcacgcacagcactgatggcattagatgccaaaggcgagtgcgactattggctgcgtatcaatgccgtgcatagcatgcatcatcttgatgatattacttgtatgcttaagcttaatcatctgcttggtgttgtgttgccaaaatgccaaaataaacaccaagttgaaagcgtgtatcaccacattcataagcctgtcattgccatgattgagacagcggtggggatggcaaatattgctggtatcgcacacgctgatgggctttgggcgatgagttttggtagattagatttgatgtatgagctgggtgtgcaaccagattcgccagcatcacagctgatttttgataaaattcgtactgatttattgattcattctgtggcaaatggtcttcatccgcccattgagaccatttttaatgattttgaagatgaaacaggattggccgcttgtgtacgccactggtgcgattttgggtttgcaggtcagatgatgattcatccaaaacaaattgccgttggctga

SEQ ID NO: 1826 - DNA, 579 bp, M.catarrhalis
cttattcgtttattatttttaaggattatcatgtcaaacacccaacacgccccaagtcctgctcccatcacatcccccactggcaccccaaaggttggtatcatcatgggcagtcagtccgattgggcaaccatgtctttatcggcacagattttggcagattttggcatcccctttgagtgtcaagtcgtctcagcacatcgcacaccagataaactctttgactatgccaaaaccgccaaagataagggcttaaaagtcatcatcgcaggggcaggcggagcggctcatctgcctggtatgtgtgccagccaaaccccattgcctgtgcttggcgtacccgtcaaatcaagcacactgtcaggctgggacagtttattatccatcgtacaaatgcccaaaggcgtggcggtcggtacgcttgccattggagatgctggtgcgttcaatgctggactgctggcaatacagatacttgccatcgatgatgatgcccttgccacaaaactggatgaatttcgccaaaaacagacccagacagtgctaacaagcccccatccagggattgtcaatcactga

SEQ ID NO: 1827 - DNA, 270 bp, M.catarrhalis
gatcatcctgatttgacgattgactttaaagactcactaacaggtgcaaaattattcaccaaaggcgatgttgcagcattaatgaccgccattcaagatggtgatgttaaaatcatgggtgattacaaattggtactttggcttgcaggtattggtaaacaagccgccagcattcccaaagaatatcaaggatatattgatgccattaagccatacgccaaacgcaccaaaggtttttttgacggcatcaagcaaaaaatgaccaaataa

SEQ ID NO: 1828 - DNA, 556 bp, M.catarrhalis
gaagactgagtattatcagcaaggtaaccatgccaaagcatttgaatggtacaccaaagccgcaggtcaagggcatgcagatgctcaatatgaactgggcgtgatgtatggcctaggcaaaggcgtgctccaagattatcaaaaggcggtggaatggtttaccaaagccgccaatcaaggcgatgcttgggctcaaaaaaatctgggcgtgatgtataggaacggtcaaggcatgcgtcaagattatcacaaagcatttgaatggtttaccaaagccgcccatcaagggcatgcagatgctcaatatgaactgggcgtgatgtatgcccaaggccatggcgtgcgtcaagattatcaaaaggcgtttgaatggtacaccaaagctgccaatcaagggtatactttggctcaaaataatctgggcgtgatgtatgagaacggtcaaggcgtacgccaaaataaaagcaccgccaaacgctactatggtcaagcctgtgatcatggaaatcagctgggctgtgatcactaccgcaggctaaaccaacaaggctactag

SEQ ID NO: 1829 - DNA, 909 bp, M.catarrhalis
ggcaaattttgtatgatggccagtgagtatgcacctaccttaactttgatgaatgccaaaaaacgggctcaaatgctacagcatattcgagcattttttgaggcacgcaatatcatggaggtcacaacaccgatattatcgcaagcagccaatactgatgtatatatccaatcggttcaagcaacatttcaaggtgctacaggtcaaaccaaaggctatctacatacatcgcctgagtttgcgatgaagcgattgcttgctgcttatcagacgcccatttatcagatatgccaagtatttcgtgataacgaaaaaggccatcgccataatattgagtttaccatgctagaatggtatcgcccaaattttagcctagaggcattggctgatgaattatcagaactattaagcgttgtttatcaaaaacccatccacttaacccaaattagctacgcccaagcatttgtacattatttgggcatacacccatttgatgatatgagtacgccagatatcttgcgtcagtgtgctgtcgctcacaacattcatttggatatgggcgatgacaaacaaggctggttagatttattatttagccatcttattgagccaaaattgggcttacaaaaccccaccttggttatcaattatccaaagcttaccgccgcccttgccaaaacagcggtcgatgctgatggttatgagattgcaagacgctttgagctgtatattcatggcgttgagattgccaatgcttatgatgaacttgccaacagccaagagctgctaaagcgttttgaacaagataatcacgaacgccaccgccaaggtctgcccatcatgcccattgaccatcgtctgcttgctgcctgcgatcatctgcctgattgttgcgggcattggccttag

SEQ ID NO: 1830 - DNA, 1059 bp, M.catarrhalis
ctaatgcttcgggttcttgctgatgaaaatattgccaatcttgatgattatcttttatgtcatcaggtggagcttatcaagatggcagggcgtgccattgaccgccaaagtctcatcacccatcaaccagatgcattattcattcgctcagtaacgcaggtaacccaagaaaatttgggcgacttgagcaacacaccgcttaagtttatcggctctgcaacgatcggtattgaccatattgacaccaagtatcttgccgaccatcatatcaattttgccaatgcatcaggctgtagtaagcattcggttgcccaatatgtcataacagccatattgcatgcccatcaatccccaaaaaccaatctgcgattaggcattatcgggcttggcaatattggcaatactctagcacgctatgccaaacgactgggctggcaggtatttggctttgatccttttttggcgactgactctatcaacaatgcaagcttagatgagattttagattgtgatgtcatcagcattcatacaccattgacaaaaacaggtagccacccaacttatcaaatgctaaacgctcaaaccttggcaaaaatccgcccaaaggccttactgattaacagtgctcgaggagaaattattgatgaatccgccctgttagctgccattaaccaaaagcaattatcggttgtgttagatgtttttcctaatgagccattcatcagccaacagctgctttatgcactcaaactggcaacaccacacattgcaggctatacccttgaaggtaaaatccgtgggactgatatgatttatcaagccttttgccaaacctttaacttaccaatcctccagcactttttggcattactaccgcccaacccttatcatttttctatgctcttaaaccataaaaaccaacagccactggcttggttttatgatattcaggctgattttaaaacactaaaagcggcagcttgtccacatattttgggtaatcaatttgacatgcttcgcaaaaattaccatttacggcgagaatggatttttgattaa

SEQ ID NO: 1831 - DNA, 993 bp, M.catarrhalis
caggcaaaaagtagattaagatacaaggggattgtgatgatttatgacattattggcgacattcatggacacgccgacaaattagcaggactgcttgataaattgggctatattcatgatggcatcagtcatatcgccccacacggtcatcaagcgatttttattggtgattttattgacaggggcaatcagcagttagccacattacaaattgtctttgacatgcttgacaacaatcaagcacttgccatcatgggcaatcacgaatacaatgccatcggctacgctacgccacatcctgatggtggctattgtcgcccccataccagccgaaataccaagcagcatcaagcatttttggatgaagcacccattggttctgatgactactattattggctctctcgcctttatgaactaccgctatggcttgagctgcctgaattgaatatcgtacacgcctgctgggatacgaaggcacaagcagcacttgcaccctatctcacccctgaccatcgcatcacccagcgtggtatcatcgcaaccgctatgagtggctctaccgagttttatgcgcttgaaagacttttaaagggtatcgaaagccccttacctgcaggtgttgtactcgtggatgggcatgacatcgtgcgtaggcgtactcgtatcaaatggtggcaaaaagactggcaaaatcacccactgtctgagattgcacagcttggcactagagcgacaatgaacctgcccagcgacttagatatcaaacctttgccgatggattttgagctgaccactcatcagccaatttttattggtcattattggcttgatggcacgccaagcatcttatcaaatcaggtggtttgtactgactattccgctggcatgaatggctacctgactgcttatcaatttgataccaaaaaccccatactatcaaatgaaaattttgtacagtatattcataccgcagataaatccaaagaataa

SEQ ID NO: 1832 - DNA, 444 bp, M.catarrhalis
tttttaatgggtgaaactgtgtttttatatatcaaggcttttcatgttatttcgatggtttgttggtttgcaggaattttttatttgcccagattatttgtctatcatgccatgagccaagatacaaccagtatcgaacgctttagcctgatggagcgtaaattgtatcgtggtatcatgacaccatcgatgattgccacatggggttttggtctttggatgataagcttctcgccaagcttatacttatctcaaggctggttacatgcaaagctattgttggttattttgcttagcatctatcatttagcatgtggtaaatttcgcctaaaactggctcaaaacccgcactataagagccatgtttattggcgatggtttaatgaaattcctgttgtcatattaattgcagtcgtgattttggtaatcgtcaagcccttttga

SEQ ID NO: 1833 - DNA, 1212 bp, M.catarrhalis
atgctgatgatgccccatatcccaaatcaagcaaatcaagagaatgcgatgacaaacctatttccccaagactggcgatttgacaccgcccaactcaaaggcataagcacagatggcaaatggctattaccgccccttgttgatctgtgtgccagattgcgagaaccgggacatcagtcgcacggcacactggcaagcgaggggcgagcggcacgccaaaatggctttttacatgtggtcatgccacctgataccagccctgtgctagaaaatggctctttgttaaagggtctcaaacaaaaagcatgggcagacggtggcatttacttgcatgttttgggggcattgagtgcaggcttagagggtaaacaacctgccaatctggcaggactaaaacaaggcggtgctatcggcgtgagcaatacagcggcaggttttgagagtgatttggtattgttacgctgtttagaatatgcagcgacctttgacatcaaagtcttcttctaccctgatgaacccagtttatcggcagggggtgtggctcacgatggctatatcgcatcttttcatggcttacaaggcattccgtggctggctgagaccattgcactgtctaagcaaattttgatgaccgaagagacaggcattcatgcacattttagccaaatcacttgtcgcacctcggtagagctaatccgtcatgccaaacaaaagggcttgcccattacctgtgatgtggcgatgcaccagttacacctgaccgatgatgacattgagggttataattctcatgcttatgtcttgcctcctttgcgtagtaacaccgaccaacaagctcttatcaagggtcttcaagacggtacgattgacgccatctgttctcatcatgaaccactgtcaagcagtgccaaacaagccccctttgcccaatgccaagcagggattagtaactttgatacttttgtgtcattgggggtgaaactggtggcagatggcgtgttaagtactgagcagttggtagaaaaaatctgcctaaatcctgccaaaatcgcaggcattacagattatgagcgcattggtggggcggtactcattgacccacatcaagcatggacggtaaccaaagacaccatgctatcagcaggcaagaacacgccttttttggggcagacgctgatgggaagggcagaaaaagtcttttttgatggctaa

SEQ ID NO: 1834 - DNA, 1044 bp, M.catarrhalis
ttaatgaagatacttatttcaaaggaagaaatcgcacgcttattcgagctacctttgatggatttgctgatgcaagcacaaacggtacaccgtgagcatttcaacgccaatgaagtacaaattagtacgctattatctatcaaaacgggtaattgccctgaagactgtggctattgctctcaatcgggtcattatcgggataaaacaggtctgaccgccgaaaagcgtttagaaatcaaaaaagtgcttgccgctgctcgccgtgccaaatcacaaggttcatcacgcttttgtatgggtgcagcttggaaacaccccagcgaaaaagacatgccttatttggtggatttaatcagtgaagttaaggccatgggacttgagacttgcatgactttaggtatgctaaagccagaacaagccaaaactttggcagatgcaggccttgattattataaccacaatcttgacacctctcgcaattactatgatacggtaacaagcacacgcacttatgatgaacggttggcaaccattagccatgtgcgtgatgcaggtattaatgtttgttcagggtctattgttggtatgggtgagagtcgtgaagaccgtattgattgggtgtatgagctgacccaaatgcccattccaccgcagtccattcctgttaatttacttgtaccgattgctggtacgccacttggtgataaagtcattgccgaaggtcgattatcggtcattgaatggattcgtaccattgcggtaactcgtatctgttgcccaacaagctatgtccgcctatctgctgggcgtgaaagtttaagtgatggtgagcaagcattggcgtttatggcaggtgcaaactcatttttttatggtgataaattactcaccacaggcaatcagtccacatcacacgatgaccgtctgatggctgagcttgggttaacgccctctaaacctgccccaaagcccaaaattattgatgctatgagtggtgcggtgatgactgccgagatgccccataattgcccactgtcagcatag

SEQ ID NO: 1835 - DNA, 780 bp, M.catarrhalis
aggcagtctgtttccgccgaccaatgctttggaaatcgcccaagaccgattggcagaaaaggtattgttaaaccgctaaatattgacaccgtaccatttatggcagtaaacagcttagatgagctacaaactgccaccaacaaacttgggttacctttggtcttaaagaccagccgaggcggctatgacggcaaaggacaatttgtcatcaaaacacaaagcgacatcgccaccgcttgggaggagcttggcgacgctgtcactggtgatggcgggttgaccgacgcacctgcaccactcattgccgaagggttcattcactttagccgtgaagtctctatcatcgctgtgcgtagtcaaaacggtgatatttgttactatcctttggttgaaaatcatcacaccaatggcattttatcaaaaaccattgcacctgctgccaacgccgaccatctcaccgagcaagcccaatccaatatcagtaaaatcctaagtcatcttgattatgttggtgttctgaccttagaactttgtgtcagtgatgatggactcatcgccaatgagattgccccacgcgtgcataactctggacattggacgattgagggggcaaataccagccaatttgaaaaccacatccgagccgtattgggcttaccgcttggcgatacaggcatcatcaagccgtctgtcatgctaaatgtcatcggcaaatatcctgatgtcagcgagcttttgacccatacaggagtgcattttcatcattatcacaaggcatag

SEQ ID NO: 1836 - DNA, 399 bp, M.catarrhalis
cgcccattttttattaaaatatgcgataatatccaaaattttttgctaattttttggatatcttttatgactgattccatcaaaaccatcggtattcttggcggtgggcagcttggcatgatgctggctcaagccgccttaaagctcggccatcgttgcgtttttttagaagatgctgacggtgtgccagctgctttatatggacaagtatttaaatacaatgagcttgatgattttatcaccgccagcgatgtctttacattggaatttgaaaatacgcctatcaagacggctaaatcactggcaagccttgagcataaaggcagtctgtttccgccgaccaatgctttggaaatcgcccaagaccgattggcagaaaaggtattgttaaaccgctaa

SEQ ID NO: 1837 - DNA, 306 bp, M.catarrhalis
agtccaccgccacggacaaggtacaaaagggggactttaaatcaggctattggcaaatcaaaaagtggcatgagtaccaaaatcttggctttggtcgacgcattgggcaatttggtttcattcaccctattacccggacaacgtcatgacattgtcggtgtcgaagcactaattaaagacaaagagtttaatgctttactggcagacaaaacctttgatgcagattggctgttagaggaactgaacgaaagggcttgccaagcggtgattccaccaaggcaagcacgccaagcgtggcaagggtga

SEQ ID NO: 1838 - DNA, 1077 bp, M.catarrhalis
aacaataggacaatcatggcaacttttcgcaaaatcctaaaccccatcagcctaaaaaaccttgaactcaaaaaccgcattgtcatgcccccaatgtgccaatattctgctacggatggtgtgccaaatgactggcatttgctccattacaccagccgagcggtgggcggtgtgggcctcattatcgttgagatgaccaatgtcgctgccaatggtcgcattacggcgaactgtttggggctttggaatgatgagcaagaacaagcgtttaaaaaattggtggacagcgtgcatgcacaaggggcgaaaattggcattcaaatcgcccatgcaggtcgtaaagcccaagatgagccaaatgccgttgccccgtctgccattcattatggtgagcttgactatgctgggcaaaatctcatcaccccaaggcagctgagcattgacgagataaaagcattggtacaagcatttgccgactctgtcaaaagagcggtgaatgcaggctttgatgcaattgagcttcacgccgcccacggctatttgattcaccagttttgtgcacccaaatccaaccaacgaagcgatgaatacggacaagaccgcctattgtttggcgagcaagtcattcacgccgttcgtgccgtcatgcctgatgagatgcccctaatcgtgcgtatctctgcccaagagtatggcgaaaacggctttgacagtgattatggtgtggagattgccaaacgcttctcaacagctggggcagatgtgtttcatatcagcggcggcggcgatggcgtattgtgtgagggcaagcaccctgagttttatgcaggctatcaggtggcactggctcgcaaagtcaaacacgccacaggcaaacctgtgattgctgtgggcatgctagatgaccctgccgtggctgaccatgtgcttggcgtgggcgatgccgaccttgtggcgataggtcgtgggctgcttcgagacccatattgggtgctaaatgcccagtatcagcaaaaccgctcagatggcaaagaggtgcagtttgtgccaaggcaatatgagcgtgggtttatgtaa

SEQ ID NO: 1839 - DNA, 240 bp, M.catarrhalis
cccaaatttgccataataatgtacttgcaacctaagccaaaaaaaccattaggacacccaaatcctaatggtttgatttatttaatccacaatgaaacctttattgaaaaaatccttaaattcacccttgccacgcttggcgtgcttgccttggtggaatcaccgcttggcaagccctttcgttcagttcctctaacagccaatctgcatcaaaggttttgtctgccagtaaagcattaa

SEQ ID NO: 1840 - DNA, 1419 bp, M.catarrhalis
cgatgtgttgcaaggagtgataaaaatcgtgatgacaagcaatgccagcgaccctgccgaatggcaaaaatacaatcaggacaaaaaacgctggaaaaacgctttaaagacccagacgaccccctaaaaatcgtcatcgtgcgagatatgtggctcacagggtttgatgccccttgttgtaacacgatgtacattgacaagccgatgagtggacataacctgatgcaggcgattgctcgggtcaatcgggtgttccgtaacaaaagcatggacaatggcggtttgattgtcgattatgtgggcttgaccgatgagcttgaaaaagcgatgaagcaatataccaacgcaggcggcaaagaaaaacctgtacgcaatattgagacggttttggaaaaaatgctcgaatatgtcagcattattcgggggcaatttgccacacctgtggatggacaaacggttgatattggcaaaattttgcaaattagcgaacctgccaaattgctgaatgcgattttgacctctgccaaccatattttggccctagaccgaatctatcctgatgacagcaaagacaaaaagggcaaaaccccacgcaaaaatgcttttttgcaagcggtacggtttgccaaaaaaggttatgccctttgcggtgcgttaaaagcggttgaaccttacaaacaggaactggctttttatgatgcggtgcgtgccaccatcatcaaaaacagcactgcctctcgcaatccttcgggcaaagaccgcttgttacagctaaccgtcttgatgaaccgtgcggtgcagtcggacggtgtggtggatttatttgatttattaaaaaaagaacgcccaaacatcaatctactttctgatgaatttttggaaacggtaaaaaacagcccaaccaaagatttatggattggtgcgatggagcgttatctggtgtccgagttgcgcacacaaagcggggcaaatcttgccaccaaaaaagagtttgagcaacgactcaaagaagcaatgaaccaataccataaccacaatttatccgtgttggaaattttggaagaactcatcatgcttgccaaagagtttgacgctcgccaaaaacgaggggaagagctgggattaagtcctgctgaaatggcgttttatgatgcattggctcgcaacgaaagtgcggtgcgagaaatgggtgatgcggttcttttgaaattggcacgagaaatcaccgaaaaactgcgtaaatcggtaacgattgattggcaatataaagacttggtgcgtgccaaaatgcgaacgctgattcgtattaccctacgcacctataaatatccgcctgatttacagaatgaagcgattgaatttgtattgaaacaggcggaggagattgcggaggatttggtaccgaaagaaacggcttga

SEQ ID NO: 1841 - DNA, 1218 bp, M.catarrhalis
gtggagggttatccaatgaataacgaagaattgtcttctagttactttgatgaaatcaaagaatggcaaagtggcgaacctatttttgtctctaaaaacgatgagataaatagtcgtatccctttattaagagtaaatggctggaaaaagtttattgatttactttctacaaattttttccaagaaaatatttctgaactcatttttagagggcaacgccgatatgattggggactaatgcctaatattgccagaaatagtgataacggcttgtttactaaagaattgatggaaaatcagcttaataactttaaaaaagccattcgcggtcggattaaagattatactttattgcttaatgaagatgatgatgaaatttgggcaattgggcaacattatggattgaatacacctttattggattggacatattctccttatgtctcattattttttgctttttcacgcaaagatgttaaagctgaaaagccaaatgaataccgagttgtttatattgcaaataagaagttactttctaactttgttacctttgttgaccccaaagtggatatgtatgggagattggtcaatcaagcaggtttatttattaaagcagaagcaggaaaatcgatagaatctttaattgtagattctattgcggagcagaacggaagtgaatttctctctgatgagtcattcgaacaagaaatagcaaaatatctctgcaaaatttatattttaaacacaccagacattcaaagtgattgcattttatctttgcgacaaatgaatattcatcacgccaatttatttcctgatttaatgggggcagctgactattgcaatctactttctgagtttcaaccagataacaaaaacccaaaaattcttgatagttcaacgctaaatcattgcgaatctccaactcttgcaaataacgaaggcagtatccttactcttacaaacaatagctctattaataatattaaggaattattaataccttatctagctcttcctgatacagacctagaacaaatagccaataagttactcaatattctaaaaaccaatatggtaactgactggcaaacacgagatgaaattaaagcaaaaatcaaaattgcatggcgtagaatcctatctcaaaccaacatgaataaagaacaaatagaaaatatgttagatgaattattcacattagattttcagccataa

SEQ ID NO: 1842 - DNA, 699 bp, M.catarrhalis
atacattatcataatcattcattattttggagttcaaccatgcaattttttaacaaagatgacgttttaaacgcctttcattatcgtgtgtctactcgctcgtatgatggcgataaaaaaatccctgctgaggattttaactatattttggagttggggcgtctaagcccaagctcggtaggttctgagccttggcaatttttggtgttacaaaatgccgatttacgccaaaagttaaagccctactgctggggcattccgaccatggaaacatcgagccacattgttgccatacttgccaagaaaaatgcccgttatgacacgccttattttggtgaaatcatggacagacgaggtttgacgggtgatgaccgtgccaaagcattggaggtgtaccaaaaattccaagaacaagacatcgccatcttagacagcgaacgcagtctgtatgactgggcaagcaagcaaacctacatcgcacttgccaatatgatgacaggggctgccatgattggtgtggactcttgtccgattgagggttttgcttataaggaggtgaaccagcttttggcagacgagggtttgtttgacccaaatgagtgggcggtgtcggtcatggtaacatttggctatcgtgataaagagattaagcccaaagcacgcaaaacttttgagcaagttgtgaagtttgtggaataa

SEQ ID NO: 1843 - DNA, 663 bp, M.catarrhalis
ctgtataatcatagcaatataaaaaatgggattcttaaaatgattatgaaaaaacatctgttcatcagtgtaatacttgccttgacattaagtttgtcgggttgcggttataacgcactgcaagcccaagatgagcaaacagctgccgcttggtctgaagtggttaaccaataccaacgcagagctgatttggtacccaatttggtacaggttgttgagcgttatgctaatcatgagcaggccgtatttagcgaagttgctgaagctcgggcccgtgtgggtagtgtgcagctgacacctgaagcattgaacgacccccaagccatgcagcaatatcaagacgctcaaggtcagatgacctcagcactgtctcgcttgatgatggtatcagaacgctatcctgagcttaaggcagatgcattattccaagacttacaagtacagcttgagggtaccgaaaatcgcatcacggttgcacgcaatcactacattgaagatgtccgtacctataatacaactgtacgccaatttccaaccaatttgacggcgatggtatttggtatgaagcctaagcctaattttagtgttgaaaatgaagcggcgatctcagtggcacccacggttaattttggcaataacaccaatactggcactgcacagtaa

SEQ ID NO: 1844 - DNA, 381 bp, M.catarrhalis
ttgaattgtctgcattaccaagaacctcctgcaccgccaccaccgaagctgccgccaccgccactaaaaccaccgccaccaaagccaccgccaccaaagccaccgccaccaaaaccgccacttcgcccaccgctaccaaagttaccgctaccatctgtgatcggtaagacaccacgagccaataaaaatacccataatatgactgcagcgatcattaccacaaaaaatccagcaccactcatcagtgccacaataacaaatccacctgcaccaaaggttgcacccaaaaatctaccaagaatcgcccccaaaaaagaacctgcaatcaacgcaatgataaataagccaatgatgtctatatccacagaatcatcagtctga

SEQ ID NO: 1845 - DNA, 1911 bp, M.catarrhalis
attttcagccataaacattattttcacggagaatccataatgctaggcatcaacgaaaacaccatcgaacaatccgccattgccacaatgcaatctttgggctgggattatgcctacggcaaaaccattcttttgggctgccaaaatgaatggcgagaacggacaggcgaagtgattttaaagcccttgttggcggccgccattgcaaaattaaaccccaatttgcctgctgccgaggtggaaaatgtggtggcgatggtttgccgtgccgacactggcgaccttgccgagcgtaaccgcggggcctatgaatggctaagaaatggcgtgccgtatcgttatcaggcacagggtgagcaaaagtttgaagtggtgcgtttggtggattttggggtgcctgcccacaatgattttcgcattgtcaatcagctggatattggcggtaaaaaaggcaaacgcattccggatttgattggctttgttaatggcttgccactggtggtgtttgagctcaaaaatccactcaaagaaaatgccgatattggcaaagcgtttgcccaactgcaaacctataaagatgaaatttccgatttgtttgtgtttaatcaggcgttggtgatttcagacggtattgtcgcccgtatcggttcgctgacggctgattttgagcgtttcaccccttggcgtgtggttgatgagaaaaacaaaagccaacggattgtgtttgaaaatgagctagaaggcttgttacaaggcttgatgacgccaaaaaatctcttggattatgtacaaaattttgtggtgtttgaacgagacaacaaaaaccgcaccattaagaaaatcggggcgtatcatcaattttatggcgtgaatgaagcggtggaatgcaccctacttgccagcagtcatacaggcaaccgcaaagtaggcgtgttttggcatacgcaaggttcgggcaaatcgctttcaatgctgttttatgcaggcaaggtattaagtcaaggcagcctgaaaaatccgactttggttttggtcaccgaccgcaacgatttagacggtcagctttatgctaccttttgcggtggtgaggcattgctcaaacaaactccagtccaagtcgatgggcgagatgaacttcgctctgctcttgccagtcgttcggctgggggcgtgatttttaccaccattcaaaaatttggtttgatggaagatgagctaagccacccaattttgaacgagcggcaaaacatcattgtcattaccgatgaagcccaccgttcgcaatatggttttagccaaaaaatcaacgacaaaggacaataccgagagggttacgccaagcatttacgcagtgccctgcccaatgcgtcctttattggttttacaggcacgccaatcgcccttgatgacaaagacacccaagaagtgtttggtaaatatgtgtctatttacgattttgaagatgcggtgaaagatggagcaaccgtgccgattatctatgagccacgccaaatcagcttgggcgaaagtcatgattttgacaaggtggtcaaagaagctcaaaccctgcttgatgacgatgaacaaaatccgacttttcgtttgcgtgaaaaattgcacggtgttgaaagccgtttgcaaaaaatggcggaagacatcattgcccattatgatgagcgtaccaaacagcaagacggcaaggcgatggtcgtggtgatgagccgtgccatttgtgtgaaattgtacgaaaaaatcattgcaattcgccccgattggcattctgacgatgtgttgcaaggagtgataaaaatcgtgatgacaagcaatgccagcgaccctgccgaatggcaaaaatacaatcaggacaaaaaacgctggaaaaacgctttaaagacccagacgaccccctaa

SEQ ID NO: 1846 - DNA, 252 bp, M.catarrhalis
ctattttttaagccatggtttggttgcaataaccttcttcttgcatcaaaaaagtatactaataaaattctatttattttcaatacattggcaatcaaaaaacagataaatatcagcgttgatgataaaaaacccaaccctaaggtaaataatattagatttacacttgaattggcaaaaaactcttcaatgcaaatagctaaaaatatcaaaaaaccaaaaattaatgaaacgatgaattgctttttttag

SEQ ID NO: 1847 - DNA, 282 bp, M.catarrhalis
aaaatagttaaatacattatgaaaaaatgccctaactgtcataaaaaatgcattgatgtcctagaatattctggcaaatgcccttgttgcaaagaagccatacaaacgccagtatttttttctgcatatctaatgattgtcttgatgattgttatgtctgttggtgcatatatcaatagttattttttgatgacatttgcttttttaatgattgtcatctataaactattttcctatcaaatagatttactgttatctccattgatggttaaaaatgaataa

SEQ ID NO: 1848 - DNA, 621 bp, M.catarrhalis
aagtatccgaaactctggacacccaagcggtcgccccgctactgtgtgcaggcattaccacctactcgcccctgcgtcattggaaagtcggcaaagacacctaagtgggcgtggtcggactgggcggactgggatatatggtggtcaaacttgctcatgctatgggggcggaagttacgctctttacccgttcgcttggcaaatccgatgacgcttactgcttgggggcgagccgtgtggtgctgtccaccgatgaaaaagatgttcgaggtggcgaacacctttgatgtcatcattgacaccgtgccatacacccacgatttaaagccttatgtgccgacacttgccttggacggtacgctggtactggtcggtctgatgggcgagctggaacaaaccattaacaccgtgccgatgattatgggtcgccatagcatttctgcgtctgtgattggcggaattcgtgagacccaagaaatgttggatttttgtgccgagcataatatcgtgccagatgtggagatgataaatatgcaagacatcaacaccgcctatgagcatatgcaaaaaagcgatgtgaaatatcgttttgtgattgatatggcaagccttaaagcataa

SEQ ID NO: 1849 - DNA, 567 bp, M.catarrhalis
tggcggtggcggcagcttcggtggtggcggtgcaggaggttcttggtaatgcagacaattcaatcaaccaaaagtttggctcggctgtttcgtcagatggtttatattccctcactgcataatcgctggctgactaaaactgtcaagaccacattgacacaagcgattatacaggcggagctgggtcatcgtggggagatttacctgattattgaaaatcacttacctattaccaatgcctatagccaagattgtcgtgagcgtgccttatatttgtttgcaacgcacaaggtttgggatacagagcataattctggcgtgcttgcgtatgtcaatttgtgtgagcataatcttgagattattgctgatcgtggtattgatcaaaaggcacatatggatgattggcaaaatatgtgtgatgatgcggtagctcaatttcgccaaggcaagatgcaaataggtttgacaacgctcatcactcagcttggtaaattattaaaactgcattatccaagtagtgatgagatgggtaatgagctgtccaatcaagtcacttaccttaggtag

SEQ ID NO: 1850 - DNA, 504 bp, M.catarrhalis
ataccaaatggggcaaaaaatcaactctacggctctattgaagtcgatgaaagctactttggagcgaaacgccaaagaggctatcatggtaaactcaaacgaggtcgtggcacattaaaacaacctgtatttgaaatctttgaacgagatggtagggtttataccgaaatcgttccagattgcacagctaaatcgctacaagccattatcttgggtaaagtatcacctgatagtgttatctattcagatgggtggcgtggctataatggcttggttgatgtgggttatgctaaacactttcgggtaaatcatagcaaaaatgagtttgctcatggtaagtgtcatatcaacggtattgaatccttttggagttttaccaaaagaaggtttgcaaaatttaacggtgtaagcaaaaatttcgaatggcatttgaaagaatgcgaatggcgctggaagcagaatattgatgatttagaaaaacatctatggttgcttctgcaataa

SEQ ID NO: 1851 - DNA, 1383 bp, M.catarrhalis
aggggttggggttttaaaatgagtgatacacaaaccagattagatgagattgcagaattaaatccaacccgtgcattgaaaaaaggaaaaatgacttcttttgttgaaatggcttcactaccaacaaattcacgagatattgagaatatcgcacaaaaagaattttcaggtagtggaagtaaattcaaaaatggagatattttatttgcccgaattacaccctgcttggaaaatggaaaaacagccaaagtagcaggactccaacacgatgaaattgctcacggctcaactgaatttattgttctttcagccagagaacctgaatttgacgaagattatctgtattatttttgccgattatctgaatttagaaactatgcaaaatcaagaatggaagggacatctggaagacagcgtgtctcttggcaagcattggcagaatttgaatttgactttcctgataaagaaatcagaaaaaaagctgctgatatgctgaaaatttttgacgacaaaatccaactcaacacccaaaccaaccaaaccctagaagccatagcacaggcaatcttcaaaagctggtttgtggattttgaccctgtgcgcgccaaagcagccgccctaagcgaaggcaaaagcgaatacgaagccaatcttgcggcaatgtcggtgatttgtggcaaagacaccagcgagttaaacgacaccgaatacaaagcgctttggcaaatcgccgaagccttcccaagtgaattggtggaaaatatagaatttggcgaagtgccgaaggggtgggaaaataccacattatcagagatttgttcaatgcaaaatggttatgctttcaaaagcaatgaatggacaggcagtggcattccagtcattaaaattggttctgtaaaaccaatgatagttgatattgaaagtaatggatttgtttcagaagagaatgaacatatacgttctgattttctccttaaacaaggagatattgttgtcggattaaccggatatgtaggtgaagtcggaagaattccagcaggcgacaaagctatgttaaatcaacgggtagccaaatttgttcctaaaaaattagaccatgaattaagctattataattttgtttattgcctagcaagacaaagaacatttaaagaatatgcggaattaaacgccaaaggttctgcacaagcaaacattagcacacgagaattacttaattaccctatttgtttggctagtctagaagttcataaattttttgagataaaaataaacgaacttctttataaaatattaaccaatagtcaggaatcaaaagtattagaaaaaactcgagacctactcttacccaaattattaagtggagggttatccaatgaataa

SEQ ID NO: 1852 - DNA, 351 bp, M.catarrhalis
tggcatgctattgatatgaacagattaatgctaagtgatgcccaatgggccaagatagagccgctttgtgccggtaaagtcacagatgccggaagaagcgcaaaagacaaccgattgtttatcgaggcagtgttgtggattattcgtacaggcagtccctggcgtgatttgcctgaagaattcggtaagtggaacagcgtgttccaacgctatcgcagatgggtcaaggctgagcgttttgccgtaatctttgaagcactgcggggagatcctgatatggaatacgctatgattgacggcaccattgttaaagtccaccgccacggacaaggtacaaaagggggactttaa

SEQ ID NO: 1853 - DNA, 603 bp, M.catarrhalis
  unsure (28),(47),(53),(116): Identity of nucleotide sequences at the above locations are unknown.
gcgtgtgatatgaccgatatccgaaccntagacctaacctatttaanagcctntgttgtcttgctggacgaatgcaacgtcagccgttcagcacagcgactgtccatcacccaacntgcgatgagcggtactttaaatcgcctgcgagagagttttaatgacccgttatttgtgcgggttcagcacggcatgcagcccaccgatagggccattgagcttgggcatgtcgctcggcgtgtcttagaagagataagcggcatgcttgccccgcctaaactagaacctgccaatttgtccatgaccttacgcattggggcgatggattatgtacagcaaatcatcgctttgcccttgattttaaggctaagacggcttgctccgaatgtcaaagttgccttattgcctgtgcaagggcaaaacatcaagactttgtttgataaaaacgccattgatttggcactggttgggcaacatcacatcagtgatgacatgcctcaaatgcgattatatgaagagcattatgtttgtgtgatgagcaaaatgcaccccatggcaaacaccgctttaacgcttgatgagttttgcaaattgccctttgtcttc

SEQ ID NO: 1854 - DNA, 351 bp, M.catarrhalis
attcacgaaatcatcggacgcattgccaaagtcggcgacaacgcccaaaaatttaaggtaggcgacttggtgggcatgggctgtatggtggattcttgccatacctgctcgccatgttcatacggtttggagcaatactgcgaacacggcaatataggcacttacggcagtcttgaccgtcatgacggcacgctgacccaaggcggttacagcacgtctatcatggtgagcgaagattttgtgttaaaagtatccgaaactctggacacccaagcggtcgccccgctactgtgtgcaggcattaccacctactcgcccctgcgtcattggaaagtcggcaaagacacctaa

SEQ ID NO: 1855 - DNA, 213 bp, M.catarrhalis
gcagtcttggtcgcatctatgtcaatgcagaagcattgtatgatttttttgactttgtatttgcttaacttactgttgtatctcatgtttctagtctatcagattgtttctgctagtctagagccaactcacattcttgatgggtatggttgccatatgatatattctggtataaaacacttgacaaacaccagttatcgttcacaacagtaa

SEQ ID NO: 1856 - DNA, 1116 bp, M.catarrhalis
ctttgtgtggttaaggtaatgcaaaaaatgcacgctcatactcaagcgatacagcgatgggtgatggcgattttactaccaattttattaatttttggtgagaccgcttgggcttctgagtctgtatctgaagatgatttgacagcactgattatcagtgctaatcgtgcgtcccaaagtaatccaaattcactactggcagaatctgtgcgtgaatttgagcaggctattaatcccgccaatcaagcagataccaaaccccaatcaacccccatcaatataccaacatctcacgcacaaagtatcagccatgacaagctgattttaaatacacctgtggttgatgttgccaaaatattgacaccatcagaatatctacacttaaccgaacagctccataagatttatcaagataatttggctcaagctgctttggtgattgttccaagtactgatggtatcgatatttttgattatgcacttgccgtcgctgagcgatggcagttaggtcaagcagatacagatgatggtttattaattactgttgcggtgaatgaccgaaagatgtatatcctaacaggttatggacttgagggtgtgctgcctgatgcagcattaagtcgtattattcgtgatgatatcacacctgcttttaaatcaggcaattatgctcaagggctgtcagcagggattgcacgcattgatgaacgcctaagagctgatcctgaaagtttggctcgtgctgacgctcagactgatgattctgtggatatagacatcattggcttatttatcattgcgttgattgcaggttcttttttgggggcgattcttggtagatttttgggtgcaacctttggtgcaggtggatttgttattgtggcactgatgagtggtgctggattttttgtggtaatgatcgctgcagtcatattatgggtatttttattggctcgtggtgtcttaccgatcacagatggtagcggtaactttggtagcggtgggcgaagtggcggttttggtggcggtggctttggtggcggtggctttggtggcggtggttttagtggcggtggcggcagcttcggtggtggcggtgcaggaggttcttggtaa

SEQ ID NO: 1857 - DNA, 183 bp, M.catarrhalis
gtgggcgtggtcggactgggcggactgggatatatggtggtcaaacttgctcatgctatgggggcggaagttacgctctttacccgttcgcttggcaaatccgatgacgcttactgcttgggggcgagccgtgtggtgctgtccaccgatgaaaaagatgttcgaggtggcgaacacctttga

SEQ ID NO: 1858 - DNA, 1665 bp, M.catarrhalis
cgccatctttcaaataggatatttattatgccaaacgctcaagccatcaaccaagactttttaaataaacttgaccaagacctatggaaagccgccgacaccctacgcaaaaacctagacgcggccaattataaacacatcgttctgggttttatctttttaaaatacatctccgatacgttcaccgattttcaaggcaaattaaaagccaatatcgccaaccccgagagtgatatttatcttgacccatcactgtttgagccaagcgaatttgaacaaatcctgtctgccgaactagaagaacgggattattacaccgccgaaaacatcttttgggtgcctacccaagcacgctgggaaaacatcaaagacaacagcaaactaaacgcaggcgatgaattgccttggggtggcaaattcaaaaatgtcagcattttgcttgatgatgcctttgaagccatcgaacaagaaaaccccaaactaaaaggcgtgctccaacgcattgcaggctttggcgtgcctgatgaaatgcttcgtggcttgactgaccttttctctcgcaccgactttacccgcccaatgtacaatggcgaacctgtgcatctgcaagccaaagacattttgggtcatgtttatgaatatttcttaggacaatttgccctagctgaaggcaaaaaaggtggtcaatatttcacgccaaaatccattgttaccctgattgtggaaatgctcgaaccctattcagggcgagtgtatgaccctgcgatgggcagtggcggattttttgtgcaaaccgaccgatttatccaagcccaccaaggtaaccgcaacgccatttcggtctatgggcaagaatccaaccccaccacccgcaaactggcggtgatgaatatggcgattcgtggcattccctttgactttggcgacaagcctgaagatactctgctcaatccgttacatattgataaaaaaatggattttgtgatggcaaatcccccttttaatatgaaagaatggtggagcgaaagtttggcaggcgacccacgctgggcatacggcacaccgccgcaaggcaacgccaactttgcgtggttgcagcatatgatttaccacctttcgccaaaaggcaaaatggcactcctacttgccaacggctcaatgagtagccaaacctcaggcgaaggcgaaatccgcaaaaacatcataacagccgacctagtcgaagcgatgattgccctgcccaatcagctatttaccaacacgcaaatccctgcctgcatttggattatcaataaagccaaagctcgtaaaggcgaagtgttgtttatcaatgccacccaaatcggctatatgaaagaccgtgtcttgcgtgattttaccgttgatgacatcgccaaaatcagcgacacctaccacaactggcaaaaacaggacggctacgaaaatatccctgcgttttgttactcggcaacactggacgaaatcgccaaaaatgactttgtgctgacggctgggcgatatgtgggagcagtaaccgaagaagatgacggcgtaccgtttagcgacaaaatgcaggaattgaccgcttgtttaaatgaacaatttaaacaggagcgggaattggaacagcaaattacagagaatttgaaggggttggggttttaa

SEQ ID NO: 1859 - DNA, 885 bp, M.catarrhalis
tacacaaacacccataccctaaatgctgtcaaactgattgcaggcatcaccgctgcctttgctggtgaagatgtcaatgtggctgctggtgtggcagcggaggctgtgaggtggaatggtacagctcaaattttttattataatgagcttgaggaaataaaaaatgatatagatggcacttatgtaaaggagcaattacaagccattacgaatatttcagatgatctcgctgagttgttggaaaatgttgtttatctgaaaaacactcgaggggattttattgtatgtttcagacattcaggtgaatcatgccaacctcgctcgggacaaagatatgcaacacaacaagaaattagacaaggttatattgatgttgcgattgaaattattcccaatcgcagacttgaaacatcggttaaagttgttaccaagcgtggagctaggactgtctcggaagcagtcattgaaaaaccaacaaataatcaaagcaaaccctctcacagggctgcagtatatataccaagagatcaagagctacgagaattatttacagcgacaaacccaagagtaggagtaagaattggaaaccgtacgctactaccagagtcaaacagccaaggacttgtaagagtatttaggggtgcgagcgatgctgaggtcaaacagtattttacagagttgacgggtaagcctttgcctcaaccaagagaaataactattggtaggaataaggggttattatatgcagtaaaaactgaaaatggtagttataatttgaggagtgtagcaagtagccagagtcgaacaggtcttgtttggacgattgatattcccaaatctgccacaggaacgaccaaaaacccagaaattaaatttttaaggtga

SEQ ID NO: 1860 - DNA, 1509 bp, M.catarrhalis
aaaggatacgctatgaaccaacctacaaatcaatctacgacccaaccctcatcgattccgcttaactgccccaatctgctaaagcaagcctgtttgattgatggagagtgggttggtgctgattctggtgagaccatcgcagttaccaatccattcacaggcgatgtgcttggtacgatacccagcttatcaaaacaaaccgttctaaacgccgttgagtgtgctgatgctgcccaagaaagctgggcaaataccaccgccagtgagcgtgccaaacttttgcatgcttgggcggatctgatcgatacacacaaggaagatttggcactgatcatgacctatgagcaaggcaagcccatcacagaatcacaaggtgagattgattatgccaatagcttcatacgctggtttgcagatgaaggcaaacgcatctatggcgatgttattccaagtaccaatcagtcgctacgctatgtggtactcaagcagccagtcggtgtgtgtgctgcgattacgccttggaatttcccttcggcaatgattgctcgtaaagctgaacgggctataggggctggctgtaccatgatcatcaagccagccaccgagacgccattttcggcattggcactgggatatttggcaaaacaagcaggcattcttaaaggtgtgttacaaattgttactggtaaatcctctgtggtcggcgaggtactgaccaaagatccacgcattcataagctgtcattcacaggttctaccgaagtggggcgagtactgatggagcaatgtgcaagcaccatcaaaaagctgtctatggagcttggcggtaatgcaccttttatcgtctttgatgatgccgatcttgaaaaggcggcagaagggctgattgcttcaaaatatcgaaacgctgggcaaacttgtgtgtgtgccaaccgtatctatgtccaaagttcagttaaagatgagtttttagcgaaatttaaacaaaaagtagaagtactgaaagttggcaatggtgctgatgaagcaaccgatatcggaccgcttatcaatcaacaagcactcaaaaaagtgcaggcacttttggatgatgcgctaaacaaaggggcaacgctaatcacaggtggcgtgccacatgacgcaagccaactgtcatttaccccaactgtcatcagtgatatcaccgatgagatggatcttgcccatgaagagatatttggtccgattgctccgatcatgacttttgaagatgaaaacgaggtaatccatcgtgccaatgataccatttatggcttggcggcgtatttttatacccaaaaccatgctcgtgcttggcgtgtttcagaggcactagagtatggtatggttggtcaaaatacagggcttttatcaactgaagttgcaccatttggtggtgttaagcaatcaggttttgggcgagagggttcaaaatacggtattgaagagtatattaccaccaaatattggtgtatggatatcagcaaataa

SEQ ID NO: 1861 - DNA, 525 bp, M.catarrhalis
ataatgagttatgatatgagcggtgtggagattttagatgcattatgtttaggcaatattactcttgctgaaaatttattaaaacaacacccacaacacaacttactcgctgtcaatagcgataaaaaaaattggcttcacaaagtcacggattctatgaatcctgatgagccaccacctgtcaccatcagctatcttatcaaccaaggcattcctatcaatgcccaagatgtttatggtatgaccccattacactatgccatgcgttcaaagaatgctgatgctgctatcgccttgctggaggcaggggctgaccctaatattcctaatagagacaatgtcatacccttggcaatgataggtatgataccgaagcgattagatgtacttgaactgatgctcaaaaaaggtggcaatgttcatttttataatggtcattatgaagtgttacaattattagagttgttttggagtcatgacaaagattatatccctgttattgaaatgatgaaacagtacgcttga

SEQ ID NO: 1862 - DNA, 675 bp, M.catarrhalis
atttataaaaaaatcaaaggacatggcgtgatgatcattcaagagatgctgcagctgctgaccactcgctctgagtttttcatgcgactgtttgttgagcatttgatgatttgcggtattgcggcaagctgtgcgatcgtgattggtgttgggcttggtgtgctaatcaccgaacatcagaagtttgcaccgtttgtcattcaaacaagtaatatcatttataccatcccaagcatttctttatttggcttattgattttggtgagtggtattggtaatacctcagcaatcattgcactggtaatttatgcactgttaccgatgattaatggcacacgcacagggtttttgcagattgatacgggattgatagaagctgccgagtcctttggcatgacacgctggcagattttacgccgcattaagctgcctttggcattaccgattattttatcagccattcgtacgatgctggtgatgaccattgcactggcgggggttgcatcttttattggtgcaggtgggcttggtgtggcggtatatcgtggtatcaccaccaatagcaccgccatgaccgcagtcggtagtattttgatcatgcttattgcgtttttggctgactttgttctggcgtattttgaaaaatcaatcaaatggagaaaatctcatgcttaa

SEQ ID NO: 1863 - DNA, 1254 bp, M.catarrhalis
attatgaccgatatcaccttaaaccaaagccataaattaacttggcgttcatttggacctggtattttaatggcttctgctgccatcggcggctcacatttggtcgcctcaacacaagctggtgctctgtatggctggcaattggcaattatgattatccttgccaatttttttaaataccctttttatcgctttggaacagaatatgcctactcaacaggcaacagcttagtggcaggttatgctaaaatttcccgtatctatctttgggcattttttgtcttatgcatcatttcaggtgttattagcacaggtgctgtggcactactatgtgcggtcattttggggcaaattttgccttgggaactcagcactctagagctttcatgtattgtgatggtaacctcaggcattttattggtggcaggtcattatcggcttttagatggtttaaccaagtggattatcgccctgctgacagtagcgacggttgcagctgtatttatcgctgcaggtaagccctctgccatatcagccgactttattcctgcctcaccttggaatttggcggcacttggatttattgttgcacttatgggctggatgccagcaccacttgaattttctgccgtgacctcagtgtggaccgctaagaaaattcgtaccgattacaccaatcgctttcaaggttttgttgattttaatgttggttattttacttcagcggttttggcaatatttttcttggcacttggcgtatttgtacaatatggcacaggcaccgaaatcgccatgcaaggcggtgcttatgtgccacagctgattaatatgtataccgaaaccatcggcaactgggcaaaaatgctggtcgccacgattgcttttttgtgcatgtatggtacagtcatcacctgtgctgatggctatggtcgtaccaattcagaaagcctatccttaattttgaccaacagcacaaaagcaaccgaaaaatatgttgttatatggactgtatttacgattgtggcaggctacggtttaatcgcattttttctaggtcaaatggcggcactgctcaaatttgcgatgatctcagcatttgtgactgcaccgatttttgcttatttaaactacgctttggtcaaaaaagaaggtcatctaagcaccatcatgaaatggtatgcactggcaggcattgtatttttgacaggctttaccgtattattcttattacaattttttggtatgattggctaa

SEQ ID NO: 1864 - DNA, 324 bp, M.catarrhalis
tattctacaagcactgagtgcaaaagggcgtactgcacaaagtaccaatcattaccattgaccgagcgtggggtgactgattttaatcagctaaaagatgaatttcttcacatcaagcagacacgactatcgcttgatgatgggcaattgcgacttggtatgacctgtattggtacctacattcaaagtccagataaagttaagcttggcatcgcagtatcactatctaatagtgaatatgatgacaaaaaagtacaaattggcgatgcactcgtcaaacttgcccaagccatcgaaaatcgtatggggtttggtagcatgtaa

SEQ ID NO: 1865 - DNA, 531 bp, M.catarrhalis
aatagctcaatactttaccatagcacaaagaaatttgtgaacgaaacatttaataattgcccaaaatgttactgcacacactttgtaaaagcaggcttgggcaatggcaaacaacgatacaaatgcaaaggttaccatcactatttttctgtgaagcaacgaagcaaccaaaaaagtaatggcattaaaaaacaagccattgatacaaacagtaaacaaatcttaggctttgtctgtggtaaaacagacactaacacctttaaacgactttatcagcagttaaatacccataacatgcaactgttttttagtgactactggaaatcttatcgtcaagtcattttaaagccaaaacatataacaagcaaagctcaaacttttaccatagagggctataatagtctcattaggcatttcatagcaagatttacaagaaagtcaaagtgttattctaaatccgaaaaaatgatagaaaacacgttgaatttattatttgctaagtggaatggtagcttaagatatgtattttaa

SEQ ID NO: 1866 - DNA, 219 bp, M.catarrhalis
tatattaaaatttatattctatatattaaacataagttcttgatattatacaatatagcactaaatattttggaatacaaaatcacccaaagtgcttctcctgtctttgctgccaccatcaccaaagagcttaagctggctcgctcaacaacttataatattctacaagcactgagtgcaaaagggcgtactgcacaaagtaccaatcattaccattga

SEQ ID NO: 1867 - DNA, 681 bp, M.catarrhalis
atgatgaaaattttaatggtattaacctcacacgaaaatcttggagacactggtaaaaaaacgggtttttggttggaggaatttgcttcgccatattatgcgtttaaagatgctggtgctgacattaccttagcgtcccccgctggcggtcaaccaccgcttgacccaaaaagtgatgagccagacgctcagaccgaatttactgaacgatttaagcaagatgccgccgccaaagaacagttggcaaccactcataaactggctgatattaaggctgccgattatgacgcagtattctatccaggcggtcatggcccaatgtgggatttggcagttgatgagcaatccatctcattgattcaagattttgtgaagaccgataagccagtggcttttgtttgtcatgcacccgccgcactcaaaaatgtgaaaattgatggcgaatattttgttaaagataaaaaagtgactggctttagcaattctgaagaacaagccgtcggtctgttagatgtcgttccgttcttgttagaagatgttctaaaagaaaatgggggcaaatatgaaaaagttgctgattggcaatcgtatgtggtagaagatggcctgttaatcacgggtcaaaaccctgcttcatctgaagatactgccaagcggttaatccaaaaactacaggcttaa

SEQ ID NO: 1868 - DNA, 498 bp, M.catarrhalis
agattaccagtctcaggcgttcaagcacaaagacagatacgaagtggtcaagcaaatatagctggctacactatagacaaaaatggtaggttgcacaataaccgtggacagtttacttctgacccaaataatcctagggtatcaaccaatctaatccgcccaaacttaagagctaaattaagaaggcaagttgatgctaattatattagactaccaaacggcaattatcaacataaggatactagggagattgttatatcccccacccagtacggccatacctatggacgtgaacacagacggcttgttctggcagctgagcaaacaggtctgacccaaactcaatttaatgactttattaattctcatcctgattatttcagacttgaaaacgtatcggataatatgggtcatcgcaatgagaaacctggcaatggtgatttacaagacatcatcaatgatatcaatgaatttaaacgcaaaagaggtattagataa

SEQ ID NO: 1869 - DNA, 390 bp, M.catarrhalis
atttttaaggtgataactatgatttatatatctgaaaaggttaaaaaagagatgcttgaaacttcaaaaaacctatggttatcagcactattcagtgctgtttcgagctattgtgttggcataaactttgagcaacacaaagagatattctttcagcttatcaaagaagccttagacgcagacttaatcaaatttataccacctaatggtatttggtatgaaggatatgacatttgggatgtctcatcagatgaaattgttgcctatcttagagataattttcctaaagatgcaacggatgaacttgatgaagatgtaaatttgtatttttatatcactgctccagctgtcctatggcgtcaagatgatggcagttattatggcagttaa

SEQ ID NO: 1870 - DNA, 954 bp, M.catarrhalis
tcatgcttattgcgtttttggctgactttgttctggcgtattttgaaaaatcaatcaaatggagaaaatctcatgcttaaaaaatctgttctgctacttatgagcgttctattggtcgcctgccaaagtcaagatgataaaattcgcattgccaccaagcccatgaccgaacaattcatcatcgctgaaatgcttgccatactcatcgagcaagaaactggcacaaccgttgaaattactaaaggtatcggtgggggtacagcaaatatccatcctgccatgcttaaaggtgagtttgatttgtatccagaatacacaggtacggcatggctgtatgtcctaaaaaatgagccaatcttcgatcaagccgtgcttttagaaaatcttaaaaaaagctatcaagatcaatataactttcgctgggtgggtatgtatggctttgataataccttcggcttggcggtgcgttctgactatgccgatgccaatcaaattgccacttttagtcagcttgcacccgttagcccaaatcttacttttggtgctgagtatgatttttttgagcgtgatgacggttaccaagcgttaagcgatacttacggttatcattttaagaataccaaagatttagatatcggtctaaaataccaagcacttaataacagtcaaattgatgtcgtcagtatctcaaccaccgatggcgctctcgccaacccaaatctaaaagtgctgacagatgataaggcattttatacccattatcatgcaggcacggtcgtcagacaagaagcactacaaaagtacccaaaacttgagtctgcactcatgaaaatggacgggctaatttcagaacaggagatggcacaattaaatgacttggtagaaaatcaaggtcacaatgaaagaaaagtggcacaagattttttgcgtaaaaaatccttgttggcatcttaa

SEQ ID NO: 1871 - DNA, 447 bp, M.catarrhalis
tggcagttattatggcagttaaatcaattccctaacacccaagtcactgttggcggtgatttgattgtcaaaagctgtcaagacacttatcaatacactcatgatcaaaaacaagcaggatttagtgccgatgttggctttgatggcaaaccccaaagctttagtatcaatggtggcaaaacggatgtagatgactcaaataccccagcccaagcacaaaaaaacaaactcatcaaccaagccaaactgattgcaggcatcaccgctgcctatgctggtgaagatgtcaatgtggctgctggtgtggcagcggaggcggtggagaataataatgatgccactaaatcaggcaaattgctcaaaaaggtctcagatgagacttgtgagataataagagatagtatttctgctggactaatcatatcaattaaaagagtgcaacattaa

SEQ ID NO: 1872 - DNA, 1014 bp, M.catarrhalis
aaaaaatacccagtatttagtaaaataggtttcatttgtgacagttttaggatttatatggattcgggtgagaccttgacttttcaagcactgattttaacactgcaaaattattgggcatctcgtggctgtgtggtgctgcagccttatgatatggaagtgggggctgggacatttcacaccgccacttttttgcgtgccttaacccccgagcgttggaatgcagcttatgttcagccatctcgccgtccaaccgatgggcgttatggtgataatcccaatcgcttacaacactattaccaatttcaagtggtgttaaagcccaatcctgccaacattcaagagctgtatttaggctctttaaaagccattggcattgatacgctgacccatgatgtccgctttgttgaagacaattgggagagtccaacgcttggggcgtgggggcttggctgggaagtatggctaaatggcatggaagttacccagtttacctattttcagcaggttggtggcattgagtgcttccctgtgacaggtgagattacctatgggcttgagcgccttgccatgtatatccaaggcgtggacagtgtgtatgatttggtgtgggcagatggtgaatttgggcgtgtgacttatggtgatgtgttccatcaaaatgaagtggagcaatccgcctataattttgaacatgccgatgtggctaaattgtttgaattatttgatttttatgaagagcaagcagataagttggttgcggtcaatttacccttgcctgcttatgagatggtgttaaaagccagtcatgcctttaacctattggacgctcgtggggcgattagcgttaccgaacgccaacgctttatcttgcgtgtacgcacactggcccgcaaagtggcaatcagctataccgaagctcgggcaaaattgggctttcctttggcagatgatgcccataaggcagaagcgttggagaagtggttgccaaaagaaccaaaaattatcttatga

SEQ ID NO: 1873 - DNA, 2082 bp, M.catarrhalis
tttatgaccacgattttatttgaacttggcaccgaagagttgccaccaaaaaacctaaaaacactgcgtgatgcccttaaaaatagtgttggcactttactaaatgatcaaaatatcagctttgatgatattcatgcctttgccgcaccacgccgtttggcacttactattacaggtgtgggcgagtttcagcctgaccgtatcgaaactaaaaaaggtccaagtgttaaggcggcatttgatgacgcaggtaatttaacgcgtgcagggcaaggatttttgcaaggtttaaatgccactgggcgaaatcttagcgtcaaagatttggggcgtattgctgataaaaaaggcgagtacatcgcttatgatttgaccattaaaggcgaaaaaatcaccgatttaatgccaaatatcttacaaaaagcgcttgatgatttgccaattgctaagcgtatgcgttctggcatcgatcgccatgagttcatacggcctgttcattgggtggttttgatgtcagatgatgttgtgattgatgcgaccattcaaggccataaaacaggcaaccaaagccgtggtcatcgctatcattcacctgatttttttgccattgatcatgccgatcattatgaaaatttacttaaaaaccatcatgtcattgctgattttgatcagcgtcaagccgatattttagcacaagtcaaaacattggctgatgatgtgaatggcacggcaatcatgcctcaagaattgcttgatgaggtcacagctttggtggatttgcccgttgcgttaagagcaagctttcctgagcgatttttagccgttcctcaagaagcccttatcagcaccatgcaggctgatcaaaagtatttttgcttgaccgatcaagcaggcaagctgatgccgcattttatttttatcagtaatatcaactctaaagattctgctcagattattacgggtaatgaaaaagttgttcgtcctcgtctgtcagatgcagagttttttttcttacaagatcaaaaacagccactgtttgagctgaaccatcatctaaaaactcagatttttcaagataagcttggtacattgtgggaaaaatctgagcgtattgcaaatttggccgcccatattgcagatcagataggtgctaataccgatgcagcgtatcgagctggattgttatccaaatgcgatttggcgagtagattggtgggtgaattccccgaattgcaaggcattgcgggtacttactatgcacgcctaaatcatgagcctgatgtggtggcagatgccatcgaagaacaatatttaccaaaatttagtggtgataagctgcctgccactcatgtgggtgttgcacttgcattggcagatcgtttggatacgctggtgggcatttttgggattggtgaaatacccagtggctctaaagacccatttagcttacgccgtgcgtctattgggattttgcgtattttaattgaaaaacgcctgcgtgtgagcctatctcatctggttaaacaagccttaatgggctatggcgatatacttgaaaatatcgatcagaccctaacagaagtcatggaatttatcaatgcgcgctatcgggcgatgtacagtgagcagggcgtcttggtggatacgattcaggcggtgcaggcggtgcagacagatgtgccgatggattttgatgagcgtatccaagcggtaacagcatttcgattgttgccacaagcggctattttggccgaaaataataagcgtgtggcaaatattttggcaaaagctggtactgtgcaaggtgatgtaacgccccaaaatctgattgaacctgctgagcaggcactgtatcaggcgatcgaatctgccaaagtcagcgttcagcccttgcataatcatggcgattaccaaggcattttgacgacccttgtgagcttatcggagcctttgacgcagttttttgatcatgtcatggtgaatgctgatgatgaaactttaaaacagaatcgtttggcactgcttagccaagtgcgtaagctttttttgagtgtggcggatattgggctgcttcaatcgtaa

SEQ ID NO: 1874 - DNA, 840 bp, M.catarrhalis
aaattgacttatttgtttatcacacatgaatataaggataacatgatgaccacacaaaacaatcaacaaaacggcaaagttgccatcgtaacagggtctgccgcaggtttgggcaatgccattgctactcgtttggcaaaagatggctttaaagtggtgttgcatgacatcagcgaagacaatttaaaaacggccaaagatgaatttgacaaagcaggctatgagagcatcagcgttgttggtgatgcctctaaaaaagacgaccaaatccgcttggtcgatgaagcggttaaggcatttggacaggtagatgtgtttgtcaataacgcaggggttgagtcggttgagccatttttggcaattgaagaaaaagagattgaccgtgtgcttggagtgaacatcaaaggcgtgatttttggcacccaagcggcggctgagcagatgaaaaaacaagacggcatcggcaaaatcatcaatgcgtgcagcattgcaggacatgaatcttatgagatgctaagcttatacagtgccaccaagcatgcggtgcgttcgttcacccattctaccgccaaagaacttgccgagcataatatccgtgtcaatgcttattgcccaggggttgctgacacgccgatgtgggagcgtattgatgctgcttttgttgagcataaaggctatgaaccaaaacaagcatggaaagagtttacccaaggcatcttggttggtcgtccacaacagccagaagatgttgccaacttggtgtcatttttagcgtccaaagatgccgattacatcacaggtcaaaccatactgaccgatggtggcatggtatttagataa

SEQ ID NO: 1875 - DNA, 840 bp, M.catarrhalis
actaaatatcagtttacatttgtacagtttattgagtatcctatgagtcaagtttggcaaagcgtacagttagcacgacatgcaaagcgaccattattcttagattatgtcgattcattatttgatgagtttgatgaattgcatggagatcgagcgtttgctgatgatcgtgctattattggtgggttggcaagatttaatggccagcctgtacttgttgttggtcaacatcgtggccgtagcactcgtgagcgtattgcccataattttggtatggcaaaccctgaaggctaccgtaaaatcattcgtttggtacagttggcggagcgttttggtttgcctgtgtttacttttatcgatactcaaggtgcgtatcctggtgttggtgccgaagagcggggtcaagctgaggcaatcgccaaaagtatcgcagtattttccagtctaaaaacgccaatcattgcgacagtgatcggcgagggtggttcaggcggtgcacttgccattggtgtggcagatcgggttaatatgcttgaaaatagcatttattcggtcatctctccagaagggtgtgcatctatcttatggaagacggctgaaaaagcatccgatgcgtcagaagcactcaagctcaatgcaaccaatttgtatcaattgcagctgattgatgagattgtcagtgaaggtgtgggtgcacatgaagcacctgaacctgtcatggcagcactaaaaaacctattgacagtacaattggcagaattacacgcattgccaattgatgagctgcttgaacagcggtatcagcgtttgatgcagtttaatttaaaagtatcactataa

SEQ ID NO: 1876 - DNA, 765 bp, M.catarrhalis
agtttgtatcatttcatcatgaatcatatcgataattcaaacacactaagcaatctgcataaactggctgatgcctgcttgtatgattttcgcccaccagcagacaagctgcgtacacatggttttttgggtgcagggggcgatttgacagtgtcaacactattacacgcttatcgttctggtgcctttccttggtttgatgaagacgagccaatctgctggtggtcgccagagatacgctgcgtcattacaccaaatgacttttatcccagtaaatcactgatacgcacagccaaaaagcagccttggaccatcaccactaatgctgattttgaggcagtgataaatgcgtgtcgtgcgcctcgccgtgatacctttcagacttggattcatgataatatggttttggcgtatcgacagctatttaaaattggtgcggcggcaagtatagaagtttgggcaggcatgccatatgacagcgagctgatcggaggtttatacggcgtgagttttggttcgatattttgtggagaaagtatgtttcacaggcgtaacgatgcctcaaaaattgccttttgggcattgatgcactgggcaaatcaatacggcatacagctcatagattgccaacttgaaaatccgcatttaagacgccttggggcaaatttgatgccaagagatgagtttttggagttactaaaacaccttgtcatgacgcccgtgcttgggaatttctggcaatttaatgcaaatatcttgcattga

SEQ ID NO: 1877 - DNA, 1038 bp, M.catarrhalis
attaatcatcaaagagactgttttatgtatgatgtcgttgctattggtaatgccttggttgacaccgaattcaccctatccgatgccgctttagatgccacaggtttggctcgtggcaatatgaccttagtagataccaatggtcaaaatatgctgtttgccgccctaaatgaacaaaacctaaaacctgccaaacaagcaggtggcggctcagcagccaatagcatggtggcgtttgccgcactgggcggtcgtgcttattatcattgccgtgttggtggtgatgatatgggtgatttttatttgggtgatttagccaatttgggcgttgcaaccgatgccacctacgctgtgcaagcagatgggacaacaggctcttgtgtggtattggtcacaccagatgcagaacgcaccatgcaaacgcatttgggtacaagcagtgaaattaatactgacaatattaattttcagacactcaaagacgcaaaatggctgtatttagaagggtatcttgccatgtcaccttcagccactgatgcactaagccagctgtacgagcatgcacgcaaaactggtgctaaagttgcggtgagctttgctgatcctgctgtggtaaaatttgccaaagaagggttaagtgccatcttaaaccgtggtgtagatgcgatattttgtaatgctgaggaagcggcattgtttgccgatgcagatgccgatcctgtcaatacactattaaaatacagtgacttggtggtcattaccaattcagataaaccaaccaccattgcctgtcgcatcgatgatcgcattatcgagcatcacattgatagctgtgttgtcagtcaagtcatcgataccaatggtgcaggtgataattacgcaggtgcttttttatatggtttatcgcaaaatcttgatttgccaaattgtggacgcttggcggcagctgtggcggcagctgtggtgggtcagtttggaccacgattaagcatcgcagagtatcaaaccattaaaaaacgcaccgtatcattgacataa

SEQ ID NO: 1878 - DNA, 714 bp, M.catarrhalis
caaatcacccaaaaattcggtatcataatacaaatttatcaaaagccaagccgcatgagtttaaatccacaatctcggtcaattaaaaccccttcagtatttaatttacctaataatctgaccatcgcgcgcattgtgatgattcctttgtttgttgcaattgcctattggccgcccgcacttggcattggcgtgcctgcgattcctgataatgccatcgcacgcttgggcatgatgggctatagcgatagtatgctgcggcatctgattttgacattgctgtttattttggcggcagtcacagactggctagatggttatttggctcggcgtatgaatatcacatcagcatttgggcgatttttggatcctgtggcagataaactgatggttgcagctgcgttaatcgtccttgtgcagtggcatccaaatattgtgatggcgacgagtgccattgtgattatttcacgcgagattgcggtatcggcattgcgggaatggatggcagagcttggtgctcgcacgagcgtggcggtgtcttatgtgggtaaattaaagaccacttttcagatgattgccattacggtatttttgctgaattggcaatcgcttgagatgattggctatgtgctgatggtcattgcggtcattttgacgctttggtcgatgatgatttatctaaaagctgcttggccatatcttaagcagccataa

SEQ ID NO: 1879 - DNA, 231 bp, M.catarrhalis
acttcataccaacaaggagtaagcccgtccttgtttttaattggtttggggaaacttattactgatgatattttgaacaagctattgagtgcgttagatgaattggcattgccttgctatggcaaactttatcctgcttgtaagggcgggagggaattccttgggttttggttaagcctggttcttggtaataaaaccaggtttaaattaataggcttgcccccatattaa

SEQ ID NO: 1880 - DNA, 1347 bp, M.catarrhalis
gttatgacacattctcacaatatccgccacactgagcatctcatcatcggttttggtaaagcagggaaaactttggctcaaacccttgctaaagcaggtaaagaggtcatcttggtagaaaaatctgccgatatgtatgggggtacttgcattaatattgggtgtattccatcaaaaaaattggcatttttatcacatgagcgtgatgtgtcattaagcgatgccattgcccgtaaaaatcaactgattgctaagcttaatcaagccaattttgataaagtcaatgaattagataacgccacggtcatcacaggtgaagccagttttattgatgataagaccgtgcaggtggtgacagctgatgacactctaaaaatcaccgctgaccacattcatatcaatacaggagcgtataattggcaaccacccattgatgggctaaaagacagcaaatttgcccatgacagcaccagtatcatgcagttaacccaattgccaaaacagttggtcatcattggtgggggatatattgggttggaatttgcctttatctttgctgggtttggcagtgtggtcacgattttagaaactgccgatacttttttaccaaaagaagatgctgacattcgccaaaatttgttgggcattatggcaaacaaacaaatcactgtcaaaaccaagcaacaaattaagcaggttaatgatgccaacaatcatgcgatggttgtaaccgaagatggggaattgatggcagatgcgattttggtggcaacaggtcgtcgggcaaatacgcaagggttagaccttgataaagcaggcgtcatattgacggataaaggcaacattaccgttaatgataggctacaaaccagcgtgccacatatctatgcgatgggtgatgtggcaggcagtccacagtttacttatatttccttggacgattatcgggtggtcaaaagtcaagtgttgggtgatggcacatataccacaaaaggacgcacttttgcctatgcggtgtttaccaatccaccgcttgccaatgttggcatgaccgagcaagttgccaaggagcaagggcatgccgttaagacggctgttttagaggcggtcaacattcccaaagccaaaatcttagagcaaaccgatggactattaaaagcggtgattgatgccaaaaccgataaaatactgggtgtgcagttgttatgtgacaatgcccatgagttgattaactttatggatttggcaattcgtcagggtctgacttatcaagaggttagggattatattttcactcacccaacgatgagcgaagcgttaaatgagttgtttgcacagtttgggtaa

SEQ ID NO: 1881 - DNA, 2997 bp, M.catarrhalis
aaattggttaaaattttggacagttttatgacgacacttcattcaagttttgagttaattgacaagcgtagcattgaagcacttgacatcacagttttgacatcacgccatcgtttaactggcgcgactcattatcatttggcgtgcgataacagtgaaaatgcattaatgattggctttgcaactcagccgatgacttctcgtggtgaggcacatattttagaacatgttgtgctgtgcggttctcaaaaatatcctgtgcgtgacccattttttagtatgattaagcgttctttgaacacttttatgaatgccatgacagcaagcgactggacagtttacccatttgctagtcaaaataaaaaagatttttttaatttattgtctgtttatttagatgcggtatttttccccaatattcatccgcttgattttgcccaagaaggcgttcgagttgagattaatcaagataaccagcctgagtatcatggcattgtctttaatgaaatgaaaggggcgatgagcggcgagattgatcagctgtattatgccttgatgccacatttattcccaacgaccacttatcattataattctggtggcgaccctgctcagattccaaagatgacgtatgaggatttggtggcatttcaccagacgcattatcatccaagcaatgccattatcatgagttttggtaatattgccgttgatgaaattcaagctaaaattcatgacgaggctttgtcgcattttgatgatattcaaaaacctgcacaaggcaaaaagttcactggcgtcgttgaaaagccgttaagccagccgattcaggtgtatgatacatacagtgcagatagtgatgataaacagatgacccatcatgttttggcatggcttttgccaaccattaccgacccacgcctacgcctatcactgcgactgatggagggtgtgttagctgaacacagtggttcgcctttgcgtgcatatttagaaagtcatccgctggcagttgcacccagtcccttgcttgggctggatgatagccattaccaaatggtattttatgcaggggtgcgtggctcagagcctgaacacgccgaagtgttagaaaaggggattttggcactattaaaccaaattgcagacaacccaatttcccaagaagtcattgaaaccattttgcatcaaattgaaattgatcagcgtcatattggtggtgacagtatgccgtatggactgaccttgatgctagaggcatttagcaccgcagttcatggcggtaatcccttggatgtttggcagattgatgagcatttggcatggctaaaacaacaggcaggtgaaccaaattggctacaaaatttgattcgccaatatttgattgacaatccgcaccgtgtacgcttaaccttgtctgctgataccaaaaaagcggctcgattggttgatgaggaaaatcaagcactggcggcacttgatgccacgcttagtgatgatgataaacaaaatctgctcacacaagccgctcaattaaaagctcggcaagcagcccctgatgatgtgagtattttgccaaaagttggacttgaggatattccaagtgaggtggcatttaccaagggcatcaaaacaaccttaagcttggatggtgaaacttatccagtgcatttgtatcatacaggcaccaatggattatattattatcaagtcatcacaccgctgaccgataaggtggcagatgaggtgattaataacccgctgctgccgctgtatttgacgctgttatcagaagtggggacgaacaactacgatgctcgtacttttcaggcggtacaagcgtcgcattcatctggcgtaaccgcccgtatcagtcaacggacacaattaaccgataaagagtctttgagcagttattttgtggttgccacccgtgctttgaatcgtaaacttgaagccattgagctggtcagtgaggtgatgaatgagactgtatttagcgaaacagaccgtatccgagaactgttacaacaaaaacaaagtagctggcaggctcgtttggcaagtgcagggcatgcttacgccatgcaaaccgcttcttctcagatgagccgccaagcacgcattgagtatgcttattcaggattgcctgcgttggcagcactcaaatcatttttggcatcggcacaagccgatgatagcctatgggataccttatgccatcgactcagtgagctgcaccacactctgataagcttgccaaaacaggtattgcttgtttgtgaagagcaggtaagttcagatttattggatgaaatctcaaaacatatcagcacaaaaacaacgctcacaccaagtcaaaaagtatctcaaaagctggtttttgatacacttgatgagttgttatgccaacaagatgaaccaaaaaccgcatggctaatctcaagtaatgtctattataatgcagctgcctatcaagcaacaacatcagagcatgaggatacgcctgctttaatggtacttgccccatttttaagaaatggttatttgcatggtgctattcgtgaaaaaggcggtgcttatggtagcggtgctagttttgatagcaatgctgccgcatttcggttttatagctaccgtgatccacattgtgctaagacttttgaacattttgacaaaagtatcgattggcttttgcagacaaatcatgatactgagcaattgcacgaggcaattttagggattattgcaggcatggataaaccaggctcacctgctggagaagcggtcaagtcatgttttaatgagctacatcaccgtgataaagcatggcaacaaaatctgcgtgccaaaattttggcagtcagtattgatgatttaaagtatgtggctcaaaaatatcttaaaaataagccaagtcatcaagcggtacttgcccccattgaacaagaattggcactcatcgatatgggctttaagattaaaaaattaagctaa

SEQ ID NO: 1882 - DNA, 1191 bp, M.catarrhalis
atctttgtcaaaataaaaattatcctaaaatttcgttgcaacatgataaactataccaaaacttttgccaaacgcctactaaaaaatgtcaaaacaatgaaaaatttacaaaaaacttcaaaaaaacagccttttcccatcgatttgagcaaaaaatctaaaagagccaagcaatctgtgcaacaatctgccgattttgctattacagattttagccgagtgaattttttgacggtgacgaataatcaagatggtcagcgagtggataactttttattggcaaggcttaaaggtctacctcgctcacatctttataaactgattcgcagtgatgagattcgtattaatggcaaacggtgcaaggcacacgataagctgtatatgggcgatgtggtgcgtgttgcgcccattcgcttgagcgtgcgtgaagcaccaattatcagtgaagagcttgccaaaggactgcttgagcgtattatttttgaagatgatggattgattgtattaaataaaccacatggtatggcagtgcatggcggttcaggtgagagctttggcatcattgaggcgatgcgtttggctatgggtaaaaaataccttgagctaattcatcggattgataaagacacctcagggctgctactgattgccaaaaaacgcagtaccctaaaaatccttcaagagcaatttcgcaaaaaaacgatacagaagcggtatttatgcttggtgatgggtcatgttcaggctgatgaaatggttattgatgtgccgttactgcgttatacattggctaatggggaacgccgtgtcaaagttgcccatttaaacgagcaaaaggctggtgaatatgccaaagcaagcctaaccaaaatcaaaactttattacgatttaaaaaagatggttgtcccgtcagtttggtacttgccatgcctgccacgggacgcacacatcagattcgggtgcatatggcacacattgggcatgcactacttggcgatgataaatatcaaaataatcctttagcacccaaagttgggcgtttgtgcttacacgcttggcagttgggtatgacgaatgatgatggacacactgtcacacgcccacaaaattttgttgcacccgtggcagatgatatggcacagttgttgccaaaaacggcagagtggttacccaaaacagtatcaaattga

SEQ ID NO: 1883 - DNA, 1326 bp, M.catarrhalis
atattgggcaagtatgctaaactaatcttgactttttattctcccaccaaacaaggaaaattcatgtttaaagaaatttcgctacatcaatacgacccagaattggcaacacaaattgatgccgaaaccaaacgccaagaagatcatattgagcttatcgcatcagaaaattactgctcacctgctgtcatgcaagcccaaggctcaaccttaaccaataaatacgccgaaggttatccaaaaaaacgctactatggtggttgtgagcatgttgatgccatcgagcaaattgccattgaccgtgccaaagaactgtttggtgctgattatgtcaatgtacaaccacattcaggttcaagtgccaacagtgcggtatttctggcattacttgagccaaatgacactgtacttggtatgagcttagcacatggtggtcacctaacccatggggcatctgtcaatttttcaggacgcaattatcatgcggttcaatatggattggacaccgaaactggcttgattgattatgaagaagtcgcccgcctagcccgtgagcataagcccaaaatgatcattgcaggtttttcagcatacagccaaatcattgactggcaaaagttccgtgacattgccgatgaggtaggcgcatatttgatggcggatatggcacatgttgcaggtcttgtggcaactggcatttacccaagccctgtacaaattgccgatgtcaccaccacaaccactcataagacactgcgtggtccacgctctggtttaattttagccaaagccaatgaagagattgagaaaaaattggcatctgctgtttttccaggtagtcaaggcggtccgctgatgcatgctatcgccgctaaagctgtttgctttaaagaggcaatgagtgatgattttcagagctatcaaaagcaagtcattatcaatgccaaagcgatggcagaggttatccaaagtcgtggctatgaaattgtctctggtggcaccaaaaaccatctgatgcttatcagcttaatcaaacaaggcatcactggtaaagaggcggacaaatggcttggcgatgctcacattactgtgaacaaaaattctgtgccaaatgacccaaaatcaccatttgtaacaagtggtatccgcattggtacgcctgccgttaccacgcgtggctttggtgaagctgaggttcgtgaattggctggctggatttgtgatgttttagacgcacgaggtgatgaagcagtcttagcagcaacgcgtgaaaagattgcccaaatttgtaacaaattgcctgtttatgagcgtaatgtggcataa

SEQ ID NO: 1884 - DNA, 3546 bp, M.catarrhalis
atcttcgtaaacttgataccgatgttgcttagcctaggcattttgcccataaggaacatcatgaaacgcatcttaattaacgccacacatagtgaagaaattcgtgttgcactgtgcaaagataaccatttatacgactttgacctagaaaatcgtactcgtgaacaaaaaaaagccaatatttataagggtcatatcactcgtgtagagccttctttggaagctgcatttgttgaatatggctcagcacgccaaggttttttaccactccgagaaatcgcccctgaatacctaaacggcaatactcatgaagacagcattaagcagctcatcaaagaaggtgatgaaatcatcgtccaagttgaaaaagaagagcgtggcaataaaggcgctgccttatccagctttatttcactggcgggcagatatttggtcttgatgccaaacaaccccaaagcaggtggcatcagccgtcaaatctcaggtaaagtccgtgaagaaatgaaacaaatcatcgcagggctaaacctaccaaaaaatatgagcgtgattgttcgcacagcagggcttggtaaaggggctgatgatttacaaaatgaccttgaccatcttttagatatttggaaatccatccaagaacaaaataaaaaacgcccaagcccttgcttggtacatcaagaagcgggcgtggtaactcgtgcggtccgtgactatttgcgtgatgacattggcgaggtttggattgacagtgaaaatgcttatgatgaagctgccaatttcatcaaagctgtcatgccgacccagcttagcaaactgcgtaaatacaccgattatgagccaatgtttgcccgttttggtattgagcgtcaaatcgaaaccgcctatcagcgtgaagtacgcctaccttctggtggttctattgtcattgaccaaactgaagctttggttgctattgatatcaattcatcaaaatccaccaagggttcagatgtcgccgaaaccgcctatcataccaatttagaagctgccgatgagattgctcgccagttgcgtttgcgtgatatgggtggtttgattgtcattgattttattgatatgaacgacccacgccaccaaaaagatgtcgaaaaacgcctcatcgaagcaacacgccatgaccgtgcccgtgttcagttttctgagattagtaaatttggactgatgcagatgagccgacaacgcttgcgtccttctcttgaggaatctacaggctatatttgccctcggtgccacggtaatggcatgattcgagatttgcgttctttatcgctatctatcatgcgacaaattgaacaaattgctctcaaagaacgcatgggcgaaattcaagctgaagtcccaaccgacattgcggcatttttattaaatgaaaaacgagaaagtttggtttatttagagcaagacagcggtgcacgaatcaccattttaccacatgcacatcttgaaagcccaaattttagcctacactttaatcctgatggatttgctccgtcaagctatgaacgcattgctgacaccgaagaaaaagaaaatatcgaccgtggttatgaggtgaattggcaaacagaccacgaaaaatcagactcaaaccgttggcaaaaacctgacaataagcccatcaaaaaaaatacgaccgattcagaacccaagccaaccaaaccagaacctcaagcggttgcatggttgtcaaacttatttgcaccaaaaccacaagcgaaagttgctggcagtttaggtacagcagatgccgctttagcgattgaagcactggtaaatggcggtgcggtaagcctaggtgcagcaggccgtatggcaaatatccaagcaccatcagctgagccaaccccacgcccccaagcagaagataaacgccacaaaaaatctcgaaatgccaaaaaagaatccggcgaagagaccgccgcccaagcccaaccctctgaaaagacagacaaaaaaaccaaaaaagaacgcgacaaagaacagtatccaaagcgtgaagcaggctctcgccgagaatctcgtggtgagattgtgcgtggtgagacacttcataaaaccgaagaaaaagcggataaagctgataagcccattcgtgccgataagcccaaatctgaaaaaaccgaaaagctaccacatcaaaaagcggccaatcctaaagaagtggtgctacatgtgagcagcattaaagcggctgaaaataatacgcaagtcatccatctttcattggatggcagtaagtctacaaaaccaacaaaagacgaaacatcaagtgccaaagatgatgccaaaattgcacctaaagcaaattccaatcaggcaataaaagcaccaaaagagccgatacctaccaaacccaagcacgaagctgagccgatcacacaatcagatgaatcaggtgagatgagtgcattacatacggtctctgctacgacaggggttgagcccaaactggctgaaaaaattcagacacttgccaaatctatgaataaggctaccaacgaccctagagtggtacaaatcgcccttcagcagacacaggctatcaatctcaatgcaataacagcaggggcgctcatcttgcgtgtcttaggtaaatcggcgacaggtaattttgtgaatgattttatcactgcaatgacaaaaatgtccacgcctgcacagtttgattttgccaactttggttattcaccgctggatacagccacaaaaaatgagtttggtaaactaactcaagcgaccgctcaagcatcagcgccacagggcagaaccgaggctataccacgcccaatcacacgccgtgctgccaatgaccctcgtggtcagcatcctgagtatattgaagcaaccagccctaacaatgatcaggtcagcaaaacaattgctcagcactctaatcaagccagtcctgatacttttgatcatgctgtcacaccagccgacaccaagcataaggaatcaaagatagcgaccgattcttcatccgactcagataacagccaacttagcaaagctgatgatgcggttgaacatcaaaccaatgatgccattgatgctacaacgctggctgcagagcaaatctctgatagcattggcgacaccgtcagtaagacaatggctgatatctcaaccgtcgtatcagaagcggctgatgatactgctaaaatggcagatttggatactcataaccaagtgaaacctgaaagtggtaaagacaaaaaagtcagccaaatcaaagagatcaccgctgaccaaaaaaccgaacgcaagaccaaggcaaatagctataaagatatgattgaaaatgtcgcaggtcagctacaacctcaggttggtattttaaatctgatggcaactaaacctgccaaagtgtccaaaccagccaaaacaagagcacctagaaagccaagcaaaaaaccaaccaaggtagaagtgcgtaagttatccaagcctgtggagccttctgagtcttctcctgctaaatcagcagatgattcagccaacaattaa

SEQ ID NO: 1885 - DNA, 261 bp, M.catarrhalis
actatggggaaatttatgccaagactgataaaattacaccgctcaaaaaaccatcgtatgattgcaggcgtgatgggtggtattgctgaatatttagggtggtcgcctaacatggtgcgtattgcatttgtgattatctcaagtttatcggccgctgtaccaggaattttgatttatttggtgctttggctaattatgccaaatgcaacaccaaattcttatgctacgaatttggttcaatatgaccgtaagtcgctgtaa

SEQ ID NO: 1886 - DNA, 450 bp, M.catarrhalis
ctcaatagtgatgttttaataacttttagttttaataacttcagaatcaatccattacatcaggatacgatgatgaaacacgccgttttattggcattatccgtggcaacttttggcttaagtgcctgctcattcaatgccaccgcccaaaatccaaccacaacaactgccataagccagccccctgccaaagccgtgggtgtgtggattgatgttcgtagtgccgaagagtatgccgatgggcatttacaaggggcattaaacatcacgcctgaccaaatcgcaagccatattgaagccattgagccgaataaaaacgcccccatcaatttgtactgtcgttctggtcgccgtgctgaggtggctcgtaagacactcttagaaatgggccataccaatgtggttaaccatggcggctatcaagacttgtatgataaaggttatcgttga

SEQ ID NO: 1887 - DNA, 1047 bp, M.catarrhalis
caattcttggataaaaccatgcattcatcgcaacagtttgactatctgatttttatcggacgctttgaaccttttcaccaaggtcatcattatgtcatcacgcaggcattagcacacgcacggcaagtgattgttttgattggttcagcaaattctcctcgcacgattaaaaatccatttcatcctaatgagcgacaagcaatgattttaaacagttttgacaaaaaaaatcgtgaacgcattcactgtcttggtatcaatgacgccacttataatgataataaatggctcattgaagttcaaaatgccattgtcagcatcacagccaatacacccaatgaacgcattggtattattgggcatgacaaggatgaaagttcgtattatctggcactttttcctcaatataagacatttatggtcaaaaattttgaatacatatcagcaacaccaatcagagaagcatattttggtgatgatagtgccaaaaaacaggcaagctttagccaactgactaaagcttgtgttgaatttttaacagcttttgagcataccaaagcttaccatcgcctcaagcaagagtatcagcacattcaagcctatcaagcagcttggcagacagcaccttatccacccaacttcatcaccagcgatgcactgattgtgcaatcggggcatattttgcttattgagcgtggcggtgaatatgggcaaggactgtacgctttacccggcggttttgtggataccaatgaagatttttatcaagcatgtttgcgtgaagttcacgaagaaacaaatctagatatcagcttgctcaaaaacagtctgataacagcaactttgtttgatgcacccaaacgcagccaaagagctcgtacggtgacgatggtgtattattttgagctaccaaagcagcaaaccctacctgatgtccaagctggtgatgacgcaaatcgtgccttttggctacctttatccgaattaaatgcggtacagatgtttgaagaccattatggcatcatctgtcagttacttaaaatttga

SEQ ID NO: 1888 - DNA, 1074 bp, M.catarrhalis
cataccaaggatatgataatgcaaccagaccacttgattttaattggggattttgcaccgctcacgcttagcatgcttgccgatattaatcatgctgcaggattatcaaagacattacacatcatcattcaaacgcccaaccatgcacctctgccctgtggtcgcacgccaacacttgctgatgcggtgcgttgggttcagatggcttgtcaatcatttggttttattaaaattcatacctttggtagtttggctttacctgatatgtcatttgattatcgaaacaatacgcagttgaccaaacatcaatttttagccatttgccaagcactcaatattaccgctcatacgacaatgcttggcattaaatcatcacataaagatactttacatccatttgaattgacattacccaaatacggccatgcctcaaattatgatgatgaattggtacaaaacaatccattggcttattttcatcaactgtctgccgtctgccgctatttttatacccaaacggtttgtattgttggtggcgaaagctcagggaaaactaccttagtacaaaaacttgccaattattatggtgccagcatcgcacctgaaatgggtcgattatacacacactcccatctcggcggtagcgaacttgcccttcaatacagcgactacgcatccattgccatcaatcacgccaacgctatcgaaaccgctcgtaccactgccagctctgctgttacactgattgatactgattttgcaacaacgcaggcattttgtgaaatttatgaagggcgaacgcatccgcttgtcgcagaatttgctaaacaaatgcgattggattttacgatttatttagataataatgttgcttgggtcgctgatggcatgcgtaggcttggtgatgatcatcaacgcagtttgttcgccaataaactgcttgagattttggcacgatatgatattggtcatcatatcattaatgacaccgactatcacaaacgctatctacaagcattaagcttgatagacaatcatatttttaatcattttacaaaaattcatgacaattaa

SEQ ID NO: 1889 - DNA, 519 bp, M.catarrhalis
aattgtacacttgtaccgccaatagatgatgatttcatgccaatggatgagatattagaccacctgcctccaaaacttgccgattttgtatttactcaagggtcgttaacggcacgattagaagcacactcaaaaaaacccctaaaggttgaaatcatccatcaaggctatcagccactcacctttgcccaaaaatcacaactgggactgcccctaaatcgcccacaaatggcttgggtacgcagtgtcaagttatacggtgatgcggacgcttgggtgcttgccaaaagtatttttcctttgtcatcactgacaggttcattagcacgcctaaaagcactgggtgcaacgcccatcggatatgttttgttcaaaaaaaggcaacaactgccaattaagcgtcatttttatcggtatgatggtcaaattggtcggcaaacagtttatgatatcaatgggcgtaaaatcttgattgatgagctatttttggcagcttttcaagcatcttttgaccaatga

SEQ ID NO: 1890 - DNA, 1626 bp, M.catarrhalis
caaaaccgatggataaaagccgccatctgtcgtaaaataaccccatttatcaaaaatgttatccaaggatttgccatgcaatcagccattttagatgatgaccatcgccaccaacaaattgccaacgccatccatgctgctgccatcagtcgtgatgagttgcttggtgcgattgatttgggttcaaacagttttcacttggcaattggacgcttagatcatggcgaggtgcgaaaagttgcttccatttccgaaaaagtccagttggcagcaggtttggatgataataatcagttgtccaaagaggtgatgcaacggggtattgagtgtttgcatcgatttgctcagcatatcaccgaggtgcagccaagtcgactgcgtattgttgctaccaatgcccttcgtaaagcggtcaatgcggccgaatttatacagtatgccaatgagattttaccaaagccgattgagattatctcaggtcgtgaggaagctcgtttgatttatttgggtgtttcgcattctaatgccagtacggataaacgccttgtgattgatattggcggtggttcaacagagtttatcatcggacaaggatttgagccaatcgagatggaatctttgcaaatgggctgtgtatcttataccaaaaaattttttggtgatggtaaaatcaccgagcgtgcctttgataaagctgccaagcacacacgctctgagcttttgacgattgcaaaacgctatcaaaaagttggttgggataatgcgattggctcatcaggtacgattaaagctgcgaggctggtcttagcggagcttggatttggcggtgagagcatcacaatccaaagtatgcaaaagctaaaaaagcatctgattaagcttggcagtgttgataagattgattttgatggtgttaaagcacatcgccaagctgtttttcctgcaggtgtggcacagctgcttgagattatgcaaactttaaagattgatgaacttggctattcagatggggcactcagagagggggtgatgtatgatatgctgggtcggctaaattcagaagatgtgcgtgatcgttcagtagcagcaatggcacagcggtattcggtggataccaaacaagcagggcgggtgatggcacgcgctgccagattatttcatcatgcgaaagaggcgttgggtttagatgatgaagatgctgatttattacgccgcacagccaatttatatgaaattggtttggcagttgggcatagcaattatcagcgtcatagtgcatatttgcttgagtattcagatattgcagggttttcccaagtgggtcaagccatgatggcccaaatcgcacgacatcaccgccgcaaactaaaagccgatgcacgagagaccgttgaaaacttaggtgggtgtaaattggtgtatctgtgcttaattttgcgattggcagctcaatctagccaaagtcgcaccaccaaggcagccacccttgacttatatagtgtcacaccagatcattggcaggtaaccgtcggtgaggggctacataaagagttaatcatcacacagttagaacaagatgtggcacaatttgccaaatggggtgtgcgattagaggtggctggctga

SEQ ID NO: 1891 - DNA, 2307 bp, M.catarrhalis
aaaaaacggtgttttgctgttaaggcacaacaccgtttttatttaaaatttcaagacattgtttcaagagattgtttcaaggtattttggcatataaagtacagaccatgccccaacatctcaaatcattttaaggataaaattatgaccacccaacgcatcatcaaaggctcgcttgccattgacaagattttatttgattttattgaaaatgaagccctgcctatcgccaaacttgacagtgatacttattggagaaattttgagcaagttgtgcttgaattgaccccaaaaaataaagccttgcttgcccatcgtgagaaattgcaagccaagattgacgattggcacaaaaatcatgtttatgagctgggtgcgtataagcaatttttaagcgaaattggctatcttgaacctgaggttgcagattttaccatcaccaccgaaaatgtcgatgaggagattgccaccatggcagggccccagcttgtcgtgcctgtgcgtaatgcccgctattgcctaaatgccgccaatgcccgttgggggtcgctttatgatgcgttatacggttttgatatcatcgcagaaacggacggtgctgaaaaaggtaagggctataatcctgtgcgtggggcaaaggtcatcgcatttgccaaaaattttcttgatgaaactttcccgcttgtggacggctcacacgctgatgtcatatcttatgccataaaagacggtcaattatctgccaatatgggcaaatcttggagcactttaacagaaaataaagtggtaggctataatggcgtgcctgacaatccgagcgaaatcatattaaaaaacaacggcttacatgtcatcatccagattgacccacacagtatcattggcaaagatgacaaagcaggggttaaggatatactgctagaatctgccgttaccaccattcaagatttggaggactctgtggtggcggtagatgccgaagaaaaagtggagggctatcgcaactggctgggtcttatgaaaggtgatttgtctgagaccttagaaaaaaatggcaaaaccatcacccgtacgctaaatgctgaccgcacttataccgacctaaatggcaatacccaaactctgcatgggcgttcactcatgctgcttcgcaatgtggggcatttgatgacaaatcctgccatcttggtgggtggcgaggagatttttgaggggatgatggatgcacttatcacgcccatgctctgtgccattgacattcgtggtgaaaataccttgcgtaactctcgcacaggttcaatgtatattgtcaagccaaaaatgcacggttcacaagaggtggcgtttgctgccgagctgttctcttgtgccgaaaaagccattggcttgcccaaaaatagcctaaaaatgggcatcatggatgaagagcgtagaacctctgccaacctaaaaaactgtatcgcccaagcttatgagcggacgatttttattaacacaggctttatggacagaacaggcgatgagattcataccgccatgcatgcaggggcatttgtgcgtaagggtgagattaaagagcaaatctggtttcatgcctatgaaaaacgcaatgtcttaatcggtcttaatgcaggactgcgtggtaaggctcaaattggtaaaggcatgtggccaaagcctgatgagcttgccgatatgtatcgcaccaaaattgagcatccacaagctggggcaagctgtgcatgggtgccatcgccaagcggggcggtgattcatgccattcattatcacaaatgcaatgttacaaaacgccaagaagaattggcacgccttgccataccaagtcttgatgatttattgaccattgctcttgccaccgataccaattggacagcagaacaaaaacgctgtgaacttgaaaacaactgccaaggcatcttaggttatgtggtgcgttgggttgatttgggcgtgggttgctccaaagtgcctgatatcaatgatgtgggactgatggaagaccgtgccactttgcgtatctcctctcagcatgtcgccaactggctggttcatggtatcgtaaccgccgatgaggtgtgggatgccctaagacgcatggcaaaagttgttgatgaacaaaacgcatccgaccccgcctatcgcccaatgtcatctgattttgataacaacattgcctttcaaaccgccgccgagcttatctttaaaggagcgaccgaaccatctggctataccgagccgctattacatagggcaagattaaaactaaaaggttatcaaggcgactga

SEQ ID NO: 1892 - DNA, 783 bp, M.catarrhalis
caattaattagggaaaatctgatgaaaattgatattttagataacatcacaggctttggtaaaaaagattggacaacaagctgggtgctactttggtttgtttgcggatttattgcactatttactggattttggaccacaacagctcacacgcatttggattggttttattttgtcatctcaatcatcggcttggtctgtgtggtaagtttgtcttttcgcaaaaatatcacaggcaatggacttggtatggttgccacagcaggtgaggtcatcgtacaaggtacatcaggtgccgttggtctcatgcttgcaccgttatttaatttttttacacatgtctatggcgttaaatactggtcaaaccatactggtgctgatggcgatatgattccaaaatctgcaggaaagtatgtttggctaattaccgtatgtttcattattttagggctgttattattcccaacggtcaatacatggcttgcaaatatgggctatgtggtggttgaaaatgacggcagtcgatttttggggcgaattgactttttttggattaatgtcttggcatttgtcttgtcaattaccgcacaaacgatgatgattttacgctattctttaaattggtggctatggattgtggtgaatgcagtttggctgattattaatctgatgacaggtaataccatttttgccattcaaaccgtgatttatcaaatcaatgccattgtcggattatatggctggtatcgctctgagcagttggctcgcttgcaatcgccttaa

SEQ ID NO: 1893 - DNA, 1227 bp, M.catarrhalis
gtttttgtgagcatcagtgtagacactcttattatcggcgcaggggcatcggggctgttttgtgcttttaatacggcggcatatggcaaatcggtactcatcatcgaccatgccaataaagctggcaaaaaaattctcatgtcaggtggcggtcgttgtaattttgtgaataaacaagttgaaccatgccattttatcagtcaaaatccgcattttgtcaaatccgccctatcaaaatatcagccagaagattttattgatttggtcaaccgccatcacattgcccatcaagagcgtgaacatggtcagctattttgtaaaaacagtgccaaagatattttgtcaatgctactaaacgaatgtcacatggcaggagttgatattcaactaaaaacaaccgtccaagacattcaagcaactgatgctcattttttggtcactgtcaaatctcaacctgataatcgcaccaaagtcattcaagcacatgctttggttattgccacaggcgggctatcaattccaacactgggtgcaagtggttttggttatcaagttgccatgcagtttggacatcaaattattccaactcgtgcaggactagtcccttttactttcaccgataaagtcggcgagatgataaaatcattagcagggttaagccttgatgtgattgcttataatgacaaagcatcgtttgacttaccgatattatttacacatcgtggtttatcaggtcctgccatattacaattatcaaatcactggcaagcaggcgagcaaattaccatcaacctagtccctacccaagatgtgtatcagtatctattggatacaaagcgaatacaccccaagcaattactgcgaactgccttagcagccttattacccaaaaaactcatcagtgcatttgaaagattattttggcaagcttaccaaaacattgaacttgccaatttaaaagatgaaaccatgcatcacattggtcagcagttaaatgcttggcaccttaaacccagtggtactgaaggctatcgtgtcgcagaggtgactttgggtggtgttgatacgcatgatgtctcaggaaaaaccatggaatcacgccgacagccaaatctgtattttatcggcgaggtgcttgatgtggcaggacagcttggcggctacaactttacttgggcgtgggcaagcggttatgcctgtgctcagagcattggggtgcggtggtag

SEQ ID NO: 1894 - DNA, 1068 bp, M.catarrhalis
ctttttgagagatgggcgctgttaagagagggcatgatgcattgtaaaatagctgttgtatgtgtgctgataatggcaggtacacctctggtatgggcaaatcatacagcaaaagctgcggttgatgagctggcacaaccaaaggtaaaaactggcatgaatgccataaaacctgacatcaataccatgggctggattgataaaaatcatcaacgttttcaagattggcttcaaaatagtgctgttaatatagatggatggtttggagaaaatcaatcatcaaaacctgctaaggcaagcttacaagtgatgatggacaccacatggaataaatatgatggtataaaaattaaacctcgtgtgcgaggtcgtattaaattgccaacccttgaaaatcgccttagtttggtttttggtgatgattcattggattatgaaacccgtgatggtgcgctgagtgatgatcgtaaagttatgccaaatgctaatgatcaccgatacgatcgccgtgaaacacgagagagtaactcttctttggcactcagatggtctaaatttcgtcgtaataaagatattgatatagatttgggtgtcaggtcaaatgatgtctatatccgtgccaaagccgaaaagaaatgggaaatgccgcatgatattacgatgcgttttgagcaaatgtatcgttatggctcacatacggaacatactgctgtttcaacgcttgagttcactcagccacaatctgggcatagtgatttggtcagtcgtagccagctgcattatactcacaaaggagaagaaaatctttattggcacagcagtttatttcagcgtcattttgtgcctgtcaagcatggcaaatcagagctgaattatggtttatatgtgggtggtaatatccaagataaaaaagtatacctaaatacttatggaccttatgtaggctatcgccaacctgtatggcgaccatggctattcttacaaactgatgtgagttattacaacagtaaacatgacgctcgcagtcatcacacatccatctttgggcgtgccgaagttattttttaa

SEQ ID NO: 1895 - DNA, 642 bp, M.catarrhalis
attaaattaattaaacaaaagagagttgccatgagtgaagcattaaccagtaatatcaaaattaccgaacccgcccaagagtatttagctgatttgcttgccaagcaagaagaagaggggattggtgtgcgtatttttgtggaacatgcaggcacgccccgtgctgaatgttgcatgagctattgccatgctgatgaaatcgatgaccaagatttgcacattgattatgccaagtttaccgctcatattgatgctgatagcattccttatttgcatgatgcggtgattgattataataaagaccgattcggtggtcagttgacttttcgtgcgcccaattccaaagttccgcaagtgggcgaaaatgccagcattgaagagcgtattaattatgtgctgcaatcagagattaaccccaatcttgccagccatggcggttcggtagatttgttggaggtgattgaagatgaagcaggattaacagccgttttgaaatttggcggcggttgccaagggtgttcggcggttgatgtgactttacgccaaggggtggaagtacagttaaaacaacaaatcccagaacttacccaagtggtagacgataccgaccacagtatctcagatcatgcttattacaaataa

SEQ ID NO: 1896 - DNA, 495 bp, M.catarrhalis
tatactaaaattaatcaaacaacttggcaaactcaggagaaagtgatgtatcagcatgtattactcgtaaccgacctaaaagatgataccgatttggtcgctcaaaaggccaaatggattttggatctgcagccacaagcacagctctcggtgctacatattgtcgaagaaaccatgcttggttttggttatgagctgattcctgcatcagccttgcacgaacacattgatgatgaacgctgccaaacggctcgcatacgcttggccgatgtgctagcacgcaatcatttacaagcacatcatattaatatcaaaaccgccatttcagggcgtaaaggtattgttgactattgccaagctcatgcagtggacttggtcgtaattggtcgtcataagcgaactggcttatcagcttggattgctggagcgaccgcagatagtattttgccagatattgacagcgatttgttggttgtacaattaaccgaagattaa

SEQ ID NO: 1897 - DNA, 1611 bp, M.catarrhalis
aaggagttagtaatgacctaccaatcagccctagaacatgttcgctctgttaaagccaaattaggtaattattgggacgccatccgcccagaagatgccgctcgtatggttgtccaaaaccgttttaaaacaggtcttgatatcgccaaatacaccgcaagcatcatgcgtcgtgatatggcagagtatgatgctgataactcaaaatacacccaatcccttggctgttggcatggatttatcgcccagcaaaagatgattgccaacaaaaaatactttggcactaccagcaaacgctacatctacctatcaggctggatggttgctgcattgcgttctgaatttggtccattgcctgaccaatccatgcacgaaaaaaccgccgtaccaaaactcattgaagagatttatacttttcttcgtcaagcagatgccaaagagctaaatgatttattccgtgccttgcaacaagcagagcaagcaggcgatgaggcaaaggtcaaagaaattgaagcgaaaattgacaactttgaaacccatgttgtgccaatcatcgctgacattgatgcaggttttggtaacgaagaagcaacctatttattaaccaaacaaatgattgaagcgggtgcttgtgccattcaaattgaaaatcaggtgtcagatgctaagcaatgtggacatcaagcgggtaaagtgactgtaccacacgaagactttttggcaaaaattaacgccgtgcgttatgcgttcttagagcttggcgtggatgagggcgtgattgtggcccgtaccgactcagagggtgctgatttgacccaaaaaatcccagtcagccgtgaagcgggcgatttggcgagtaaatacatcagctatttacagaccaccgagattgacatcagtgaagccaaagaagatgaaattcttatcaagcgtaacggcaagctacaccgcccaactcgtctgccatcgggtctatatcaattccgtgaaggcacgcagcatgagcgtgtggtgctagattgtgtcacatcgctacaaaacggtgcggacatgatttggattgagaccccaaccccagatgtggcgggcattgcaagatttgtcaatgacatcaaaaaacaagtaccagatgccaaattggtgtacaacaattcaccatcgtttaactggacaatcaacttccgccaacaagcctatgaccgctgggcggatgaaggtcgtgatttatcaggctatgaccgtgataagctcatggatgcccaatatgatgacagtgagcttgcttatgatgctgatgaaaaaatccgtactttccaagcagatgctgcccgtgaagctggcgtatttcaccatctcatcacattacccacttatcacactgccgctttatctacccatgagcttgccaaaggctactttggcgatgagggcatgcttgcctatgtcgctggtgtgcagcgtaaagagattcgtgatggtgtcgcttgcgtgaaacaccaagccatggcaggctctgacattggcgatgaccacaaagagattttctcaggtgaaaacgccctaaaagcgggcgatgcaagtaagaacaccatgaaccaatttggcggttaa

SEQ ID NO: 1898 - DNA, 564 bp, M.catarrhalis
tttatgacagtacactcagtgaaacactcagttaaaaaaaccaagcggttttttttgcccatggtgatgtcgttgactgccatgatggcattgaccgcttatggcaaccacctgacatcacaacccagctctgctaaaaccatacccacccaaaccatggagtatcacgccatgaacacaacacacaccaccaaaaccatcgccagccgttatgattttaatgacaccgtcagtcgcttgcagtctgcttttaaagagcaaaacatgaccatctttgccaccattgaccaccagcacgctgcccaacaagtggatttggacatgcaacctgccacagtcatcgtttttggcacaccaaaagcaggcacgccattgatgaaaaaagaccctcattttgcgttaaaattacccctgaaagtgttggttaccgaaacagatggtcaggtttgggtcaggtttgaagacacgcacgcactgatagcaggcagtcagattggctttgatgatgttaaagacacgcttgccaatgctgaaaaattaattgaaaaaaccgtaactcaatag

SEQ ID NO: 1899 - DNA, 1056 bp, M.catarrhalis
ttaggtaaaactatgaaagcgcccccaaataatgccaaagattttgaagaatttggcacgccacaacaagcggacttgccaaacgatgccattccgttttatggcactcaaaaatacagcgaccacccacctagccgccttaagcttggctatgatattgtcatgttgatattattattcatcgatttgattttaatgatcattgacaatattttaatgagtggttttgcactcagtattgccaattggttgacgatatcacaggctgtaacaacctatcaaaccgatcatcacttgcatatctctgcacttggcggattttttacattattttggataatggatttattagcacgctggagtttggcgatttatcaaaaaacttattaccgctggtttttctttccatttgtgcattggtatgaggttttgggcgtatttcctgcgttgcgtgcgttacgacttttgcgagctgcagtcattaccaaaagattacaccgattgggtattcaggttattcccaaacgctgggtagattctgccaaattttattatcatcttttacttgaggagctgtctgatcgggtaattttgacagcaattgataattttcgtgcccaaatcgctcgtgatggtgctgggggtgctaaagtcattcaccagaccattgagcgtaatcgtacccaaattgagcttgccttactcaccttattgcgtaacgagttgacgcccaaattacaatccgctcttttggcaaatcacggtgaaaaacttgccattgatattgggcaagccgtagaaaaagcactcaccaacacccctgaattacacaaatatctaaaactcatccccattgcagatggtatgatagaatcacaaattcacaccattggcaatcaaatcgggcaaaatgtcaccactgctgtcaatcgtcatttgtttgacgatataacactagatactctatgtcatcgattgcccatggtgttgcccaaattgatgcctctcgtcctgagattcagatactcattgccgagattattgaagcggtgctaa

SEQ ID NO: 1900 - DNA, 303 bp, M.catarrhalis
tttttaggagcattcatgaccatcaccaccgaagacattttggactgtgcaaatttatcacgccttgctcttgatgaaaaaaccgcccaaaactatgcaggcaatttggataaaatcctagccatgatggacatattagatggcgtaaacactgataatatcaagcctttggcaaatatccacgaagcttgtaatgagctgcgtgccgacattgccaattctgacattggccgagacggttttcaagcggttgcccctatggtgcaagatgggttatatttggtgccacaggtgattgaataa

SEQ ID NO: 1901 - DNA, 1491 bp, M.catarrhalis
aaaaggcattttatgacagatttacaccacctatccgtccatgaattagcagacggtctaaaaaacaaacaatttagcagccatgaactggtagagcattttgccaatcgcattaaccgcttagatggtcaaatcaacagcttcatcaccaaagattttgacaatgccctagcccaagccgaacttgccgataaactgcgtgcaaaaggcgacaaccgtccacttttgggcgtaccaatggctcataaagacaacctatgtaccaaaggggttttgaccactgctggctcaaaaatgctctacaacttcatctcgccttatgatgcaacggtcgttgacaacatcgcaaacagtggctttgtgagtcttggcaaacttaacatggacgaatttgccatgggttcggacaatgaaagttcatactttggggcagtgcataacccttgggataccactcgtgtgccaggtgggtcgtcagggggttcagcggcagcggtggcggcagggtttgtgcctgtggcgacaggctcagatacaggcggttctattcgccagcctgccagtttttgtggcatcacaggcatcaagcccacttatgggcgtgtgtctcgctatggcatgattgcttatgcttcaagccttgatcaggcgggcgcttttggcaaatccgccctagactgtgcctacctgctcgccccgatgacaggatatgaccccaaagacgccacatccatcagtcgccccagtgaggattatgtggcggacattttggcaacagccacagacggcaaacctttggcaggcaaaaaaatcggcatagcacaggcgtattttggggcagggcttgatgatgaagtagaaaaatccattcgtgctgccctagccacatatgaagcgctgggggcaaaaatcgtagaagtggacattaccgaccctgccatcacacttgccacttattatctgctcgcccccgctgaggccagctcaaacctatctcgctatgacggcgtgcgttttggttatcgctgtgaaaatcccgaagacttacacgacttatacactcgcagccgctctgatggctttggcgaagaagtacaacgccgcatcatcatgggtacttatgctctctcggcaggctattttgacgcttattacaccaaagcccaaaaggtacgccgtcttatcgtggatgattttaaaaaggcatttgaaaaatgcgacatcatcgcaagtcctaccgctccaacggctgcctataaattgggtgaaagccttgaccctgccagcatttaccttggtgatgtctacaccatcggcgtaaacttggcaggtctgcccgccctatcgcaccctgttggacaagcaaatggcttgcctgtgggcttacaactcatcggcaaacattgggcggaaagcgagctgttaaaaaccgctcacatttaccaaagccataccgattttcatcaggcaaaggcggatttggtgaagtga

SEQ ID NO: 1902 - DNA, 795 bp, M.catarrhalis
ggcatcattcttatgacccaagccgtcactttatttggtaaaatgctaactttcagtcgcctaaaagtccataccgatgacttaaccgagattcgaaaggatttgatgcaagtactcagcaacaatcccattgccagtggcttgccgattgtgattgatagcacggtaaatcttgagctggatgcactcattgatatgctttggctgatggatgtgcagcccatcggtgtggtgagcggtcctttagataatcaagcacgagatctacgcttggcaatctttcctgctgatggtaaacgcattgaacgattgccaaataccgaagacaaatcaaatcccaatcaaagcggtacagtgcctgcacccaactatgacactgacaaacccatctcagctgctgctgtaagtactcagcaaggttccacgctatcaaccgctcaagataatcatcgctcattagtgagcggcattcatacacatatgttgcgttcaggtcaaagcctacaacacttagggggtgatttgacagtcattggtggcgtcaatgatggtgcagaagccattacggataacagtttgcacatttatgggcgtggtttggggcgacttgttgcaggtgcaacgggtgataaagaagcacgcattttttgccaaaaatttaatccatctttggtgtcagttgcaggtacttattgcttgcgtgatgccatcccaagcgagatgattgatcaggcagtacaagttacttatgatgaagcacaaggattggtattcaccctactaaaccagctataa

SEQ ID NO: 1903 - DNA, 411 bp, M.catarrhalis
ccatttgaccaagctggtcaaaaagcggataatgcgtttgttgtctactatcttaaaccgattatgaatgatataaaaactttgccgattgtgttggcatccacatcaccaagacgccaagagctgcttttggctgcaggcgtgaaatttgttgtaaacgcagttgagattgatgagtcttggcaagccaaagaggcaccaacagactatattaatcgcatggtgctgaccaaggcacagcaagcagccctgaacagccatttgccagataagtgccttttgatcaccgcagacaccattggcgtgattgatgatttggtactgaccaagcccaaagatcaggcggatgcatatcgtatgtggcagatgctttcagatacatcgcatgagatgtatctgaaatcttcacac

SEQ ID NO: 1904 - DNA, 210 bp, M.catarrhalis
gtacacgggcaaatgcttttaacacctgttttgacacctctccgggtggtaatatttgtcccttatcctaatattaaatgtgaagaaaagagagcatgtattgctctcatctatttgggcgccgtctgcctctataatatggttagttgtatctctaatattcaggacacactatatcgctacttatcgtgtcattatgcctgcaacact

SEQ ID NO: 1905 - DNA, 612 bp, M.catarrhalis
agcagagttaaatttggtgatcaaaccaagttaaatgatcaaaccaagttaactgcaaagcgcaaaccaaactgtatcggagcaaatatgaaacaccaaaaactaaaagcacagccacttattttttctttgtgtttgggtctttggttgacaggatgtggcagcgataattcaacatccacgcctgcacctgttaatgaaacccagccaagcacaccaaccagcgagcctgccccagctcagcctgaaccaagtgttgaaactcaagcaacacctgagacggcagagacccaagacgcccctgaagtggcggaagtgactgagccagttgatgttactacaagtcatgcaccagtggaagctgcatctattgaggtgggtaaagctctctatgaaaagacttgtaaagtatgtcatgatgcaggcttgcttgaagcaccaaaaatcactgacaaagctgaatggcaaaaacgcctagatgaaaaaggtttggaaacattacaggcgcactctgccaaaggatttaacaagatgccagcccaagcgattggcgatgtagcagaatctgaggtttatgcggcggttaattatatacttgagcaagccaaataa

SEQ ID NO: 1906 - DNA, 960 bp, M.catarrhalis
ctcatgataaactctcgcaaaatgctgcccttatttaaaaaactgcacaccaagcaaccgaaacttgcccagaaactttcactactcaccaacgcaagtgccattaccgccaatagtttggcattgggtgtacctgtcattggggcgggcttggctaaaacactcactcgctcaaaattagccgatcaaaccatcatcacagctgccaatcgctggattcataccaataatttgttgattgataaggtcttacctcataaagattggcgtatttttttacccaaaaatttaaatcccaatggcaaatatctgctaatttgtaatcaccaatcttgggtagataccagcatcattcagtatatcagcgaaggtcggctgcccatcacccgattctttgccaagcatgaactgatttatatcccagttgttggtcaagccttttattttttagattttcccatgatgaaacgccataccaaagcacaaattgccaaaaaccctcaattggctcgccgtgatttggatgaagcattacgagcttgccaatctttgaaaaataagccttttgtcttactcaattatttagaaggaacacgctttactgctgagaaacacaccaagcaatcctctccgtataagcatctgttaagacctaaggcgggtggttttgcactggctttatccagccttggtgatgagattgatggtattttggatatgactttggtttatccagacggcgcaccgaaatacagcgacctttggtcaggtaaactgacacggctatcggtagatattgaatttatcagcccaaatgatgagttattaacagcacttaaacatggtgaatacgataccaatcaaaccatcaaacacgcactttatgcttggcttgatgaaatttggcaagccaaagataaaaaaataagtcaaagactggcggaatttcatcagtcttaa

SEQ ID NO: 1907 - DNA, 696 bp, M.catarrhalis
ccaaaagcaaaaggagtttttatgaaaattaaagcattgggtgttgtgctgttggcatcaagtatggctttggcaggttgtgcaaatacaggcacaactggcaatggcacaggatttggtggtgctaatgtcaataaggcggtgattggggctgtggcaggtgcacttggcggtactgccatttcaaaagcaactggtggcgaaaaaacaggtcgtgatgccattttgggggcggcagttggtgcagcagcaggggcgtatatggagcgtcaagcaaagcagattgagcaacaaatgcaaggaacgggcgtgactgtaacccacgataccgacacgggtaatattaatctaactatgccaggtaatattacttttgctcatgatgacgatactttaaacagtgcatttttgggtcgtttaaaccagctggctaatacgatgaatcagtatcatgaaacaacgattgtcattgtaggacatacagactcaacgggtcaagcggcttataatcaagagctgtctgagcgtcgagcggattcagtgcgttattacttgattaatcaaggcgttgatccatatcgtattcagacagtggggtatggtatgcgacaaccgattgcatcgaatgcaaccaaagcaggtcgtgctcaaaatcgccgtgttgagctgatgattttagcaccgcagggtatgtaa

SEQ ID NO: 1908 - DNA, 261 bp, M.catarrhalis
tcaattgcatgggtcaataaagaggtgatgcatgtattttatccaaaccaaaaccaaaaaccaaccaaaacaagcacaacaggcttttttaatgaagtattaaaaaagcccacctttgttaaaatatattttaaccatatcttgtggtggacttttgtttatggtttaattaagactgatgaaattccgccagtctttgacttatttttttatctttggcttgccaaatttcatcaagccaagcataaagtgcgtgtttga

SEQ ID NO: 1909 - DNA, 546 bp, M.catarrhalis
ttgtatcatcgctgtttgctttatcttattttaaggagtgccattgtggcaaaaatcgttgtagtaacttcaggtaagggcggtgtcggcaaaaccaccaccagtgcatcatttggtgcagggcttgctaagcgtggctttaaaacagtcatcattgactttgatgtcggtttgcgtaatttagatctaattatgggttgtgaaaatcgcatcgtctatgactttgtagatgtgatcagtggtaatgccaagcttgctcaagccttagtcaaagacaaacaatttgaaaatctatacattttgcctgcatcgcaaacgcgagacaaagacgctctgaccgatgaaggcgtggctaaagtcatgaaagagctggcagatgatatgaaatttgattttatcatttgtgacagccctgcgggtattgagcgtggtgcacagcttgcgatgtatcatgctgatgaagcactcatcgttaccaatcctgaagtttcatcggtacgagactctgatcgtatcattggtatcctacaaagccgtaccaaataa

SEQ ID NO: 1910 - DNA, 954 bp, M.catarrhalis
aaggagataatgatgcaacgccgtcattttttacaaaaaaccttattggcactacctattattttttctggcaatttattaactggatgtaaaacgaatttatctgatgattatttgcccgatgataagataacaaacaatccaaatttattacaaaataaattaaaagagatattgccaatttgggaaaataaatttaatgccaaaattggtatgacgattattgctgacaatggtgaactatccagtcatcgtggtaatgaatattttcctgttaatagtaccattaaagcctttattgcaagtcatatattattacttgtagataaagaaaaattggatttaaacgaaaaaatcatcattaaagaaagcgatttgatagaatattctcctgtctgtaaaaaatactttgatgagaataaaccaatttctattagtgaattgtgcgaagctaccataacactgagtgataatggttctgctaatatcttgttggataaaattgggggtttgactgcattcaatcaatttttgaaagagattggggcggatatggtgctggcaaataatgagcctttattaaatcgctcacattatggtgaaaccagtgataccgcaaaaccaattccttacacaaaaagcctaaaagcactgattgtaggcaatatcctatccaatcaaagcaaagaacagttgataacttggcttatcaatgataaagttgctgataatttattgagaaaatatttaccaaaaaattggcgaattggcgacaaaacaggcacaggtagtgaatcaaaaaatatcattgctgtgatttggaatgaaaataataaaccttattttatcagcctatttatcacccagccccatgatggtaaatcccttgattttaaaaatcaaaaagatgaaataatggcacaaattggtaaagaaatttatccatttttataa

SEQ ID NO: 1911 - DNA, 219 bp, M.catarrhalis
gtagtgccaataaggttttttgtaaaaaatgacggcgttgcatcattatctccttttattgtttgggataaatttattattgtttgggataagtttatcattcaccccaatccaaaaatcacttcaccaaatccgcctttgcctgatgaaaatcggtatggctttggtaaatgtgagcggtttttaacagctcgctttccgcccaatgtttgccgatga

SEQ ID NO: 1912 - DNA, 1485 bp, M.catarrhalis
atagaaaaatttatgacccaacaagcccccctaattgacggctatgaagttgtgattggtattgagattcattgccaattaaatactgacagtaaaatcttttcaaacgcccccaccgtctttgggcaagaaccaaatacccaagccaccattgtagatttgggctttcctggggcgttgcctgtcttaaatgcaggcgtgattgagcgtgccttaaaatttggcatgggtgtcaatgccaaacttggtacttataacacttttgaccgtaaaaactacttttatcctgacctgcccaaaggctatcaaatcacgcaaatggcaaatcccattgttggcgagggctatattgacatccttgtcaatgcagggcaaaaggatgaatacaccaaacgcattggtatcacacgggctcacctagaagaagacgctggtaaatcggtgcatgatgctgtaccgcagatgacgggtgtggatttgaaccgtgcaggcaccccgctcattgagattgtctctgaacctgacatgcgttcggttgatgaggcggttgcttatgtcaagaccattcacgaactggttacatggctgggtatcagtgatgccatcatggcagagggttcatttcgggcagacattaatgtgtcggtacacaagccaaacacgccctttggtactcgctgtgagcttaaaaacctaaactcatttcgctttattcaccgtgctatcaagtctgagattgaacgccaaattgatgtcatcgaagacggtggcaaagtcgtgcaagccacacgcctatatgaccctgagcgtgatgaaactcgtgccatgcgtaccaaagaagaagccaacgattaccgctactttccagaccctgacctgttgcctgtcatcatatcagatgagacacttgccaaggtgtgtgccgatatgccagagctgccaagcgtacgcaaagagcgatttgtgagtgaatttggcttgaccgcctatgatgccaatgtactaaatggcagtcgtgaactgtcggattatttcttgcaagtacttgatatcattggtaaaaataatgccaaaatcgcagccaactgggtcatgggtgagctgtcaggctcactgaacaaaaatgagctgaccattgaccaatcacccatcagtgccaagcgtttggcagggctaattgtgcgaattttggatgataccatcagcggtaaaatcgccaaagaggtgtttggtcatctgtgggagtctgacaaaagtgctgatgaaattatcaccgaaaaaggactaaaacaagagaccgacacaggggcaattgaagccatcatcgtcgatgtacttgccaataaccaagccatggtggatgaatacaaaggcggaaaagaaaaagcctttaatggactggtcggacaagtgatgaaagccagccgtggcaaggcaaaccccgctcaggtcaatgcgttattaaaacagatgattggagcgtaa

SEQ ID NO: 1913 - DNA, 2151 bp, M.catarrhalis
tatactctaacaaaaggaaaatcccccatggataccgatatcatcctaaaaaataccccccttgacgcccgcttacagttgattgactttaataaagccacacctcaaacacttaaaaatttaattcaaaccgtcttagatgatgccaacgaaactctgaccgacattgaatcggcaagcctaccaaccaacgcaaaagaagcatttgaaaaaatccaaaaatttaatgcaatcagcgaaaagctcgaccgttattttagcgtactatcacacctaaatagcgttgccagtaatgatgccgtccgccagacccaccatgaggtactacccaaaatttctgaacttggcactcgcattggacaatctgtcgctttattttctttgtatcagctggttgatacacaatttgaccaactgccaagccaataccaaaataccgctcaaaaacgcgccattgaaaaatctttacaaagctttcgcttatctggtgtggcattggatgcagataaaaaagcacaatttgccgacattcaaagtaaactgtctttggcttctgctaagtttgcagataatgtcatggatgcgacgcgtcattttgttcgaccactacgcccagatgaattatcaggcatcagcgaaaacggcttagcactgcttaaatcagcagccgaaacttatcgtgccaagcacccaaaggcaacacttgaaacagaatatgttgccacccttgatatgccgatgtatttggcggtcatgcagtttgctgacaatcgcacgctgcgtgaagagctttatcatgcttataatacacgcgcctctgaccaaagcccagatacaaccgagtttgacaatgcccaaattatggtggatatcatcaatttacgcactcaaaaagccaaacttttggatatgcaagactacagcgaactgtcgcttgccaccaaaatggcaaacaccagtgatgagattgagaaatttttactgtcattaagccatgccgccaagccacaagcttatgcagaatatcaagaacttaaagactacgcccaaagcttaggtctcgatgaacttaaaccttgggatgtggcttatgtcagtgaaaaaatccgccaaaccaaattcagcttaaccagcgatgagcttcgtccatattttccgctacctgtggtattagatggtttatttgaaatctgtcaaagactgtttggggttaaaatttctgttacccaaaaacaaaactatgttgcatggcatgaggatgtgctgttttgtgtgattcatgattcagacagtcatgaactgttgggcggcttatatcttgatttgtttgccagagcaggtaaacaaggcggtgcttggctagatggcttccaaagccgacaagtttacggtgatgagttacgcttgccagttggctttgtgattggtaactttgcaccacccattggtgataaacccagtttattatcctttgacgaggccaatacgctgttccatgagtttggtcatgcactgcaccatgtattaacaacggtcgatgtagctgatgtctcaggcatcagtggcgttgaatgggatgctgtagagttaccaagccaatttatggaaaactttgccatcaccgatgaaggtctacgcctaattagccgccatgtagaaacaggtgacgccctgccaaatgataaaaaagatgcacttatcgccaccaaaaatttccaaactggtttacagacgctacgccaaatggagcttggtttgtttgatttgcggttgcacaccgctaaaatggttaacttcggtcaaatcacttatgcagacatcttatcggtagccgatgctgtgcgtgatgaggttgccgtcatcttgccagcttcatatcagcgttttggtaacggctttagtcatatttttgctggaggctatgcttcaggatattattcttatatttgggcagaggtgctatcagcagatgcgtttggtaaatttgaagaagatggtatctttaatccagccacaggccgtgcgtttcgtgatgaaattttagcccgtggtagctctcgtgatgcccaagataactatgtggcatttcgtggacgcaaagccacccaagaagcgttgttacgccatcgtggcttgattaatcaagcataa

SEQ ID NO: 1914 - DNA, 828 bp, M.catarrhalis
tcatcaatttatcatcatcgtgctacaatagccatcattaaaatcaattctacccacatatccataaaataccacgccatgaaatccattacaatcaccagttataatattcataaaggtatgtcgccgaccaatcgcttggtacgattgatgggcatgaaggatgccttattaaaaaccaatcctgatattttatgtctgcaggaggtgcaagggcaaaatctcaaacgcacgattgattttgctgaatttcctgacggtgggcaacatgaatggtttggcgagtttttgggcattgcatcaagctatggcaaaaatgctgaatacgaacacggtcatcatggcaacgcagtgctttctcgccacccacttgacccaaaacacaacctaaatattaccgtcaatcgccttgaaaaaagaggtgtgcttcattgtgaggtgcatccagatggctggaggcgtcctgtggttgtgttgtgttgccatttaaatttgttgcatcgagaccgcattaagcaatatcaagcaattcgtgattatattgtcacattgccagcagatgcatcgctgattttggcaggcgattttaatgattggtcaaaaaaatcttgtcaagccttgtcatcactagggcttagtgaagtgtttttgcaagtgcatggtgaatatcctgccacttttcctgccaaaatgcctgtattaagtttggatcgcatttatgtgcgtaggcttaaggtgcataatgcgatggtgcatggcggtgtgccgtggtcaaatttatctgaccatctgcccatcagtgcgtgtgtttctgagatggatgagtga

SEQ ID NO: 1915 - DNA, 810 bp, M.catarrhalis
  unsure (173): Identity of nucleotide sequences at the above locations are unknown.
gttctttgtcattggggtcgtcaatatctgcacacaggctatgtcacacgcacaaatacctatacaccacttgaaactttggggaaaatagcatccgcttggattatactgccattaaaggattgcatgccagtggctattatagccctgccagcttcaagcgatgttcgtanaaagaagaatgggcaagaggtagagggttttggtgcgtctgttagctaccttcatccacttgatgatcatcaaacggtgcgtgttgcattgggctatagtgatagccgtcaaaacgcaaaaaccacaggtagagacagtaatttttatgctaccaagagccaaggtgcagcagcttcggttgaatatcgcaacaataaactgctattggcggcagatattgggcaaaaaaatgaacaaatcaatggtactgttaccgataaatccaagggcaactacatgggcgttaaggtaggttatgaaatcacgcctcgcctaaccatgacggcaggctttggtaaaaaagttgctgaacgcactcaaaaaagcggtgcagcactgatacatgcctaccaaaaagacttgtgtgttgctgatgccaatgattcatgccataattttgttcaggcttatgaaacagcgttatttgataagattgattcaaaacgctcttatgtgcgtgccgattattatctaagagaaaatgtacgcctatacggccgtattgatgacgaaaaaattaccaatcagttgggtaataaagactttagcaagcttcacaatacaggctatcgtgctggcgtgtcattcattttctaa

SEQ ID NO: 1916 - DNA, 252 bp, M.catarrhalis
ttaatcaagcataatcacatgcgttaccaatctaatcgcccaaagcggcagtttttggctggtgtggtttgccccacttgcaagaaaatagataccatcgtccaagttcaagtctttgagcctgactatgatgaatatattgaatgcattgagtgcgggcatcatgagcatcgtcccacacctgatgagcttaccaccatccaagaacacgccgcccaagcagatggcgttggcattgtgaagtttagataa

SEQ ID NO: 1917 - DNA, 2772 bp, M.catarrhalis
ttaaaatttaatagcatggcttggctgattacttttttgaccaagcatgctaactttgctctgttatggagtacggagacaataatgaaactcaataaactagccgctattatcagtgctggcatatcgtgtgcgtacctgacccaatgcacttctgttcatcaaatggcaacatttgacaccaaaaccatcgataatgaagcagctttacaagatactaagccgcccactaacggtgtttatacttatcctgtaacacgcattcatcaagacagtacggattattttttaagtggcgaatatggcagatcagctgaccatgtgcgatctgaaggtgagtttggcgactcttcagcataccctcgtcccgatgatggcgtcagtcgctattttggtgaaaaaattgttgataagtttcgttggcttgaaaatgtcgatgacatgaataaagactacacccaagaaactgatgaagatcgtgatcgcaatctgattggttcgttgcttgaagatgatgtgaaagatgggttgtttgataaccgcacacgcaaagatttacagacggttaagccaaaacaatcaagcgaggttaatgattgggtaaatgctcaaaatgaggtaaccaatcagtattttgatgccaacccaatctatgagcaagtcaaaaacaatattaacgctttgatgagctaccgctatagctaccgtaaagaaaataaagatggcgtaggcagtcttgaattataccgtcatgaagacggctatatccgccttgagttgacagacactgatggcaataagcgcaccttattcaatgaaagagagctttcagaagatggtaataccgttttgccgtggccagatatttatgtcagcgataaaggctcttatgttgcctatgtcaccgcccctggtaataatgatacagacacccgaggacgcacagatttacatgtcatcgatatcaaaacaggtaaagctgccattgagccgattcaaaatgctgacaataacagcattatttggctagatgataagagctttttgtacattcaaggctcacaaatcaaacgccatgaagttggtagcaaaaaatgggttgatcccattgaggtgacttggggtgagatcgatggtgcaggtccaacggatatgtggtacagcgatgatgaaaccagacggtatttagtcattgaagcatataaaaaagcaccgaccagcttcatcaaagacaccaaaaccaataaggtatatcgtattcacagcgaaaaattctttaatgactttttctatcacgcacctgattatactcacgcaccgttagcctctttggtacattttgatgataaaacgctggatgtttacttcatctcaggtgaaaaaaatatcaagggtgatattttcaaaatgaacctaaacaatcctaaaaagcgtgagattgtggttgctatccctgatgagtatgatgaaaccttagaggcgatttatcaccctgaagcaggcggtcattttttgattaaatatctaaaagatggcgcacacaagctgatattaaccgatacaacgggcaagattgttaaagatttgacacctgacataccaggtaatgcggacgatttaaccagctatgttgcagaagatgacaacaaggatggggataaaaaagcaaaagataaagaggtagccgatgaggatgatcaaacccctgatgaaagctatgtgtcttttcgctttaatgccatcattaagcctcgcacggtttataaatacagcccatcaaagggcgagtttattgatgtgcgtcgtcgagatttgattccttttgatgaaaatctttatgaaagtaaacaaatactttacacctcaaaagatggtaccaaagtaccgatgaatatcaattataaaaaagggattaaacttgatggtaaaaacccaaccgtattgtatggttatggtgggtttggggctactgaaaatcttgcctttcataaaagcaaagccgcttggcttgagcatggtggtgtgtgggcaactgcctttatccgtggtggcagtgaatatggccatacatggcataaggatggccgcctgctcaataaaatgaatgtctttgatgattttgcagctgcggctgattatttggcacaatcaggctatgctgatagcaatcatttggcaatctctggcgcgtcaaatggtgggctgttggtgggtgcttctatggtcttgcatcctgaaaaattccgtgtcgccataccagcggcaggcgtgcttgatatgttgcggtataacgataatttccatacccaatattgggcaggtgagtatggtttgccctatgacagtgttgcacaatacaagcttttaaaaagctattcgccttatcataatgtcaaggcaggtgtctgttatccatcaacattggtgatgacctccaagcgtgatgatagggtgacgccttcgcattcttataagtttgttgcagctttgcaagataagcaggtgtgtgctaacccaactttcttatatgcagctgagcagtttggtcactgggcaaatacttatcaagagcaaaaaaatgactacagtctgtttacaagttttgcactcaatgaaatgaatatcaaacatgtaccagacctaactcatcgccatgatgctgatttttataaaactgataaatggcgtgaagaagaggccaaagagcatgctaaacagattaaaaaactgcaacagcggattgataagctcaatgaaactaaggataaataa

SEQ ID NO: 1918 - DNA, 375 bp, M.catarrhalis
ggatattttatgaaaccatcaatcatcaaaaacccattaaagcttttgaccgccatgattttgttaaacgcaatgcctagccatgcgatttataatctgtataaaagcggtgattttagctttgatgtgcatggtgagattaacacttatgggcaaaaaaatagccaaaaatatacctacctttatccagaaacaggctgggcaagtgttaacaatgactacgaagccatcaccaaaggtgcttatgagcaaagaagtgatcgccgtgtacgcttggggcaagatacaggtgcttcttggacggagtttcgtgcatctagaaaactaagagatggctggcgtgtcagtggagcgattggttttgggttattatga

SEQ ID NO: 1919 - DNA, 639 bp, M.catarrhalis
aaccaatcaatcacaaagggagtaatgatgcaaaagtgggtattagccagcaacaatcaaggtaagttggcagaatttcaggcgttatttgatgacgctgatttgggcgttcatatcatcactcaaggcagcttggggattggcgatgtcagcgaagatgggaagagttttattgaaaatgccatcatcaaagcacgccatgccgccaaagtcagtgggctgcctgcggtggcagatgattcagggctatgtgtccccattcttggcaacgcccctgggattttttcggcacgctatgctggacgacatggcgatgatgctgccaataataccaaattgcttgagcaattaaaaccctatcgcagccgtgcccccattgatgccttttttgtctgtgtactggcgtatgtgcgtcatggcgacgatccgatgccacttatcgcaattggcaaatggcatggcgagatacttaatgaacctgtgggcgagcatggatttggctacgatccgctgttttatatccccaagcttaaaaaatcatccgcccagctggatcgtgccgccaaaaatgccatcagccaccgagcgtctgcactgcaagatttgcttcgccaattaaaagaaacttggctggtgtga

SEQ ID NO: 1920 - DNA, 1233 bp, M.catarrhalis
aaggagcaattacttatgaaaaaaacttccacacagcttgggctacttgccgtcagcgtttcgttgattatggcaagtttacctgcacatcctccctatcttgcccgtaacttaacacatggtctgaaatttggtatcagtggttctgtcaatcccagccttagcgtcaattcaagcacttttacttatttgggtgactcatcagtatatggcaataatgccactttagagcgtatgctacaagaccaagacagacaagacagtgatgagcgagcaagactcaatggatttggtggtgcttctgtttatctgggtgcccaaaaatacctaactcgggatattactttatttggtaatgttggtttgtatgcaccagcaagcaaaggtcaaagagctgcatatggctatggcgtgaatcttgccaccaaatatggcagtatcggtattaatactgataatgaatttagtgctggtgctggtacgcccagcggaatttataatttggttgatggctcaaacgagtacagcactgccatatcggttagtaccagctatatccctaagtttaagtttagtgcataccatgcattgcctggctcacctgatacacggtcggtgagtagccacgaaaactactatatccaaaaagcacaaggtctttctgcatcttatagccatcctattagcccaaatcaaaccctgtctgttggcacggcttatagcaaaagccaaaggcacaaagatttttttagcgataccgcctataataacaaaacagcgtccactgtggggctaagttaccgccaaggagattggagtattagcggtaatgttggtcaagccaaagaaaatttacacggtgcgatcattgatgatattaccacaaaagcttttgggacaaaaattagctacaaagtaaccccaagaatttctgtttctgggacttatggacaaaaaaccaccgataaaaataccaagcccaacaaacgcttggatataccaaatatcatcgcacaacgaggaggtaatatttcaagccgtgtgcatgaaagttggttttttgataaaaccaaacaaaaaacctatggtctgagtgcaagttattatatctatggcggcatatcgatttctgcttcgatgaaccaaacacgcaccaccaactttaccgaagaaggtgcgtatagtgagcgtaagaataacagctatcgcatttcaactggcttttcattttaa

SEQ ID NO: 1921 - protein, 84 aa, M.catarrhalis
VQNLLFNPVFVPNDMQVGQTGKIVAPNLYIAIGISGAIQHLAGMKDSKTIVAINNDPESPIASVADYFLEGDLFDVVPELIEKL

SEQ ID NO: 1922 - protein, 502 aa, M.catarrhalis
RPDNAVLFVPNGDLLTQPANQADKPQLYHRLWGDLLNWIKTNRPRQPMNGIVLTVDTLSLLTNSKEQNSQLLADLQMRIEEIRMTFNSRLPLYIVLTKLDLLRGFDSMYQSLDVQQRNEVLGVSFNQKAKSNWKKELNHFWSQWVGQMNSALPEMMLQRAEGNQRSDLFSFVRQIEGLQHSVCTLIDALLINNEQHNICLRGVYLTSALQIGQIDDVFSQTASEQYHLPTAPLTTWPINDSHPYFTTQLFNQVLFSEPNIAAENHYWVKKHRTRLLVTTAVSFVGLIAIWNGWSHYYDKNYRAGENVLNEVKAFRAIENNAQKDTDGSLQLPVLNPLREATLAYGNHRDKNVLFSDMGLYQGQKVGPQVEQVYLQLLTDRFLPAVMSGLLNELNSADKGSEDKLEILRIMRMLEDKSGRNNGMVEDFMADYWSQLFTGQREKQLQLKAHLRYALEHTDWKQEREKRFVSATKAFMPFAGPIKNAQAELSVLSLYQRVYQALR

SEQ ID NO: 1923 - protein, 62 aa, M.catarrhalis
LILSVSIFLPIFIVDFCSTYMLLLLFHTIYLIIPSNILSSSNYLTQHFLNLVLYSSWCHQYL

SEQ ID NO: 1924 - protein, 201 aa, M.catarrhalis
EDPNCLEIVTTMQQDSLVCQVPCHRFDLTIYQDIVEEITRMYGYANICATLPELSVDMRYDDTADLVQLVKRSLASSGYYEAVSFSFSDAKIEALFDDQSLGAVLPLANPISSDLAVMRRTLMSSLLPIVSYNLNRQQPRVRLFETGLSFVGGDVEHVVQTPSLAMIATGELTTEQSHGTRKMDFYDLKRDIESLLPNTLD

SEQ ID NO: 1925 - protein, 284 aa, M.catarrhalis
KGNPMSDQAPSSITPKPKAPITLSTLNKLKAEGKTFSCLTCYEASFAHAMQLADIDTILIGDSLGMVVQGQSSTLPVGVQDMVYHTQNVVRGNSHALILCDLPFMSYATLSDAITSAKAVMQAGANVVKIEGGSELSDTVKVLTNNGVPVCVHLGLTPQSVNVFGGYKVQGKTDAQADKLMRDCTAVVNAGASLLLLECVPAPLAKAVTERFDVPVIGIGAGVDTDGQVLVMHDMLGIYTRKPAKFVKNFLTDDSNQTKDIVGAFKAYHHAVKQRAFPTKQHSF

SEQ ID NO: 1926 - protein, 221 aa, M.catarrhalis
MLSTVKNLFGEFMNAMIKKLLQGQAVEWRALGEVAKKISSGGTPKTGIPEYYNNGEIPWLRTQEVNFNDIYDTGVKIIEPGVKNSSAKWIPANCVIIAMYGATVGRVGINKIPMTTNQACANIEVNEEIAEYRYVYYCLANQYEYIKSLGTGSQTNINAQIVKKLKIPIPPLSIQSQIVAILDTFDTLTQSISEGLPKEIKLRQKQYEYYREQLLNFKATI

SEQ ID NO: 1927 - protein, 73 aa, M.catarrhalis
KTEAAPAPKSININTASQADFISLVGVGHKTAQAIVDYRHEHGKFDSVQSLMNVKGIGPAILNKNRHRLSVAN

SEQ ID NO: 1928 - protein, 221 aa, M.catarrhalis
YHHQILGFILQQGNFMKFALKTALLTTMLSVATLAQANFVEGQDYKVLPNPETIAGDVIVVREFFWYGCPHCYHLEPHMQKWAKTRPADVAFFQTPAAMNPVWEVGARGFYAAQQLDAQEKTHQALFDAVHKDGNRNIISSQQELGNWYASKGIDKAKFDSLYNSFAVTTKIERAKAAATRYGLSGVPAVVVHGKYVVSGEDAKVPQVVDFLINKVREEKQ

SEQ ID NO: 1929 - protein, 181 aa, M.catarrhalis
PQINDKLTTNIRYLMIDWSKMDMRVSRTEIKKSHERLQALSEPLAKLSKKQLANLPVSEYFLDELKHLTNIDSHAAKNRQIKRVGKLIIEENRHALTQALFECQFTPEQIAKIETWYDRLKLSDESTIKQFVKQFKKAEYNSIYQLLLWIEYAKHLGDDELLAESVADFESYVKEVAILSK

SEQ ID NO: 1930 - protein, 170 aa, M.catarrhalis
CQTKGRQHMTTCFIGLGGNITNELGTPTEHIINAVQAFKQSPHFTDVKMSSLYQSKAFGITDQPDFINAVLSANTSLPPLELLDFCQGLEQTAKRVRLRHWGERSLDVDILLYGDKRIHHERLTVPHQGLFERNFVLIPMLEIDECLLVNGQKLADLNESNSWQGLNKLT

SEQ ID NO: 1931 - protein, 130 aa, M.catarrhalis
SKAKLSDELGDVLFVLTHLARHLGIDSEMALQGTVGKFRRRFAFVEQSLMDQGKSFENSDLAEISGPRSCQRQMVVWLRRALPYYLAVFRMQALDMPIRPNSAMLIQKVPIKNGSSAGAEKHKYQYRKPS

SEQ ID NO: 1932 - protein, 82 aa, M.catarrhalis
IPPLIRQFGEFTNFVKISIIDRLVGIAGRVYAVDGGSIMTLHGIILWFCFMWLNFFILSFLTVFDYFYNLRSSLLILSTQNS

SEQ ID NO: 1933 - protein, 132 aa, M.catarrhalis
ISKSGRTWALRVMYNLAVAYFQGDGIQQNYQKAHAWYQKAADMGHASAKYNLGSMYFYGQGVAANQSHALALWQQAAKQGNAKAAHNIGVYYYKSNLEQNKAAAKQWFLVSCQLGLSDGCIKHDNFDKLTTN

SEQ ID NO: 1934 - protein, 623 aa, M.catarrhalis
WISGKIKDLLQSVFGQCPSNQGVGMGKVPKKPKQTKKSICTTHSAKSLRLQKGSLPHSIVEVIGTLQKAGFDAYIVGGGVRDSLLGLAPKDFDAVTDARPHEIKAIFGGRCRIIGRRFQLAHVYSGREMIEVATFRAPPKDDTHTTDDGMIIRDNVWGDIEQDFARRDFSINALYYQPIKGEVLDFCGALKDIDSHTLRLLGDAKVRIEEDPVRLLRALRFKAKLGFEFDQDLANQFHQDNWTLLEQVSAHRLYDETQKMFGGGYLTPLLPLLFEHGAMSSLMSFAPNEPTPLMMVVAQNTDRRIAADKSVNPAFFYAAMLWENYLYQLAKYKKRGLPFHEAQIKAAEKTIDAQRIKTAIPKFAEQFITDIWLLQPKLVNPRVRDIANLERLPKFRAAFDFLVLREGYDTHPLSEPTQNMGAWWQAYQDASAVDKAIMIEAFGTQAGTPKRRRDRNAKKDTKTRELEQLKELSLRSDDELIKTRPEPLFVVAGAEDLVKKTKARTKLPTPAVPTPVFEPVNFTQADFEKLLANDEPYIPASRHRKRKPSSTLSIKEREQGLIKQSDEHWSGSKQSAQTKKPSRHQSKQVDGVTDIEPKLVENQAKPKRTRRRKSNAKPKADSI

SEQ ID NO: 1935 - protein, 61 aa, M.catarrhalis
HFHIGKMWRLFEGLYGVDDMLGGSAKFIGNVATKSNKTSGHMLSAFGLALDLRRRVLFGLA

SEQ ID NO: 1936 - protein, 283 aa, M.catarrhalis
DKNMNICHTIKDLKNKLNPLRNQKIALVPTMGNLHDGHLSLVNLAKQHADVVVVSIFVNPTQFGAGEDFASYPRTLDDDCQKLAKAGVALVFAPSVDEMYPVYPPNVQILSGSISKILCGQTRPTHFDGVGLVVSKLFNIVRPDVAVFGKKDYQQLAIIYQLVQELNFEIDIIGGEIVRADDGLALSSRNQYLTEQERAIAPRLAQALQQLAGGLKSANFADFDMMIQKTKDELTHDGFTVDYLQVLNQQLQPASRHDKNLVILTACYLGGARLLDNLEVALN

SEQ ID NO: 1937 - protein, 84 aa, M.catarrhalis
KKKKRKKKKKKKKKKKKKKKKKKKKRKKKKKKKKKKKKGGGGRRRKIRRGGKKELLGDFNYKPDTLSDNQKQNYLMSWAMCCLC

SEQ ID NO: 1938 - protein, 298 aa, M.catarrhalis
GNMMPKLIAPNSIIVVSGRSGSGKTSVLNTLEDFGYYPLDNLPLSIVPLAIEKLVNDSQIHRIAVGIDVRTPKADLSNFGQVYDSLIQTYGKTALSVLYTTAQDDVLVARYDATRRVHPLMAMAGNLPNAIQKETALLEPIACHADIKIDTSLLNIHELKNSLRQHLGVDNHIIVNVLSFGFRHGTPKDADFVFDVRTLPNPHWQMDLRPLTGLDAPVQEFFAQFSAVHEMTHDISTFLLKWLPDFIENNHHFVTIAIGCTGGKHRSVFVSQVVGEILTGHLPDKMQVNVKHREKSFW

SEQ ID NO: 1939 - protein, 92 aa, M.catarrhalis
TIMIKRLLFMNVETPNPKTAKHMATSVIFMLSVMAGTPSWATDGDAVQTSKDSTIAQQADEFFELAVRYDQASDYPMAVREYQKAAELGHYE

SEQ ID NO: 1940 - protein, 207 aa, M.catarrhalis
ENTDVARDNKAVAQALEIESPNGNLEGMFAPNTYQFSHGTTDLEILRRLYQDQIKILNKAWESRDETLPYQTPYEALIMASIIEKETGVKQERQMVSAVFVNRLRQGMRLQTDPTIIYGMFDRYDGKIYRSNIAEKTDYNTYQIDGLPPTPIALPSAASIKAAMHPADTDVIYFVATGSGGHTFSRTYQEHQKAVAEYRAFMRDRNQ

SEQ ID NO: 1941 - protein, 73 aa, M.catarrhalis
  UNSURE (66),(71),(73): Identity of amino acid sequences at the above locations are unknown.
KGKCMQGKFISFEGTEGVGKTTAIEALITRLVDRGIQVVRTREPGGSELALVSSPRGWKDPTRASXVPKGXSX

SEQ ID NO: 1942 - protein, 373 aa, M.catarrhalis
SHILEETIMAKAKFERVKPHVNVGTIGHVDHGKTTLTAAIATVAAKHHGGEAKDYAAIDSAPEEKARGITINTSHIEYDTAARHYAHVDCPGHADYVKNMITGAAQMDGAILVVSATDGPMPQTREHILLSRQVGVPYIMVFMNKCDMVDDEELLELVEMEVRELLSDYDFPGDDTPIIKGSALEALNGSDGKYGEPAVLELLDTLDSYIPEPERDIDKSFLMPIEDVFSISGRGTVVTGRVESGIIKVGDEIEIIGIKPTAKTTCTGVEMFRKLLDEGRAGENCGILLRGTKREEVQRGQVLAKPGSITPHTKFDAEVNELSNEKGRRHTPFLNGYRPQFYFHTTEVAGAITLQEGTEVVIQGDNVLDECRP

SEQ ID NO: 1943 - protein, 88 aa, M.catarrhalis
TSSRLVPRNKIPQFSPARPSSNSLRNISTPVQVVLAVGLIPMISISSPTLIIPDSTRPVTTVPRPEIEKTSSIGIKNDLSISRSGSGI

SEQ ID NO: 1944 - protein, 60 aa, M.catarrhalis
THLGCIAKHFSQWYFCTNRLGATRKIIHALNHTTTTVQVTHDVAHVVFRCFHFNFHDRLK

SEQ ID NO: 1945 - protein, 198 aa, M.catarrhalis
RGKFGHVWLRLEPLDPTGDVEYEFNEEIVGGVVPKEYHAAVDKGIQERMKNGVIAGYPVVGIKATLYDGSYHDVDSDELSFKMAGSMAFKKGFLQANPALLEPIMKVEVETPEDYMGDIMGDLNRRRGMVQGMDDLPGGTKSIRAEVPLAEMFGYATQMRSMSQGRATYSMEFLKYQETPKNVADEIIKKFTAKDDDE

SEQ ID NO: 1946 - protein, 427 aa, M.catarrhalis
KISLIVIITDYNAIKSTIYGVVMKFYIAKTHIFLALMVGLSSMAWANPAATLTGFAKLDVETYATGPISGRAAKTANGIVVPFKAQPVQGFSGALKNHDSSYTVLADNGYGTKDNSADFLLRIYHLDVDFRSKEGGGGEVKVLDFIQLRDPNKLIPFEIVNENSADRLLTGADFDPESIQRTSDGSYWIGEEFGPFLLHFNKEGVLIDAPIALLHPNQKNQQLRSPQNPLNTNYSSPTTVQRSGGFEGMALSSDGKFLYPMLEKPLTDTGTKQLLISEFDVQKKAYTGNHYWFVLDERATAIGDFQMIDNRSGIVIERDDTENDWNGYKKLIRITLGRSGQAVDRTDLVDLMNIDNPDHLYGPVRAGDMGVGQRFTFPFFTIEDIIIEDDRTITVFNDNNFPGSSGRNANLADDNEIIRLNLHQPLR

SEQ ID NO: 1947 - protein, 392 aa, M.catarrhalis
RHLKQVNLTLAACNLIVGANGSGKTSLLEAVFLLSRGKSFRHHEPKRYIRHHQSACTVWARTKFEESCTLAIQKKLDETGKSDSILRFNEHTVSTQSTLSFHLPTLLIDPVSMSLLDEGSISRRQMLDWLTFHIQPKFYHQWLQYQRLLKQRNALLKHPSVHHKLPELFAWDEQLGFYAHALHEHRLAVFDQWTRYFDEMIKQLLPEYHSSLSLQYLAGFDYTKPLSQTLKMRLNQDMSLGYTRIGAHRADINVKIHSQNNQGQTIHEQATHILSRGEKKLLITALKLSQLKLMCHAIDKIPMQTAHPPVVLIDDLDAELDEDAIEILLKTVFSLPCQAIITSLNVQTHQKILALKSDGFMATSAPNQRTAEDLSYKMFHVEQGKFQECNIS

SEQ ID NO: 1948 - protein, 84 aa, M.catarrhalis
  UNSURE (11),(12),(13),(14),(19),(21),(22),(23),(24),(26),(27),(30),(33),(42),(43),(44),(46),(49),(53),(54),(60),(64),(67),(73),(74),(75),(81): Identity of amino acid sequences at the above locations are unknown.
IGRDHVLRRKXXXXRRRGXIXXXXTXXTYXKKXFIFIFKNIXXXKXKFXLKIXXKLINIXFILXYEXNIFFFXXXKKNKKXFFF

SEQ ID NO: 1949 - protein, 111 aa, M.catarrhalis
  UNSURE (103): Identity of amino acid sequences at the above locations are unknown.
KPKDQMMKKIFVAALALSALSAQAATVTYYGDKFHGKKTASGERFNQNAMTCASNSHKFGTHLKVTNTANDKSVICRVNDRGGFGKYGVTLDLSKGAFTKIIXLARGSRAR

SEQ ID NO: 1950 - protein, 525 aa, M.catarrhalis
LTEGILMTNITQDRILILDFGSQYSQLIARRVREAGVYSEIHAFDMSDEDIRAFNPRGIILSGGPESVHQEGSPRAPKAVFELGVPVLGICYGFQTMSEQLGGKVEAGLVHEFGYAKIDIAHQDKLLSKINDEKNQSQVWMSHGDKVASLPTGFTVTSSTPNCPYASASDEDRQLYGVQFHPEVTHTEKGEQLISNFVHIICGCGNAWNSENIIEMRIEQLKNQIGNQKVLLGLSGGVDSSVVAALLHRAIGDQLTCVFVDNGLLRLNEGDQVMQMFAENMGIRVIRADSEARFLNALAGVSDPEAKRKIIGREFIEVFSEEARKLDGVKFLAQGTIYPDVIESAASKQGKAHVIKSHHNVGGLPDDLAFELVEPLLDLFKDEVRKLGVALGIPHHMIYRHPFPGPGLGVRILGEVKKEYADILRLADDIFMQELRASGWYDKTAQAFAVFEPVKSVGVVGDGRRYAWVIALRAVETVDFMTARFAHLPYELIDKISTRIMNEIKEVSRVVYDVSSKPPATIEWE

SEQ ID NO: 1951 - protein, 822 aa, M.catarrhalis
GNFMTDSTNNHPQVDAQEIEYTAKNVRVLRGLEAVRVRPGMYIGDTDDGTGLHHMVFEVVDNAIDEALAGHCDEINIIVHDDESVSVMDNGRGIPVDIHPEEGVSAAEVIMTVLHAGGKFDDNSYKVSGGLHGVGVSVVNALSKKLILTIWRDGYAHTQNYTDGVPDAPLAKLEPSTQTGTQVRFYPSFEIFKGVQHFDYDILAKRLRELSFLNSGVRIVLTDERTSTTQVFEHKGGLSEFVSYINGGKHTLNDIFHFTADGADGIGVEVALQWSDSYNEKVLCFTNNIPQKDGGTHLSGFRSALTRCLNHYLDSENITKKEKVQITGDDAREGLTAIISVKVPDPKFSSQTKDKLVSSEVKSVVETAMHERLSEYLLENPTAAKMIASKIIDAARARDAARKAREMTRRKSTLDIAGLPGKLADCQEKDPALSELFIVEGDSAGGSAKQGRNRKMQAILPLKGKILNVERARFDKMLSSAEVGTLITALGTGIGPDEYNPDKIRYHKIVIMTDADVDGSHIRTLLLTFFFRQMPELIERGHIYIAQPPLYKVKRGKQEVYLKDTEALDAYLLSSTIDDHQLFLSKDTPPVTGVALEKLLKDYSQSQVIKAHLQSKYPSHLLDALTLIPKLDVSAIGDKQAVDEWALALENQLNDLEPKLDAKVEAVQVLGGDDGNGHWLPRVTLHIHRLPHQYLLDTNFLGSADYMRLLKLSANWNTVLSNSAFLRRGDKDFIIKDFEYLWQQLMLAARRGVDVQRYKGLGEMNKEQLWETTMDPENRRMLKITIEDAIKADHLFSCLMGDEVEPRRIFIEENALNADIDT

SEQ ID NO: 1952 - protein, 128 aa, M.catarrhalis
IRTPKQLVNIYSKRMQIEETFRDLKSPAYGLGIRHSRTSSSERFDIMLLIAMMLQLTCWLAGVHAQKQGWDKHFQANTVRNRNVLSTVRLGMEVLRHSGYTITREDLLVAATLLAQNLFTHGYALGKL

SEQ ID NO: 1953 - protein, 90 aa, M.catarrhalis
SLKRFEVIRGLIKSNSILKANSYCIIPALKAEKISAEQRTHCHHRSHKIYSASAKRPWVLAINLLVKFEHPNNLLISIRSECRLKKPSET

SEQ ID NO: 1954 - protein, 82 aa, M.catarrhalis
FIGAAPMLDTGIEVSLPKEQTKPITQADKLPVIVSIQANGNLYVSHKNGLDVPITPDKAKYPATPDAPRQYRFTSDGQCRCK

SEQ ID NO: 1955 - protein, 534 aa, M.catarrhalis
VPFLGILTFLCFLFLLMALKKITGNLSIRRTHMSKPTLIKTTLICALSALMLSGCSNQADKAAQPKSSTVDAAAKTANADNAASQEHQGELPVIDAIVTHAPEVPPPVDRDHPAKVVVKMETVEKVMRLADGVEYQFWTFGGQVPGQMIRVREGDTIEVQFSNHPDSKMPHNVDFHAATGPGGGAEASFTAPGHTSTFSFKALQPGLYVYHCAVAPVGMHIANGMYGLILVEPKEGLPKVDKEYYVMQGDFYTKGKYGEQGLQPFDMEKAIREDAEYVVFNGSVGALTGENALKAKVGETVRLFVGNGGPNLTSSFHVIGEIFDKVHFEGGKGENHNIQTTLIPAGGAAITEFKVDVPGDYVLVDHAIFRAFNKGALGILKVEGEENHEIYSHKQTDAVYLPEGAPQAIDTQEAPKTPAPANLQEQIKAGKATYDSNCAACHQPDGKGVPNAFPPLANSDYLNADHARAASIVANGLSGKITVNGNQYESVMPAIALSDQQIANVITYTLNSFGNKGGQLSADDVAKAKKTKPN

SEQ ID NO: 1956 - protein, 177 aa, M.catarrhalis
TWLQSVIMRLTQYSDFALRVLIYLATIPNNDELVRIDDIAKSYGISKNHLTKVIHQLSKLKVVDSARGKNGGIRLAMHPKNINVGNIVRQTEPDFFVVACFADEPAQDDLMTDNLMTNDLRKIKTLDLSVGQPAMSCVISPACHLKQVFAEATKAFLQVLDSYTLTDKYRHECCALH

SEQ ID NO: 1957 - protein, 83 aa, M.catarrhalis
RVQCLCRKKKARARFLKNKGDPRIGAALSRRLSTFGRANKTHAFLLFTNTGVVVSLWYSTFERDFLSIYLRGGKVLTRRDALN

SEQ ID NO: 1958 - protein, 62 aa, M.catarrhalis
AIKMASMCQSRLTKLNTLLRQMHQDNTDLQVMVNADANNAYSRIMQIMELIQKVGITQVSFA

SEQ ID NO: 1959 - protein, 271 aa, M.catarrhalis
  UNSURE (224),(242),(252),(254): Identity of amino acid sequences at the above locations are unknown.
KELVMTYQSALEHVRSVKAKLGNYWDAIRPEDAARMVVRGQTGLTAIVVGVLFLLMLFFQPLAFLVPSYATPPLGCWHGFIAQQKMIANKKYFGTTSKRYIYLSGWMVAALRSEFGPLPDQSMHEKTAVPKLIEEIYTFLRQADAKELNDLFRALQQAEQAGDEAKVKEIEAKIDNFETHVVPIIADIDAGFGNEEATYLLTKQMIEAGACAIQIENQVSDAKXCGHQAGKVTVPHEDFLAXINARAYAVLXLXVDEGVIVAPYRLRGCLI

SEQ ID NO: 1960 - protein, 912 aa, M.catarrhalis
MAKTVKQLAQTSKTTTETILKQLADAGLPSRGENDLVTDSEQDKLVAFLKQSHGEKPKSRISLKSKTTSTAQVTGTSGKAKTVNVVRTKKVVYDKPDPAKIEAKIAAQAKAAKEARLKAAEEKQAAERSKKEAAERQAATLAAMRASSEPVKNHEVNATVVVKKIKNPEDAKPADKAEKTDKKKPAKPIKKESATDKKAREAREAEEERLRQMEAETRRKAAEEAQKRTLEQMKQMASRYSDADDGATAAIVRTKDDAPLADGLVGAALEESFEKERREIKRGATGTAGKGGKKSRKGQQEEREMKTRAKGLKSSQANKHKFEMPVEKIVHNVEVGENIVLSDLAQKMAVKVREVIKSLMKMGEMVRESDSIDQMTAALVIEEFGHNFVPISDTQLEDDLQVAVDEKSGNVQTRPPVVTIMGHVDHGKTSLLDKIRTTKVASGEAGGITQHIGAYHVTTDRGLITFLDTPGHAAFTAMRSRGAQATDIVVLVVAADDGMMPQTEEAIDHARAAGTPLIVAINKMDKDTADPDRVINELSVKEVIPEEWGGDTPMVKVSAKSGMGIDELLEVISIQAELMELEAPIDGAAQGVVIESRLDKGRGAVASLLVKRGTLNQGDLVLAGEYYGKVRAMTDENGQRIKTAGPSIPVEILGLPEAPAAGSEFLVVSDEKKAREVADFRAARERERTLDRQNKMRLDTLFESMGSAEVATLNIILKTDVRGSLEALLNALDELSTDEVKVRVISSGVGAITESDVILAESSEAVLLGFNVRADNAGKRKADEAGIDIRYYSVIYGLIDDVKAAMSGMLAPEHREQILGIAEVRDVFRSSKFGAAAGCMVQEGTIYRNKPIRVLRDDKVIFTGHLQSLRRYKDDVNEVKAGMECGLAVKGYEVAVGDKIEVFEIHEVKREL

SEQ ID NO: 1961 - protein, 172 aa, M.catarrhalis
GNKTMKTPHTIDDTQTLELLEERAEVQKQRVNTGKVILSKKIHTRTVNIPITLTEEHLVITYQQDDASLATHEQLSNDDDLVNIIDNTKATHAKITINGQVRSLTPDTPIEMLLYCETATVTKTAHAIEDIHLNTQTIQREHVFTTKLQKEVLDIQEGENLVIQNDDLDYAK

SEQ ID NO: 1962 - protein, 199 aa, M.catarrhalis
LIYQSDQQNKGRSMVSKLVRLYDIEATNREVLGDDYYNPIGKTAYGIGQEKLGKVQDVLVEVDTGKIRYLVVDAGGWFFSKEVLVPAGLSRIVGDEVYFDSLTKEQVEAMEGYDQNYSYTYEEQYNKDREFYAAETLPAESRLELDESHYHAPNTLELLEERLTVNKDRIVAGIVSLGKHVVTEERRVEVDLEEEHAPH

SEQ ID NO: 1963 - protein, 312 aa, M.catarrhalis
IMMNRPTKKVVISGILLLDKPADISSHSALAKAKYLYQSELYDSKKAGHTGTLDPMATGLLPICFGEATKFAQYGLNADKSYVALLSLGVKTDTADRYGQVIQRTDAPSFNQQTLDGIANALIGKQMQVPPMYSALKKDGKKLYEYARLGEVVERDARPIIIHNLTLTKLDNTTIKLIVSCSKGTYVRVLGESVAEHLDCVGHLIALHRTCTGGFDVADAISLGELANSSLDERLGRLLPTDAMLGHLPMLRLTTDEAARIKMGQRLNVKDRLDSLLEFDDVLLVRLYAQDVFIGLAEVSKSGRLQPKKLVA

SEQ ID NO: 1964 - protein, 61 aa, M.catarrhalis
YNELRPSDNILEDKGLGYGISSRKETDLARYALDFKNYGTINSSYSYQPQTSTTFTSSGEH

SEQ ID NO: 1965 - protein, 168 aa, M.catarrhalis
KNGLYYHHHTEVNFNNILLIVYLFRGLMNQRLQRLADQIQRTLAILIRDEINDPRLTGFVTISSVKVSPDLGYADVYVTILEPSQDGGMNSEAHAQSLKVLNTAAGFLRTELARTMKTRTTPRLRFHYDEVTAHGNRMMSLVGQAMQKTQESEKNYLDEEHQLDDDKS

SEQ ID NO: 1966 - protein, 103 aa, M.catarrhalis
KKSMPHIERTAVDRPTDRRINDSGADTISVELEAERANVTKQTYVTEEVTLGKTSETRTETILETIQREELNIDDLGNVVDKNGNVVNYEGITADEVRRARGL

SEQ ID NO: 1967 - protein, 217 aa, M.catarrhalis
LFGMKIPAQYIISALEPADVIGLVLDEDAKTAEVIFATNDQLARAIGSQGQNVRLASELTGYKLNMILESEYSERQASENQAVIDLFYERLELDRDLAEVLAEVGFADIETVAYAPVEEFYEIDGLDDETITAIQERAKEVIISDEIAKQQNIKEPSAELLALEDMTPAIAYKLAERDIITLDDLAEQAIFDIEDIEGLNSQSAGKFIMAARQSWFE

SEQ ID NO: 1968 - protein, 62 aa, M.catarrhalis
CKMVELIISISRYNNSCEYMMKKLILATVLAGLSTADADNVLVNNGYYDQADLGYSKSRNIV

SEQ ID NO: 1969 - protein, 319 aa, M.catarrhalis
RLCISQYSYCNIVSVAVAVLRYTDKFLVAKRHMHQHQGGKWEFIGGKIDANESAKQALMREVNEEIGLSLNTDQLVFMGKVYHDYQDKKVYLYTYEVYLTKKQYHDFLYCQKGLENQALRWLDMDEMIAKVNQFPVANARIMDWIGLPNLLYISHAVDYFGDFDGFVNYYSNQLPKSAYFYCRPCVGTDDAIRLLTLLKSKRPDINFVVSWSVCQAAQDMMKVLGGVMVKLTCDELEYFSANFDKLPTDLPLWVGVHDKKEAMMANQLAKSHRIVAALISPVHKTKTHPKAHALGWQGFESLAKLCVFTTGLEECAPTS

SEQ ID NO: 1970 - protein, 331 aa, M.catarrhalis
MAGLFKPSTQKILELFNGVLNMPINTNHTTDLNRFQNRPKSSAKIAFELSDALYKMDDLVLPIKTKADLERTIGLRQYQSEVFEHWGFSETHKFDNKMIINLYGEPGTGKTMSAHAIAHALGKKLILINYGDIESKYVGETPKNIQAAFEFAKENDAILFFDEADAILSRRVTNMTSATDTSVNQTRSVMLTLLNDYNDTVIFATNFISNYDPAFMRRILIHIEYTLPDEETRTYLFNKYIPNKLPHSIDLPTIVKLSEGLSGSDISNAILLAAFSAKTEGCDLVTHENLQNKIEAIQRSKSENSRKETKFQTRVVSEEYVKSQLNDGETI

SEQ ID NO: 1971 - protein, 99 aa, M.catarrhalis
SVTLTEPISQTRPISLRPRSMSIRCSAISFWSFNNSCSSARSSSISLPRRRVPANGLTVTVPFSMRDKISGEAPIISNGDLVVPKVSPCNINRYGDGFK

SEQ ID NO: 1972 - protein, 167 aa, M.catarrhalis
YRQTFGSVMEIIILIVVGLSVLGAILAILKFIWGLFKKIWLIIIGIAVLFGISWLIKYGFSIIGLDIPIWIIFILTLFCLGYLSHTNEKKVHRAVAKYFTIKEMGDLTDITNFLDEKSIKYDQEILSQAIVKLVEDDQIIEQLPGQLWRSTQSGNFLEPIETVHIEI

SEQ ID NO: 1973 - protein, 513 aa, M.catarrhalis
TNFYENFGSVMSTLLSHHEYLRLKSQGFSHVPLIKKRLMDDATPVSVFANIRQLNPKAYLFESVVGGERFARYSMIGLGKGVYFEYQDGVMRVGSELVGTVSSTKTDQPFDEIRRFMGQFNIPTKDDVPNLPVFSGGLVGYFGYDLIRTIEPTVGHSDTPNPLNLPDLWLMLSTEVVIFDNLEHTLSIVVYANCDVENGYEDALGRLTNIENILNQKPDLTTKAHPIPKFVSATGQQKFCDDVQKIKEYILAGDVMQVVPAQRLSAKSEADALSVYRALRYLNPSPYLFMLHGETFGTTKSPFDIIGASPEILSRIENGTVTVRPLAGTRRRGSDMDEDLALEHELLNDQKEIAEHLMLIDLGRNDIGRVCEIGSVKVTDQMFIERYSQVMHIASNVEGRIRQDVDALDVFCATFPAGTLSGAPKIRAMQIIDEVEPVRRTVFGGAIGYLGWHGNMDTAIAIRTAVMKDGQIHVQAGAGVVADSDPLAEWDETNKKALALVKAVEMACRGLEI

SEQ ID NO: 1974 - protein, 138 aa, M.catarrhalis
RRWYLIGTQNNEIKTFRLSKILNLSVLQGQSFVPDDEIWQLIDQGQGIWFGHQLTNVLIKTDEYARGYFLQKQILPNQKIIKSLEDGGLLIQCSVYQKQQIFPMIRSWIPHLTIIEPAEWRDYLNHQLKKYLNYLTEC

SEQ ID NO: 1975 - protein, 123 aa, M.catarrhalis
WRNHMIPFLLAGALIAGVFVATAFWKEIKSFIQASIERIKTHLIPSMIVGFKTYLQTGNALYATAKALQKFFSKNERGQWQETIMTRNVPANEIPEDIRRKVKNNRGPVDITDEVQAELHLEV

SEQ ID NO: 1976 - protein, 318 aa, M.catarrhalis
SRFNRIHHNQKYLARCLMTDAYQQIKSTLKGVMTALVTPMKPDGSVDYDTLAQLIDWQIDEGVNALVAVGTTGEAATLAIDEHIDVIRFFVKQVAGRIPVIAGTGANSTREAIDLTMAAKAAGADFALLVVPYYNKPTQEGMYQHFKAVATAVDIPQIVYNVPGRTVVDMCEDTVSRLADIDNIVAIKDATGNLERGISLIRRVGERMVVLSGDDPTALELIKYGSKGDISVTSNIAPKAMSQAFGLALEGHFEEAYQIHDTIVHLHRDLFIESSPQPVKYALHKMGKIGTGIRLPMVWLAEHYHETIDNSLKKAGLI

SEQ ID NO: 1977 - protein, 119 aa, M.catarrhalis
LFTDFEDKAIYFQMYKIVTYIPEPDLETVKTAMFEAGAGHFGPYERCSWQTLGIGQFCPLEGANPTIGKIGQVSQVSEWKVEMIVPENKLYEVVEAYKHAHPYEVPAYEVYQTVDVDSD

SEQ ID NO: 1978 - protein, 174 aa, M.catarrhalis
RAMCQQMKSQKIFAGRLRITEDLLILQMKYKQNYIWRCKMNNDSTKIYDNLKDLEQAAKEIISRNILPKLIKHNQTSAAEFVSSFSKGADDFILQTERDEGLNFVAGYAILNLLESGTMQIDFDFYFQNTQGSWINKKKQSKTFNVDEYLNPQAQASLLEHQSLKFDIDKPLDR

SEQ ID NO: 1979 - protein, 114 aa, M.catarrhalis
FEPILADILINMGNDQIQNKSGRFMKFLKITAGVLTASMMLTGCTTTKNILSKRNNGSLDYRNEKKLAPIQLPAQQPAAEFTPLYHTPNSVSQLLDFTNESGKQYQLPRPPSVR

SEQ ID NO: 1980 - protein, 241 aa, M.catarrhalis
SNEITMQKQALLYTGKAKSVYETDHPDYLILHFRNDASAFNGEKMESLDRKGVVNNRFNAFIMQKLAEAGIETHFEKQLSDDEVLVKRLKMIPVEAVVRNYAAGGLMKRLGLSEGLPLLPPTYELFYKDDALGDPMLSESTAIALGYATADELAQMQSLTLKVNEVLSKLFDEADLMLVDFKLEFGLFQGRVVLGDEFSPDGCRLWDKQTKKKLDKDRFRQGLGDVVEGYEEVARRIGVPL

SEQ ID NO: 1981 - protein, 127 aa, M.catarrhalis
SDNKMCELDILHDSLYQFCPELHLKRLNSLTLACHALLDCKTLTLTELGRNLPTKARTKHNIKRIDRLLGNRHLHKERLAVYRWHASFICSGNTMPIVLVDWSDIREQKRLMVLRASVALHGRSVTL

SEQ ID NO: 1982 - protein, 126 aa, M.catarrhalis
EDALSFRPKRSVTKLLPEITERFGLKDKANLDTSTEEARKQNIKDRIVSVGGLIAARGVVNKTIQGFGGRFIGKQISKFIPLGGSMVAASLGYMIFKKIAFDHIEECYNIAKQSQRQETSSQDFNA

SEQ ID NO: 1983 - protein, 64 aa, M.catarrhalis
  UNSURE (10): Identity of amino acid sequences at the above locations are unknown.
GTPIDIAAIXQKSPVLVYFWGSWCHVCTITSPKVNQLHQRWLFCRQGCCQIKKRSPTWQIFTKT

SEQ ID NO: 1984 - protein, 110 aa, M.catarrhalis
GKNMTFVVTDNCIRCKYTDCVEVCPVDCFYEGPNFLVINPDECIDCALCEPECPANAIFSEDEVPSGQEEFLKINEELSAVWPNITEKKDALPDYEKWDGVEGKLQYLER

SEQ ID NO: 1985 - protein, 159 aa, M.catarrhalis
FNQILSRRFMNFWLLFWHILGACIWVGGHLYLCLCILPKAVRHQDSQPILNFENSFEKLGMTALIVQVLTGFYMAHKYLPSFGMLTDYHNQISVLISMKITWLIFTILTALSAQLIVIPRLKKDLGNAKLRHIFAGHIILVTVLGLAFMTTGVLFRTGF

SEQ ID NO: 1986 - protein, 158 aa, M.catarrhalis
LSVAPSHPRGEDLGGYLESMGIQVIFATTGIVLATLFVTFAFIARELIPLMQAQGDSEEQAALTLGANGWQMFWKVTLPNIKWALLYGIILTNARAMGEFGAVSVVSGHIRGETNTVPLMIEIAYNEYAFTLAFALSSLLALLALITLVAQGLMSHKK

SEQ ID NO: 1987 - protein, 247 aa, M.catarrhalis
  UNSURE (244),(247): Identity of amino acid sequences at the above locations are unknown.
VLNMSIKIQNIHKTFGDFVALGEISIDISTGELTTLLGPSGCGKTTLLRIIAGLENADNGRIYFDSIDVTDIPVQHRGIGFVFHQYALFRHQTVAQTIAFGLTLLPRNTRPSANTIDRRVDELLDLVQLSHTKTRYPHELSGGQRQRVALARALATDPKLLLLDDPFGALDAKVRKSLRDSLKDIQREIGITSILVTHDQAEAQAISDKIVIMNHGQIEQIGTPTNSFARLHHGAGRHQRVVHXSPX

SEQ ID NO: 1988 - protein, 520 aa, M.catarrhalis
MTIAQQHSNACVLWLVNTQITPKLLNKFVLLTTVVITFGISKMMTFMSSPSNNALVSLLSSVQSLDCTDFFYYDKSWLIVADLNPDEPPYASPEKSMQTLPIKPSKLRLGKLLLPASLMMILSACHMLIPPKQTPAKLLEKTRSSIITNGRVSAATQSILVSAGYTQESCMADFEACVDDVRSIFFIELPNRLQLSVFSELYYTYADNLIAKDACRIELARPPIDPYYTNAPISKDIAENQQKARTECHAKYRDALYQTVKYSYAYLFYYSLGGHGTPSSLPQEPDIRTLDLYHLAINDLITQIYRKDHGAFYNAKFQDVVSSEQLEPIYNQLRIGRVLSNDHGQNTLHISVGDRDFLTSKLKQHEHSSELFSEMISAYDSRLLDLDVNARRSGLGVSFVGAINDRHTTSIDNLKKLARNKALDDRIHHVGHIQLTAIIKPMGNTIDEVLSSHEFYAYFFNPSNNTHVKIGDTSYPLTANFSAGYALGLAENQLRPVLLTNMNSWSEANGLPGLFKLKTE

SEQ ID NO: 1989 - protein, 77 aa, M.catarrhalis
WESAPFTPREDHPSPVNTRKIAMTMSIARYFSNRDHIRLPTLYSQNLFAMTKEVRIEHQGEEYRLRLTRNNRLILTK

SEQ ID NO: 1990 - protein, 68 aa, M.catarrhalis
FHVNILIIANVANGSLDNYEIITWSKLIDYFELNAGGTLPLDVQYALPWSWQKDFVSIMLVSECDHGY

SEQ ID NO: 1991 - protein, 947 aa, M.catarrhalis
SWGKFWAFIMYKLCYNSRNLIFYLEFFCMSKPVLFANCSFMPVALAAYLPLMTSQALAQQNNSANIINHIPAHDTAINQAKAGNPPVLLTPEQIQARLNAAGLNAKPQSQALDVVNFDDQSPISRIGEQSPPLGLDMSVIEETTPLSLEELFAQESTEMGINPNDYIPEYQGEQPNSEVVVPPTLEPEKPGLIKRLYARLFNDGVNKVPRLKAKFYQSSQSGETSAIGSSHQKTEPYANIKAALEDITQESAMDLNGSIPRLRQTALVAARAVGYYDIDLSIIRNSIGEVDVIIHDLGEPVYIDYRAVEVRGEGADDKAFTTVADEVPLLIGDVFHHGKYETKKNLIENASAEHGYFDGRWLDRSVDVILPDNTADVSLIYDTGTQYRFDEVVFFTIDPKTNQLTTDPDKLPVKRELLEQLLTVNMGEAYNLQAVRALSNDLIATRYFNMVNTEIVFPEREQIQNDQVSFEQSSSNRTEPAQVDESTLEPVIETVELTDGILMDISPIEFSASNLIQDKLNLVAAKARHLYDMPDDRVLAINHDDGVNRSILGRISDAVSAVARAILPDESENEVIDLPERTALANRKTPADVYQSKKVPLYVFVASDKPRDGQIGLGWGSDTGTRLVTKFEHNLINRDGYQAGAELRLSEDKKGVKLYATKPLSHPLNDQLRATLGYQQEVFGHSTNGFDLSTRTLEHEISRSIIQNGGWNRTYSLRYRLDKLKTQAPPETWQDLPVDFVNGKPSQEALLAGVAVHKTVADNLVNPMRGYRQRYSLEVGSSGLVSDANMAIARAGISGVYSFGDNAYGSNRAHQMTGGIQVGYIWSDNFNHVPYRLRFFAGGDQSIRGYAHDSLSPISDKGYLTGGQVLAVGTAEYNYEFMKDLRLAVFGDIGNAYDKGFTNDTKIGAGVGVRWASPVGQVRVDVATGVKEEGNPIKLHFFIGTPF

SEQ ID NO: 1992 - protein, 296 aa, M.catarrhalis
NFIKGYRTLISYSFSHHYHGFFMKKLALTLSVFTAIFASTAIANTTYQSPTMRGEITETITARAGTADLLQTIVQGLPAPNILITEIKNIPTVTIAANTAGTVILDVTLVDEFLDDIAPNARHYPTNFPNRTAEYITTENIKHLSDWIESYASTPDASFDVVIRAAKLNGIARNLNLGTTYTVRAGTYMQKALQLKPNDLEANLLFGIMLSESGGFKEGRKYLDKAVSMGNVEAEQSIAQADLLNDNRTAALKRLRTLAGKHPNHAQIAEQIRIVDNGGYYIWNIKDDDIHVKPIK

SEQ ID NO: 1993 - protein, 444 aa, M.catarrhalis
IMASQLNLFRRQVFTSMFFTQFFGAFNDNIFKQALILVLTYSAAAKLETEVSLLNNLAALLFILPYFLFSALAGQIADKYEKSTLTGHIKLLEIIIMAVAAVGFIYEIYSLLFFCLFMMGTQSTFFGPIKYAYLPETMRHDELVAANGLFQTSTSLAILTGMMTAGILTQLYFSEYWLATVTIVVAILGYLSARQIPKTKVHAPDLSINWNIAGTSFELLKYLYHLPLLFFITLGNSWFWFYGATFLTQTPEVTKVLLHADESVVIFLLSLFSVGIAIGSLLCKTLTKNQVSFRLLPYGLLGLSVFAMALYFSLNQLSLALPIWPYAVMDIIHQLHAWPVFIALFLLGFSGGVYIVPLYTAMQAYAPIDYRSRIVGANNILNAIFMVISAIFSIIILAVIKLSLAQLFAITAILNAIFGLFLCLKLKKYDRTLPIHTDKTAISP

SEQ ID NO: 1994 - protein, 1675 aa, M.catarrhalis
RRHMTHQDNSKNSSSAENGVSAGVAAPTKTQPKPPNPPKPQWLIYLIRLIVGAIIAALLLLAVLFAMTNSESGSKFLIEKIALETGTKLKYSEGSIRHGVWVQDVKIAQSEDITITINRAYVQLGWRALFARQVHLVNPKIDKVYVTNTKPSTGEPFDYATINLPVTLKLENAKVNEIIYDQVDSEPVVLHHIAFDHASWADSTVKIDNAMLSYGDDINISHATGGIDLTGHYPLSLSADVHILALDDAYFDTLSVKAGGSLKRTVGTLTGKYNQHHVTGSFIAQGLDKNSPFSARLDFDEVRLPYADSQNILLKNGSIIADGVISNIELRINTELSAKDIPDGHYHGRGIIRGSTMQIPYLQADTANGTLVATGDMTWEDGYELDATIAADGYRIREEMPSDYHEYRAYLPKVLTGSLGVKYTLLDKASHDTRFEFDLNQKDGERIQATLAQNQQSDHEPWRIDATWANLIRHDIPQIGEIHSRSGQASVRLENGHTYINASADIVKLNAVPSGSYHVQANIEQNQHLHLTDFNYQGVMGELTGTGRVDFATAQRPLEWQLDVTANPVKPNAYFQTPNQTPFEQISGRIIASGRLREIDGVSIHDIKVDDSDLTALLNDGKQVHLMGQGVSKIRLQDGQISHLKANFDGKLAQDILPQVADSSIGLDIEGDLNDLTITRAVMMNDSGKVSLAGRLGLNDGIHWQIQGRLDEVDTAAFVDDDNLVAIITGDLATSGRYRDGVMDDIALTFDGQVINNSIPNGHLSIDATGSGNRFMVNHLRHDGTAGTLNATGWVDISQGVAWQLEADMNSLNLGAFIQSLDTDLNGTIQLAGNWQESHQVIDISNLDITGSYNNQPLIATGSLYAKLSLPKDLAGYIQSIKQASRPPTSSDDLLALKNRIDNNARQTQNIVHKLNADNLQVRIGNNHLAISGDERQLTASVNVIDLGQLIDTASGAIQGGVIVVNDHHALPTLYIDASVSSLRFANITIQNAQAIGKIVNLGNSESQLLVQGDDIIVMGRTIKSARMDFSGTEADHILSISTKSGDIEASMHIDGAFNRNNMRYHGVLSDGFVKSGFGKMSQRQPTEFSYGLDDNSLQIAAHCWQSAHIQGDGVGAICLQDTLSYTPQSGNVNLIIQNLDTQVLLAALPSDIHWKSMLNGRIKAMWQAGQSPLVDAVLYSDDGTIGLTQEETGYIEMPYQRAFVIAKSVDNGLKVRTDILGTAGRGYADVIINPKQTDKPISGALVMNDLNLAVLRPFFPSIQTLSGKVSLAGGLGGTLSKPLFYGNANLKNGALAIVGVPMPISDVDATVNIRGTKARLDGRFMGGEGHGVLYGEMDWAEELYARLGVFGENLTVSQPPLVTAQISPELEVIIRPFQKFVDVQGVVSIPSATIRPPEATADIVTESPDVSVIDRRITGNIDQILSRAKPWDINANIGVDLGNEIEFRGFGAVLPLAGAIHLTQLGQGAMQALGVVQVSKRTKIDVIGQNLDLNYAQIRFDGDMLNPRLSIEGEKQIEGQTVGVRIRGTASNPNITVFNDAGLDEYQAMNALVTGRISESSDLGITEQGFRSQVTNHLAAAGLSLGLSGTRDLTNQIGHAFGFQSLTIDASGSSDDTNVNVTGYITPDLYLRYGVGVFNAESTLSMRYQLTRRVYIEATSAAENMVDVIYRWKF

SEQ ID NO: 1995 - protein, 278 aa, M.catarrhalis
TISPYIVAHYGNKVSNICNSDLTTLRNMMNIPLLGVNIDHIATLRNARGVGYPCPIKGALICEQAGASGITLHLREDRRHIQDEDVYELIGQLTTRMNLEMAVTDEMLNIALKVRPAWVCLVPEKRQELTTEGGLDIANLSNIQAFIHSLQQADIKVSLFIDPDPHQIDAAIALGADAIELHTGAYAQATLQNNQKLVDKELDRIQKAVAMAQKKSSLLINAGHGLTRDNVAAIAQIDGIHELNIGHALISDAIFMGLDNAVKAMVFTTGLEGSSAGA

SEQ ID NO: 1996 - protein, 72 aa, M.catarrhalis
MVITDAHQAFDELGVFLLLFFMVCFNEHDDGDVLALSDCLRFYLWIPRLPPPLSLLKRCLQCHACHQNKHIT

SEQ ID NO: 1997 - protein, 61 aa, M.catarrhalis
IRYFVICFWPIVMVHLHKSDMGILCVYFYYNLGSVISNNTLKNKISFLLPCVVLYLISYDK

SEQ ID NO: 1998 - protein, 67 aa, M.catarrhalis
SFYADDNSKMEPPDPFPNSEVKRLSADGSVVRPCESRSSSAPYFKPLFAEAKGGFVWGLVIRIYIAT

SEQ ID NO: 1999 - protein, 77 aa, M.catarrhalis
  UNSURE (2),(27),(28),(31),(39),(44),(50): Identity of amino acid sequences at the above locations are unknown.
PXVHRMFTAISVSLSLCWRRAPKKQDXXQVXTGGRVNFXYLKTXIFTGRXYWGCDQKLPLRLPPSINLSAPGRHHTL

SEQ ID NO: 2000 - protein, 103 aa, M.catarrhalis
QPKHQRFVHSGPLVLGADPLKFPTPTVDRDRTVSRRSKPSSRTSLNGEQPYPWDLLQPQDEMSRHRGAKHRRRYELLGGISLLSPEYLLSVERWPFHTEPPDH

SEQ ID NO: 2001 - protein, 346 aa, M.catarrhalis
VCFKDISQSAIIRKNMSDNTKTHSNEDTISAFFENRSTPKNESFRAGFVAIVGRPNVGKSTLMNHMLGQKLSITSRKPQTTRHRIHGILTDEDRQIVFVDTPGIHSKEVRAINERMNKAAISALADVDVVLFVVDGIQWREDDLLTLEKLSATNLPVILVINKADTVKDKSKLLPVIESFSESFDFADIIPVSALRRHNLDRLQSVIGEYLPIRPAIFDAEQITDRSERFLASEIIREKIMRISGDEVPYDLTVQIDTFKDEPAHKDPETGKWRKAVTFIDATIFVERAGQKSIIIGDKGAKIKQVGIDARKDMEVLFDRKIMLTLWVKVKRGWSDDERALNSLGY

SEQ ID NO: 2002 - protein, 101 aa, M.catarrhalis
PIKNTNKTMNNTRLGTAILSILVLSLSWLHTPAHAEPMGILPKGEGVIYQNELGIQTVRKTFSKDTPMKCHNHPNDIVTLTVTNGLAQVIKWSRSTYAVFR

SEQ ID NO: 2003 - protein, 268 aa, M.catarrhalis
LRLEYVVANKSPKTMKMSQKVTKTPDQMPYFSDFEQGLPVLYAKLGYTFKDVSLLCRALTHRSYDPKKSYERLEFLGDALLSSIITKALFAQYPKHDEGKLTRMRAALVRQETLVQIADHLELSRYLILGVGERKGGGRHRASILADAVEALIAAVYLDNLNSDGENIIHRMVMDWYKDLIQEVGQEQVLKDAKSRLQELLQGNRLPLPTYELIQTLGSAPNQVFVVRCHCTVVGVDPIIETGASRRIAEQKCAERMINQLNKLLPNS

SEQ ID NO: 2004 - protein, 63 aa, M.catarrhalis
RVTEEYEGALRTVGNRSKSIKAKARLTARPTSRAGTKVGLSDPVVLYGRAIAQRIKGTLGITG

SEQ ID NO: 2005 - protein, 212 aa, M.catarrhalis
KSFGQISLGFSDEFVRQLTAQSNEAAYHPASYGLMTGRVQYALLYMNEILDKLLATESPCLKLWQVYHTNMTKLHALDRLSLMAVDKMQAMKLYLRSFERGLFSELGVMMDFCVDGHGVPINADAMYCFIPQMGFMLAHLVRTQIDPKIRFDGVCYTGSQILQMGAAMEEPELALEFLDQFSQIQKAVLDNLLNHQPLHSRTLWQQSIQYLQ

SEQ ID NO: 2006 - protein, 607 aa, M.catarrhalis
APYMTAKKPTDISHIRNFSIIAHIDHGKSTLADRFIQVCGGLSDREMQAQVLDSMDIERERGITIKAQSVTLYYNHPNGETYQLNFIDTPGHVDFSYEVSRSLAACEGALLVVDAAQGVEAQSVANCYTAVEQGLEVLPVLNKIDLPQVEPERVIEEIEDIIGIEAVEAPRVSAKTGVGIEELLATLCDVIPAPKGNREAPLQALIIDSWFDNYLGVVSLVRVREGQVSKGDKIFIKSTGETHIVTSVGVFTPKSLETDVLHAGEVGFVIAGIKDIQGAPVGDTITHAKTPDVENIPGFQKVTPQVYAGMFPIDSSDFEKFREALQKLQINDAALFFEPDTSEALGFGFRCGFLGMLHMEIIQERLEREYDLDLITTAPSVIYEIVKKNGDIIYVDNPSKLPDTGVIAEFREPIARCHILVPQEYLGNVITLAIERRGVQVDMKFMARQVQVIFDIPMGEVVMDFFDKLKSASRGFASLDYGFERYEADKLVRVDVLINGEKVDALAMICHQEHARRRGNQLVEKMKELIPRQMFDVAIQAAIGSQIIARSTVKAMRKDVLAKCYGGDVSRKKKLLEKQKAGKKRMKQVGSVEIPQEAFLAVLKVDS

SEQ ID NO: 2007 - protein, 159 aa, M.catarrhalis
VLNIIAFAQKHGIPFIDADYDMDNWFARAKGMEQDPERGRRCTMCFDMRFERTALYAHEHGFPVITSSLGISRWKNMAQINDCGHRAAAPYDDLEYWDFNWRKGGGSNRMIEISKREHFYQQEYCGCAYSLRDTNNFRRSQGREPIKIGVKYYGDEPVE

SEQ ID NO: 2008 - protein, 367 aa, M.catarrhalis
ENLVNFDINLVIVPITLVFLLIWLVDKLVLKQHFAIKHHAKEVKFTETQLSMHKQKLELALANYGMRSDAQSYTPDAHAPSDLYSAYQDYQASRVKLAALVGNPPNHIAVVRWAYEFLPILLAIVIVRAFVIEPFNIPSSSMVPTLYTGDFIIVNKAAYGLRLPIIHTKILDTGNPKRGDVAVFRYPVNDNIYFIKRVIGLPGDTVSFNRGVLSINGEKVETTAVNYQMPSVLLDKMLPNMIHGQTLSDADRAGFGRQEEYLARYQTENLGNHTYTVRYVINSNSSAEAPFLIEHSPEVVDSHGEQWSIVIPEGQFFVMGDNRDRSDDGRFWGFVPESNLSGKATYIWMHKESGFRLPSFGRNGTID

SEQ ID NO: 2009 - protein, 60 aa, M.catarrhalis
MTPSPFGNMPIGSAWAGVCNHDSDKTSIDKMAVPSRVLFIVLLVFFMGHALSRSKITLLH

SEQ ID NO: 2010 - protein, 64 aa, M.catarrhalis
  UNSURE (10),(48),(51),(57),(59): Identity of amino acid sequences at the above locations are unknown.
SGRSGGGPYXFAADNKSSWIFFMMPCSCSSNSEKLLYCPRDAPTRAKXENXHGGGLXFXCLVHK

SEQ ID NO: 2011 - protein, 377 aa, M.catarrhalis
PKEPMMDFIKTRAAVAWAANEPLVIEELDLMPPQAGEVLVRIVATGVCHTDAYTLSGADPEGIFPCVLGHEGAGIVEAVGEGVTDFAVGDHVIPLYTAECGQCKMCLSNKTNLCSAVRETQGKGLMPDGTVRFFKEGEPIYHYMGTSTFSEYTVVSQYSLAKIQKDAPLEEVCLLGCGVTTGMGAVLKTAKVKPGDTVAIFGLGGIGLAAVIGACMAGAGRIIVVDINEDKFAKAQELGATDCVNPNKFDKPIQQVIIEMTDGGVDFSFECIGNVDVMRAALECCHKGWGESVIIGVAPAGAEISTRPFQLVTGRVWRGSAFGDVKGRSELPGIVSQYMQGDFALSDFITHTMPLDQINAAFDLMHEGKSIRSVIHF

SEQ ID NO: 2012 - protein, 202 aa, M.catarrhalis
LTLTLDLAKGTLYKHFTSKDELLLRILIDYEKRKLDMIIVEDGAGAGVARLVIQLVNLPHRAILFNHIEERLSSTTSGLNKMFAQLYHVRRERMVRMSCIVQRYLTEQNSQMNIRDYMATLYAVGQGGASLLNSSFYQRYLGRRDTLKSALVRQMLDLPKLYPKADNQPADEISQRLLATSQDISEAEILELTEVIGQTITP

SEQ ID NO: 2013 - protein, 72 aa, M.catarrhalis
PCSAWTPCNLCMIGMLKALANPDMSITTPLNLRRLNAWILDFSQAMTVPVASSMGKVPNQKNTIKVVAVNPT

SEQ ID NO: 2014 - protein, 67 aa, M.catarrhalis
SIYLINDDTNANGFDLNAMSERGCGQMLQGDLDGCDDLLDHEYARRWCGNGDGDGDHVLRGRHVICA

SEQ ID NO: 2015 - protein, 76 aa, M.catarrhalis
NHLCYNGINFYKLRHAMLSIYLLIPLSLMLFVIAIWAIYYAVKSNQFEDLDNASEQIILDDRQARRKTKRIHKEQR

SEQ ID NO: 2016 - protein, 441 aa, M.catarrhalis
IIIGLAYIQPMTLLDTFGVVSRDSSGHVPMSYIFALIAILLTSVSYGHMIRAYPSSGSAYTYTQKSINPSMGFMVGWSSWLDYLLSPLVNIILAVIYLEALFPAVNHWVWVIGLTALMTGVNLFGSKAVAYFNSWIVFVQLAVIAVFVFLTYNALSAGQNADGIISPENAYHLWSMAPFWDSMTSVAALIKGATILCFSFTGFDALSTLAEETKDAKNTLPKAMILTTLIAGVVFIISTYFMQLYFPNHPETYFKLIDETQPEILEAVGGAVFKAVVLGFAIVTVMASGISAHAGVSRLMYVMGRDGVISKNIFGKIHPTLFTPVNNILIAGVVALTAGFVTFESVINLISFGALTAFSFVNISVLFHYVFRNKYVHNANDVLSYIIVPIAGFISVFLMWLKVDKLTFEVGLFWAAIGFIWLGIKTRGFKAPVPQFKEEDV

SEQ ID NO: 2017 - protein, 501 aa, M.catarrhalis
LNFMKFIHDYLKHDERLYRHTLPTPLDNPKLVSLNAQLIDQLGLSSLDATAWTDIISGRLSPLTQIAPHKIQPIAMAYAGHQFGQWAGQLGDGRGVLIAQLHNKKTGKLIDLHLKGAGLTSYSRRGDGRAMLASCIREYLGGHALNGLMIASSDAIGLVVSDTHIQRRHIEKAAALLRVSDCHVRLGHFEWVAMYAADYFETFVIKIIQSYYLHLYDTHQNTANISQLLHEIAANTARMIAKWQLIGFCHGVMNTDNLNITGTTLDFGPFAFMEGFNPTWINNHSDHTGRYVYQNQPTIGHWNLAVVYHHFKRLVNQDGIDDALMTYQEVFENTYHHGLCQKLGIKPSHQAIQLGYRLLMLMQNERLDYTNTFRALIAVADHGENRTQFTHEYTLLANLTNILSATSYDIWQNWVNDYLDCLKQQSTKQTAIKTLQQTNPIYILRNHMAERAIVSAHQGDFDEVARLFALLDNPYQQQTIATVDDTRMAFANEAVAVSCLS

SEQ ID NO: 2018 - protein, 120 aa, M.catarrhalis
KTLMLMPVFLLLLPLLIPSKTPWGQKAFTAYLGEKESDWCEYASTYLVAKATKAPPIYIDQGLADDFYPNQLQPEQFVAAAQENGINVELNLHDGYDHSYFFVASFIEVHIKFHANHLNA

SEQ ID NO: 2019 - protein, 289 aa, M.catarrhalis
GTAMTFALIFAAFSMGLLGSPHCLGMCGGIVAAFGISMKNTSPAKRTLLMLGYHMGRLGSYTILGLLVAALGKHILAPLMANSALPKYLLGGALVFAALLMLGLPVLNRLEKAGLRFWNTLAPLRTKVLPMDSLPKALIAGLLWGFLPCGLVYGALGVALGLASDSQVGLTATTFMVFFWFGTLPMLLATGTVIAWLKSKIHAFNLRKFSGVVILISGLASAFSIPIMHKLHGVHAEHGHHHHHHYHTSDEHIHDQVGHHSHQDHPEASAHNPAHSSHSDRSHSHSYHH

SEQ ID NO: 2020 - protein, 406 aa, M.catarrhalis
IIPVCYLYYRILTFMSIERNSEAFEQAPINWVPAIVLLSTLFLAITIVPWYLWTHGVGMGVWVAFAILMAWTGLSITAGYHRLWSHKSYEAHPVVKYILLLGATLAVESSVFDWCSGHRSHHRHVDDEYDDPYSSRRGFWFSHMGWMLRKYPSGQYDYKNIPDLKKDKLLALQHKYYGFWVIATNVVILAMIGWITGDMLGTFLVAGLLRLVLTHHFTFFINSLCHMFGTRPYTDENTARDNGLLAIVTWGEGYHNYHHYFQYDYRNGVKWWQYDPTKWIIGLLAKVGLASNLKRVDDLTIKHAELTMQFKRAQERIVTGGEPSLDERLAAFKERISAEYDEFTKTVEEWHTLKAKAIELKRAELADRLNEADEKLKAQLAQIETKILEQSKRVEQAYLQLKGKAI

SEQ ID NO: 2021 - protein, 176 aa, M.catarrhalis
LMELISCHKMFDGEHRRYRHVSKAVQSEMTFAVYLPKQALKGACLPVLYYLSGLTCNDENFSTKSGAQQYAAKYGIILVIPDTSPRGETVPDDEAYDLGQGAGFYVNATASPWSVHYQMYDYIVDELPRLIEKNFNVGQKAICGHSMGGHGALQIGLKNPDAYASISAFAPIVNPV

SEQ ID NO: 2022 - protein, 67 aa, M.catarrhalis
NYRLQIIYVFCYLLIATAAERAHCYLTDQFSIGQFLVNACLAKTSSGVMQTGLSDHSSKGISFFESE

SEQ ID NO: 2023 - protein, 73 aa, M.catarrhalis
LKISIFVFKILLLDAKTISLCLLTPIYCAFKLAKFMILFSYELTTILAILIISNLEALFVLNSAFLFRILIFF

SEQ ID NO: 2024 - protein, 86 aa, M.catarrhalis
YKMTFFQPLDLNNKKAQIFRFELFKIWSGKRDSNSRPRPWQGRALPTELFPLISICCMDAYYTRKIHTVKPFLQKFCNYLSKTEMS

SEQ ID NO: 2025 - protein, 159 aa, M.catarrhalis
KQGQIMAKKPSNQICANKKARHEYFIEETYEAGLVLEGWEVKSIRAGKMSITESYVIFKNNEAFLFGAHIQPLLTSSTHINPDNIRTRKLLLNRREIDKLYGMVNQKGYAVVALSCYWKHGRVKCEIALAKGKKLHDKRATLKERDFARDKQRGFKNQL

SEQ ID NO: 2026 - protein, 725 aa, M.catarrhalis
EIFKYLLSLKYSKSDKISAKIGRLSLTHHTQSRFMNTQTSFINNTSKNNPSKANDQIIAQMCALIKLLKRHNHAYYVMDAPTISDGEYDGLRRTLMMLEQQHPNLIQPDSPINTVGGEPLPFFTQVAHEVPMLSLGNVFNADDLSGFLRRANERLGIAIDEYEMELKLDGLAVSLKYQNGQFAQAVTRGDGQVGEDITHNVRTIRNLPLTLTGCEQIKQLEIRGEVLMPKAGFEKLNRESIAQGIKTFANPRNAAAGSLRQLNAAIAAARPLAFFGYSVNDGLPDGITTQSGAMQWLGQLGFEIAPFKVAKSLDEIQAFYAHVIKTRSQLPFEIDGLVIKVNDLNLQARLGFLSREPRWATAYKFPAETVPTRLIDVEWQVGRTGTLTPVGRLEPITVGGVTVSNVTLHNFGEIERLGVMVGDVVNVHRAGDVIPKVSGVIGELRPTDAKPILLPTVCPVCQSPISLPEGEALARCTGGLYCAAQQQEALIHFVSRRAMDIDGLGSQWLIKFFEMGLVQTVADIYKLHKQAEYLITLEGMGDKSVTKMLSAIEKSKQTTLPRFIFALGIRGVGESTALSLAQQFGELQSIIEADLQALQAVPDIGEITAQSIYDFFRASHNIEVVQALIEAGVSWQAMDTPDKSSLPLTGETWVVTGTLGSMGRDEAKDKLIALGAKVAGSVSAKTTRLLAGEKAGSKLEKAQKLGVTVVLEDEFLALIALYNQV

SEQ ID NO: 2027 - protein, 309 aa, M.catarrhalis
EFIKMIAKFFRSRSEQTTNVILVKYPNSGFADNALKGLGEYLALLPFVVLVVMFILLPLGLIIFNAFYNEYGEFGFGNFSKIFNSEFYLQALVLSLKISLYSSLIGIIIGFQGAYSLYAIKDSALGRALISLNTLLSNFSGVPLAFAMMIIFGSSGVITLILSRFGINDLIDIYSFKGILLSYTYFQIPVAILLLFPAISGLKREWQESAALLGASTRQYFFKVGLPVLSPAILGTFIILFANALGAYATAYALTSGSFNILPIRIAAMIAGNLTLEPNMAAALALILVGLMLIITFVHQYLLSRYKID

SEQ ID NO: 2028 - protein, 175 aa, M.catarrhalis
TVCFVIKRRIAMTTTPRKVLYPGTFDPITNGHIDLVTRALKLFDEVVIAVAFAHHKKPIFDFDERVALVEQYFGNNPKVSVVGFEGLLVEFAKEQGVSAVLRGLRAVSDFEYEFGLANMNRSLDDDFEAVFLTPSQEYSFISSTLVREVAKLGGDVSKFVPESVLIAFEQKFNIK

SEQ ID NO: 2029 - protein, 360 aa, M.catarrhalis
CCSNLLFLYSNHYYSFHKWIQQFANNEKKMSYIQINNAHKSFGSLTVIDDLNLNVEKGSLVTLLGPSGCGKSTLLRCIAGLETLNQGSIILNNQDITYLKPQKRRIAMVFQNYALFPNMTVADNVEFGLKIKKVSLEERLIKVKDVLDLVELTSFAQQKPESLSGGQKQRVALARALVMEPDLLLLDEPLSALDAKLRKSLRMQIKRIQKELGLTTLFVTHDQDEALAMSDEVVLLNKGKIEQHSTPDTLYTQPNNRFTAGFIGHYNIGYFESVKSKSAKQLSMMAIRPETILLDTDDGDIPGVILERTLTGGVVRYQVRTDYGDIFDVDVLNHGKISQLKVNCKVFLIIKDEQVINLDS

SEQ ID NO: 2030 - protein, 335 aa, M.catarrhalis
KEGKMMTDLSILDLSPFRQGETFAQAVDNTVALAQHAEKLGLSRFWIAEHHNMPYLASSATSLLIQRVLDKTAHIRVGSGGVMLPNHSPFVVAEYYGTLASLYSNRVDLGLGRAPGTDPETARAIRRNHDDFAMSFPNDIKELQFYFGDDADSNKVRAYPAKGLKVPLYILGSSTESAYLAAQMGLPYAFASHFAPRFLTQAVQIYRNHFQPSAVLDTPKVIVGVNAFVADTDTEAEFLASTSLQFFLNIVTGQRSGMKPPATDIAAHIPAHIVQMADSMMSCRLLGSPKTVAEQLEQLQSQVQADELMAVSYIYDVQKQHDSYELLSDIVKNFK

SEQ ID NO: 2031 - protein, 219 aa, M.catarrhalis
NLVNLMQKSIWMIHMITISRIKPFIFLTAVILIGCQDNTVEQNLQPISDHAKTNTALSDDPKNARQNAHEFESLFNELDTSDTQEIQSPQLITTADGKAKLNWSYIDTKTKKANLQDFNYPFLIDSEPVMNYANAFNISAKQAQHSMALSMASPEVLGKIVDQLGNRYIAHQFRDGSNPALIIQVTPNIVNERHSYIISDKFAEGLELPIEIVSAQNSQ

SEQ ID NO: 2032 - protein, 298 aa, M.catarrhalis
SGIKMRWINNPQTLSILGLLIGCILFGMGSLIVAYVDVGAYAMSFWRLAISSVVFVLLARLFCQKFPQSRSALIYALLAGAALGLDLALWHESIHAVGPGISTLLNSLQIFFLTFIGFYFFAEHQKLIQLVSLILAVMGVVLIASPEFGHNMQAGWGFITGIISGACLAISLTWVRQVHYHEPTPLFSLMALVGLGGAIVMLPLMLWLDQDHILPKTPHELGWILVYGTVMQCLAFGAITFSIPRLSLAVTGLLLLSEPVAALVLDYFWLNKTITLIQWLGAILTMFAIYLGSVKVRH

SEQ ID NO: 2033 - protein, 275 aa, M.catarrhalis
KVKKMKNTNKVILVVLDGLNADVGLTCMGFLQALCEQHKAKAYKLQCELPSLSRPLYECILTGVRPTDSGIYHNQINRLSKEKSVFNYCIQSNKVTAAAAYYWISELYNRSPFQAAFDRHTNDSSLPIQFGHFYYDDAYPDSHLFDDADHLRKIYRPDFLLVHSMNIDDAGHRFGLNSMQYRNAARRADMLLSNYINLWLDDGYQIIVTSDHGMNNDLSHGGNLIEEREVPFYTIGDRFTNKNMDEPIQQTEICGTICALLKVEHDKTVCRNLLK

SEQ ID NO: 2034 - protein, 88 aa, M.catarrhalis
RQTDKPSSVVDNHSSRHIIADMLKQPTRTLSGQPIEFLFGLATCGVYLAVSCRQSRGGLLPHRFTLTYLIGGLFSAALVVGFRPLAVS

SEQ ID NO: 2035 - protein, 248 aa, M.catarrhalis
LLKCIINLRIASRYKMITHRDSQIKTLALFDLDHTLIDVDSDYMWGQYIVEEKLVADDDYGITNRQFYENYIDGTLDATLYNEFVARFLRSKTMPVLLQLRNNFIDKKIKPAMRPKGIVAINNHLRLGHEVVITSATNSFLVPAIAELFGIHSKNTLSTPLQIQKDLFTGFLTDRPNFKDGKLYHINKWLKNMERENLYFEGTYAYSDSKNDIPLLEWSDNPVCITPDEVLAKHALTRNWPIENWSVR

SEQ ID NO: 2036 - protein, 286 aa, M.catarrhalis
IWKLVMSKRLSYKNDYRLEKAPLSIKQYFHLIFLIALISLMMIPVVATGVYAVSGDWSQSILPESWTIKWLLEIWTQERFLWACFYSLVLCIGSAILSIILIFPVLLIVHTSKPQWQRWINFILILPFTVPPIVASISILDLYSGILGSKIGTTFILIGCYFTIVLPFVYRSLDNNFRAIGVKDLIESANLLGASTPQIIAYILLPNLKPGFIVAFFISIAFLIGEFVYVNILIGGHFETIQTYLFNLKNQSGHLSSAVVISYFCILIIITAFINGFSNSQIMRKK

SEQ ID NO: 2037 - protein, 89 aa, M.catarrhalis
YKIGSIMALKITEECINCDVCEPVCPNEAISAGDDIYVINPALCTECVGHYDTPQCVDICPVDCIPKDPKFPETEDELLVKYQKLTSDL

SEQ ID NO: 2038 - protein, 107 aa, M.catarrhalis
SGVGGKFHIKKAAGENLSRPFVHTRPEKHGGFVPPKSGEANTRGGGSPTGGGGGKGGLISYTRKPGGGEREILKHTFLTPPLLELGGEKKKQNYPLVGGFKNRGYKP

SEQ ID NO: 2039 - protein, 343 aa, M.catarrhalis
DHLMTEFSFKAHLERQNIVISWQRYGIEALNFMALGLFSSLILGLIIKNLGAWLDLPWLVEIGKQAQSLMGAAIGAGVAYALKAPPLVLFTSITTGFAGAAMGGPIGAFIAALIGAEFGKFVHRMTPLDIIVTPATTLIIGMAVAGFISPAIDQLMISLGQLIMWAVDLSPIVMSIIVAIAMGLMLTLPISSAAIAISLGLGGLAAGAATVGCAAQMIGFAVMSYRDNGIGGAIACGLGTSMIQVPNILKNPKIWLPPTLAGAVLAPFATAIFGMVNIPSGAGMGTSGFVGQIGTLDAMGISPMTWLLIISFHVILPAILTWIFAKLCDKKGWIKTGDLLLNK

SEQ ID NO: 2040 - protein, 218 aa, M.catarrhalis
GTIMTTSLNIHVIDHPLVRHKLSLMREKETSTYKFRTLTNELGRLMAYEASRDFEIESFSMQGWCGEITGEQIKGKTVTIVPILRAGLGMLDGVLDLLPTAKISVVGLQRDEMTLEPVPFFEKFVSDIDRRPALILDPMLATGGSMVATIDMLKKHGCTNIKALVLVAAPEGVRLVNKAHPDVKIYTAALDSHLNENGYIIPGLGDAGDKIFGTKQIG

SEQ ID NO: 2041 - protein, 371 aa, M.catarrhalis
DSYMQFSKSIPLFFLFSIPFLASCGTNSKDAAEQDDKAVATPQLSVEELIEKAKSEGRVNSVGMPNTWANWEETWNDINTEFGLSHQDTDMSSAQEIAKFLAEKENATADIGDVGASFAPVAVDKGVTQPYKPSTWDQIPEWAKDKDGHWVIGYTGAIAFIADKQKVNKIPTSWDELKRSKYKVTIGDVSTASQAVNGVLAANYALGGTEADLTPALDYFTDLAKQKRLGMADPSVANLEKGEIEVAVVWDFNGLNYRDQINRERFDVVIPSDGSVQSGYATIINKYAKNPHAAMLTREYILSDKGQLNLARGYARPVRIDHLTIPKDVQSRLLPQNQYINARPIADAKAWEESSAKLPQQWQERVLIHQQ

SEQ ID NO: 2042 - protein, 263 aa, M.catarrhalis
GKNMLNSQPTLKTLLEHRSIRKYTGEPIDDKVLTAILEAGRAVSTSSFLQAASIIRVVDKNKRTQLRQISCDMSEEEYQKALADGKRLGHAYVEDCAEYLVFCMDSYRHNQLAKVQTDWTEVMIIGAIDAALMAQNILAAAESLGLGGVYIGSLRNDIRRAGEILGLPKHVVPLFGLCLGHPDMSSKINQSQRPRLPLDVLVSTDTYQIPDESTLTKYNEVVREYYQGRRLDLDWAAQITATFGDEVRPFMLNYLQDQGFAKR

SEQ ID NO: 2043 - protein, 86 aa, M.catarrhalis
RQGLWVLTISFSSPLKVLYNQKAFFTHAAWLDQAFAHCPIFPTAASRRSLGRVSVPVWLIILSDQLQIVALVGLYPTNQLIRLRLI

SEQ ID NO: 2044 - protein, 731 aa, M.catarrhalis
CQFLSKLSFVNYNLMLIIISGGVWSPEIITSIGILDMNIPESIIEQLNSQADLVGIIGKHTTLKAAGREYKGCCPFHGEKTPSFYVNPETNLYYCFGCHAKGNPITFLKEFERMSFIESVKFLSEQTGIELPKDDTDQKKFKYKKTVKTQGAKLPTQPSPDPSSRQNFIHHQSDTRPSPATDWVNDLSAYDTYSGLADPSHHAGQVNELYGTRAPILTQSPNAAQGDLYSLLTAVHDYYQLMLNNFTFAKQYFLDRGLSEETIQTFGLGYAPDGWQHLEQVFPQDIEGLKILGLVRESSKSNGRTFCLLRHRVIFPIRDNQGRVVGFAGRSLGDENPKYINSSESPVFQKQQILYGLYESRKQKAKNYLLVEGYMDVIALYQAGIYGAVAPMGTAANEKQIERLLRYNNQLTLCFDGDNAGQKAAWRTLEIAAPILNDGRELKFLTLPDHHDPDTYLKSHGAAVMRDAIEGAVSLSDYIYGVLASQYDLTRPESKAQAMATLRQLTELLPKGSSLKWWLNSDIYQKLKAIGREGQFSPKVELINYNRHDAADAITEIALHLIHTPILLKSDPLAFVIEHSGMAQAHLPLSNHLERQEISLPKLPNWASFKSPLLDEIIATVSTLPNEILQDDTKMVQSCAYFVIAALSDVHKSQIQRYWQRFIQSWSNQDLKAITPVFYGLICTALKDILLKQQTNSKNLILSEVYKRRLQALVHWDNIHNKSQLAEILTK

SEQ ID NO: 2045 - protein, 438 aa, M.catarrhalis
NMTLSSYLKINERGSSVRQEIIAGLTTFLAMVYSIIVVPNMLSAAGFPAESVFVATCLVAGLGSILIGLWANVPMAIGCAISLTAFTAFSLVLGQGVSIPVALGAIFLMGVVFTLISVTGVRAWILRNLPASIAHGAGIGIGLFLLLIAANGVGLVIKNDAGLPVTMGEFMSLPVILSLVGLAAIIGLERLRIKGSILWVIITITMIGLLFDPAVKSDGAILKVPSFGSDSLFMQMDVMGALNTAILPVVFALVMTAIFDATGTIRAVAGQANLLDKDGQIINGGRALTSDSVSSLFSGIFGTAPAAVYIESAAGTAVGGKTGLTAIVVGVLFLLMLFFQPLAFLVPSYATAPALMYVGLLMLSNVSRLDFEDFVGAMSGLICAVFIVLTANIVTGIMLGFGTLVLGRLISGEFNKLNLGTVIIAVVLVAFYALGYAI

SEQ ID NO: 2046 - protein, 125 aa, M.catarrhalis
HWPPSAKRRSALTTNFQKVLGNKRALYHGCNIPANQKKPKDGFVQKTLLEFIEESSRVMILQKVGHDHDEPLVSIAYSEQVQDMLGADARVVGQAMIHAAIASVVQRQSNFWHAHVYDEEPAHYS

SEQ ID NO: 2047 - protein, 280 aa, M.catarrhalis
TMIPNENMTLPLDILYQNDDVLVIQTHTGVSDKADRLIGHDDNQLALYGKFNMALHVNDMPSWVLNRRARLLAWLYEQAGANQIHWLNQVHGNVVIDVDQTRSQSLSLADALITQRAKTALAIMTADCVPIAIFEKNGSTVACIHAGWQGLANGVIAKTVALMPTSYKLFAVIGACISLPAYEVDQHLAEHIIDEAVTNKLVLLDRQVLFDMLIKPSHNSDKAYIDIKRLAQLQLEKFGITVLNDTVPCSYLSPKYYSYRLQTHTNRPAIGRMAMLIIKK

SEQ ID NO: 2048 - protein, 68 aa, M.catarrhalis
QLPPRHLPKGGWRTALCWLSTQGPCDLFILLLKPMDFLDPWMTQSQRACFIKNDGINATSRLKADRIF

SEQ ID NO: 2049 - protein, 134 aa, M.catarrhalis
ENFYLHIVRLPRFWYHRRHIVQAVCLPQTHCPTFYNLAFYFLRIYPMANSAQARKRARQNTKRRQHNASQRSMVRTYIKRVNSAIEAKSYELATEAYNKAVPVIDRMADKGIIHKNKAARHKSRLNAAIKALKG

SEQ ID NO: 2050 - protein, 750 aa, M.catarrhalis
FLDFIIRIIMLSPELLTIQEFMLKFAKQHSHQFISVEHLLMGLLKDAFTVRVLEECGADSEFILSSIKQYLKDFMPKREDVDPLPTKSLNRVMQRAIWQVQASQTQQLVKPIDALVAIFKEERSYANELIQSCGVDILSVTRAISIHQRSAHDAYNGVDESANQSTKPKQNPLDAYTLNLNEQAKQGKTDPLVGRADEIERTVQILCRRRKNNPLLVGDPGVGKTAIAEGLAWLIVNGKAPKPLANATIYSLDMGALIAGTKFRGEFETRMKDLIDELKDTPESILFIDEIHMMIGAGASMDSSMDVSNLIKPALAKGYIRSIGSTTFAEYRQVFEKDHALSRRFQKIDIKEPSVSDTIAILQGLKGYYEDFHGVAYTEDAIEAAVKLSVKHIHERFLPDKAIDVIDEAGSFVRLHHDKVTNHSQMDTQKTSSSIQVDIDIIEQVVAKIARIPPKSVSHDDKNILKNLNANLKQMVFGQDQAVDTLVDAILLARSGLTHPDKPIGSFLFSGPTGVGKTEISRQLAYLLGVPLVRFDMSEYMEAHTASRLIGAPPGYVGYDQGGLLTEKIQQNPHCVLLLDELEKAHSDVFNLLLQVMDHGTLTDNNGRMASFKQVIVIMTTNVGADSISRRSMGFTQQDHHSDNQNAIQRTFSPEFRNRLDAIVNFAPLPPEVIGDVVDKFITELYDQLLDKNIILSVDDEVRLHLAKKGYDRLMGARPMARTIQELLKKPLSKLILSSPRGWKDPRWRD

SEQ ID NO: 2051 - protein, 199 aa, M.catarrhalis
MVYHMNDNLSIGENNLHAGTSGTKRKNKPEELKHGLIMAAKHLMVSDGVANLSMQKVADTAGTSKGGLFHHFKNKEELLNAVVGLYIAQLNTAILSITDELGAIQGRFTKAYLQVIFQDSKIGMNSNWSRLLTAIHADANMFEVWQNWMAQKQKQFAATDSHPQYQVVRYAIEGAQLDTELKSNQAKQHEIYETLASLI

SEQ ID NO: 2052 - protein, 250 aa, M.catarrhalis
MFSQAYGLGFLELSIMLHLYHLNNSRSFRVVWLLEELKLAYGLEYQLHLIERDQKTFLAPKNLEQIHPMGKAPILIDDRLPKGEQVLAESALILSYLLKAYDSKAYFYPAAANPNEQANDKVWRDYTFWIHFAEGSLMPPLVMGLILDKARQKSPWFVKPVLNKFNSSIHQIILDKNVMNALKMLETALADKLYLTGQFSAADIQMYLAVYGVRLRGLIPQTHTNTHAWLGTCESRQGFKSAISLAGSPL

SEQ ID NO: 2053 - protein, 426 aa, M.catarrhalis
VIKQRRFGMRFSAVITALLIGAMGYMSAFANPQAFDDQADVDDLIIDTPALDVAPNHLYGIDGLHSGRVPLNTISPTTLKTFVQVVDLMRREYIEPVDDEMLFYHAIHGMLNRVDRNAEFLDATAFANLSSFTTGNVAGVGLKAVWRSQDAHWVVTEVIADSPAKSAGINVGDYLHQIGDIKLNQSQTENDIIQLLSGIAGSSVDITYSRAGRSKQSVNVIRNQAQKSSIEVFVQNGIAVIKLPVFQNNTRQDIIDRLALIEGQVRGVVIDLRNNPGGVLDSAAEVASLFMRKQVVTQVQNRSGIERVIETHGSPVLESMPVIILQNRYSASAAEVLASALQTHGRAMIVGEASYGKGSVQSVIALGNHQGIKITTAHYLTPNGKKIDKIGVVPDVSFKPPSNDSQDDEWLRLSLDLMERVKTNQS

SEQ ID NO: 2054 - protein, 128 aa, M.catarrhalis
NFQQQYDMTKQCSSYFLIKAVQDFKSPSKHRSDTDVITETKIQVKQPKLYTVIMYNDNYTTMDFVVYVLVEIFQHNIDKAYQLMMQIHELGQAAVALLPYDLAEMKVDEVTALAEQESYPLLTMIEPA

SEQ ID NO: 2055 - protein, 64 aa, M.catarrhalis
WTNKLLSLNYGFFSTKNTAKSLAVFEYQKFILGQPFVLDAQSHQIQLQLISSAEWQFVLKIDYF

SEQ ID NO: 2056 - protein, 605 aa, M.catarrhalis
FSDNSLFVHYHTPFIMTTTQARLKKPKKPRRSQADIVANNFLNSVFRPAKKQLTLAWLCDVISLLLFMVQAWILVMIFDGWLLPFIPELSQHQVMAIEALAVYVMALFGVMLLRALIGYAKDALLTRIGVQAASDVRQRLLVKLGDMGPARRFFGSDGALASKIIDEPEHLIGYARFEIQKKTAVSTPILLAVCISFFNKTAAMILLATAPLVPIFMAMIGVATARKSREQMDAMAQLGGRFFDWIRGVNTLSRLGVVDIAVKDIDVSSDNYRKKTMAVLRIAFLNSAVLEFLSALSIALVAVYLGFGLIGILPWQSGVVITTYSSALMILLLVPEFYAPLRRLGAEYHVKGQAVGAAKEMVGILDFKHSKTELHQVDLMGKVGFCLRQVAAFGDDGRVRLTPTTLHFVAGKSTLLKGESGTGKSTLLQILLGFGQYTGVVEVYDDQGHYRYDTLDMAYLRHQFGYLAQMPALLPISIRDNLTLAKSDATDDELIDVLDAVGLWSLIRDLPEQMDTILGERGGGLSGGQAHRLAIAQLLLQDAKVWLLDEPTEHLDSETAFMIKDLLKRLSVHRTVIWITHDQSVDIAFDDIHHLGGYDEIKSTI

SEQ ID NO: 2057 - protein, 72 aa, M.catarrhalis
VIVKEMMAMNKNKPVILQNSGVKILVGVLCLLSFVAGYFAHQSRQMNYCNSINQTPIVQNGIVICQLNDPNT

SEQ ID NO: 2058 - protein, 350 aa, M.catarrhalis
SGLNLLLGFIMNHDELMDNLVNQAPDCGIGEDSDADDLIDADETTTQTPTQIHLTHSVSTEQIGIRLDKLCADIFGGFSRANLKKFIDEGQLTVNGKVVKPKYAVKVGDILTLEAVHESHSEDLPENIDIDIIYEDEAVIIINKPAGMVVHPGAGNRTGTLVNALLYHFPKQAHLPRAGLVHRIDKDTTGLLVIARTKSAQLSLINQLKDKSVYRHYQCIALGAVHEVLRHAQIDAPIGRHSTHRTKMAVKQTGKPALTHIVNAKSLHERYSLLDIHLKTGRTHQIRVHLSYVGHPLVGDPVYGTSPRAGLSDRQRCAILDFGRQALHAYMVGFIHPVTGEAIKFHAPAT

SEQ ID NO: 2059 - protein, 368 aa, M.catarrhalis
TSPNLDQFMRIPMKSQNKLIAAMMAATLTVTGCQSVNGLFDRKADTVETAEKTDAAYYQEASEALDKNQNRNAIEALNNIRTFYPTGQYAQQALLDLIYAQYKANDFEAVLQSTEEFIHRYPNSRSVDYALYVQGVTHMGGAPKASRLVRFDQSHRDVTYLRLAFRDFQNLLKHYPDSPYVADAAQRMIAIYNDFAEHELAAARWYVKRDAMVAAANRAKWVFQYYPQSTGVPEAIAILAYSNQKLGLTETAKQYKQLLQINYPQYLNQDGSVRLSDTGAKTRTQKVLSALSFGRLGRVSENLDNYQGQYHGATRTQIISQAGAISLPATTQVPKEIPTAGGTNHRPAISLDLPSAEADAGQLNQIPR

SEQ ID NO: 2060 - protein, 205 aa, M.catarrhalis
SLPNINTMTKTSHQTNLSAVHLRKHMRMQRRSLSHCERQRSAYLATRFLYKLMPLLPKKANIGFYLDGFCELPTATIAQFCQKLDYQAYLPITTPNKPLTFAPIIQPLNKTPLKKHRLGMHEPRSKLILSANHMDAIICPLVMVDLDGIRLGMGGGYYDRTFAKAKNCLKIAWCYDFQVADRLPKQPWDMSVDIIITDQRLIRLK

SEQ ID NO: 2061 - protein, 232 aa, M.catarrhalis
NQKKLINPSSCLISFVCRVGWMFENTPIAITHLCIGYIKPLPNFLSLNTKNGWFFQHRSVLNMVKTWLIDILGNLQEKFPKIHAIIMDDDPTARIHQCVFYEDFVQRLHTLGLQDRVSFIGKNPPDMREWLSSANIVLSLANHPESIGMTALQAIHLGTPVIGWAKGAFADILGDLYPQGLVKEQTAIMLCKSVKFLLSNPIPPAMTHAYEIDDMVDNTIQVYQDLVKQSTE

SEQ ID NO: 2062 - protein, 234 aa, M.catarrhalis
KLMKTKAILIGGSSRVGEALAQELALIYESVILITRTQPRAMSANMQVYHVADFRALASTIEMVAIGADTDAFSCLGVSKQQVPSHDEFYQVNVLYNLEFAKACKQKGVQQFYFLSKEGADTPNHDDELTAKADVEYDLRTLSFDTLAIFRLYRLTLPKHRLSLKSLGSQALNGVLSTLNKNKRALEPKQVAACMAITAYKHNHQPQLRTPNQATIITHEQMLNSVIRPNKKSK

SEQ ID NO: 2063 - protein, 67 aa, M.catarrhalis
LLALVRLDLQHLPRLWQAWAQQHAMVYGLKDAVSLESAGGIDTIIFDKTGTLTLGHPRVQKIHWLKQ

SEQ ID NO: 2064 - protein, 298 aa, M.catarrhalis
RYFDRPMNIRFFMPNLTLFTHFKKQRGSTNQILALFLIALAVSALIVAVIGYKFGYRQGMHSVERTVLAKHDAAVNVSELTAENVRLKQEMTTAIQERDISRSTLNNLRTDYDNLKTTNLQLEQVNELLKTAVAEQGGVALSIMASEIISLPNDTFEYRFDVSMLDISGKAVKMIPKLTLLNETNMVKVPLEPSSYDIRGVQIFVFELSCLRALKRKQKKLKLVACNQKVQQLYNWQNWQNHHQCTRFIGTNVKFKPTDQLKKARNNLWVLFITNTGEAVAFACFILTKIEISSSNTI

SEQ ID NO: 2065 - protein, 217 aa, M.catarrhalis
YGRLMSIKVLVVDDHDLVRMGITRMLDDDPNIEVIGEAIDGDSAVIQVRAISPDVVLLDVNMPNINGVEATRRIKQFNPNIKVLAVSSLTAQPYPSMLLKAGVNGYITKGTPLDEMIRAIKKVHAGSRYFSHDVAEQLAETVLGEQKESPFDALSEREKQVAMMVVNCQSTQQIADQLFVSAKTVNTYRYRIFDKLGIDSDVKLTHLAIRHGLVQTH

SEQ ID NO: 2066 - protein, 182 aa, M.catarrhalis
NMHRLTVMIKMTTRYLMLQNSNETITLPSFELTMVAADTQEATAVQLNQLLNQSHQGLILYFYPKDNTQGCSIQAVDFSHHKAKLESLGFYILGVSRDGIKSHQNFINKKALSIDLISDTDEKLCQYYDVIKEKKMYGKTHLGVVRSTFVYNKNGEMIGSFRDVKAKEHVEKILDFLENKTN

SEQ ID NO: 2067 - protein, 440 aa, M.catarrhalis
ETNRFACIKHSLPLLLSYQQLKASALMSDKSPNPHFSPEQVHEITEQFAISGMTCQSCATRIEKVLSKKSAIHQATVNFATEVLHISYDANQTNRDEVMAWVAKAGFEAVPMADRQDQHKMPWDLMILWGLSLPFWVGMLGMLFGSHALMMPVWIQFVLASVVQVVFGARFYLGAWASIRGGLANMDVLVALGTTAIWAYSSYVWLTDLHAMHMVYFEASVMVIAFVRLGKYLEHRTKTQSLNSLGLLTQLIPTEVNRRIDDKWVKTNIEHIKVGDVLLANTGDKIAVDGVVQGGFGVCNESHLTGESLLIDKNIGDTVYAGSSVEDGSIHYQAAATGTKTQLGDMMSALQDAQGTKADIARFADKVAAVFVPVVVALAMMSFLVNYLLGAEFDIALMRGVAVLVIACPCALGLATPAAIMAGMGTAARHGVWFKRCGQP

SEQ ID NO: 2068 - protein, 288 aa, M.catarrhalis
INRRALELTASIEQYASHPLANALVEAAKDKNLPLYEVSDIQSTTGQGLMGYVDGIGQLKVGTPKFIGLETWQADDQWSDTSLVGLAIDDEPMAVFGLSDTLKADAHSIISRIHHDGIKTYLMSGDRQSVVDGVANQLGITAAFGQMSPRDKMSAIETLKTQGKRVVMVGDGVNDAPAMAASHASFAVGSATGVAKHTASARLLGDSLNHIFYAYRIARMTLTNIKQNFFFALVYNCIGIPLAAIGLLNPMMAAAAMALSSISVLLNAMRLKRVQLTPNDMHSDKSVG

SEQ ID NO: 2069 - protein, 261 aa, M.catarrhalis
  UNSURE (2): Identity of amino acid sequences at the above locations are unknown.
FXIGKFMTTISVQALVKFCDNYLNAHEFQDYCPNGLQVDAGRPIERIITGVTACQALIDQAIQAKAQAILVHHGYFWKGEDQPLVGMKGVRVRKLMQNGISLIAYHLPLDAHPDIGNNRTLADMLDLTITGALYPNQKHPIGNVATTNPILASEFSDKITKVLGRTPLHIAATDGNRRLNKIALCTGGAQDMIEQAATMACDAFISGEISERTTHMARELGVDYFAAGHHATERGGVIRLGEVINQQLGIDAKFIDIDNPA

SEQ ID NO: 2070 - protein, 463 aa, M.catarrhalis
NMTIRTEKDTMGEIAVPADAYWGAQTERSRQNFRIGGERLPEPLIHAMATVKKAAAMTNATLGRITDEQSQLIVQACDEILAGKLNDQFPLVVWQTGSGTQSNMNINEVIANRANEIAGKPKGSYQPIHPNDHVNHAQSTNDSFPTAIRVAAAQEMSNKLLPAINNLRQTLAQKSADFDEIIKIGRTHLQDATPLTLGQEFSGYVMQLDYALERIEAALSGLYQLPLGGTAVGTGLNSHPDYAVKVAKVLAELTKLNFITAPNKFEALAARDAEVFASGALKTLAASLNKIANDVRWLASGPRCGLGELSIPENEPGSSIMPGKVNPTQCEAMTMVVTQVFGNDTTISMAGASGNFELNVYMPVIGYNLLQSIRLLTDAINSFNEHCAVGIEPIYEKIDHYLHHSLMLVTALNRHIGYENAAKVAKTAFKNNQSLKQTAIQLNLLTEAEFDEIVRPEQMVAPK

SEQ ID NO: 2071 - protein, 579 aa, M.catarrhalis
GVMMKSNQPFKLRELISTQVWVWILAWLLGLVTVWSVLGLSMVSGWFVTMSAVAGLVAVGTHTFNYMIPAAIIRTFAIARTLSRYGDLMVSHHAVFGLLKDLRVRFFADWASLDFNARNLQRQSSSQKMHRLVKDIDVLDEFVLRLISPWIMAIGAVILVAGVTLLLLPKAWFGLVPIGLAILIAAFVVYRGIHLAYDESTILETRKSKLLDTLPALTSLLIWHRWDAYIHQLSDLDAQQTKITLSSHRLRRMGMLGVQVALALAATLMLWGVGRFFRQTDSVAFTIETLNDYPMMSSAVALAVFLGLMGLGEFIQNLIAEPLALGRSQVAKQRLNEMLVGQNAAPKINFNQITNQQDALTLWLNNAIVRAPNAIISAHIHHAKIRSDKPCLIIGPSGAGKSTLLHTLAQEHDLTSGEIWLCTDTKKYPWQSVDFDQSLGFLGQTVDIFDQTLADNLRLGKPNATDDELITALKKVNLLTWLNNQPKGLATRLGEYGMAVSGGQARRIALARLLLSPKAVMMLDEPFAGLDPDTRHNVWLSLIDAQKSGDIGLLLICTHQLWQQMGEVQVIKIEGEGQV

SEQ ID NO: 2072 - protein, 531 aa, M.catarrhalis
GVFLSVYLERAMSNQKKIPHVLMILDGIGHREETKDNAVAVANTPNLDALFASYPNGLISGSGMDVGLPEGQFGNSEVGHMNLGAGRILFQDSTRIMNEIASGEFFNNSALIDAIQATLNNKGVVHILGLLSDGGVHAHIDHIKAAAKLALSQGAMQVFVHAFLDGRDTPPQSAKGYVTDIEDYFTQINQEFEGNVKIASIIGRFYAMDRDKRWDRVESCYQLLTEGKSVRTADNALDAIEQAYAAGETDEFIAATFIEDDGVIGDNDGVIFMNFRADRAREISLAFVDTNFDGFNRHIVPELSAFVMLTKYSDELENNPKTDIAYHPTSLTNTLGEYLQNLGKTQLRIAETEKYAHVTFFFSGGREALYNGEDRILINSPDVKTYDLKPEMSAFEVTEKLNDAIDSGKYDVLIVNYANGDMVGHSGVFDAAVKAVEAVDQCIGEVVKHIRAAGGHLLITADHGNCEQMQDYQSGQVHTQHTTELVPFIYIGDKKATVRRGGKLCDVSPTLLDLMGLDKPSQMTGESLLVF

SEQ ID NO: 2073 - protein, 224 aa, M.catarrhalis
VMKVLQLSSSLRHDESERGIYPISHALIKAGHESIIIGSAPSDSKLVVRLVRDGAIYYRLPMPKKSWWALIHTLKLRQIIEQHQPDIIHIHSRTPAWVLYWAMHSFPNDKRPKIISSLYGFYPVNSYSKALFHVDLLISASKSIDKHFNKIFEKVKSEKIDKSIKLPDIICVPRGVDVRKYPYRHHSSVHWLHQTFTQFPELEHKKWLVFPTPIGPEYGQDMAH

SEQ ID NO: 2074 - protein, 892 aa, M.catarrhalis
QGLFMSDSVSPIGIVEELKRSYLDYAMSVIVSRALPDVRDGLKPVHRRILYAMHELGNDYNKKYLKSARVVGDVIGKYHPHGDTAVYDAIVRMAQDFSLRYMLVNGQGNFGSMDGDPPAAMRYTEMKMQKLTHKMLADLDKETVDWEDNYDGSMKMPSVLPARIPNLLVNGATGIAVGMATNMAPHNLTEVLNACLAYAEDPNISTDELISHISGPDFPTGGIIHGRSGIIDAYRTGKGRLHIRGRYHIEPMGDSGANKDRERIIFTQIPYQVNKANLIKHIADLVNAKKIEGITEIRDESDKEGVRVAIDLRRGENCEVMVNNLFNQTPLETSFSINMVALDNGQPKLMTLRDLVAAFIRHRQEVVTRRTIFELNKALARGHLLEGLAIALANIDDILQTIKQSANRSQARENLLVRTWQSAGVVAMLDAAGAKSIRPEMIDGEDLKAPYGLIENKTRYRLSPDQVNAILDMQLHRLTGLEQDKLTGEYQEILGEIARLTLILDDFDVLMGVVRAELIDIRDEFGDERKTDIVDARHDFNREDLIPEQTVVLTVSRTGYAKTQPISDYQAQKRGGKGRSATAMKEDDVIEHLLVTSTHAHILCFTNTGRVFRLRGFEIPIASRGSKGRPLVNLINLESDELVTAILPVNDLKDENSFVFFATASGTVKRVALSQFANLRAGGLRAIDLAEGDTLIGVAITDGEQEIMLFSNEGKAIRFKEQSIRAMSRVAKGVRGMRVNLLATTDEEELLDEDGDEVGDDFAVSRVVSLVVAPKQGEILCACENGFGKRTPIDDYPTKGRGGKGVIAIKTSERNGQLVKAIAVTGEEDVILISDKGTLVRTPVAQIANAGRNAQGVKLIRIADEEVLVGMACVEHDDDEIEESEVLADMVQ

SEQ ID NO: 2075 - protein, 262 aa, M.catarrhalis
DGEFDAQRDLFFCHHCASLAVGINQIDTTDFTGSLMRPIVVVLLILAAALTPILWRVERAAPDPVVQVDLLASREVRIATAISAGNGLSQAAIVFIPRYAFFALSLSESMASFSLLPFVTTMAFSAPIVGVLLDRVGSRVVMISGSLILMVGCTIMALLSSTTPLFILAEVLMALGLITVIGAPLRYIMLSETPPEHRASGQALINILSSAGQLVGGALIGGIVASMGSGVMGYRFSFLFLVAVAFTLFLLSTGLKGRTGTA

SEQ ID NO: 2076 - protein, 158 aa, M.catarrhalis
NSPPCRPENQGEVISTPKVLTADKQTARISSGLQIPYQETTHSGASTTKFKEASLILEATPNITPDGKIGLKLNIKNGNPVPTLGHIAIQEDAIETNVIIEDGQTVVLGGIYRTSQNEGANKVPRLGDMPVLGRLFRHDSKAHDKSELLIFITPKLVR

SEQ ID NO: 2077 - protein, 231 aa, M.catarrhalis
RHCTNPKPFGRDRIAIKDGQGYPMSNEYAKQILNALKAGNDRYVENLSSTKKTPLSPPTLVKEHKPNAIILGCSDARVPVELIFDQGLGDLFVIRVAGNVVAPSQIGSIEFAAEKFGTRLVVVLGHSHCGAVTACVEALINPDQYYSPNLQSIVDRIRPSVLNLHEIATASCDDVDMDELIERSVRANVGMSVSQIKYGSRILEDMVRQGDLLVIGAEYDVATGKVHFLDD

SEQ ID NO: 2078 - protein, 501 aa, M.catarrhalis
TNFLFCRPLEKTMTVGTFNPKTQATAIKNPATALHEIREADRDTAVPKKVYIVTQGCQMNEYDSQKMGDVLGSSHGMVITNDINDADVLIMNTCSIREKAQEKVFSELGRWRKLKEKNPNLVIGVGGCVASQEGDNIQKRAPYVDMVFGPQTLHRLPELYESTTNQAKTDMGQIPKNRIGVVDVSFPSIEKFDFLPEPRVEGYTAFVSIMEGCSKYCSFCVVPYTRGEELSRPLDDVLAEIDSLAEQGVREVNLLGQNVNGYRGEKDDGSICRFSELLHYVSYIDGIERIRYTTSHPLEFTDDIIEAYQSIDKLVSHLHLPIQSGSNQVLAAMKRNHTVDVYMNQIAKLRKIRPDLHLSSDFIIGFPGETDEDFLQTLQFAKDLDFDHSYSFIYSKRPGTPASDLPDDVSLETKKQRLAVFQELIKRSTFEKTEAMVGQTLRVLAEEPANRRQGYLHGTADNTRSVIFKADTDLLGKFVMIKITKAISMHLVEGELVEVLG

SEQ ID NO: 2079 - protein, 87 aa, M.catarrhalis
KLSYHTMFGNLLPVFLCIDHSDTDYLDKNFIYFIDQYNASYLTNLGVIKIKSSDLSCALESCRNNRPSTGISPNLGTLFAPSFWLVR

SEQ ID NO: 2080 - protein, 224 aa, M.catarrhalis
  UNSURE (219),(223),(224): Identity of amino acid sequences at the above locations are unknown.
AKFNSFKLIMKTANKLTITALLATISIMQAACAQGHANDGSIYQFFDVERQKSSPNALRQYEKNMQGTLFGMYPTYWRLNYNLSGQSPEAVNQFVHQYPSTVMSEKLAADYAEIKARQGDYASVRAVADSIENPDESEACAIALGFNQSRDSLRALYQKPNVWLNTQIRQSLCHKLATEMVYNPRITNIDKHEQLLRMLRIDKRQVCTASYKSRLYKTXPRPXX

SEQ ID NO: 2081 - protein, 233 aa, M.catarrhalis
KLIKQTNAQNQLLSRCLMFNEYYRWGILGAWIWVGIGCADSTSQVVDDKLAHITHEERMAISEPVPIPLSVPMIYQQGKDPFINPYRNVEVLDTNHAADQQDEPKTESTKAWPMADTMPSQPSDTHQSAKAQAQVFKGDPIVIDTNRVREPLESYELSSLRYHGRIFDDIRLVALIMSPDGIVHRVSTGQYLGKNHGKITHIDSRTIHLIEAVADTQGGYYRRDVNIHFIHKQ

SEQ ID NO: 2082 - protein, 327 aa, M.catarrhalis
HMDKKFLKNSLVIAVMLGVVHMEVRADTHIDHVSVTQTAEQHYTGKPISLEFADIPVRAVFDILAGFTGINIITDDSVTGSMTIRLMNIPWDQAFDVILQTQNLSVLKHGNVWLISSKSIQSNQPTITEYIRLNYALADDVATLIMGEKTQRGNVNRTNHRDVIYPEAPLSRAYNTQTDELITTAVRGTLLSERGTVTVDKRTNTLIIQDVPASVANIKALIERIDIPVEQVMIEARIVSANENFGRKLGVSFGAHGQNGKVHYGGSQGSLWAMRQEGVAAGGHQNSHLNVDLGVDNAMGRIAFGLLNLPDIILDLELSAMQARKSR

SEQ ID NO: 2083 - protein, 645 aa, M.catarrhalis
LKASWLRSWANLIDTGTEWDVRLNKLRAWLRGQSDTPTIGIYFGEKAATAVWLDEHDGRYHWLGSACVFYTDVVVSGKIVDKEKLAQTLRQMMQTLGLSQANAITCVPDDAVMQTLIDLPADLSDEDIEAQILVDAERYIGRNIQDVYFDFQVLERSSVATQITLTVAHQNSIHDCCEVLAMVGIEAVAVDVHTSCLARMMAKMTAQVSALVEITDHDIGGYITHHGVLLYQQNEPIHTLTNFGNQPLDEQSELDQFSQFTHDVDTPKNWPNQSPLTMNFGDLTDRLSKTNASIQNDFVQPLQDNFIQKTPDIAIKAQTGDYHIRFDDWVDDMAADELSFGEASANTPHIKSSDRSELEVDQMATKILSLIKNCQAQTVLPIERLYISGTTWTKASQLAEALQAKLDILCLPMHPKYAVNHAIEDNDMEQAPMLTAAAALALTRSEGINLLPWREERRSQADAKFRQIFVSVVGLAVLVMMLIFGAIYYRLNQQQAINDEIKTRISTLDDKIHQMQQLKEQLDTAQKHSEALNALSEDRQVAYRWQQLSNLIPEGVYLDEMSQAADMLSLTGKAVSTQSVSAFAHRLELSGLYTDVLVVSLQQADQAMSFTLTATQLPLDAKDMIQPANITNHDENTDVNERGNE

SEQ ID NO: 2084 - protein, 183 aa, M.catarrhalis
QKESMMSIQQPKNALAAEGVKDIPVQSEGYILNHTMLRIKDPVRSLEFYTGILGMTLLKHSRFADSEFDLYFLARLTEDERANLPAGDELKDFVSRQRSILELTHNYRTENHADFSYHDGNSEPRGFGHICFSVPSLKEAGAWFDENGVQFKKLSEEGTMKDILFIIDPHGYWIEIIESYNHL

SEQ ID NO: 2085 - protein, 375 aa, M.catarrhalis
GKFMTQAPLIVKTQRHDYPIFIRASDDQIDLVSQIIPFITAKQVLIVTNDVVAPLYLAQMQERLLSAGFHVEVCVLPDGEIYKNQDSINAIYDVLLGVHFARDCTLIALGGGVIGDMTGFAAASFMRGVNFIQVPTTLLAQVDSSVGGKTGINHPCGKNMIGAFWQPSCVLADMTTFQTLPEREFAAGMAEVIKYALIMDDDFLIWLEEHADQINAKDRHLLAEMVYRCCDFKAQIVAADERESGKRALLNFGHTFGHVIETHQGYGKWLHGEAVAAGMVQAAQMSYRLGLIRACDVERIENIIKKYHLPTKPPKIDVAQALDLMGHDKKVKQGQIRLVLLRRIGDAFVTADFELSDLEAVLAGQITTASLLVDE

SEQ ID NO: 2086 - protein, 318 aa, M.catarrhalis
VGKIMSKIPMVNEKYFRRQALYWLIAAAIMAGLWLIVWLTSSVPAMINKQNANQTSSYVATLPTTITALNELDHVVKPMDNSALVRDLRNYPPEFKDKVYFNGISGRYTIELMDVTENEVIVDYLNSREDRNNFAYFRYTDANDNKRYVLTYGKFTSPADAESALQTVNFRLPKSVTQKTTKISELVAVMDNYELGQDVVDLADFQPRRVRLQATRTEIPVKAATPADEELARLSRERALQTQISQQTESVRQPTDLDIQNDINRLSNQRSQVSSSDLPMAPTARPQSPQQTADIVPKNEISKGTAPTQSHSAETESQ

SEQ ID NO: 2087 - protein, 231 aa, M.catarrhalis
VKLVHKYPSWRIYYINWKITMLDDDSAFIEEVMVEKAGNALSKQLPAIFLVGPMGAGKTTIGKLLAKHLGRNFIDCDWYIVDQTGADIPWIFEKEGEEGFRDRETRALQELTALPNIIMATGGGAVGRTKNRELLKKGLVIYLDASVDTQLARTKKDKNRPLLQAQNPRAVLESLYKKRHPLYREVADIIILTGRAYPKQMIGEILEVLENYALDHAPNKLKTDQHAKENS

SEQ ID NO: 2088 - protein, 216 aa, M.catarrhalis
TSVVMNNFVYQLQSFWYELNQVNRHTIAQSPKYIQLTVLGLIVMIIGIFGWLLAILPTIQKLNAAQSQESALIDEFATKYHKAQQFDHLSHQVIQKNTQLENQLNALPRTAPMSEIVGMINTKAQAVNVQVVSASVQAGREQDYYTERPIAVSATGDYHALGRWLLELSEANHLLTVHDFDLKAGLNHQLMMIVQMKTYQANKRPKPVAQQVPDVQ

SEQ ID NO: 2089 - protein, 300 aa, M.catarrhalis
SFSNFCQNKTMISTKKIYHADSSDDFQDWQAELSAAVSDLDTLFTLLDLPKQAHSHTPKQFGLRVPHAFIKKMKKGDIHDPLLRQVLPDGRERMTVDGYSTDPLDENNHNPIKGLLHKYQSRVLLTVTGACAVHCRYCFRQHFDYHANQPSTHEMDEVMDYITKHTEVNEVILSGGDPLSLNNKRLKLWLDKITAIGHIRTVRLHTRLPVVLPNRVDHELIALIRHYQKNIVIVLHINHPNEIDDQLIAKTKQLKDAGATLLNQSVLLASINDDIQTLSKLNQDLFGAGILPYYLHQQVF

SEQ ID NO: 2090 - protein, 204 aa, M.catarrhalis
IMASFSTNDFKAGLKVMLDGNPCSILENEYVKPGKGQAFNRVKLRNLRTGKVLEQTFKSGDSLEGADVVDVEMNYLYNDGEFWHFMHPETFEQLQADKTAMGDAAQWLKENSNALCTLTLFNGAPLSVTPPNFVELEIVETDPGVRGDTSGGGGKPARLETGATVRVPLFVQQNEVVRVDTRHGEYRTQWTLDNEPKWPKDPRK

SEQ ID NO: 2091 - protein, 77 aa, M.catarrhalis
CVGRPKVNDRYNNTYRMHPALYQGYYANRTMLAINKTRRGPAAEIKDSYAQPITQRAPSNPVINRDASAHIYFSNNE

SEQ ID NO: 2092 - protein, 579 aa, M.catarrhalis
LILRFITSKASYQSTIQQGAFMTKPRLRSHIFAISFGIFASLTMLSACGKPSKIHTPSITHQNMLPSNTLAQLSALPQLTQGLGDTGKSVIDPNKPTLVKFWASWCPLCLATLQETHDWRDDPNLAGFNIITVASPTHLNEKNTQDFTDWYQVLQADYPNLPVLIDSSGQLIKELGVQVYPSWAILDKNGQLVYLNKGNLSFEQVSYLAKNPQELDQLKTQGGQTAMPTKNKDGVYYNDQGQPLNTKTIHLAGGCFWGVEAYFERIDGVVDAVSGYANGNETIANPSYEQVIAGSGHAETVKVVYDADKVDLDTLLQYYFRIVDPTSVNKQGHDRGIQYRTGVYYTDPSDKAIIENALNELQQKYKAPIVVENLPLRHFSPAEEYHQDYLTKNPNGYCHVDLSLANDKITSKAPTLPKASTVQEALDPRRYQAFTKDNLKQSLTKAQYDITQNAGTERAFSHAYDHLFDDGLYVDIVSGEPLFLSTDKYNSGCGWPSFTKPIDPQVISEHTDTSYNMIRTEVRSRIANSHLGHVFPDGPKARGGLRYCINGDALKFIPKADMEKQGYGALLPLIKPAQP

SEQ ID NO: 2093 - protein, 308 aa, M.catarrhalis
FIKGNSQMMRIGLFLLTNLAVLIVFSIVFMVLSQVFGLGNVHASGGLNYVSLAVMCLLYGMIGSVISLFLSKWMAKKSTGTVVIDTPKNGTEQWLVDMVARQAREVGIGMPEVGIFDNAQPNAFATGWNKNKALVAVSTGLIHTMTPDEVEAVLAHEIGHVANGDMVTLALIQGVVNAFVMFFARIIGNFVDRAIFKNESSSPGIAYFVTSMVMDILLGILASAIVMWFSRLREYRADEMGARLAGRDKMISALNALRPAEARPDQMPEAMKAFAIASGQSQGFSIASLFRSHPTLDDRIASLQKFHG

SEQ ID NO: 2094 - protein, 299 aa, M.catarrhalis
VYFMSYSMTKSIRHRNKVMTFDVPKVMGVLNMTPDSFSDGGRFNHLDAALVHAEQMIAYGVDIIDIGGESTRPYAPKVSTDEELERVIPIIAAIRENFGEDLWLSVDTSDPAVMLQAIGAGADIVNDVRGLSREGACDMVADLECPVVIMHSRGTPDTMTQTMNELTSYNDVLAEISTELQIRIDKAMDAGMGQEKIIIDIGMGFSKNYEHHIQIMQNLQQIIQHFQMPMLFGVSRKRFLGEVLTNSELEYLKNHQPIERDNLGTLAHFIALQQGVHIVRVHDVKPMAQAVRLWQALYG

SEQ ID NO: 2095 - protein, 106 aa, M.catarrhalis
  UNSURE (26),(27),(28),(30),(38),(40),(76),(79),(81),(88),(89): Identity of amino acid sequences at the above locations are unknown.
KINMCRCVTINHRIAWCPLCDWLSVXXXYXGGGTAARXIXRKHGTIRIIALIQCRMHTISVVVAVIYLRAPHALRXKWXNXGGGGEIXXACIISGNHMIWIAKLVL

SEQ ID NO: 2096 - protein, 115 aa, M.catarrhalis
KKKKKKRKKGRRGREGGEKREGETRPPKPVIHSESSFNPIVRSGMGAMGLMQLKPGPARNMGVYNAWDPAQNIKGGTKYLAYLQHQFSNPNHVIAAYNAGHNNFAPPAGIHPFTS

SEQ ID NO: 2097 - protein, 472 aa, M.catarrhalis
GFVLQYFDRHEGGENAILVHLDIHQITDPDDLEEFRLLVHSAGANEIEIITGSRSKPHAKYFVGTGKAEEIAEAVKRFRDTNDDNTDDVIVIFNHTLTPSQERNLESLIKCRVLDRTGLILDIFAQRARTHEGKLQVELAQLNHLATRLVRGWTHLERQKGGIGLRGPGETQLETDRRLLQIRVTQLKAKLDKVKQTRKQGRAKRQKSDIPTISLVGYTNAGKSTLFNRLTDDNIYAADQLFATLDPTLRRVKWPGVGNVVLADTVGFVRHLPHELVESFHATLEETLEADLLLHVIDAASEDMHAQIEAVNDVLEQIQADAPILLVFNKIDKSGEPAKIHYQDHGVPHRVYVSAKENLGINQLMLAVQELLSGQLNHYTLTLPHHAGALKNTLHELGVIESESFDELGHQILSVQLSPAKLTQLLGQYALNPKQVLPPNEAASLEPALEPFEEVLKQHDDKSDDQLNPFCL

SEQ ID NO: 2098 - protein, 255 aa, M.catarrhalis
FKSFNRSNMPRFFVDTPLTTNLIGQIIALPDHVTHHWCKVLRASVGDCAFLFDGMGGEYTVTLTHIHKKSASVKIDAYHPINRTPPFRASIGLVMSRGDRMDYAIQKATEMGVHCIHLLTSDRCQAHLKYDRDFKKLTHWQSVAVAACEQCGMNIIPNIIAPILLDEWVANCQDELKLVLALSENNPTFNKLVPKNISLLIGAEGGLSPREIDLAIHHGFVPWRIGERVLRTETAPVVALSALTLLAELNHSPLN

SEQ ID NO: 2099 - protein, 647 aa, M.catarrhalis
HNLSYQKQFKNSLLLGLSCATISRIIEILEDSLKHTTKFSAISLGIFILPFVMSLPSYAANVITDTTQIKPNAVSRQDGFVDTKVDQMINPYGLSDKALQSISQSAAWRRLLLFQDTPVEHDNSSIDNPKFFLAQNGRHDAHAELIATLSAMQSGDGDAVCRFVARTHFLTQALATQDIDSGVDDRQCSDFHAFADTLNAKRLSLIFAEEHPNNIASAFAHVLMRVDDGQDEDEAATAINYTVQPNKADGVLVSTAKSIIGGYPGVMEIMPYQKKADDYLVKDERDLWQFSLNLTPKEVTQIVRHIWEVKEMKRPYFFTHDNCATEIVRLIDVVRPEGNIQADIGNIAIPSRIAAILSQAGMVTDQKFIPSNSTIRQAKLNNGENFDIAHLAPNRNSPVHAMPVHRFGFGIGLDTRLSDRAVYGIQLNGAYQDLLDNPQGVRSLLDLQVMSAKLITDGSTLRLEDLTIFSTRSLNPANTAKNNATVKKGVGLAMAFHTGLTRTIDASNKANHHHLVLDMDIKAGKSWNFGQVRQNSGELANTTCYTLVGGGTQIGRVNQGYRLRAGTDIGCIHYANENLRGLMQLSLPYYYHFDNAPSDRSGYFQPALSIGIQADIAPYHAVRLTAQREKLNSDYATQAMLSVQRYF

SEQ ID NO: 2100 - protein, 182 aa, M.catarrhalis
ANSSLGFISMTKALYPYTLKPIALNMSETEFYAAQLSLFEKGTSHFTLKSLKRTEWIVIALMVVAAIAGLVFVSGYSTIIFWLMLILVGVYLLARTLGMKWYMKREYEKQVASTQMPEQLRTLQLGVQSHGLVMAMPTSTDLMKSPQMRGMQMRAGATQSATIPWHTVSSWDETDDYLFMMV

SEQ ID NO: 2101 - protein, 445 aa, M.catarrhalis
ILLFIILARQAPFGAFLCLIGFDMLDPKFLRGNLEELKAKLAVRGYDLDVAFWQEVENQRKSIQVKTEALQAKKNAGAKKVGELKRHGEDTSELMNQMQLVSEAMKAAENELKELQNTITTAALQIPNLPDDSVPVGSDETDNVEVRRWGVPREFDFAIKDHTDIGESLGQLDFELAAKLTGARFSVLKGHLAKLNRALVQFMLDTHTQKYGYTEMYVPYMVNSDSLQGTGQLPKFEEDLFKLRGEKEYYLIPTSEVPLTNSVRDTILSPKDLPIKLTAHTPCFRSEAGSAGRDTRGLIRQHQFEKVEMVQVTRADSSMQALEDMTAQAEYVLQALELPYRVMTLCTGDMGFSAVKTYDIEVWLPSQNMYREISSCSNCGDFQARRMSARLKDGKHSELVHTLNGSGLAVGRTLLAILENHQNADGTITIPKALQPYMGGLEVIA

SEQ ID NO: 2102 - protein, 66 aa, M.catarrhalis
QIFPQNLSQFQIKAVKNQKILTNINFGFIFLDKMGNIGKFIVRIYLNDQSTLSLYAKAHRFKHERN

SEQ ID NO: 2103 - protein, 81 aa, M.catarrhalis
QHLPMCLTCTMCKRSWDSDDVRPHLSEPLSKGRESDIKANHHANIDRLPMNDARLTDQSAAMLKCLTFIIVACAVINSCTK

SEQ ID NO: 2104 - protein, 78 aa, M.catarrhalis
VSKLCKPLVVADTRCIDTKFNLRQSKVPKKIPNDDQMPVSDRHWVLLLSHSLPNFASIFVMILYKAISYYLDNPNKYR

SEQ ID NO: 2105 - protein, 148 aa, M.catarrhalis
LKITSYFSCRYFTYSSEWIIWARKYSKIPHYFNYDLMKKLNGDKQAKDVWRLPAVGSWEKTQGKHPTQKPLGLLSRIILSSTQKGDLILDPFSGSGTTGIAATILGRQFIGIDKELEFLELSKRRYQAITPKSKYEFKQKIREQISLV

SEQ ID NO: 2106 - protein, 147 aa, M.catarrhalis
SLWFNRFNATKTLMLINMPPPHHVYVNFISVTQMLNHIFDTLTAEDKSTLNAHLTSKLEALNLPLNIVEVFYDARNLPCPMPLLKAKVTLRHVTDNQALYLIATDQNSQKDLVTYCNKNALIVHTWHSHDLTNETPIYHFIIIKPAN

SEQ ID NO: 2107 - protein, 246 aa, M.catarrhalis
KINTDLPKFYIDKNLAISTLKSHPTIYLFNEFITVMKLLKKLKSLLKRADAKRSNKNAQSITEHQSDTKQPITDHIIQYLKRHGWQYEARSNDGTITPQIHHLIILFSYTKYQWSCVFRINETSQLVSIFGILPEVVPDSHFAMMLMAIAKANLSIPFGSIELDPTDGEVHAKVSLDAEFTPLSDNALGVHLQGVVSLTELAQRLYDDVLYEADPSPIVTDYLQHPTDAHTKDLLDQYFEPTDQYQ

SEQ ID NO: 2108 - protein, 85 aa, M.catarrhalis
RRRLSFWRLKWCIYSHQVLPMTPKSLTLPAKLLRLTLPYLLFVSMTAFFGSILQSYGRFAAPAFAPVLLNLCMIGACINIRAGGW

SEQ ID NO: 2109 - protein, 134 aa, M.catarrhalis
CVMTALYMFLAAVCILGPLVALHEFGHYIVARLCGVKVQTYSIGFGPKLLAWTSKRSGIRYQIAAIPLGGYVKMLDSRQESVADELKSVAFNHQHPLKKIAIVAAGPVMNFLIAIGLFWVLFLLASEQLNPRNG

SEQ ID NO: 2110 - protein, 189 aa, M.catarrhalis
NSQTAYTAFALNYSRKITMSTPVSQPVATQIDPTLDLEKIRYECQSLAKSRAKVSAGAAVIPLPFLDVAVDVAMLTKLLPEITERFGLKDKANLDTSTEEARKQNIKDRIVSVGGLIAARGVVNKTIQGFGGRFIGKQISKFIPLGGSMVAASLGYMIFKKIAFDHIEECYNIAKQSQRQETSSQDFNA

SEQ ID NO: 2111 - protein, 342 aa, M.catarrhalis
LARALILGQVGGKPIMALGYAVAISGILQLLIQLPQLWQQKLLIPLSISFKDEGVRRILKLMLPAIFGVSVTQINLLLSTVFASLMIAGSVSWMYAAERLSELPLGLIGVAIGTVILPSLSSSRAKSDDENFRQTLDWAARLILVIGIPASLAIFVLSDILMDALFVRGQFTHQDALMSGIALKSLSGGILGFMLIKIFAPAFFANQDTKTPVKIGIISVFANMIFSVVFIGLFYLMKLPLHGGLALATTAASFVNAGLLYAVLHRRGIYRFGTHWKKMIRQFVIANIAMVISLSVILPLYPIDANHWLKIAILLGICGFGAIIYGITLLITGFRPSQLKHG

SEQ ID NO: 2112 - protein, 259 aa, M.catarrhalis
GVYFSICKGRRRCTDDQPSGDKSDKSATEFGGICVMMTHPFLTMITREWQIKRQGTVQWLYPLVLFLLIITLFPLAIGNEPKLLLRLAPSAVWIAALLALVIGVDDLFRSEFDNGTLAQMVVAKSPLIIWVLARLLVHWLFSAGVVAILSLLVIVLFEIPFGEAGILMVSIFVGSPILLGLSAIASSLTLTLKNGAVLVPLIALPMQLPVLIFATGAVDLYATGLNGLPTLALLAAGSIITVLVTPWVVASVLKMAWAD

SEQ ID NO: 2113 - protein, 116 aa, M.catarrhalis
VTRAVSRSGEAGGGVEAVVSFFNLVYSRVYMYGTLLYFQSTRLTMSPNALKDLINSIQLTVTEDRFCEEYTTKYKLPQEALNDKVENALKEHFLNNNYKQVEIENGALILKHPSID

SEQ ID NO: 2114 - protein, 113 aa, M.catarrhalis
VLNLAVFTLDTHLNPPLYINPTPKGHTMPATERINIRTTPHAKALIEKASQCLGVSVSSFMAQSAYEKALSLEQSETIYLNQDEWQKALAMLDDEPSDEINALLARGYRVIGR

SEQ ID NO: 2115 - protein, 67 aa, M.catarrhalis
TMKQVTLNGQPTESDHSTVFELLNAHGLTQGRFAVEIDEMLVPKSRLTLTELKDGMSIEVVQAVGGG

SEQ ID NO: 2116 - protein, 155 aa, M.catarrhalis
VYIKMAKSRLFRSTVIVSSMTMLSRILGLIRDMVLMSVFGAGGLMDAFLVAFKIPNFLRRLFAEGAFSQAFVPVLTEYKEARTLTEVQLLIARVSGVLSLVLLVLTEAVIFLAPQVVYLFAPGFADDPQKFDSTSQAVTLDFTLFIIRLHDGIFW

SEQ ID NO: 2117 - protein, 88 aa, M.catarrhalis
SKSNNPLNLGEYSMGKNQHVVPHKDGWAVQGEGNSKPTRVTSTQKEAIQIAQDIARNQQSDTKIHGRDGKIRAGNSYGNDPFPPKDTK

SEQ ID NO: 2118 - protein, 296 aa, M.catarrhalis
SALKLITLCKDVLVMWQRIKTAIILVLIVGFALFASSMPIFVLPLLAIGVLIAAHEWTKLMPKCRQPVQFILAVLIITMLSVALPWTWVFWWAVSLGIWVMATAWVAQYPNKERWYGRRLVYMGAVILTAAITAMYGLWQMSPWWLMYVFLLVWCADSGAYFIGRKFGKRKMAPNVSPNKSIEGLCGGLMVSGVVTVAVGYYLQLSGMSLVLFLILSWLTVLASILGDLFESMLKRRAGIKDSGTILPGHGGILDRIDSLLSAIPIFALGFWLLLKLGIFTEVWIKMYFATMQVPF

SEQ ID NO: 2119 - protein, 302 aa, M.catarrhalis
AMLKIAYSPLFCHRLPVSHRFPMAKYDLIPKKLLTDGIITQDNLFHPELLSEQEILSTHTADYWHKLKTGTLTDKEIRKIGLPMSASLIKRERYITHATYECALYAKKYGISLSVSGGTHHGFADHGEGFCVFNDVCVASNLLLARGQAKRILSVDLDVHQGNGNASIMANNPAVFVFSMHGKKNYPFIKPPSDLDIELDDGTDDNAYLTILGKTLPKIIREFDPDMLFYQAGVDVLATDKLGKLSLSLQGCYERDKLVLTTAHKAGIPVAVVMGGGYSPDIETVVAAHCGVFGVAVGLMAS

SEQ ID NO: 2120 - protein, 493 aa, M.catarrhalis
IGIKMSVKIGFKPMPLVIAIALSVTILLIPTPEGVTDQAWNLLALFVGVIAAIIGKAMPIGALSILAITLVAVTGITVADGGSANDAMKDALSSFANPLIWLIGVSIMISRGLLKTGLGARIGYIFIAIFGKKTLGIGYSLAFSELILAPVTPSNTARGGAIMHPIMRAIADSFDSSPSKNTQDTIGKYLALVNYHSNPISSAMFITATAPNPLVVNLIAETLGSEFRLSWSQWAWAMLIPGLVAFALMPLVLYFVSPPKIKNTPNAVTFAKAKLSDMGTMSRDEIIMLAIFAVLLLCWAGVPNLLFNFPINATATAFIGLSLLLLSGVLTWEDVTAEKGAWDTIVWFAALIMMATFLNKLGLITWFSSSLETHIASLGLSGLSAGLLLLIAYMYAHYMFASTTAHITAMFGAFLSAGVALGVPPMLFALLMAAASSIMMTLTHYATGTSPVIFGSGYTTLPEWWKAGFVMSVVNIIVFTLIGGLWWKVLGYW

SEQ ID NO: 2121 - protein, 314 aa, M.catarrhalis
SCTKPSHITLTIQTNIDKLIQNNLKNQGNIMTIRIATIQLNSQTDIDANLGIINNAISEAAACDAKFIVLPENACVMGRQSQLATRYDEICQFYQSLAKTYGVHLLAGTLPCPTRPDGSDVPCDLVRQVSLLIDDQGNIKARYDKIHLFRATIDDSTGNYDEGKTFEHGSRLVCEPCVIHGQTINVGMMICFDVRFPAFAQRLRQMGADIITVPAAFTHRTGQAHWQMLLQARALDSQCLIIGSAQGGIHQIGNSIRQTWGHSMIVNAHGQIIADSGRTEVADNGYCIAYADYDADRQAKIRAAMPIFDCHHLA

SEQ ID NO: 2122 - protein, 261 aa, M.catarrhalis
KTMNLYFDKNLANEYSSKAQIARVLTENWVLNNSYCPKCGNLPLSEFENNRPVADFYCQNCLEEFELKSKNGRLPNVITDGAYATMIERINANNSPNFFFLTYDKQWRVNDFLIIPKQFFTPSIIIKRKPLSPNARRAGWVGCNIDISNVVDFGKIFLVKNSQIINQNLVQEHFNNTLFIRTKNIESRGWILDIMMCIDSISKDTFNLKDIYDFEEILKIKYPNNNFIKDKIRQQLQILRDKGLIEFVARGRYKKVKYANL

SEQ ID NO: 2123 - protein, 73 aa, M.catarrhalis
FNANAVYAVWLFYICVILIVTFYDNYKKLQVIFFVCFVLLMSMVRQGIMYNDSRIYNDSSAMLKLTWAKTSDE

SEQ ID NO: 2124 - protein, 216 aa, M.catarrhalis
TVFDMINYAKIILSSVKSVYLMCSASVIQHGILQGATFIKSDNFNARPADKTGLITGIVIRNISLPPSQFGQVNADGVHHVKAFFQNQLNPDDHVYFQGIHTLKVSAHLFIERNGSVTQFVNFNDRAWHAGQSAYLGRQNCNDFTIGIELEGADDIPFEAVQYQALGQIIVAIYDAYPATRRHLMGHSDIAPHRKTDPGKYFDWQKLRTLVAQMMI

SEQ ID NO: 2125 - protein, 258 aa, M.catarrhalis
TISDKAMLIGWVIWRFIIALFDRVVVKLGVNLYTTVKPIIFIIDTNHAMTTVTKPIDTDNKPILTIDKLDVQRGDFVLCQEVQLTLEMGDVCHLIGENGLGKTTLMSQIAGLLPIIHGTCVCAGAMVYVSHQLGISAALTVAQNLRFLLSLYGVDADDTLIDEALWQVGLEGLQDISSVQLSAGQMRRVGLARLFVLTPNEASFWLLDEPLTALDTTMVQRLEACILAFAKAGGAVLMTSHQATKATNRQLNLAEFAL

SEQ ID NO: 2126 - protein, 154 aa, M.catarrhalis
IKGFIGLICCISICCIILHNHHQIEGFMTVKINWLLVAALNLAIGVAFGAFGAHGLKHIADEYALQIWQTATLYLFIHALGLLVIGVLQHIGRYRSALAGVLLQMGIVIFSGTLYTMALGAPRWLGAITPIGGGLLIIGWLVFALQIAKTTRLA

SEQ ID NO: 2127 - protein, 93 aa, M.catarrhalis
THFWQGAIVLSVVKFDKSFDRESFDCGVAVLNDFLKIRASQYIKRYEAVVYCAFDDQTQKIAGFTPCPIPPFAKLMTLFFSKNSTQPLRLVAC

SEQ ID NO: 2128 - protein, 397 aa, M.catarrhalis
LKDWILANFWKIAYNSIKILRIYRDKMAPKRTQDNGDDYDHNHEGYDDTYDDEFDEDLIEALDGFHEIDDEEYAEIIDDIDDDIDKPKVSATPKAYSTPSGTDAIATHDLVPAMPTHLAAPGVNLGAYINTVHQIPILTPEEERALAERYYHDGDVEAARLLVMSHLRFVIHIARSYSGYGLSQADLIQEGNLGLMKAVKRFDPNKGVRLVSFAVHWIKAEIHEFVIKNWRIVKVATTKAHRKLFFNLRSLKKSSNQLTLDEATAIANDLNVTVKQVLEMESRLTSYDASFEAQDSDDDEGRYAPQLFLEDAVNPADVVEEADWEENTTTALKDAMETLDERSRDIITQRWLADQKSTLHELAATYNISAERVRQIEKNAMNKIKEAITLDRMIIDE

SEQ ID NO: 2129 - protein, 95 aa, M.catarrhalis
TTKSLQMNELDTVVDWMLIRLNQDTCLYQDDVIDYLIKANLEHLTAENAEGNQVLRDKVLAVFKQKTLDDVVWVQRGLYWRFRVLEDEPSRMARW

SEQ ID NO: 2130 - protein, 347 aa, M.catarrhalis
  UNSURE (40),(47),(62): Identity of amino acid sequences at the above locations are unknown.
LPLGYFGCYFYWPVSSLTPEMGKIIDNSPAATTGLVVGDXIISIDSXSVNTWQQTAYALASXMGESTTIHIGVNRDGQVLQKTAKVLHFMQTKDSRQPNDPLSSLGILPYQPIISPVVGEVLSDGAGALMGLKTGDVFTAIHGEPINDWLSATKIIQANPETMLDVTVMRQGKQVDLKLMPRGVKTQNGVVGQLGIRPQIDTDTLIPDEYRMTIQYGVGEAFTQAIRRTYDLSIMTLDAMGKMITGLIGIENLSGPIAIADISKTSFELGFQEVLSTAAIISLSLAVLNLLPIPVLDGGHLVFYTYEWVMGESMNEAVQMTAFKAGALLLFCFMLLAISNDIMRFFG

SEQ ID NO: 2131 - protein, 256 aa, M.catarrhalis
FCKGEISHFNQLGGCMSDKNPQFSRILLKLSGEALAGGRDMGIDANILDQMSLSIAHLRGLGVQVGIVVGGGNLYRGSTLQKQGLVGRVTGDQMGMLATVMNGLAMRDALVRRNIKTRLMSAIAIDTVVESYSSRDAIRHLNNGEVCIFVAGTGNPFFTTDTAACLRGIEIEAGLILKATKVDGVYDKDPTTDDDAVKFDSLSFDEVLEKKLGVMDLTAIALCREHNVPLQVFDMNKPNALLNVVMGEAEGTRVYH

SEQ ID NO: 2132 - protein, 187 aa, M.catarrhalis
GNFMINEIKTDGESRMQKSIEALEAAFSKLRTGRAHPGILSGVMVSYYGSDTPLNQVASINVEDSRTLLVQPFERSMVQAVDKAIREADLGLNPMTADVIRVPMPALTEETRRDMQKIARNDAEQTRISVRNIRRDMLSDIKDLLKDKEISEDDERRAADDIQKLTDKFIATIDSRLEKKESELMEV

SEQ ID NO: 2133 - protein, 272 aa, M.catarrhalis
GVFFIHVIHLFRLDLKLNDGNCNTMTTQICESLPIIPKHIAIIMDGNNRFGKSKQLATGAGHVAGKDALDPIVEHCLALGVEVLTVFAFSSENWARPKDEVDLLMRLLSQTIYEQLPRMNQHRIRLRFIGDRSQIDGDLVKLMAQAEAKTADFDAMTLVIAISYGGQWDITNAAKKLAKQVELGHLSADDIDIQMIKTQLELADLPSVDMLIRTGGEYRISNFLLWQTAYAELFFTPTLWPEFGCDELDEMIRIFAGRERRFGMTSEQIQKT

SEQ ID NO: 2134 - protein, 204 aa, M.catarrhalis
SMFILTIQLVWVKMGPTHQPVEQIANLRMTPNHYVWRPCDTVETAVAWKMALKTKTAPSSLILSRQNLAFQSRSDEQIQNIEKGGYILAPEKGTLKAIIIATGSEVELAMQAYEQLEGVRVVSMPCAEIFVKQDSGYIESVLPSDVRVRVAVEAAITDYWYKFVGLDGKVVGMTTFGESAPAKVLFEHFGITTQAVVDAVNSLL

SEQ ID NO: 2135 - protein, 299 aa, M.catarrhalis
TAIMQLKRCYQYKGIFKMANYLMIGQGNIGKPLAIRLAKAHTVKTVARRLHEYGTLAKYIHFLQKDAKTLTLDDVKDTTHLAIIITPSNIGRASTLDYQKSYLAVCQHIVGLANQSCEWQQKLKQVLFVSSTSVYGQNQGEWIDETAPALPITDTAQILKDAEDLLWQTFGKRAIIVRAGGIYHKNSIRLIEQARQAHLVGIPRHHYTNRIMDSDLVNCLYQILVSDCPKSLYLATDNTPVTSFEVLEYIAKSLNYPSVTPIFDPPSGKRIIANINTNWLSYPNYQIGYDAVIAHLIRS

SEQ ID NO: 2136 - protein, 497 aa, M.catarrhalis
KYDIMKQILLGTLLMPIELNQRHNANAIRILTMDAVQQANSGHPGAPMGMADIAEVLWREFLRHNPKNAKWVNRDRFVLSNGHGSMLLYALLHLTGYDLSIDDLKNFRQLHSKTAGHPEYGYADGIETTTGPLGQGIANAVGFALAEKTLAAQFNKPDNAIIDHFTYAFLGDGCLMEGISHEACSLAGTLGLGKLIAYYDDNGISIDGEVEGWFSDDTAKRFEAYGWQVLKIDGHDADAIRDATNQAKAESAKPTLIICKTIIGLGSPNKQGKEISHGAPLGLDEIALTRTQMGWADTTPFIITDEMYRAWDATAKGSTDEAAWNKQFAEYQDKYPKEAAELLRRFSGDLPENFDQLADEFIQTCVQKAESIATRKASQNAIAALAPHLPEILGGSADLAGSNLTLWSGAKGVQEYADGNYVHYGVREFGMTAIANGVALHGVFIPYTAPFLMFMEYARNAVRMSSLMKQRVINVYTHDSIGLGEDGPNAPACRADC

SEQ ID NO: 2137 - protein, 989 aa, M.catarrhalis
LNVIFYYKSSESYPMSIDNLSTNYNPVNIEQKWYKIWEQQGYFKPQPNPAMSDKQNAFSIALPPPNVTGSLHMGHGFNNTIMDTLTRYHRMMGHNTLWQPGTDHAGIATQMVVERQLGLQGISRHDLGREKFIDKIWAWKEQSGNTITRQIRRLGSSVDWSRERFTMDDGLSQAVKEVFVWLYDEGLIYRGKRLVNWDPKLHTALSDLEVESVEEQGSLWHFRYHFADQSLTTQDGKNYLVVATTRPETLLGDSAVAVHPDDERYAHLIGKTIVLPISGREVPIVADDYVEKDFGTGCVKITPAHDFNDHELGKRHELPLINIFDEDACIKAEFDLIAKVGEPISNHITAPADYAGLERFAARKKLIEQAQNENWLEKIEPYTLKAPRGDRSGTVIEPLLTDQWYVAIETLAKPAIEAVQNGDIQFVPQQYTNMYMAWMRDIQDWCISRQLWWGHRIPAWYDDNGNVYVGRDESEVRAKYSLADTPLRQDDDVLDTWFSSALWTFSTLDWTGQTSFDDYGDALQTFHPTSVLVTGFDIIFFWVARMIMMTMHFIKDKDGKPQVPFKTVYVHGLVRDSQGQKMSKSKGNVLDPIDLIDGIDLENLVNKRTQGLMNPKEADNIAKQTRQEFPDGIPAFGTDALRFTYASLASTGRDINFDLKRIEGYRNFCNKIWNATRFVLMNCIDKDGRPQNIDKSANPKLWQLPEHWIISRLNATINDIHEHISQYRFDLMSQAIYEFIWNEYCDWYVEFAKSSLNASEQDSTVSDERKAQIRYVLLFVLEMAMKMTHPIMPYLTEEIWQTITPLLGKTGKSIMLSTYPKCDDSKINEQAESDMAWLQSLIGAVRNIRGEMKLGNAVRLPVLIQGVSDEQKASLVRIDNQFKTLAKVDSLTIVKTGEEVPLSSSGMVGQMKVLVPMKGLIDPTAELNRLNKVRDKLQTQADAINKKMSNDNFIAKAPAQVVEAERAKLSELQGQLAEVEKQVGALKQL

SEQ ID NO: 2138 - protein, 110 aa, M.catarrhalis; identical to SEQ ID NO: 1984

SEQ ID NO: 2139 - protein, 435 aa, M.catarrhalis
GLLIIFINQIKNVIKINLRIIMADTLQSLAILGATGSIGDSTLAIIRQHPNRYRIHALTGFSRVDKLLALAMEFHPVKICTSPDNYAQLSQKVTDAGLDTIILSGDEGLIEIASDEAVDTVVAAIVGAAGLSSTLAAAGAGKRILLANKESLVMAGDLVIKTAKKHGATILPIDSEHNAIYQCLPAAIQADNTAIHHTSYGIKKLWLTASGGSFLDKSIKQMQNASVKEAVNHPNWSMGQKISIDSATMMNKGLELIEACHLFDLKEHQIQVVIHPNSVVHSLVEYVDGSFLAQLGTPDMKTPIAHALAYPERIKSGVMPLDLYQLGSLKFLAPDLDKFACLKLARYAARLGTGACIALNTANEIAVEAFLAEKICLTDIAVIVKACLDDKTIAQDYSQDFGDEVLGLERILTMDKKVRKIATAKIKLLKQGDVL

SEQ ID NO: 2140 - protein, 93 aa, M.catarrhalis
LVSMMKMMGLTVVYKLTPNFTTTLSNKAMINRHITQPINIALSLMVYKYTKVDSHFMIQYKFIYQAYISVKNLSCLVVFMIFWLLVCDFYSSI

SEQ ID NO: 2141 - protein, 81 aa, M.catarrhalis
LIMINNRKVMKPFIKWAGGKNSLLDKIQKRLPDFVYSQDFCLVEPFVGGGAVSLWALSDLPHLKQLIINDYNADLINVYPH

SEQ ID NO: 2142 - protein, 76 aa, M.catarrhalis
PIRIYHLIDFCINEAILSANSVWLDLSGISDDIGSIRWQTHHKWQYKDAQRYGAKFGGMLQTIFQNLNNTAYCSTA

SEQ ID NO: 2143 - protein, 63 aa, M.catarrhalis
NRQVRGKINPGDFQGKSGLKIWVYNNPVKQAKVGANILCAKKKARQDRAQSKQFMPNFLKIIF

SEQ ID NO: 2144 - protein, 98 aa, M.catarrhalis
KLPLPRLGFGWALGWVAFLLLSGQCNPSLLNFYKNLKNRTGEGCWALEHHFAGGIYPKINPPMLIRAWKKFAFGPQGNTGSRIFIRGKNPQSNGNIAL

SEQ ID NO: 2145 - protein, 164 aa, M.catarrhalis
SYLLNLSPSIHRIIRIVIMLNQPIPLKNRARRVMPFFGLSMGISIFALGLLVILPFLMMILTTLQMSFDDIMQTIREPQVFAAIKLSLSMAMLATLTNLIFGTLAAWVLVRYEFWGKSFLNALVDLPFALPTAVTGIALATLYAPNGLFGQWFTHLGILLLMSP

SEQ ID NO: 2146 - protein, 271 aa, M.catarrhalis
SQCYKLDGIFMTETTVKNFDDLPLSEPILKAVQALKFDQLTPIQAQILPHTLANQDAIGQAQTGTGKTATFLITIIESLLKRPFQADEIRYLGEPRALVLAPTRELAQQILADCRELTRFSQLYNLCITGGSDFDKQLEQLHKRPLDILIGTPGRIIDWVNKGELFLDRVEVFVLDEADRMLDMGFIPDIKRIVRHMPSNTERQSLLFSATFNQDVMNLAYRWLHQPAFVEIAPESKTNQAIDQQFYLVTEREKTSALKQILADDSVKKTI

SEQ ID NO: 2147 - protein, 155 aa, M.catarrhalis
SKINYKEMTMMMKNKWMRGLAILVLSLPTVTYAKTAAPKASEAPEVSLTQEEQMAIDFCDFSAYGVMHIAGDHQGGATKSEALTNHDKRMAELKDLIDLDPETATMLDKYWKGAIDRIFQESVQKTDAEKQAFVMGVGESSFYSCLDQVLKTPKN

SEQ ID NO: 2148 - protein, 510 aa, M.catarrhalis
SVKAFWMLDVKLCFELFCNMLQWSNFLNLTFEHSMGFLSNFFSNLGASLWMLVGSERAFRLTKPTFAQAVAFMVVALAANILFAWLAAPNDSYFNEQGLISYLVWPTIIVAAGIIIAQRSLNYALLFVPAILWLAADTLLVLFQSGIQFLENESLLPFWLHSILPTLFLLLFVWQTAALLLIFAKRFNWPWYETVLMLIASIVLLVVWQKNTINQPIFKMDEVLVELDELVFYEQAAQLPKQLQAMKAGRKGRHEWYFLGAASYSEQDVFASEIIQARQLFDVKFDTAGRSIALINNPSTWGEYPIATRTSIERSLEHIGGLMNPDEDALFLVLSSHGSVDEHGEPIGELAVTNPPMNLRQIDPFWLKSALDKSGIRWSVIDVSACYSGTFINALKDPYTMIITASKADKASFGCTDDADMTYFGRAFFNESLPRSDGVMTAFYDALPKIKEREILMGFEPSEPQLVIGEAMQLALPELQKALFHHQDNPNISIPYGLIDKVTDTKSVLN

SEQ ID NO: 2149 - protein, 269 aa, M.catarrhalis
SVWQRNALSLFMSNFISNQYYRTKAAFGLTNTLLNGFQMLYESKAYRSDVPRNRLMPYVKKFCQKMANSFGVTVIQIEPVPQRHGLWVSNHVSWLDIPVVGSVAPVFFLSKAEIGKWPIFGRLAKAGGTLFIQRGSGDVGSVSDQIAEFLSEGSSVIFFPEATTTDGKQIKKIYGKLLKAAIDTNLPICPMVIAYVDKEGGLSDKAAYYGKRTMVQSLKSVADARGITAYVLPLEPIYPEGRDHRELTEVLQAVMQKGLTDLHGRVLAA

SEQ ID NO: 2150 - protein, 62 aa, M.catarrhalis
  UNSURE (46): Identity of amino acid sequences at the above locations are unknown.
KNRKNYAHQPQFIPAVQEIAMTIEKLIDIILNLQNLKVFERFCEPXRIISFRVNLEKEPRAG

SEQ ID NO: 2151 - protein, 288 aa, M.catarrhalis
KNYLRTIGGENQCLGPRTPGFNGVQLAILVKEPALFVARRNKARVIWIILGMPKITVYGPERKSMVLRKKEPGATAYQEAGHALVAELLPGRAPVHKVTIMPGGWALGVTWQLPEQDAISNYKDKMLNEISILFGGRIAEEIFVNRKSTGASNDFERATKLARAMVTRYGMSDELGVMVYEAEEHGGYFGGSTRTISEATQQKVDDEIRHILEAQYGVAYQLIDENHDKMHAMVEALMKWETIDREQLLQIMAGETPREPKNYQHIVQTPVAAEEPADDDALPPPLPV

SEQ ID NO: 2152 - protein, 679 aa, M.catarrhalis
HLLEKIFIIPILISENEIKYLIKYSLQLLCYRKKIMTNPTAHHFEAEVSQLLHLVTHSLYSNADIFVRELVSNASDACDKLRFLATSDDGLYENDGELAIRIDIDNTAKTITFSDNGIGMNEEDAIEHLGTIAKSGTKAFLDKLADSDKKDGHLIGQFGVGFYSGFIVADKIVVESRKAGESADKGVRWVSDGTGQFTTESIHKPNRGTSITLYLKDEYAGGGESETNYLNDQHIKSLVNKYSDHISLPIQMHKQIWQDELGEDGEPTGKGEYITTDDYETVNQANALWTKSPSDISDDEYHEFYKNLSYDYAKPLAYTHNRVEGRVQYTQLLFIPSKAPMDLYAREQQHGLKLYVKRVFIMEDAEQLLPMYLRFVKGVIDTADLPLNVSREILQESRDVKAIREGNARRVLTLLSSLANSEDADKQQKFADFYQEFGDVLKEGLGEDQTNQERIAKLLRYATSTDDKIATGFGDYKARMKDGQKAIYYLTADNLAAAKNSPQLELFKKKGIEVILMTARVDEWAMNFLHEFDGTPLQNIAKGAVDLGELTDENEKQEAKQAEEKMQPVVEKLKTTLGKRTKDVRVSSRLVDSPACLVVGEGELTPQMAQMLKAMGQSVPEIKPVLEINPNHPLIDKLQNSHDFDDLAQVIFDQALLADGGQLDDPAGYLKRVNKLLMG

SEQ ID NO: 2153 - protein, 791 aa, M.catarrhalis
QAKEFMSKNTFSASFIAILSKVILGVLALFAILILAFPIGFYGMVMYLEPTLPDVKNLDNSRFEMPLQIYTADNKLIGQYGNRYSLPVTFDEIPERMIQAFLAAEDDTFFEHSGISVKGMGRALTEVISDNDAQTGGSTITMQVAKNYFLSPERTINRKLTELFIARKIENELTKNEILTLYVNKIYLGEGTYGIQAAARRYYSKNLESLTIAQMAMIAGLPKAPSAYNPVVNPERAMERRNWIIGRMHQEGFITASEKDAAIAEPMGLNIYQEKLDLNMPYVAEMVRSTLVDRYGEAVMDSGWRVQTTINSSSQLAANAALVGGLRDYDRRHGWRGVEAESGSLEGRKNFDHIYPAKVTKVHNQSFEAKLQSGETVTIGWSGMNWARRYYDANRVGGGYSNAHQMVKVGNIVRISPINEAKTAWRMESIPKVQGALVSLDPENGALRAVVGGFHFNHSKFNRAIQGYRQPGSIIKPFIFAAALESGQYTPDSLISDAAIRVGRWQPKNADGRYTGDMTLRRALTLSRNTPAIRLLRSAGVDESRHLMNAMGGLEIERMPSTLALALGAADATPLQMATGFATIINGGHRIQPYFIERIYNFDNETIYQANPQQACALCFNENLSATNAKLLELFEANKSEISTDTPSAPAGDRLQPRSAPQYVAATQAPRVLSHQTAYDISNMMREVITSGTGRRARALGRSDVGGKTGTTNLAKDAWFAGFHPTNVAVVWVGFDTPSTLGNSEYGGVAALPIWVNFMSHELRNTPSQWISQEDRSKAVKATQQVIDLKD

SEQ ID NO: 2154 - protein, 584 aa, M.catarrhalis
HKNPNNDLLILQFGWFMLISLTFENLALIEQKHIDFDDRFNVITGETGAGKSLILDALSLCVGERADSSMVRHGCDEASVFGEFDISGNAQVIAWFEQHDRKLEDETLLIRRKISNQGRSKSWINGVPASISELKSLGSMLVNIHSQHAGLELLKPQFIVDWLDRIGGFGDLKAAAKTAFHHYQTLKRQADDARSQSAQRADRMALLSAKLTDIEPLLLVDFQEIEAEYDELSNLESLMREALEAAVQLDNDDDAPSVLSLLGRAMRICDNNAQSSKTFGECSQLLVLAQEQIIDAVAKLTDYAERELPDAARLDELNGLLSLAHRLSSKYHTPITELIADAVHWQDELDMLSSLPDNDTMDAKVLEAYQAYLVAADALDQARIQIAPDVCERLEARLVPLALPNARCQFSFNEKPVEHYTAQGKYDIALLFSANVGMPLQPLHKVASGGELSRMALTMQVMAADDGIGAHPTLVFDEVDVGISGGTAQVVGELLRTLGKQQQLLAITHQAQVAAAAHHHILVYKEHGEHTKSQIQVITDEAQIDELARMSGGVNITEATRAHVKSLLADIRHADKMAQRGMAT

SEQ ID NO: 2155 - protein, 65 aa, M.catarrhalis
AFQAINGPGPFTQNKTIPGLCSKVGLGRVGSSFRVESAGFAQKLDSPSGVEAFSLPPTNTASQSP

SEQ ID NO: 2156 - protein, 194 aa, M.catarrhalis
YRIYHRDNKIMALLPILTYPDPRLRTLAKPVTVFDDRLKQLIEDMFETMYDARGIGLAATQVDRHIQLIVMDLARKDEPPSPQVFINPKVTPLVDEHSSYQEGCLSVPEVFDTIERPSRVRIEALDKDGQPFEIEAEGLLAVCIQHEMDHLNGKLFVDYLSTLKQSRARDKVKKALKAREKTVNSTTDNTLKNS

SEQ ID NO: 2157 - protein, 285 aa, M.catarrhalis
DKTKQTELKFGYIMTQSAKNKSAKPAYHEKSDAARIVITGMGALTPIGNSLDTIWQNLTQGVSGISRLDGFEDKSVAIDGFRAQIAGLVKNFDAKDYLNPKEARRFDTFVHYAQVAAAMALYHAGLIDDIKGDSLPINVDGERFGVVMGSGIGGIQTIETSRDTLKSYGAKKVSPFIIPGAIINMPAGLIAIRHHLKGANLATTTACTTSTHAIGLGARLIAYGDCDAVLVGGSEKASTPLGLSSFWANPALSTRNDEPTRPSPTFEQRPGMVLFWVNGPGPLMA

SEQ ID NO: 2158 - protein, 90 aa, M.catarrhalis
ILSKNQSNKTTMAMINHTLDTKGLICPEPVMLLHKIIRQALGGEHIEILATDPATMRDIPNFCRYLGHTLVNQETLDDGSYRYLVQKKQA

SEQ ID NO: 2159 - protein, 167 aa, M.catarrhalis
VHYNNWICLMTSETLTLALDYGVKKMGMALGNSITHNARPFDILAMNNGQPDWDNLLGIIEHWGIDRVLVGLPLNMDGTESMLTKRAHKFARRLAHRLGERRQAVSVFIYDERLSSKEAKMIALDNGWIASSSEPIDDIAACLLLDSYYHAPNHAIYVSERKDSHKD

SEQ ID NO: 2160 - protein, 193 aa, M.catarrhalis
DGSKRYGYMTQTQKLIHHFLIPSPQMTDERFMDAVIYICRHTKDGAWGFIINQSLPNSVGGLLTELEVPVTASTMQVPAMNGGPVRPEAGFILHTGQPIYKSSFAISENVCLTTSKDILERLSYDGLRHYLLCMGYCNWGRGQLDAEMAFGDWYACPADLPTLFSTPFEDRLKACYDKIGINLNKFITTTGYA

SEQ ID NO: 2161 - protein, 308 aa, M.catarrhalis
AMAKSTIPRADSAVIYDDDPEYLSEFRAAMLARGLSIATRNAYSQDVRLCIRLSDTPVNLWQPSDVRNHLMCLKDAKKSERSIARALASLCQFFLWQIESGYREDNPCESIKTPKLGKTLPKTLSEQEVSSLLDAPDISSVRGLRDKAMLEVLYACGLRVSELTSLSLEHLNLTAGWLSVTGKGNKMRLIPLGEYALSALNEYLAVRGSLLIGKKDCQAVFLTEQGGYMTRHNFWHLIKKYALMAGINTAISPHTLRHAFATHLVNHGADLRSVQLLLGHSDLSTTQIYTHVATTRLQNLHAKHHPRG

SEQ ID NO: 2162 - protein, 102 aa, M.catarrhalis
KCMKNPFHLTPTPRTCPHGDCGKMFCDAIYKHGIIFCLHCQKSLLVNPFTPDLQQMTFWQFVKDFTKRYYKIYVVCTGMPILIYTAIFAFDGLDKFNLTTGF

SEQ ID NO: 2163 - protein, 169 aa, M.catarrhalis
TKRLSQRLILSGKAMQHHTLIAHQFDQAIRQATLSVRFGFGAIVCFCIFGTLASLPAFKDSTWIYYAFHYLPYALIAMTMPISLYHGFLLMRYRVMDGSILAVILATGIALLGFTVVWGLSIGIDTVFFMALFLAMIAWFGMPFLFRVNLKKFASFLEEKSSKSPQEPI

SEQ ID NO: 2164 - protein, 361 aa, M.catarrhalis
DCRGLLMSIHTTVARRPSWRGIFAGLLMGLVVSMIMLALALVLSSFLSLDLRGAGIAAGVYAAVTALISAFVAGFFAVKASAPEALFGDGTDILPKDAALTGMLTAAAIVVISSVFAFNSVTGIVRTAGNAVGTTAGAIGGAASAVTSTVTTVAGAGATAAAGSSDAAGGDITAKAQELYQKATGNISRQDIEAWVAKNNETFDEAQISATVNVLEDMLNKTKADLNGMDFTNLDTWKNIDEYAKQRADEVQAIVTGDELIARLQAEGLTQEQALEVREETATAYHEYRASTEQAIADAKMNIEQTLQSAEDTARKAALYSGLFWLISTLLTFVASIMGAKTAAANYRLASPITVRERDLR

SEQ ID NO: 2165 - protein, 211 aa, M.catarrhalis
GVVMTKVALLDYGVGNLYSVANALKVAGADVITTDRADDIKKADKILLPGVGAMRDAMAHMAKHGIDIAVKEALNTKPVMAICVGMQAMFDVSEEGDVPCLGIISGTVRRFDDAWIQNDEPIKIPHVGWNRVDTDTDHMLWQGCNHEYFYFTHSYYCDPTPNNQLILAHTTYGQKFCSSIIWDNLFITQFHPEKSHHAGLKLLSNFITWQP

SEQ ID NO: 2166 - protein, 206 aa, M.catarrhalis
LRKIMKLIYLHGLDSDSNAIKAQITQNYCQANYPNIEVIRPDLNRTPDEVVKLLKSLIIDDRNTVLIGSSLGGYFANLLSDLTGVPAVLLNPSIWPDISFRRFLDQNFDERALSDETVIYTTAGGWQITYGDLAWFERHRLAVKNPDLIKVLLKMGDELLDAQVTQAFYDQKGVQVLAQAGGDHRISDYEVQVATVIDWAIRLHQR

SEQ ID NO: 2167 - protein, 637 aa, M.catarrhalis
PIFLSIIFMSTYNSQKLEVLEGLEPVRRRPGMYTDTMRPNHLAQEVIDNSVDEALAGFARHIIVILHKDGSLSVEDDGRGMPTDIHPEFNQSGVELILTRLHAGGKFSTENYQVSGGLHGVGISVVNALSTRVEVTVWRDGLMHTMAFEHGEPVTALIADKSANKKKRGTKVQFWVDGQYFDTPKFSIKTLKHNLKAKAVLAAGLHIDFISEIEPNDSESWQFTDGVVQYLTEQLDGSDTLPKEPFYVSQEPTLGERGGATFALSWLAEGGTPITESYVNLIPTAQGGTHVNGLRTGVLEALREFCDIHNLLPRQIKLSGEDVWDGVNYILSLKFVEPQFSGQTKERLSSREAAPLVQTLAKDAFSLWLNQHPDHAKAIAELAISKATKRLATAQKVARKKVTQGPALPGKLWDCRGGLKEGSELFLVEGQSAGGSAKQARDNAFQAILPLRGKILNAWEVSSDTVLSSQEIHDIAIAIGVDPASDDLSELRYDKICILADADSDGLHIATLICALFVKHFPALIEAGHLYVAVPPLYRIDAGKDVYYALDNEELEQVLARLGNKKTQITRFKGLGEMNPSQLKETTMNPDTRKLIRLDLDDTASTNSIMDMLLAKKRSADRKQWLETKGDLADISV

SEQ ID NO: 2168 - protein, 222 aa, M.catarrhalis
SRLLAILGFYARIAVNYYPSYFSRIIMTRFSSVTRNTAETQISVNINLDGSGQGVLDTGVPFLDHMLDQIKRHGLIDLDVKCVGDTHIDDHHSVEDVGIAIGQALKQALGDKKGIRRYGHFYAPLDESLSRVVVDISGRPGLHMNVPFTRSHIGSMDVDLFSEFFYGLVNHAFITLHIDTLKGKNSHHQIESVFKALARALRMAVEYDERAKDQLPSTKNML

SEQ ID NO: 2169 - protein, 134 aa, M.catarrhalis
PKILSKIKNKPLLKGVDNYDDIKNDFNISVAHDKLATSFDTHAPYCPHCQSQRFHNTADDDYVCQKCHTKSSLNPKLKKTNTIQFASIYTILFLIMRYVSFDFYLFIYILAVFVIFLISLSINYYWYKTPKWLP

SEQ ID NO: 2170 - protein, 72 aa, M.catarrhalis
HISLSKIRWCRLMQIGWYSFFLILDLGMILYGIFDTHNHHLLYCEIFEIGNVDNMVHVYQKRLLVYHGQQRC

SEQ ID NO: 2171 - protein, 78 aa, M.catarrhalis
DSHPLPHAEYANPAYKSRTITKDNQHGFYDMEHKQPDNLVQVYAHAQNDALERHHTAVSKAKLKNGQKNAPLNVNNCW

SEQ ID NO: 2172 - protein, 304 aa, M.catarrhalis
IKKFTHQPIVIRVKMIMNTITHAIIPTAGFGTRMLPLSKAVPKELLPLGDKPAIHYVVMEAVRAGIKTIVLVNHAQKQAIENYFDINTELDSQLRQKGKDGLADGLNFLPKDVRIVSVRQGYPLGLGHAVLQGRAVVGDNPFVVLLPDVVLDPFMTDFRADNLAYMMTRFAQTGRSQILVEPVADSQVHKYGIARLKDRQSVQKSDANHPFDVLGFVEKPSLDLAPSNLAVVGRYVFSPEIFEYLAKTKPSVGGEIQLTDAIDALISQQGMDVVTIKGASFDAGDMTSYIQAFAYFASQVDQSF

SEQ ID NO: 2173 - protein, 330 aa, M.catarrhalis
IQLTNNVAPRPGNLFWNGSPIFWANLSQRAPFGGQSLVWGLSTNPSRLIVMKAGAMSKYRIVSWRMLPRVIFVAKSLGVNHFVFPPANKHAATIRADTIYDKLITIDGYWSVNHDGDNQDVVYISYADNEGGFGEVKRYQLKDGQLIAALKAKSGVYLPQSDDVMNAQKARYTWQLSGIDEIGIGTSQVQQAHSEGKILTLPIAPTDVYLLTKEPEDLSLSSLYAHRQLMAHQGTRSLRHELAFWQKLLSPFAVLSLVLVASSFVFGSLRSQGLALRVVLALLTGLLFSYLTDLTGFVALATGLSPLLMALVPIVLSAMAGMYLLNRKSS

SEQ ID NO: 2174 - protein, 178 aa, M.catarrhalis
CIYFKEIMMRFLLVGCLATLFLLGCSNNSSQELETNTIEQSSPRITIKNEMIEAQPLPETGATNKPNLYGDSPLQIKTNSGSHYWVKIVNAYDEREELVSYFIRGGETLDVTLPAGSYVVKYAYGDTWYGEEYLFGENTGYSKADEVFEFYHNQGYVIELIQQLNGNLHTTIIDESQF

SEQ ID NO: 2175 - protein, 112 aa, M.catarrhalis
IMLAIAWACINIFHVRCPCVCHKSNQKYYDIPALSITHKPHLCHMPQTGQRHMAWAVRVDNNKVDKVSLDQVFINYPYLVWDLDLASYTPQMNFDTSSPIVSGTILFQLLDE

SEQ ID NO: 2176 - protein, 310 aa, M.catarrhalis
APEAVKTQITDLLNTLHLKRIGDDVFEGPSFDYVGPRVFGGQVLAQALLAGANTLTIDKPCHSLHGYFLRGGDIRLPVIYQVRRLRDGRSLSAREVIAVQYVPTTDKNGNHTTNEQVIFSMIASFSPMEGGLDYQETMPDYPPPESLKTEQELKADYLHKIPEPLKARFMRQRHVEIRPVTPRDPVTPKPERPHQANWVRIADIGEQPVAIHQALLAFVSDYYLVSTGLMSHGLSLMTQGLQMASIDHSIHFHRPFDMTEYLLYDMWSDTSSHAKGLNHGQFWQDGKLIASTQQEGLMRLHDDPSIFTSS

SEQ ID NO: 2177 - protein, 137 aa, M.catarrhalis
MALAANWMSTGVSSNGKETYEVDYDSISAYHFNSYDKNSYYVTAWVKLDYPTAQKLKDGRLYRQTKGLLYVDCLGKRVTWGDTVFYDSKGNVVDSGRNYVNTYSSSNWNRMVPDTIGEDVSKFICGVYDAKSKSQTK

SEQ ID NO: 2178 - protein, 60 aa, M.catarrhalis
YSFYNLSTSLLYNVITSIYIQRSLALLLHTEETREERQQIGRPFRPGEDIIGGTALPTCT

SEQ ID NO: 2179 - protein, 75 aa, M.catarrhalis
DTFYASGLHPKLFTQETLKTVEQMTLKKASYSNLTVNFRQVLVQKYTIVQEVCTNLSTIILAHTVKQCFRQISCW

SEQ ID NO: 2180 - protein, 376 aa, M.catarrhalis
QGWYIIVFLIAFMTNTGTTDMKNIDTSPSNSEHYLPKKILVTGGAGYIGSHTLIELIQAGFVPVVYDNLSNSSFVAVQRVEQIVGKHIEFIQGDVLDKTHLDAVFKAHQFFAVVHFAGLKAVGESTKNPLKYYQNNVVGTLSLLELMAKYGVKNCVFSSSATVYGSSNRLPITEDMPRFCTSPYGQSKLMVEHILEDLVNADDTWNVVCLRYFNPIGAHESGRIGEDPTDIPNNLMPYISQVAVGNLKQLSVFGNDYETPDGTGVRDYIHVVDLAKGHVAALHYLVGQSVGIGFCPINLGTGQGTSVLQLIKAFESNTGQSVPYVITSRRTGDIAAYYASADKAKAILNWTAELDIERMCVDTWRWQSNNPHGYLS

SEQ ID NO: 2181 - protein, 321 aa, M.catarrhalis
LFNQINFGRQIMTTQTQHTPKRDYRQRFFIDGSVVRGDVVKLTDAYQTVITQKDYPVALKALLGEMLVSASLLISTLKIDGKLSIQLQSSDSDARLNWAMAECDHTGSVRALAGFDDTNQNQTVWQHLKSADEAFGELGKGVLFISIHPDNGEAYQGIVERVSDSLGECLAHYQRQSAQIPTIIKLATNETTAGGILVQLLPQSDADKEADPDLWDRLTALTDTLKTDELTDLDANEILYRLYHEEDVVLPSLTPLQFACTCSSQKSEGAILQLGYDEAKQAAAAQGGVLTLDCGFCGREYRFDDQALAQLFADGLSNHHK

SEQ ID NO: 2182 - protein, 619 aa, M.catarrhalis
SETKERLMCGIVGAIRTHHNVVDFLTDGLKRLEYRGYDSSGIAVQTESGIRRVRRVGRVALMEEAAKQKQIHGLTGIGHTRWATHGGVTKPNAHPHISAGLISVVHNGIIENFETERTRLQHLDYEFESQTDTEVIAHSVHQEYTTNGGDLYHAVQTACSRFHGAYAIAVIANDAPNQMVIARMGCPLLVAFGDNEVFVASDVSAVIAFTRRVTYLEDGDIALLQADGIQKLLDKDGNQVNRSIKTSEMSLASLELGPYSHFMQKEINEQPRAVSDTAEIFLEGGFVADNFGEEAPEIFAKIQSIKILACGTSYYAALTGKHYLESIAKIRCDVEIASEYRYRDVISDPDELVITISQSGETLDTMEALKYAMAQGHRYSLSICNVMESALPRTSTLAIFTRAGAEIGVASTKAFTTQLVVLFGLAVTLGILRGHVDESQAQDYAEDLRLLPGSIQHALNLEPQLASWAQSFANKPSALFLGRGIHYPIALEGALKLKELTYIHAESYPAGELKHGPLALVDENMPVVVISPNDGLLDKVKANMQEVSARGGELFVLSDLDSDYTASEGVHIIRTPRHIGTLSPIVHTIPVQLLAYHVALVKGTDVDKPRNLAKSVTVE

SEQ ID NO: 2183 - protein, 423 aa, M.catarrhalis
SMNNNAYVIGHQHEAINTCLWLASMNQTVYLLADELSVLQTLEYYQCDHQMNTLWQLYCVQQKIIITDSQRQAFLSSAQAGLLWLFLDDVDDITLSHIIHVLDSPHSRIILSGVQKLGKIDKIAKQFKSSWVYYLPISFMKDGANYNAFYHSDLVMIGEKTAGSVAYCQILLSLKTYAKHCQVADILTVEFARSTLMAILATRLSFMNEMARLADNQGVNIKSVERIIAQDGRIGSAYLSAGWGFGGKTLPRELELLMDKFKQNRVDTSLISAVSHINDDQKELIFRKFWQYFNGFIEHKTVMIWGAGYRNGASRMINSAIHPLIELLWSYGICTLVFAHNTAFEMQSTYGDHPLLRLTDDPYQDLVQADALFIINWSLLTKPDIHVLNQINIAIFDAKNVLDDEQIAMLTAPYYGIGREKYS

SEQ ID NO: 2184 - protein, 860 aa, M.catarrhalis
FMQKLVNLFKKSGSQPSALPKPPQNSQDHGNERTPSPYRRASTKGLSLVVKPALLGEIPKIDDKVPTFYVIRSYSRSNSLLVGMQTEALGLPAALAEVHAEQIHETSAMIFLKDRRTKSTNRHVPRLKRLIQACLDNPELKINLVPVTILWGRAPDKEESLFRLLMADEWESPSKAKQLFNIGVMGRDTFIHFSQAKDLQTLIAQTQASGEDGMTIAIAQRLQGYLDKQRTSIVGPDLSDKRNVAGEILSSPKVVKAIEEQAATSGKSIAAVKAEAQGYLGEITSNYSHSVVRFFDHFLTWLWTRLYDGVQVRHFERVRTLAPDYQVVYVPCHRSHVDYLLLSYVIYKRGLRIPHVAAGENLNIPILGELLRSGGAFFMRRSFKGNTLYSTVFKEYVHSLMQRQAPIEYFIEGGRSRTGRLLPPKLGMLAMTVNSHLRKPAKPVVFIPAYISYERIMEGATYVGELKGKPKESENLLGLLKTARKIERIFGTVHLSFGSPLYLTDFMEKFQVNACDDSDENTKKVHAMVQNLGVKVMQNINKAAVVNPVSLLALALLSTPNAALDEAQCLEQIRLYQHIAQALPYDDDTHVTDMTPRQILNYGVKLKLIERTPHILGDMIRVADKQVPLLSYFKNNILHVFIIASLLAALVQRNGRISHQKLDGITELLYPFLQSELFLKISLKNIIEKVHQVLKLLIEQEVIVELGQGIVGSPEGNSQAYQKLIVLASPAQQSLERYFMALTLLSKQGSDRLTTEQVVTLCHVVGQRVSVLHADDLPDMFDKALFTSFIDTLVRMGYISINTETNLLSFDERIDRIAEFAKFVLQPDMMQVLTHTASLSSDELGLAMASMEKKRKFGIR

SEQ ID NO: 2185 - protein, 375 aa, M.catarrhalis
  UNSURE (357),(367),(368): Identity of amino acid sequences at the above locations are unknown.
LLRKESRMSLFIDTKNIPNQITITNKNSLKVISLFSGCGGMDLGFIGNFNSLGNFYPKQPFEIIFANDIFEKACQTYQHNFNHNIICQDISTIDDGDIPKADIVIGGFPCQDFSLAGKRKGLDSERGKLYLQMKRVIKIANPKAFVAENVDGIRKAKGLSKNDASALDVIIKDFSQIGYNVVYQVLNASHYGVAQNRVRVIIVGIRKDIDKKMKYPKPLFGELSDSQKPVITSKQAIDDLWELLDDNINSHSKNHYSKAKFYPNKKLQGNCQINADKPAPTIRAEHHGNIEAHYRSTNKKSPYDMQYWRRLTVRECARLQSFPDDFIFPTSASSSYVQVGNAVPPIMSSPGLKGRPXCCLSSRVSSXXSSNASER

SEQ ID NO: 2186 - protein, 393 aa, M.catarrhalis
IVWDVDQMHKMYPTSILLCAVVLSGCDAVKQTITDKPTLSDAQITKLIPKRVNNAKLWATDIGDIFDELSLPKTAQNICTAIAVIDQESNFHADPSVPNLGNAALKAIDDKLEDKLGKNMAGVFRNMLETRPTPKNNFIKQIKAVKTEKQLDELYREIFDYFTRTYKIAPLTNITKLSGQGIDERINPVTTLGSMQVHIDYARAHRRASMSDRDLRADLYTRYGGLYYGIHRLMVYQANYDKPLYRFADYNSGMYSSRNAAFQQRIATLSGESLAIDGDLLLYKDGSPISKISSTETAAIALLATASKPINAQQIRSDFKKEKTRDFEKTITYRAVNDMFASKFGREPTYAIMPKVVISGPKLSRDFDTNWFATRVNERYQTCITTAKRHRLS

SEQ ID NO: 2187 - protein, 573 aa, M.catarrhalis
YDKLYSGICLFCQSSRSVVLIFSKTKKQGRLMNTWHDLKRLAHSPINLQHYFTADSNRGQKFSATACDIYMDFSKQAIDDESLLKLIQLADACELSQKIKALLAGEKVNDTEQRAALHTALRLPKGESLIVDGVDVGEQVHDSLDKCEALVHRIRSGIWRGYSGKAIRDVVNIGVGGSDLGPLMATTALSEWADTDIHVHFVSNMDGTQLESLLKKLNPQTTLFIISSKSFGTVDTLSNAKTALSWLLAAYAHKPTILRRHFIGISTRPDKMSDWGIHPDNQLLLWDWVGGRFSMWSAIGLAIAVRIGMANFRALLAGAHEMDKHFAQADFYKNLPVLLGLIGVWNATFLGINAHTVLPYDGRLSHFPNYLTQLEMESNGKSVKRTGESVNYRTCPILWGDIGSNAQHAFYQLLHQGTQRVSCDFITPIHRYNDTQIINNSLVYQHKLSLANCLAQSQVLAFGNAALPHGVANAADDLAKFKKYRGNQPSTTLLLGDLNPKTLGALIALYEHKVYVMSVLWQINPFDQWGVEVGKVMANRVYDELISKTNTDCFDHSTNTLLSVIKQSRIINE

SEQ ID NO: 2188 - protein, 71 aa, M.catarrhalis
NYIMSLNYNNLWKLLIDKDLKRTDLINLADISSNVLARMGKNEPVSLESLEKICIALDCSIQDVLTIEKGE

SEQ ID NO: 2189 - protein, 171 aa, M.catarrhalis
YKSVDQEAMDALMKIEEFRSLNDDIEVVINRSEKIKGLKEKAKDNDGELSKEDKKTLSDEEKEQKSLRKQIQEKLIKFATRIPIFMYLSDYREHSLKDVITVLEPELFTRVTGLTQADFSLLVSLNVFDEAVMNDAVYKFKRYEDASLEYAGIDKKEGYVGLYNTQIKRQW

SEQ ID NO: 2190 - protein, 88 aa, M.catarrhalis
NQKFWRVMYDNDKKLTTIVGVLYTVSYIAIWLVSGYILWGWIGVTGFTRAILWLIAWMIVGTIADRILIPIILTVVVGLFSIFFEKRR

SEQ ID NO: 2191 - protein, 67 aa, M.catarrhalis
KKRSQAMGEKNTRPAGVGIIQKVRPFEKLSTQGQSINSRSIFAFGQCEEGIVSRPLGEKCALRPLRN

SEQ ID NO: 2192 - protein, 214 aa, M.catarrhalis
YNSPILFDISIMPNASHLVSTSPSQPTVAKPMVRLVAIIYDGMLILAMLFLVGSILAVLGTVLFLEIGTSSQEAQTLPDWYKNAIMTPSFVLTLVGFYGIFWRKSGQTLGMQTWRLKTVNDQGGLLTWRQSFVRIISACLLPALCALLGALLHGSKFAILVATVLGFLFNFLFCLFNRQGLAVHDMLSNTITLKVPKIAHQTLWQTIKRRKNRL

SEQ ID NO: 2193 - protein, 521 aa, M.catarrhalis
YFNQYILLKMITCARLVIKRRLTMQSVETGVWISLAVYFILMIAIGIYAYFKQKNDIEGYMLGGRNLSPAVTALSAGASDMSGWLLLGLPGYMYASGVVSIWIALGLTIGACANYLIVAPRLRVYTELADNAVTLPDYFSNRFHDKSHLLRIMSAVVIILFFTVYTAASLVAGGKLFESSLNLSYSMGLWVTAGVVVAYTLFGGFLAVSLTDFVQGVIMLIAMLIVPVVAFGEIGGVSEAMAIATQTNTEVFNWMNGVTVMGVISLMAWGFGYFGQPHIIVRFMAIRSVKDVPTAMVIGMGWMILSLIGALMVGLAGIAYVARTGIELKDPETIFLVFSQVLFHPLISGFLLAAILAAIMSTISSQLLVVSSSLTRDIYKLFLDKQASEARQVLIGRISVVLVAIIAIMLAGDSNSSVLNLVSHAWAGFGAAFGPLVILSLMWKRMNRNGALAGMIVGALTVIIWVYGGFEIGGQPANDAIYSILPGFAFSLVTTIAVSLMTAPPPVYIVQKFEDMEKGLK

SEQ ID NO: 2194 - protein, 479 aa, M.catarrhalis
FMLNHPKRIVMTTPNPYAHRTAQHFDGIRYDEALIQKYNRQGPRYTSYPTALEFMPIEQGVEAQILVNRNPAIPLSLYIHIPFCHHLCYYCGCNKIITKKNSDAGDYLTYLFAEIRHKKSLLRGKTWVKQLHLGGGTPTFLSDDELITLWDFLHEEFLFADEGDFSIEIDPRELRPNTLKILKDLGFNRLSFGVQDLDKKVQIAVNRVQSLELIQNVMQEAQALGFSSTNIDLIYGLPHQTPASMNATIEQIIKLSPDRLSVFNYAHLPERFFAQKRILEADLPSPTDKLTMFGNIITSLGDAGYQYIGIDHFAKPDDAMAIAQRQGKLHRNFQGYAILGECDLLGFGVSAISQIGKHILQNPTALVDYQATVLADTLPAIKHIQSDDKDALRRHVIMNLLCHDYMSFEDLHARFDIDAKEYFANEIKNLQDMQTDGLVQIDEDGITILPKGRILGRSIAMVFDEYLGKKHTNRFSKVI

SEQ ID NO: 2195 - protein, 98 aa, M.catarrhalis
TIIWRLVMKKGFWSSLFGNQCGPNSADIATDRLKVIDASHDRLNTRLTADRIEQMKREILAVVNKYVNGVNIDDLNINHRHEDNLDMLEMNISLPDRK

SEQ ID NO: 2196 - protein, 193 aa, M.catarrhalis
VSKMGIKLIVGLGNPGVQYQQTRHNAGFWFVEQLADKFGIRLIFDKKFHGQVGRGTIHNQEVRLLLPETFMNRSGQSVAPFTKFYGIHPESILIAHDELDIPVGSIKLKTGGGHGGHNGLKDIVPHIGADFHRLRIGIGRPMHSSQVSGHVLSKPSADDRISITSAIDCAVASIHEIILGDMERARNQINGFR

SEQ ID NO: 2197 - protein, 60 aa, M.catarrhalis
FKKVLDIQNNHCIIAATTKDIQNISVELAPVAQLDRALGYELRGREFESLRVCHMIKITE

SEQ ID NO: 2198 - protein, 234 aa, M.catarrhalis
HLTFIYPKGSFMSQFTLNGVARAESQQGKGASRRLRKDNLVPAIIYGGNDEAVAICVKTNEIVKALSNESFFSSVITINLDGAEHEVIIKALQRHPSKGFPLHIDFQRIVRGQTMNFNVPVNIINEDSSVGKKEGGILTILVNDIEVNCLPRNLPEAIEVDVANLAIGDSIHLSDVTLPNEVTLVTHDEADLNRTIATMQPPAVIETADDAEASTEETTEAEVAPADAEETTEE

SEQ ID NO: 2199 - protein, 72 aa, M.catarrhalis
PMPSVKVKENEPVDIAIRRFKRACEKAGVLADVRKKEFFEKPTQERKRKKAAAVKRYKKKVYREQVRHQRKY

SEQ ID NO: 2200 - protein, 455 aa, M.catarrhalis
FKYPLMITIKKGLDLPITGEPSKQISEHTPTKVALVGYDYVGMRPTMHVKEGDKVTKGQVLYEDKKRAGVLYTAPVGGTVVAVNRGERRVFESLVIAVDPNASEEITFNAYRSEDLSMLDRKTVVEQLVASGEWTALRTRPFSRTPEINSIPSAIFVTATDTNPLAVDPATVLFEEIQAFNDGLAILSTLSPKTYVCHGDIVPETLSKTADGNDTIYEGFTGVHPAGNAGTHIHFLHPLARGSLVWTINYQDVIAIGKLFTTGRIYTERLISLAGPAVANPRLVRTTRGADLTELTQGELNGDDNRVISGSVLSGRTAVGATAFLGRFHNQVSVLTEGRERPALHFFTPGANRFSKLPIYISQFFKGKKYDFTTSTNGSPRAMVPIGLFETVMPQDYLPTQLLRALIVEDIISAVELGALELDEEDLALCTFVSPGKYEFGDILRDNLTRIEQEG

SEQ ID NO: 2201 - protein, 174 aa, M.catarrhalis
PIKPSNRLNINEEIRAKEVRLVKEDGEQMGVVDIQTALKAALDVNLDLVEIVADAKPPVCKIMDYKRYLYEQKQKAKEAKKNQKQTQVREIKLRPGTEEADYQVKLRKIVEFLENKDKVKISIRFRGREMAHQEIGKAQLDRIIEDTAEIAIVEQAPKVEGRQMGMLLGPAKKK

SEQ ID NO: 2202 - protein, 211 aa, M.catarrhalis
RLITRRRSLMGHYVSLFITSVFIENMALAFFLGMCTFLAVSKKVSTAIGLGVAVIAVMAICVPLNNLLYQFLLKDGALAWAGYPNVDLSFLGLLSYIALIAATVQILEMFLDKFVPSLYNALGVFLPLITVNCAIMGGVLFMVERDYNFGESIVYGIGSGLGWALAISALAGIREKLKYSDVPAPLRGLGITFITVGLMSLGFMSFGGMSL

SEQ ID NO: 2203 - protein, 270 aa, M.catarrhalis
AMSTKNNNVSTAATALILCLVCSVMVSAVAVGLKPKQQENARLDLNKNILMAADMYDPETESADVIAERFADFEIRLVNLQTGQFATEQEIMASGISDVNSYNVSKAARTPSLSTSLTNDIAKIGGKPNFAKVYLAKDANGQLEQIVLPIHGAGLWGPIFGLLTLDKDLNTIKGVNFYQHKETPGLGSRIEEAQWQATWVDKELYNDDGSRKIAVVKSGTARESQIDGISGATLTIRGVNNLLQYWIGEDGYKPFLDNLRAGQADKGEGV

SEQ ID NO: 2204 - protein, 189 aa, M.catarrhalis
KLCALSVFWSVAVNYLAIKKSELSESDFNYLCQKIAEIEQLVMHGDAWHAQAIAEMMGQFGTQMLIQTDHSKTDNSKSDIDWRMMTIKGYCIYQRVFENSELHRIGTHPNFQRQGVATQLMTGLIAEVMHAKCQQLLLEVRSDNTTAITLYQSLGFLRFGVRKNYYRFGNQSIDALIMRLGFEDTNHHV

SEQ ID NO: 2205 - protein, 78 aa, M.catarrhalis
TAVARRAMASLKINFSTMIFPFKIKKDVVDTPLKLFLYSKLTYAKFFANKHGFTNSVLILVIYQAVHGEQSPPLHLGH

SEQ ID NO: 2206 - protein, 557 aa, M.catarrhalis
ISYQNYCYTMSLCFLILNQSIGIKIMTLQSPNDFDQAGKTSHMQRFLKGVEWLGNLLPHPVVLFIWMSVILLGLSAILSAMDVAVIDPRPEGAKGRAEDGMIYVVNLLNGEGLAKIVENLVKNFTGFVPLGTVLVALLGVGIAEYSGMISAALRGMVMNAPKKIVTLVVVFAGIMSNTAAELGYVVLIPLAAMIFHALGRHPLAGLAAAFAGVSGGYSANLLLGTVDPLLSGISQEAARIIDPNYMVGAEANWYFMVVSTFLISALGYLVTEKIVEPSLGKYNPHDADDPTVLDNKIEQLNALEKKGLVWAGVSMLIFCLLLAWTVVPENGILRHPETGLIAGSPFLHGIVVFIFVFFAIPGYIYGKVTGSIKTNQDVVNAMSQAMSSLSMYIVLVFFAAQFTAFFNWSNLGSVMAVSGANFLNEIGLTGPLLLIGFILICALVNLMLGSASAQWAITAPIFIPMLMLTGYAPEMIQAAYRIGDSTTNIITPMMSYFGLIMAVAIRYKKDTGVGTLMAMMLPYSMIFLFGWMLLFYLWVFVFGLPVGPGSATYYHMG

SEQ ID NO: 2207 - protein, 437 aa, M.catarrhalis
YHENHHTIIIPLLYLLIQQMIVGLSTYFIANLAIDIAKNDDFLLNLSGFVLSLIIVYVPAYFATIYLEKSKFDLLNNYVQKFTTTFFGKTVLLNNKELKDQSTVFVSQESKSVIDDMLDFAFDGVALILNLLINILVLGFFLDYDLLVAYAVGFLLVEFFIFYHKNQISKMSKISQKSRIYFIAILNKIWDNVIIFNQYNVGIFNRIYKKNFNRSKKYHIHSQSFNQLISSFGMILFMIPVLGLIVYLFIKHHNDYVFLSLLVATLPRQIQLLQMGQVLVFHQTNFSGIKARFIGLQNSLNMPDIDILSRINFKEIFVNNMPLSDFDLNHLPKNGRMTIKGRNGAGKSSFLLYLKTLLSNRAFYLPVSHDLFFHQNHKKSTGQKLSSQLMQINNNISDIDVIILDEWDANLDGINKSHLDELINELARQRLVVEVRH

SEQ ID NO: 2208 - protein, 201 aa, M.catarrhalis
VSFEYKNNFKGVSTTSFLILNGKIMVEKLIFKDAMARLATAVHIVTTDGDTGRHGFTASAVCSVTDSPPSLLVCMNANARSYEHFIANQILAVNTLSAEQAHLSDVFASPLESKARFEHADWSVLSTGAPVLTDALVSFDCEIQTIQDVGTHSIFICKIIAIRKGENEKRSLVYFDRQYHKIGQPVAIDRQPASPQVQKVD

SEQ ID NO: 2209 - protein, 412 aa, M.catarrhalis
KFLRFTTVSGERGAADAERDIRGFALKFYTEEGNWDMVGNNTPVFFLRDPKKFPDLNKAVKLDPRTNMRSATNNWDFWTLLPEAFHQVTIVMSDRGIPKSYRHMHGFGSHTYSFINADNERFWVKFHFRTQQGIENLTDAEAEMVVGKDRESNQRDLFDAIERGDFPKWTMYVQIMPETDAQTVPYHPFDLTKVWPKGDYPLIEVGEFELNKNPENFFLDVEQSAFAPSNLVPGISVSPDRMLQARLFNYADAQRYRLGVNRNQIPVNAPRCPVYSNQRDGQGRVGDNYGGRPHYEPNSFGQWQDQPHLAEPALKIHGDAKFWDYRENDDDYFSQPRALFELMSDEQKQALFGNTARAMGDAPDFIKYRHIRNCDKCHPDYAMGVAKALGLTVEDAKNARETDPARHLPSFL

SEQ ID NO: 2210 - protein, 71 aa, M.catarrhalis
RHLSGRVLANLLGGLASDWQIQAFFDGNHKRILKLRPKHTSLHQVVINWLDTKFPKNIQSRATDEWRADFV

SEQ ID NO: 2211 - protein, 782 aa, M.catarrhalis
KNIRYKQLGSPAMTQTTKKTKWNDPNADIEASKYQNPIPSRLLILQTVADITNQGKPATQETLAIHFGFLDDEDKFFALTNRLKAMLRDGQLERIDGIHFSIAPLPTILTGQVSCNPKGFGFVILDDMPDLFLHEKQMRLVFDGDTVEAVATEYRGKTEARIIQVIKQSQLEFIGKLSLDDEGYFVQLSGANAHQPITVTAENVQTMNAAVGDDVKVSLIDLPTYQEFATGKITELLTSLNDRELIIETTLYNYGIPHEFSQAALTQASKFDEPTDADFKNRVDLRHLPLITIDGEDSRDFDDAVYAEKRAGGNYRVVVAIADVSHYVTPQSALDQDAYARGTSVYFPHRVIPMLPEALSNGLCSLNPKVDRLCMVADIKLSRAGKVTGYEFYPAIMHSQARLTYNQVNAYFNDPTNETLPDELVRNSAVLKSIDTLHQLYLVLDARRENRGAMAFETAETYIKFDKQGDIIDIVARTRGDAHKLIEEMMLLANTCAANFSLKHELPVLYRNHDKPNDEKSTRLHEYVKSFGLSFPSEAPTHEDYQRIIKATADRPDAISIHSMLLRSMMQANYSPDNIGHFGLAYDEYSHFTSPIRRYPDLMLHRAIKDKVTHQKPATPIYRSLDDAGEQTSLTERRAEEAARDVETWLKCHYMQRHIGDEFNATVTTVTNFGLFVTLDALFIEGLIHISQLGDEYFTYDEREQKLIGERGSRFGLGDGLIIQVAGVNMDLLQIDFCLIEQLNRIDKNGDSQMIPSKPTNDKSDTKNERSKKHRRKSNKSK

SEQ ID NO: 2212 - protein, 225 aa, M.catarrhalis
TKSRSCPTAGTLIHTIHGLKPIETIEHGDLIWSRQEFGTEYGYRPVIATKVTPNQEIYEVVVKHSNNSTETFKTTKEHPFWVEGIGWLKASLLEQGMTLLDKHGLPNVTIISQTKLDRKETVYNFEVDDFHTYHIGEFGVWVHNDGCCGVALSTLESYVEKSARGMGKLHRVNENELTQLILDIGYNKDELLKAKSILEHSIKIRKAEKASQPGGRIRCWSSKKG

SEQ ID NO: 2213 - protein, 415 aa, M.catarrhalis
AGRLTMKFIHNIFDRMEPSFTKGGKYEKYYAVFEMFDTFFRQPSSQTYSASHVRDGVDLKRIMITVWLCTFPAMFWGMYNVGFQALSAIQAMGITPEGWRTIITNMAGYDPNSIWASFVYGAMQFLPIYAVTFAVGILWEIIFAVVRGHEVNEGFFVTSVLFALSLPPDIPLWQVALGITFGVVVAKEVFGGTGKNFLNPALAGRAFLYFSYPAYMSGDAIWTAVDGFSGATPLGLAAIGVSPDQFVDAYGQTITWMDAFLGNMQGSIGEVSTLAILIGMVGLLWTRIASWRVIAGSVIGLVVTALLFNVFGSDKNVMMSLPAHWHLVIGGFMFGAVFMATDPVSAAHTNIGRWCYGLLIGVMTVAVRVANPAFPEGIMLAILFANLFAPLFDYFVTQANIKRQNARRLSHVNQE

SEQ ID NO: 2214 - protein, 61 aa, M.catarrhalis
YPLSLPMTNQIPKMRGLKSIAENQISQNNLIKIIQSLPAVHLGKLNSQSNTPRALTNQKLP

SEQ ID NO: 2215 - protein, 416 aa, M.catarrhalis
IGESIMEFGTAIGGVIMFTIIIMSLVAVILVARSKLVSSGDVTIRINDNPDNDVVTPAGGKLLQTLANEGIFLSSACGGGGTCGQCRCKVTEGGGSILPTEEGHFTQGEIRDNMRLACQVAVKQDMKIEIDPEFFDVQKWECEVISNDNVATFIKELTLKIPEGEVVPFRAGGYVQLEAPSHTVHYKDFDIAKEYHEDWDNFNLWRYTSTVDEPVIRAYSMANYPEEKGIIKFNIRIASPPPRAPEGIPPGKMSSYVFSLKPGDKITVSGPYGEFFAKDTDAEMVFIGGGAGMAPMRSHIFDQLKRLKSTRKISFWYGARSKREMFYVEDYDGLAEEFDNFEWHVALSDPQPEDNWEGYTGFIHNVLYENYLKDHPAPEDCEFYMCGPPVMNAAVISMLKSLGVEDENILLDDFGG

SEQ ID NO: 2216 - protein, 642 aa, M.catarrhalis
GNIMVAITLPDGSIKQFDGNTTVMQVAQSIGAGLAKATVAGRVNGRLVDASDPITTDATVEIITPKDDAGVEIIRHSTAHLLGHAVKQLYPDVKMVIGPVIDDGFYYDIYSERPFTLDDMAKIEARMTELINQDYDVIKKMTPRDEVIKTFLERGETYKLRLVEDMPDETHMGLYHHQEYIDMCRGPHVPNTRFLKAFKLTKMSGAYWRGDAKNEQLQRIYGTAWADKKQLKAYLQRLEEAEKRDHRKIGKALNLFHMQEQAPGMVFWHPNGWTIWQVLEQYMRKVQKDNGYLEIKTPQIVDRSLWEKSGHWDNYGEMMFTTASEKRDYAIKPMNCPCHVQVFNQGLKSYRDLPLRLAEFGSCHRNEPSGSLHGIMRVRGFTQDDAHIFCTNAQIRQEALNFIKLTLDVYKDFGFDHIQMKLSTRPEKRVGADELWDLAEQALADALDNAGLDWELQAGEGAFYGPKIEFSLQDCIGRVWQCGTLQLDFNLPERLDAEFVGESGERERPVMLHRAILGSFERFIGILIEHYAGLFPAWLAPQQVVVMNITDKQADSVGDVVSKLNTKGYRAISDLRNEKIGFKIRERTLERIPFMLILGDKEVESGTVNVRTRTGENLGSMSLDDFIAVLDKAIEKKGRLNL

SEQ ID NO: 2217 - protein, 227 aa, M.catarrhalis
RSIIMADTKSILTTPIFNNNPIALQILGICSALAVTTSVANALVMCIALTLVTAFSSFFISIIRNKIPSSIRIIVQMVIIASLVIVVDQILQAFAYEISRSLSVFVGLIITNCIVMGRAEAFAMSNPPIPSFLDGIGNGLGYSAVLIFVATVREVIGNGSWFGITLLEKITEGGWYIPNGLLLLPPSSFFVIAGFIAIIRLWKKDQQEAAEFIMKPQSKGLSHGGGH

SEQ ID NO: 2218 - protein, 76 aa, M.catarrhalis
NYSLKVILVMQYWECSNADPVLLDQHDGWMYASIIARSKIFYKITYDVSKFILYAHLVIATNKKLCYNPVFYTLLI

SEQ ID NO: 2219 - protein, 252 aa, M.catarrhalis
FDTILRKIQMSMLIIPAIDLKDGQCVRLKQGRMEDDTVFGSDPVAMASQWVAQGARRLHLVDLNGAFDGVPVHKDVVTAIAKAHPQLPIQLGGGVRSLSTIEHYLAAGLDFIIIGTKAVEAPEFVEEACREFAGHIIVGIDAKDGMVATHGWANVTDIKATELAKRFANAGVSSIVYTDIAKDGMMQGVNIEQTVELASFSGLPVIASGGVTNLDDIVALKPYGDYLLGAITGRAIYEGTLNLSVAQALLDA

SEQ ID NO: 2220 - protein, 118 aa, M.catarrhalis
QTLVNEWRQYEESFPNLQQSKIDIVSLECQNSHVPMDLIELIRGKTVMVGAIDVATNQIETPEQVADTLRKALQFVDADKLYPSTNCGMAPLSRTVARGKLNALSEGAAIVRRELLGK

SEQ ID NO: 2221 - protein, 86 aa, M.catarrhalis; identical to SEQ ID NO: 2043

SEQ ID NO: 2222 - protein, 166 aa, M.catarrhalis
IMITLPSLPSKLPLPAKMVNLLRHYGFDFDSIQKAMHRNESQGAVSVGGSTISQQLAKNLFLTSHRSYVRKAEEAIIVVMMETLWSKQRILEVYLNVAEFGEGIYGIEAASRHYFGRSAANLSRDQAALLISLLPNPKYYGKRPNAKRLKNKQRIIMRRMNGVQIP

SEQ ID NO: 2223 - protein, 79 aa, M.catarrhalis
KNQAQLWLRAFLMPTLPKRSSKKAKNAGQSNKSYIKKNYCSLNNIIINKMAKKDEFLAILLICYPLILQSLTNRMLLAY

SEQ ID NO: 2224 - protein, 66 aa, M.catarrhalis
AKDYHAADEWCADSLRLFGYIFASCVMQLSLIFGILIKMLKHSHGSRAASYELVKINNNLILIIKI

SEQ ID NO: 2225 - protein, 123 aa, M.catarrhalis
TWIKLMSVILNDNQPIITSLLDNDLYKFTMLQAMLHQFPQTHGVYRFRCRNNHETAFALGEIKADLEQQLDYLCQLKFTQDELDYLRGLRFIKSDFGDYLEIISLKPPFYYPFQLDENHFFKN

SEQ ID NO: 2226 - protein, 91 aa, M.catarrhalis
LTDEYFSVFRTFFKWILTPLLMLFFSFHMMVMGLLVVWGNLPVQNSAFMLWHKLSRGRVTHIWVDYDHIAKSAKQAAIASEDGKFVAPLWI

SEQ ID NO: 2227 - protein, 68 aa, M.catarrhalis
AFKWVFDLFAMKIIQFAQRADNSGSLTKAKGPKILQKTFALDQLDLQLSIFKKMIFIKLKRVIKRRFE

SEQ ID NO: 2228 - protein, 179 aa, M.catarrhalis
VLQLQHQHNSKALESDYMQIIDGKTSRLFMMATKGAALLQGREEFLDDLGAFAYHFGNAFQMIDDVPDVSGDAAIMGKNLGDDLAEGKPTLPIIKTLEFLEHSNPAMYDKLRIAVQTGKVVDDVQMLIKLVQSSGALDYCKARALEETKNAQHALNNLPNNRYREGLYLLTELASSRLV

SEQ ID NO: 2229 - protein, 191 aa, M.catarrhalis
NELGFYYLIYFMEQIMADFNKILDAGNVDDGIINVVVEIPTGSNHKIEWNRHLACFELDRVEPIAFAKPCNYGFIPQTLDEDGDELDALIITEQPLTTGIFLKAKVIGVMKFVDDGEVDDKVIVVPADDRNNGNAYNSLDDLPPQLIKQLEFHFSHYKDLKKPGSTVVEGFFDANTAKEVIKESQKRWTEQ

SEQ ID NO: 2230 - protein, 374 aa, M.catarrhalis
SDKGSIMAGNTIGQLFTVTTCGESHGTGLMAIVDGVPPGLKLDAKDLQCELDRRKPGTSKFATQRKEEDKVEIISGVFEGHTTGTPIGLLIYNTDQKSKDYGNIANTFRPNHADYTYTMKYGFRDYRGGGRSSARETAMRVAAGAIAKKYLKERLGIVIRGHVTQIGTQKAHALDWNLVNTNPFFCGDKDAIPRFEALVTSLREQGTSCGAKLEIFAENVPVGLGEPVFDRLDADIAHAMMSINAVKAVEIGDGFDVVAQFGHESRDELTPDGFTGNHAGGILGGISSGQRIRVAIALKPTASITTPGKTINLAGEAVDVITKGRHDPCVGVRATPIAEAMLAMVILDHYLRHRAQNADVVPPIEPINKPATSY

SEQ ID NO: 2231 - protein, 162 aa, M.catarrhalis
MIKVDDNCPCGSLKCYTHCCHRYHGGDEFAPTAECLMRSRYSAFVIQNIDYIVQTTLPALQPLLDVAALKAWAEQTWWTYLKIISTTPKIGKRHAQVHFCAYFEELGVQGCHNECSAFVKINENGQNRWYFLDPTLPITLSGKQPCLCGSGEKFKACCGKFL

SEQ ID NO: 2232 - protein, 258 aa, M.catarrhalis
HQPFNKPNRFIMNKITPSSYLDLLALSTDTLTVRLLDNADYQTVHESMLNHTLKRIENKKINQHHADELWIVEHQNVYTLGQASKPEHILYRTDTPIIQTDRGGQVTWHGDGQLVVYWLFDLHRLNFGVRDLVSHAEQAIIDIVAHYLPKTLTVKARRDAPGVYIYNHTGDMLGKIASLGFKIKQGFSYHGIAINLINDLSAFHAINPCGYAGMPMAKLSSFGQFTADDMGVFITQLIKNIARRHAGLVELRTQDTLK

SEQ ID NO: 2233 - protein, 138 aa, M.catarrhalis
PCKFMSNYLSSQTLKALDQLLDDRHALSRLPKETYQHIYAQILATLGVTNKGWYLLGTEGCHLCHNIQAIIEHALAMTAVPIVFRVLDLADSQDEALIDALGVYIPILLTQDQMMLYPFGLMDVMNLLKSSAVKPWIV

SEQ ID NO: 2234 - protein, 745 aa, M.catarrhalis
SLKFNMNHQFRLQALYTSIRQILATFREYAMINTMNDVNQANHADHTNPMTQIDHLFDEKGAFTPKCYINRDLSALRFQLRVLAQAANPNHPLLERMFFLTIFSSNLDEFFEIRVAGLLQKMKQGDQVSSLDGRKPSEILQIISDIAHGAVTQQYQILNDEILPQLAKHEIRYLRRDELNAKQRAWLKDYFVSQVKPVLTPISIDPAHPFPRLVNKSLNFIISLEGKDAFGRDINRAIVPAPRSLPRVIRLPDEITDGKEHHVMLSAVIHEHINELFLGMKVTGCYQFRLTRNADLALADDVDDIAKALEGELDNRRFGHEVRLEVTTNCPQDICDFLLDEFELDKSQLYRVNGPVNLTRLLTSFDRPELKFKPFTPAMPKAFRDIDMSSAGSMFLAISRQDVLVHHPFHTFNPVINLLWQAASDPNVLAIKQTIYRSGVNSEIVQALAAAARSGKEVTAVIELRARFDEASNIAVANMLQEAGAVVVYGIVGYKTHAKMMLIVRRENGKIRRYVHLGTGNYHAGNAKAYTDYGLFTANAEVTEDVAGVFQQLTGMGRPLPSKQILHAPFTLHDTLMRLIDHEIAHVKAGKKGRIIMKFNALTECKIINKLYEASIAGVQIDLIVRSICCLRPQVVGLSENIRVRSIVGRFLEHTRVYYFANGGEERLYCSSADLMDRNLLHRVEVAFPVLDKKIFKKIYEDGLMNYLKDDVQAWELLGDGKWQPLLVSGGTHDAQKTLLEKITL

SEQ ID NO: 2235 - protein, 402 aa, M.catarrhalis
KDASMFEHVTTYAGDPILGLMDKYAQDPRTDIKVNLGVGVYYTEDGQLPVLECVKTAESKITNPPRPRGYLPMDGLPGYRKACQDLLFGKNHPAVLEGRVATIATLGGSGALKVGADFIHEWFPNAKCYVSDPTWANHVGIFEGAGFEVAKYPYYDPKTIGVKFDELCEFFKTLNENDVVLLHPCCHNPTGVDLTREQWNVLLQIVKDKKLIPFMDIAYQGFGDDMDGDAYAIRRAVGLGLTVFVSNSFSKNLSLYGERVGGLSVVAPTKEEADVVLGQLKFTVRRIYSSPAAHGNYVVDAVMNDEALFALWIGEAYEMRDRIRDMRQKLQEALSTKLPERDFSYFTKQRGMFSFTGLTKEQVIRLREEFAVYMVENGRMCVAGLNNSNVEYVASAMAEVLK

SEQ ID NO: 2236 - protein, 260 aa, M.catarrhalis
NMTTMRSHDAIRDFQFTKDSLKDKIILVTGAGDGIGKVAALTYAKCGATVLLLGKTQSKLEVVYDEIEALGLALPAILPMDLERADFAQMQKLAGLIEKEFGHLDGVLHNAAILGALTPLEMYDPITFEQVMRVNMTAVFMLTQSLIPLLRAAQSGSVVFTSSSVGARPRAFWGAYALSKQAVEGMATIFTQETQNMTALRFNCINPGATRTNMRAHAFPGEDPYTLKTPEDIMPVYVYLMTDEASGIKGQVIDCQPKNT

SEQ ID NO: 2237 - protein, 198 aa, M.catarrhalis
HHDYHQISLNLRFLNQSWQIFQSKLHQMGVTVSLFQNFMIILVLILTSSFFSISEIALAGSRKIKLKLLAESGDDRAEKVLKLQENSADFFATSQIGLNAVAILGGSVGESALRPYFSEWIGLVYQGIWLDSIAFFSSFVLVTLLFILYADLIPKRIAMINPERVGFGGHQSDFVDNSCGQALGMDYQYHRRCDFSAF

SEQ ID NO: 2238 - protein, 92 aa, M.catarrhalis
FFSLRLAHLDYHLTVKKHQIFKNLVLGFMTGDLAYLSTSAIALATYSTLELFRPATHIRPFSTIYTANSSRKRITCSLVSPVKLNIPRCLVK

SEQ ID NO: 2239 - protein, 232 aa, M.catarrhalis
RRWDRMGAFKSLHDINPLRLNWIEDRVNDCYGSSLVAKSVVDIGCGGGILAHSMAVRGASVLGIDLGDENLKAAGIHAAKTGIDGLDFRCVAAEELAAEHASGFDVVTCMEMLEHVPDPSAIVQACYDLLKPGGVCVMSTINRNPKSYLFAIIGAEYVLNLVDKGTHDWHKFITPAELDQMAMSVGFQRCDLTGLHYNPITQHYWLSNKNVDVNYMMAFTKPNTQTDTPKHT

SEQ ID NO: 2240 - protein, 308 aa, M.catarrhalis
LILSEWALVVINPILWTIRVVKPLAWIINTIADVTFRLFKFDTARDDSIPFDDISAIVDAGAEAGVLMEQEQHFIENVFELEERTVPSSMTAREDVVYFALSESEESIRQKIADYPYSKFLVCNEHIDQVIGYVDTKDILVRILSEQPIFQLNESTIRNVLIIPDTLTLSELLDKFRASNEKMAVVINEYALVVGLITLSDIMMTVMGDWAAAEPEDLQIIRRDENSWLIDGITPIDDVKHALDINEFPDWDHYETLAGFIMYRLRKIPRPADWVEHEGFKFEVVDIDHYKIDQLLVTRLEQLPKHED

SEQ ID NO: 2241 - protein, 233 aa, M.catarrhalis
GSFMTQPIQAVFFDLDGTLIDTAPDFVRIIQQMCADEGLSAPSEAAIREQVSAGARAIVQLMFAEQLGQICDDDPRLLSRRQAFLDRYEIDVCVDSRVFEGLEVLLEKLEGYRIPWGIVTNKPRYLTENLLDKLNLSSRCGVLVCPDDVKNPKPDPEPLYLACQKIGVEPLACIYIGDHRRDIEAGRSAGMQTAIAGFGYLSAADLASIDTWGADVIMQTPKALTDWVLQQVL

SEQ ID NO: 2242 - protein, 506 aa, M.catarrhalis
GKDMPAHTFQISVKNTLTLKKATKNKPLPIVVVFVNDEGQILGNLGDAQYISRATALIQQSHFKGTLGKSVTDYALDDQASPAISIVGVGKLDKLADNIAKVAVATYDVIKNSQSAAILWGDTICQIHFTQFVTALIGASYRFEHHKTKPKDADTLREIVIISNKDTQTDYDKALVFAQATAAGITTARDVANEAPNVLNPSELAKKAKQLAKDYADTVSVTVLNEKDMKKLGMGCFLAVSQGSDAEGKLAVIEYYGKSKKSDKKAKLDKPFALVGKGLTFDSGGISLKPAAGMEEMKFDMGGAASILGTVRAVAEAGLEIDLVAVLACAENMPSSRSARPGDVVTAMNGTTVEILNTDAEGRLVLCDALCYVQEHYDARIIIDTATLTGACVIALGSVRSGMYSNDEDALFALQAASEYTGDLVWHMPLDDAYDEQINSKIADVQNIGGREAGSVTAACFLQRFIKEGQAWVHLDIAGPAWKSGSTNTASGRPVALLTQYLRSQA

SEQ ID NO: 2243 - protein, 362 aa, M.catarrhalis
GACMASNTRFGLPIWSMLLPLVAWGLFFVGIKTHLLLQILGGVFLIGSVLSAVYHTEVVAHKVGEPFGTIILALAITIIEVALIISLMVTGGDNAAYLPRDTVFAAIMLILNGILGMSLMIGGLKHREQFFGQKSASTALITLVSILVMTLILPNFTTSTTQGTYSSAQLMFVAVASLVLYGSFIMVQTVRHRDYFLAADDDLDHHAQPPSTKITTISFIFLLICLGIVVMLAKSLSPSIEAAVAYMGAPVALVGVIIAAVVLLPEGLAALNAARHNRFQTSLNLALGSALASIGLTIPAVTIVCLIYDIPLVLGLDGKSMVLLGLSTFIVMLSLNQGRTNILYGIVLLVNLSAYVFTIIAP

SEQ ID NO: 2244 - protein, 312 aa, M.catarrhalis
LKGIAVSVTLRQLKAFLLVAEQNSFTKAAETLCLTQSALSGLIKELEQNLGVKLFDRTTRKLHLSDAGMRLLPQARRVLNEMSVLNEKVNNLKSLHQGHVRLAVSQQLSASTMPKFVAKFCDIHPNIQVTLTDCSVDDVVEHIENLEADLGVAPERVHSDDLQAVVLFSSPFYLVLPATHPFAKKDVLRWTDLLNERLITLNGPFIKSLQNELPAQISSRIFNSEFEVNFLSTALGMTRMGLGVTLCLLYAAEWVEQNGLVMRPIADPVVERKFLLYTHKNRSLSPAALAFKEFLEQNAHEFLVSHSKVSGI

SEQ ID NO: 2245 - protein, 98 aa, M.catarrhalis
SVRFYAGCRCCCGHNTKKSLFSTVTPTVAAQSRTTHSQKQETKVGFGVLAGAQYAINPQLSVDAGVEYNYLGKYDKLDTASKLKAHQYGAKVGLRHNF

SEQ ID NO: 2246 - protein, 89 aa, M.catarrhalis
MMLTNKDREAVIAKYQRGENDTGSPEVQVALLTARINDLQDHFKAHKADHHSRRGLIRMVNQRRKLLDYLKGKDLNRYTDLIGSLGLRR

SEQ ID NO: 2247 - protein, 219 aa, M.catarrhalis
LMITMTENFSGLTIALSKGRILDETLPLFAKAGIVPLENINQSRKLIFPTTHPNVRLLILRASDVPTYVEHGAADIGVAGKDVLIEYDAQIYELLDLGIAKCRLMTAGVKGAVLPNRRLRIATKYTNVARNYFASRGEQVDIIKLYGSMELAPLVGLGDLIVDVVDTGNTLRANGLEPLETICQVSSRLIVNPVSYKRKLVQIEPILQILEKAVLEQGA

SEQ ID NO: 2248 - protein, 165 aa, M.catarrhalis
TMVTNTAVSHSPQYDDSEFEYAGFWIRFVACLVDNLIIMIIIAPYWFYNYQQMMAMPADQIPFYSVGDAILYSAGDAILNLVMAAAVVWFWVKKGATPGKMLFGLQVRDAKTGQFISVPRALLRYFSYLISSVILCLGLIWVGFDKKKQGWHDKIAKTVVVKRIR

SEQ ID NO: 2249 - protein, 96 aa, M.catarrhalis
CNYFGWINRPMAMRKPMNAQALIELLRPHFADAHIDAVNEGNKFELLIVDDAFEGKRLVARQQMVYTLVNQYIQNGAMHALTIHALTPAEYTAKKA

SEQ ID NO: 2250 - protein, 525 aa, M.catarrhalis
AKPAVCVLHKLAKRKITMTIIKQDDFIQSIADAFQYISYYHPTDYIEALVEALAREENPAAKDAMTQILVNSRMCAEGHRPICQDTGIATVFLKVGMNVTWDATMSVEDMVNEGVRRAYNHADNTLRASVLTDPAGKRQNTKDNTPAVIHMQIVAGDKVEVTCAAKGGGSENKSKLAMLNPSDDIVDWVLKTIPTMGAGWCPPGILGIGIGGTPEKAALLAKESLMSHIDIHKLKQKADSGAQLSTTEALRLEIYDKVNALGIGAQGLGGLTTVLDVKILDYPTHAASKPVAMIPNCAATRHVEFELDGSGPVELMPPSLDVYPDVTYNPENGKRINVDTLTKEEIANWQTGDVLLLSGKIYTGRDAAHKRMTDMLNNGETLPVDFTNKIIYYVGPVDPVGDEVVGPAGPTTATRMDKFTRQMLEQTGLLGMIGKSERGEAACQAIADNKAVYLMAVGGSAYLVSKAIKNAKVVAFPELGMEAIYEFEVCDMPVTVAVDSSGSSVHATAPKIWQAKIGKIPVVEA

SEQ ID NO: 2251 - protein, 454 aa, M.catarrhalis
PRFNHDKTCIEFVFIKRVSMPTLKILKSQDDNFASQLKDLLAFETVTDSTLIATVNDIIATVREDGDDAVLKLTQEFDKHPAKSMHELFVSADQLKAAFDGLADDVKHALQYAAKRIFEFHQHQVEAGFRFTDHLGNSLGQKVIPLDRVGIYVPGGLASYPSSVLMNAIPAKVAGVGHITMVVPAPNGELNPLVLAAAHLSGVDSVITIGGAQAVAALAYGTDSIAKVDKITGPGNKYVAAAKRAVFGQVGIDMIAGPSEVLVYAEGEPDDNADWLAMDLLSQAEHDTVAQAIFVTTCPSQLDAVKDAIDHALAELPKADIAKQALASRGALILVKNRAEGINIINQVAPEHLELSLNNPEEVEQYVRHAGAIFLGRHTPEAIGDYCAGSNHVLPTSGTARFSSPLGVYDFTKKTSLIYCTPNGAKPLAKTADILAVQENLDAHALSARYRHHD

SEQ ID NO: 2252 - protein, 421 aa, M.catarrhalis
VMDKFKIIGASRIIGEVTISGSKNAALPLLAAMLLPNGETVLHNVPTLKDTATLIELIAGTGVKIYKEGNTVTADASVVTNYYAPYELVRTMRASILVLGPLLARFGEAEVSLPGGCSIGSRPVDQHLKALEAMGATIEVENGYVKARAPAGGRLIGCDFSFDMVTVGGTENIIMAATLALGTTRLENCATEPEVVDLANMLVAMGAKISGIGTTTMVIEGVESLHGCEYSVIADRIETGSYLAGALMSRGDVLVLNTSAEFLHPVLKKFEAMGATITTGHNWIRAVMTTRPKAVDIRTQVHPGFPTDMQAQLMAVCCLAEGTSTIIENIFENRFMHVPELQRMGANIRIDGHTAIVKGVEKFMPAPVMATDLRASMSLVMAAACAEGESVIDRIYHIDRGYDDVENKLRGLGVNIERIKG

SEQ ID NO: 2253 - protein, 61 aa, M.catarrhalis
LSILSAISVNWYRLSQFYKFWKKLSWSRVLKGRVIFFVYDTLVPDSMLGKIYLEQSHIIFC

SEQ ID NO: 2254 - protein, 275 aa, M.catarrhalis
IKINQAIRSFTIRYIPVIWKHSMMKKLLIVLTSMAMIGLTACVSNGTQSVGADAMGRTIPERISDSSIELTARRNLATIPGVSPNTVRIDIASFRREVLLTGEVPSEQIKIEVGRTIDSMRDVEKVFNYLTVVETPKSQSHTLHENYLRSKINTRLLTNRHLKSSQYKVVVRDRTAYVLGYLTSEQQGYILEAIQATPGMEAAVTLTTLVSVQELESYTNHEVNTQAYTNDDGYDAMVAKPDTQEDSGYILQEIYTPNASNVAPANTAPVFEISQ

SEQ ID NO: 2255 - protein, 149 aa, M.catarrhalis
NCQNCCGKTHSLMGRQLNNKTIKRKQGDVFEQLAVDKLKQAGYEIILTNFTTPFVGEIDIIARQPLEQSHRLVQPRFCTVFVEVRSRTSSVYGTALESVTSKKQAKIYRTAERFLINYPKYIDDAYRFDVMVFDLVDGLIEHEWIKNAF

SEQ ID NO: 2256 - protein, 119 aa, M.catarrhalis
YTLSADPCRPVVNTPGTNQAGNNPEQFFAMGYAACFDGALALVKKSADKSFDSRTEVTIELNKEGDSNFFFTGAIHVVASNGDITEDELLSLVEKTHTVCPYSKAVQGNIDMKLSASVE

SEQ ID NO: 2257 - protein, 163 aa, M.catarrhalis
EALMKLRILSIGHKMPNWVQQGFEEYLKRIQPMISVEMVELPPAKRSKTPSPAEIDKYKAIEATTILNAKHPKERLWLLEVKGKMLSTEHLSDKLSVAMQDGADIALVIGGADGVSPEILQAADFKWSLSELTLPHPLVRIIVIEQLYRAMSLINHHPYHRGG

SEQ ID NO: 2258 - protein, 370 aa, M.catarrhalis
KCRIIMSIDNRLWSTKAKNLSPYVPGEQPKHDNLVKLNTNENPYPPSPKAVMAMQAVLSNEACALRLYPEPESDELRQTLADYHGLGLDEVFVGNGSDEVLALVFACFFMKQRPLLMPDISYSFYPVYADTFGVTTQSIPLKDDFSIDIKEYHQSCDGIILANPNAPTGRLLPIEDIKKLIAMHPDAVVVIDEAYIDYADDVKQASAVRLIRQFDNLVITQTFSKSRALAGLRVGMAFANPNLIAALMAMKNSFNSYPLDRLAQAGAKASVEDVAYFEDKRTQVIKLRKALTQDLQTLGFTVLPSAANFVFATLPNHQAADLSQALRQEGVIVRHFNQPRIKDYLRISVGTQAQNQRLIDVLTQILAKMD

SEQ ID NO: 2259 - protein, 699 aa, M.catarrhalis
KDQFMFNPIRQEFQYGNQQVVLETGRIARQANSVLVHMGGVSVLVAVVVRPEAIAGQNFFPLTVNYQEKMYASGKIPGGYGKREGRASEFETLTSRLIDRPIRPLFPEGYFNEIQVTATVISSDKTQDADIAAMIGASAALAISPAPFNGPIGAARVGFINGEYVLNPTLAEMKQSDLDLVVAGTKSAVLMVESEAKELSEDQMLGAVLYGHGQQQVVIDNINTFAQAVGNTKQEFVAPAINEELNTQLKEQFTAKVSEAYTITVKQDRYARLDELAAEALVLAGDETSDDYADKVAQIKELFETLKYRTVRDNILSGKPRIDGRDLETVRALDIQVGVLPYTHGSALFTRGETQALVVTTLGTTRDVNLVDTLAGTKQDHFMLHYNFPHYSVGETGREGAPKRREIGHGRLARRGVQAMLPAAERFPYTIRVVSEITESNGSSSMASVCGASLSLMDAGVPLKAPVAGIAMGLVKEGERFAVLSDILGDEDHLGDMDFKVAGSVNGITALQMDIKIEGITADIMEQALKQAHAGRIHILNAMNEVIATSRTEINAHAPNYATITINPEKIRDVIGKGGATIRQLTEDTGATIDIDDNGTIRIFGTDKASTRAAITQIEAITAEVEVGTVYEGTVARIVDFGAFVTILPGTDGLVHISQISDERVENVSDYLKEGQTVKVQVQDIDNRGRIKLTMKGVE

SEQ ID NO: 2260 - protein, 73 aa, M.catarrhalis
SSKFMLNAIDDLNNKQIINKKRHAKARRFRYRIQVKNPMPQGQINGVDPMNRLSQYSGSNLYLLGSPIAYGVG

SEQ ID NO: 2261 - protein, 72 aa, M.catarrhalis
CQGFCKSALMTDESKGRFALQEGIGYFIRRILYIGFNCSYHDAVTKPCFDQAYQLELVKFHTVYLSSFIIRE

SEQ ID NO: 2262 - protein, 137 aa, M.catarrhalis
FLVSLLPSHRADNLANAQSGIRVLIMMVAETDSKSSPSPNNKIPAPAETGKKAKPLSTSKVLAELDSHAGNPTDIRTPTNTINKLTKPTIFAAVGIPSQVHTTNANSRKPTTMAAVTIMASQNLLLPNLSVIFIPLI

SEQ ID NO: 2263 - protein, 560 aa, M.catarrhalis
IMQYVAPIRDIQFVMHELLDSQSHYSKLSAYAELDTDTINSYLEAAADFAQSVIAPLNRTGDIEGCQFNHGVVTTPTGFKEAYAQYCELGFPAINAEPEFGGLGLPVSLSSAVSEMMGTANWSFAMYPGLSHGAIQTIEHHGTEVQKATYLEKMNTGAWSGTMCLTESHAGSDLGIIKTRAVPNEDGSYAITGQKIFISAGEHDLTENIIHIVLARLPDAPAGTKGISLFIVPKFIVNDDGSVGERNTVSCGSIEHKMGIKASATCVMNFDHAKGYLIGPKNRGLNAMFTFVNVARLGTAIQGLAAPELAFQGSLTYAKERTAMRALSGVKEPNKSADSIIHHPAVRNMLLTQKAFSEGGRALVYYLSYFADTVAKGENPSEVKFADEMLSLLTPITKAFLTETGLESANMGVQVYGGHGYISEWGMEQNLRDTRISCLYEGTTEIQALDLLGRKVLGSQGRMLANFTQIIHQFCQENADNDEVGQMVSTLAKLNQQWRDLTSRIAMQSTLNPEAVGAAAVDYLYFSGYVTLGYLWARTAVLAKAKLAEFDADLSTDKSL

SEQ ID NO: 2264 - protein, 97 aa, M.catarrhalis
RHQKSQRWIMMLDTTTIVIAFIITLIAHIGAKYVLRYLNKFIKGVPMIIGAIILTLILLFVIGLDYHTYYAHAKPVFDRLLGYCTKTGNRALYGHGF

SEQ ID NO: 2265 - protein, 796 aa, M.catarrhalis
SKDSQSHCPIGYNLMLLMGKIIQRSFIVLENDMSNLEQILQRIVVLQELPEPEALKRLIDALRVTDEDEDNEIVDAKFDELIALLREHPEYGSGLAAFILRLINKYRQITLYTDTGIASDQSFSSSVSRLISHRFLPLLPEEDSVVELANYLFDRNNDWKWVESISDERWDALVPLIRPDEQDLSLVAQAKNSILNAIVVLSYRISGIGLHPELMNFYPELLNYSAAFVAQNQEAVLFVNQYRQAHELDLMTDVIPDQDIDPAPLMVMVEQCEDIVDTLRKRVYKTGISIRLTNMLARLEQSLQRMRTLVELVSDAEHKRDQAIADLTIEVVQTAKTRYSFSSLIESNTRLLSRKVTENAGRVGEHYISTDRTGYRKMYKKAAIGGLFIGFMATLKMLSYHVVLAPIGRAFVNSMIYGLGFVFIHIAKGTVATKQPAMTAAAIASTISGSSGKKTQQLAKLAELVVDILRTQFIAILGNISVAMPVALLIALAWGYFYDTPMIDGAQAAHLLHDLDPIRSLALPHAAIAGVFLFVSGLVAGYYDNLAAYNKIGERIRKHWVLMRVMPKRWLDKMSSFVEANLGAIMGNFIFGCFLGSTATVGYMLGLPLDIRHIAFASANFVHGLYYLSPEHLTWQVAILSFVGMLLIGMMNLLVSFSLALMVALRSKEVKFTEWKQLYKLVTNHFITRPLDFVWPRKQTVKYAKINSLGEIIFEEATDEKANHIFADSIVRRLGRNKPKDASKGEVPDDIREAIEAYHNDELDESGNLVDKSSDDYNDNGINSLPKPSTPPNLPG

SEQ ID NO: 2266 - protein, 496 aa, M.catarrhalis
CPPRDKIHMREHNHINEDHDASSSQLGALIRLGKEQGYLTYAEVNDQLPESVTESDQIEDIIQMLTDVGIQVFEVAPDDDDILLSDTGSDDDIATDEAAAVLASVETEPGRTTDPVRMYMREMGTVDLLTREGEIGIAKRIEEGTREVQYIMAYWPGTVKFVLDEYQQVLLGEKKISDIVSGFLNGDDGDFILNEEEIELDLGSPKTTDKDDAEEDGESDGTELDDTDDSSLDPEEVRVRFEEIQRLYDVAQEALAKHGRGSEAVKVAYDELANHFMLIKLNNRLSDQVMSLMREVYEDVRSNERRIMKLVIRHGKMPMDEFKKTFPSNETNVEWLSHRIKGGPAFAETLAKIEPEVVALQQKLLAHEQALQMDIRDMKAVARQMAIGEAKARRAKKDMVEANLRLVISIAKKYTNRGLQFLDLIQEGNIGLMKAVDKFEYRRGYKFSTYATWWIRQAITRSIADQARTIRIPVHMIETINKSTEYLASYFQRMGR

SEQ ID NO: 2267 - protein, 514 aa, M.catarrhalis
PESGSWQPRGEDRHAGLREKVMSADKAAQFIQNGMMLAITGFTGAGYPKALPTAIANKAKDAHGKGEKFSVGMVTGASTAPECDGVLAEAKALHFRSPFQSDPILRNGINAGETAYQDMHLSHVEQQMRQGFYGKFDIAIVEAAAITENGELIFAMGIGHGVEAIKNADKIIIEINDALSVGLEGMHDIYDEVGLPPHRKPIPIVGAFDRIGTAGLAIDPDKVLAIVLTSAGDRNSKFAEPDDVSKRIAAQVIDFLDHEVKAGRLPKSLLPLQSGVGNVANAVMAGLLDAPFDDLEGYTEVLQDGMLDLILAKKMKTASATALSFSPDALARFNENIEFLKDKIILRPMEISNNPEIIRRLGVIGMNSMIEADIYGNINSTHIMGTRMMNGIGGSGDFTRNGFFSIYVSPSTAKGGAISAIVPMVSHHDHTEHDVMFIVTEQGMADLRGKSPKQRAKVIIDNCSHPDYRDMLRDYYDRAFVASQKTGGVHTPHLLLEALSWHQRFVETGDMRIK

SEQ ID NO: 2268 - protein, 73 aa, M.catarrhalis
VGLGGDPEYGGQGMPKMVTMLVEEMLFATNQSFTLYPILTVGATLTYWLPQVASKNPNILKKCTQVNGRVRCA

SEQ ID NO: 2269 - protein, 95 aa, M.catarrhalis
GKFMTLHYTAPLDEMCFTLKEVFHAPKFWTNTDRLSHVDEQTVDMILDEMAKFATEVLLPLNQSGDEEGAKYLDEGRVATPSGFQEAFRAYADAG

SEQ ID NO: 2270 - protein, 159 aa, M.catarrhalis
RDVICYQPIIYPISDFDGRSNANLLATASCEQKSQYLEKMYSGQWAGTMCLTESHSGTDSGIIKTRATPNEDGSYAITGTKIFITGGEHDLTENIIHLVLAKTPNAPAGSKGMSLFVVPKFLVNSDGSLGERNGVQAGSMQSWHLIMNFLLKLGCIKLC

SEQ ID NO: 2271 - protein, 161 aa, M.catarrhalis
TKSMFQCNIAKYPLAFDAYIKGINMTLKLGNKRFWLAMIVTAAIVVGFRELALVVCTWLGIPTAANIVGLVSLFIVLVGVRMSVGLPAWLSSSASTLLVDSGFAFLPVSAGAGILLFGLGEDLLSVSATIIISTLIPLWAFAKLSALWLGSSDTKNHRGGL

SEQ ID NO: 2272 - protein, 73 aa, M.catarrhalis
FYYSSLGLIIILITHMPNLFLIACLVIVPKLVTGPFTGMDFKGLPIKKPGRGGDIGSIVGAIFPMSLGYFFDP

SEQ ID NO: 2273 - protein, 147 aa, M.catarrhalis
KGNSRPRITIGQAFSRLLPYSSLITPNTHEIRALSGQQDLHDAAKALNDQGANAVLVKTSHDFNTGDIEQFLYINGRIHHTSIVPRLTGEFHGSGCSLASHIAGRLAMGDDIIDAITAADAWIHQTLIHADKPHQSDNTQLIPNRFI

SEQ ID NO: 2274 - protein, 79 aa, M.catarrhalis
MISKKFPKPNTINIGNIRYKGKKLAQKLRIPFWLRDSLWKINHQGHPYLIAPMMVWDLSSGQRLDSFAPIGRMVYNALD

SEQ ID NO: 2275 - protein, 306 aa, M.catarrhalis
NGTGGFYWYDCKIKSLSPKKLRRKLMTDFSMLNGKTISFIGGGNMAHAIIDGLLQAKNQHNLALTLCVSDSDDDKQAKFRDKGLIATNPDNAHQIIEGADVVVLAVKPQIMHQVAGSIAPYLQQQTVLSIAAGLSIQALSHMLGGYDKIVRCMPNLPASKGFGASGLYAFDVSDEVRLMTQNIMQASGKVSWVEDESLLHAVTAVAGSAPAYFFYVLENMIAKAVEMGLSPEDAQTLAVQSMRGAAALAEENNPPVLREQVTSKGGTTAAALDSLYHDNVGDAFARAMQACSDRSFELGQTFSQAD

SEQ ID NO: 2276 - protein, 191 aa, M.catarrhalis
WIYIMNSMSFVLINMVINFALMLIFVRFMIQLAQIDTNMPIARAAYRLTGVVDVFARIFPTMGKGRISLAAVVLMLLLYFINIAANTIILGRSMTAIELFFIGSLSGIMKFLQLLRYTMIASAISSLLVVFLNINNSVMFVLMQLPEPIVAPFRRFVPNLGMIDLSFLAALFSLLLLENFIGIIGSYIWGG

SEQ ID NO: 2277 - protein, 242 aa, M.catarrhalis
EKFSMTMITFPIIGYHHSPLTQKFGIPRQPNLVQVSSHIEFVPPYDNVAAFEGIENYSHLWIIWQFHHNRPQANFRPQVRPPRFGGNAKMGVFATRSMYRPSPLGLSVVRLERLEVINHKVRLYIIGADMADGTPIFDIKPYLAFSDSITDAISQQIDTPSMRKTAIDTKAKQVFDGLIRQGVLEDADVQIIQGLIAQDPRPAYRQDEVGTIFALRYDGVDVDFLMNEIGVLMIVGVRLIGS

SEQ ID NO: 2278 - protein, 426 aa, M.catarrhalis
KLTTMIAMLEEDFTQVLQALQFDDAPAGGALVIYKDGQEVVNTATGLALPNLPWSSQTLSVNFSIGKGVMATLIAVLVSEGLLDYEARISQYWHEFAQNGKTDIRLKDVLSHTAGLFNISVVTTDAEVLLDWDEMLKRIAAMPTSTPKSQEEYHYASAYSALVSGWVLGGLVERVTDMTLNQALNQYLAKPLGVIDELYFGVDADLIDKIAKPERYFGEIPKKNTPRRKPILKPDSETLLQTLTHLPTSPLWRASLGDKPITTAHVNRLYFDTARMNLTNYKNALMPNAKDGLEYHRSDVLMATIPAANGVSSANALARIYAMHANDGIWQGRTVISKDVVSRMRAIQTDGFDAVMPANMRWRMGFHRLFSLQDVPDGYGHMGYNGSVAFCEPSRRLSFAFIHNFDTTMLNDVRQFALSEMALQYF

SEQ ID NO: 2279 - protein, 156 aa, M.catarrhalis
NKVTISLTQEDIMTTHYDDSNIFAKILRGELPCHRVYEDDQTLAFMDIMPVAVGHVLVIPKYPAVELSDLPLQYAQAVIATAQKVMKAQRQVLQTQGITQVQINHPEAGQSVLHYHMHLVPAHFSDIAKHEAKHESVSANQDELAQLAAQLSEAIN

SEQ ID NO: 2280 - protein, 431 aa, M.catarrhalis
EGYFMSLNKVAILGGNRIPFARSNGVYADANNIDMLTAALDGLVARFDLADKQIGEVVAGTVLKHSRDLNLTREAVLNTQLPATTPAYDISQACGTGLQAAFAVANKIALGLIDNGIAGGTDTTSDAPIALGDGLRKPLLRLGNAKTAKQKLSALSTINPKDLLAFPQNGEPRTRLSMGEHQAITALEWNISRTDQDELAYNSHQNLAQAYESGFFDDLITPYKGLTKDNNLRPDTTLEKLASLKPAFGKKNANPTMTAGNSTPLTDGASVVLLSSDAWAKEHGHEPLAYITHQQTAAVDFIGKEGLTEGLLMAPAYAMPKMLKRAGLTLQDFDFYEIHEAFASQVLSTLAAWEDETFCKTRLGLDAPLGSIDRSKLNVNGSSLAAGHPFAATGGRILATAAKLLAQKGSGRALVSICAAGGQGVVCILER

SEQ ID NO: 2281 - protein, 337 aa, M.catarrhalis
DLRAFMYTFNRQFPHTRLRRLRISDGIREMVRETQLAPCHLIAPVFVIEGMNQKQSIHSMPNVHRYSIDLLIDYARELYATGVRMIDIFPVIDPKLKTPDGQDAYHNDTLAVRAVRAIKDAVPQMIVMTDVALDPYTTHGQDGIIDESGYVINDITTEALIKQTLAHAKAGADIISPSDMMDGRIQAMRQALENGGYVNTAIMAYSAKYASAYYGPFRDAVGSSGNLKGHKKQYQMDPANRAEALHEVALDIQEGADMVMVKPGQPYLDIVSEVKDTFGVPTFAYQVSGEYAMHMAAIQNGWLTDAVILESLIGFRRAGCDGILTYFALDAARMLND

SEQ ID NO: 2282 - protein, 336 aa, M.catarrhalis
FSFKIKIMLENRLIDPNPKKDDTADRAIRPSSLDEYIGQPKVREQMKVFIPAARARGEALDHTLIFGPPGLGKTTLANIIAKEMGGNLRSTSGPVLERAGDLAAILTNLEAGDVLFIDEIHRLSPVIEEILYPAMEDFQLDIMIGEGPAARSIKLDLPPFTLVAATTRAGLLSAPLFDRFGIVQRLEFYNVEDLTTIVKRSARLLGVLMDDGGALEVAHRSRGTPRIANRLLRRVRDYAEIKGDGVATADIASAALDMLAVDKQGLDQLDRRYLSVLSQRFHGGPAGVEALAAAMAEDRGTLEDVIEPYLLQQGYIQRTSKGRIISDKVFQMDVLE

SEQ ID NO: 2283 - protein, 422 aa, M.catarrhalis
IKSNGKSMNTQEQKSFIFMTVAVVLMLLSFYYLIHVWLIVFASILMAVWLLSLVEYLTLIPWVGQYLKKLPHGILLTMVLMGLVGVLSTLAALFGHELALQLENLKLLVPQAFEYMNQYLTQYLQTHPAVYEWLAGLEWARELRDNPQQFLTRFSDGAMAYLPTYLGGMVSGMGTLVVITIIGLFLAISPSVYRRSFVAMVPKDSRDKAEYLLDRSYRSMQQWLLGQLVVMAFVGIATGIALWLMGIPFALALGFIAFLLDFVPVLGPWLSAIPILLLTLIVSPKMLLWVALMIVVVQQLESYVISPIVQNRMVDLPPVALLLSQVIMGSITGILGIALATPLMVMVIVWVQVLYIKFTLGDYAVRILDQNESQMQADPFGDWEAYQKKQSIEENPSLKRRLQLMRQKRQAKAAQIKDNLSE

SEQ ID NO: 2284 - protein, 783 aa, M.catarrhalis
PNYNGYIMTSATRDQKVDDTTFNTNADLQKQQFEQAALHYHEHPRPGKISITPTKKIANQRDLALAYSPGVAVPCLEIEKNPKLAAKYTARNNLVGVITNGTAVLGLGNIGALASKPVMEGKGVLFKKFAGIDVFDIEINQNDPDKFIEAVASLEPTFGGINLEDIKAPECFKIERELRERMNIPVFHDDQHGTAIIAAAALLNALKLVNKDIADIKIVCSGAGAAAISCLELIIALGAKRSNVYVLDSRGVITTRRDNLDPSKQLFAQDTNATTLSEVIDDADFFLGLSGPGILTQDMVKRMAGNPIIFALANPNPEIMPELAHAARPDVIMATGRSDYPNQVNNALCFPYIFRGALDVGATIVNEEMKIACVHAIATMAHTEVSLSETDKNTESKQFGREYLIPGPLEPNLILNIAPAVAKAAMDSGVATLPIEDFDAYRQTLSEFVYNSALAMKPVFTQAKQAPKRIVYAEGEDANVLRAVQVVVDENMAQPIIIGRPDVIEAKIKELGLRLTMGEHVEVVDINNNPKHEQYWQHYHQANHRLGVSAELARRDMRRKSSLLGAMMVEQGDADGLLCGTFGYYDLHLNYIRRVIGKRQGVSDYYAMSGVILQDRTLFIADPYIHENPTAAQIAEMTVLAAQSIRRFGVEPRVALLSHSDFGTSQRTSAVKMREAYQILCNMNVDFEFDGEMHGDAALDVRVREQSHPFSTLHGSANLLIMPTLDAAHIAFNLLKSSSGSSAIGPILLGADKPVHILVPASTARRIVNMTAIVVTDAQKVDV

SEQ ID NO: 2285 - protein, 272 aa, M.catarrhalis
VIFKKHLSLGFDKKGKIMIKTALITGGAKRIGAAITNLLHQHGFNVIIHYHTSQAEADKLSHTLNQIRPNSATTLCANLDIIHHQEQLSEFSKLCIAQFGRIDALIHNASSFYPSDLNDTHQTLLKHWDNLFLTNAKAPLLLSHALLPALKKSHGCIVSLLDIHADAKPFIGYPIYNMAKAAHRMMVQSLALELAPEIRINGVSPGVNIFPENHHSSFSHQIKSDLIASIPLARIGTPEEIAQAVLFLLKSSYITGQIIAIDGGRSLTLKGG

SEQ ID NO: 2286 - protein, 576 aa, M.catarrhalis
NFIKIEGLMSASQPPSHQKNHKDIQIMNQGVKISRFGVFPKVSVPVFAVSAFLVIAFMLYGAIFSEQAGQVFGQMQQFISQNFGFGLVILMNLALAFCVYLALSRYGDIRLGHQTEVPAYSFGSWIGMLFSAGIGIGLLYWGTAEPLYHFAAPPRAEPETVNAAVEAMQISFLHWGLHAWAVYAVVALSLAYFHYRRGLPLSVRSVLFPLIGKRIYGGWGHTVDILAVFGTMFGVVTSLGLGVMQLETGLAQLWGVTPSLTLKLGLIAGITVCAALSVMAGLDKGVKRLSDITILATLAMLAFMILAGPTRFIFDSFIENIGNYAGNLITLGLWNEAYVDTDWQSSWTIFYWAWWVSWSPFVGIFIARISRGRTIREFLFGVLFVPMLLLFLWFTTFGGVAVHMEMLGSYGFVEAVQADYGSAIFRFIEHYPFTKGLMVVIMIMIMIVLWFVTSADSASLVVDMLTAGGETDPPKIQRLFWVTSEGIIAAVLLAAGGLGALQAAAIVAGLPFAIVVFVMMYCLWRGLGRDRLTLYRNSQWYITEESAEHNSQNEMIDEYLLKGPLPLPKSDQSTQS

SEQ ID NO: 2287 - protein, 121 aa, M.catarrhalis
NAPKKYSAILYNPLIISMTHSSLYPTSQATLWLELLERTQAHKDSTKLIQLYDACHAYQGSPLSYPKQWLFDAITCHQSISIADIDPTLTKKAIGDALSYLRCQALHKLLSNFQKTSVTRL

SEQ ID NO: 2288 - protein, 179 aa, M.catarrhalis
TNPKLIDLIMKVLFKAHLMAILPQLEAIASRDNMRLFLCRMPNTVQRLGMILFFMLSLSLYTVALANSTTPRYQRISTPQAISTQEIYLTATQYEVALIQVLSEICPPMLNARQKANFNRAYDRQLRIFMPYSADPYQSLRQLSAQREYRIILHNVRAWTASFPASENRALCYEFAAAA

SEQ ID NO: 2289 - protein, 78 aa, M.catarrhalis
LNHLTLNASLVAGIFYWIFEKLLLYLIIHLYKDYPCKYIWLAVLCVMLCLACPLPIRTLWLWVLRLRCCLIWDLSKLG

SEQ ID NO: 2290 - protein, 84 aa, M.catarrhalis
PDSWISLANSMIKMAFFADKPITVNRATCRYTSLASPWIFVSNKEPITPKGMTKMTAKGTDQLSYSAAKHKKTTKIDKAYSIGA

SEQ ID NO: 2291 - protein, 80 aa, M.catarrhalis
MAGWQSGHAADCNSVYAGSIPTPASKVIQQRPKAYFCKMLCPSGEIGRHKGFKIPRSYECAGSSPASGTIIIFGITKFNK

SEQ ID NO: 2292 - protein, 479 aa, M.catarrhalis
SLKWVIMKLNLTAVLVIGLMTSMGVLTACSQQDDTSVQQQMPNPTVDVQTIMLETVPVIQSFAGRVAAIETSEVRPQVTGIIDEVLFYEGSMVQAGQPLYRINVDSYTSQVQAGEAAVQNAEAAVGNAEATRASAQANLAAQEANLAQARADVMRLEGLLEVEAISRQAFDQAVTAMRTAEANVLAARAAVAQADANIHSATASVQSARANLNASQLDAGRTIVKAPISGVTSISAVTAGALVSANQPTPLVTINRLDEVYVDISQSSTQMLRLREQIESGQVGQGGADVQLVLEDGQTYPILGQLLLANAQVDTATGNMTLRAVFPNPDGKLIPGMFVNARLIQSVVHEAALLPQSAIMRTPKGETQVYIVNADNKIEIRTVTTAGTYHGNWIVTGGINSGDRVVIIGGSKVKPDQEVNVRELPAASSEANADISTPPPSKPSTVNSNIPMARPQSDTTVANLSAEEQAAMNAADETK

SEQ ID NO: 2293 - protein, 308 aa, M.catarrhalis
SHHRLSRKKLCRINILANCQKCTRPTPMSSKAYYHLQTLRQKTYQAQSIRWISLSLNKATFVSIVRFADLWMMGGYPATYFAVLSQTLQMNMMAKPDFPFAMLGLVHVENSVTQHRVIFDTETVRLSVRLNNLRTHDKGQQFDFVTSVWVADEMVWEGVSTYLSRQKKSKVQRQATHQGTTKPVFSRPDKSDDSLFLVMNVEEDIGRRYAFVSGDFNLIHLHPLSARVFGFPKAIAHGMWTKARSLAMIARHFELPAAYRMDVSFKFPVFLPSKIELMTDTPDELGIEFGLYAKDSEKAHLIGTLAYL

SEQ ID NO: 2294 - protein, 71 aa, M.catarrhalis
RLILAQILIQNRFTTMLKIKHYYQKIENKYIKRKKSPQLLPMCYQIRRYATIHIHIMWDFFTKKTYHRHLS

SEQ ID NO: 2295 - protein, 116 aa, M.catarrhalis
QAASTPESNPKNSSANLTTSLIKHAVKQTCQTQLTGHQYWKIATMKLSSESKAKISETACGCVADKAPEAVSLTELTTAAINPNARTEVAQKIVRHSLKPCMLETVNAFIVPTTTR

SEQ ID NO: 2296 - protein, 635 aa, M.catarrhalis
GICMPIYRSKTSTAGRNMAGARALWRATGMTDADFQKPIIAIANSFTQFVPGHVHLKDMGQLVAREIEKAGGVAKEFNTIAVDDGIAMGHSGMLYSLPSRDLIADSVEYMVNAHCADALVCISNCDKITPGMLMAAMRLNIPTIFVSGGPMEAGKVLASTLVDGSNVHETVVNDQGQSIRKLDLVDAMIDAADDLVSDSDVQTVENSACPTCGSCSGMFTANSMNCLTEALGLSLPGNGSLLATHTKRKELFLKAGRMIVEITKRHYEQGDDSVLPRSIATKSAFENAMSLDIAMGGSTNTILHLLAAANEAGVAFKMADIDRLSRLVPCLSKVAPATQKYHMEDVHRAGGVMGILAELDRAGLLDTSLPTVHSPTLKDALATWDVMNPDNTQARALYIAAPGGVRTTQAFSQNKIYPNLDLNRESGCIRDVKHAYSQDGGLAVLFGNIAERGCVVKTAGVDDSILTFTGKARVFESQDDAVEAILADQIIAGDIVIIRYEGPKGGPGMQEMLYPTSYLKSKGLGKACALLTDGRFSGGTSGLSIGHASPEAAEGGAIGLVEDGDTIHIDIPNRTINLAVDPTELQKRREAMQVRGKHAWKPANRIRHVSQALRAYAAMTTSADTGAVRDVSQVE

SEQ ID NO: 2297 - protein, 458 aa, M.catarrhalis
ELVMSDHYGELVQSPLGKKVAKNLGLPMPMKLDRYETGQPVVRGEVALGIASGEDAAVQSALVEILGGYEAKVNTDATLNHLKTTSLNDRLKDDNARFKVAIFDATNIKNTDELKQVYDFFHPIARRLKASGRVLVIARPECCTGDDIGFSLAQRAVLGFVKSIAKEFKRGITAQVIYVQKGAESELSHTLEFFMSAKSAYVSGQPIYLTKAATQTHATLQGKKILVTGASRGIGQAIAEVLARDGAKVYCLDVPDSLPNLQKVAGQIGGYALPLDITAKDAGEQIIRACGTLDGVVHNAGVTRDKTLAKMSEDKWNLVMNINLGAIHRVNDYLINHHGLGEAARIVCVSSISGIAGNLGQSNYATSKAGVIGLVEATAKVFKDSARTINAVAPGFIETKMTGQIPFAIREAGRRMNSMSQGGEPVDVAETIAWLLSPKAGGLNGNVVRVCGQSLLGA

SEQ ID NO: 2298 - protein, 250 aa, M.catarrhalis
GLSMQVYLVGGAVRDAVLGLPITDKDFMVVGATPQVLLDLGFIQVGVDFPVFLHPKTQAEYALARIERKSGVGHTAFQVHADPSVRLEEDLIRRDLTINALAIEVKGLFDETPMTGKVIDFYGGLTDIQNRTLRHVSPAFSEDPLKVLRVARFFARFAPLGFSIHDSTAKLMQDIAKSGEMSSLSRERLYSEFVKAMRQPQGDQFIACLHQLDILPFILPTLAQHFNTPQNRQRTFTRVALSLYAEFAYF

SEQ ID NO: 2299 - protein, 117 aa, M.catarrhalis
NLLIYIKFMKPSSAIKEKIMSDKHFSELPKMHTTYANVIKSLLPSSNTKAKDLPSSVYTVDKLVIEQSNLREYRKICGFVDDGRVPSDLFCGAIANFTNEHDGKTRLSFCHAWTGAC

SEQ ID NO: 2300 - protein, 99 aa, M.catarrhalis
LISISKTSIPANFLNKTPLPSITGFEANAPILPKPSTAVPFVMTPTKLFRAVYLAASLGFFSISRQGTATPGEYANAKSRWLAIFLVGVIEILPGRGCS

SEQ ID NO: 2301 - protein, 219 aa, M.catarrhalis
CTKMNKTDKTLILLQNIFNDTGFTFRIHNVKLAQLTIDFDLPQMFLAHYDQLADELKARIPLTPQLLKHMNTPMTADEAEKLLGLPHASIAKAWHIKLKGTAVIACDALSLAIHTHFTNTAKPAQVAYGDKQTLIHQEAARWQMTGGVNVLFKHTNYDLVSIDLEDNILTMHAQGGYIRLPNSHSLATTHAINTLKHTNLDAIGYLNDAIIETITAAQR

SEQ ID NO: 2302 - protein, 313 aa, M.catarrhalis
NFFVYVKLVYAKIKAAYSKITLKQLGKIHYHTKNNYPIGCCNHLPIPKHHHNQRNFMSKFITETVTYVHHWNDSLFTIKTTRGDSLRFRNGEFAMIGIMVDGKPLARAYSIASPNWAEELEFFSIKVPDGPLTSRLQHIQVGDELLISKKPTGTLVLDDLLPGKHLYMLATGTGLAPFLSLCRDPEVYERFEKVILVHGVRHVNDLAYRDFFENQLPNDEIFGEWIREKFIYYPTVTRDEFHHTGRVTDLIKSGKLFDDIGLPVMNKDDDRVMICGSMAMNADTAAILDELGLTVSPRMGEPADYVVERAFVG

SEQ ID NO: 2303 - protein, 78 aa, M.catarrhalis
RVVVGTIKALTVSSMQGLSECRTIFWATSVRAFGLMAAVVSSVKLTASGALSATQPHAVSEILALDSEDNFMVAIFQY

SEQ ID NO: 2304 - protein, 975 aa, M.catarrhalis
RNQVNKGIACLVFLYIRPIFAWVIAILIMLVGILAINNLPIEQYPKIAPPQVKVRAVYPGADAETVENSVTQIIEQQMKGIDGLMYMSSNSSAAGSASVTLTFENGTDPDTAQVQVQNKLQSAMSSLPETVQRTGLNVEKSASDFLMVTAFVSEDGSMDQSDIADYVATSIVDPISRVEGVGGTNVFGSSYAMRIWLDPAKLRAYNLIPSDVSSAIRSQNVQVSAGQLGTLPTNTDRVVINATVSVQSYLQTPEQFEDILLKTDTAGAQVRIKDVARVELGSENYQFRAQYNGQAASGLAIMLAPGANALEVREAVGVRLDELSQNFPTGLKMVVPYDTTPFVRLSITQVVYTLLEAVVLVFLVMFLFLQNWRATIIPTLAVPVVILGTFAVLSVFGYSINILTMFAMVLAIGLLVDDAIIVVENVERILEENPSIQVMDATIQSMREISKVVIGIALILSVVFVPMIFFGGSSGVIYRQFAVTLMTSMVLSAFIALVFTPALCVTILKRQAHKDINIQTGFFGWFNRFFYQTSRRYENFIGKTYASKLAYLAVYTGIVAVMALIFMRLPSSFVPEEDQGAVMTLVQLPAGSTLDKTNAVMDKLANYYHDKETDNIESVFTISGFGFMGSGQNSGMAFIKLKDWDERAGSENTAQSIARRAMVMNMMIPEASLIFPIAPPPIQGFGNTSGFDLQLKDVGGVGHEALLDARNQLMGMAMQNPAIASIRPGGQEDAPKLKVDINQAQAAAYGVPLTAINDTIAQAWGGSYVNDFIDRGRIKKVYIQGEPDSRVVPEDINRWYVRNQSGEMVSFGAFSGSQWEYGSPSLARYNGVSSMVLTGSAALGVSTGDAMEAMAQMASQLPAGIDFEWTGLSLEQQKSGGQAPILYALSILVVFLCLAALYESWSVPFAVILVIPLGVIGSLLLTKIHGLANDVYLQVALLTVIGLSAKNAILIIEFAKEIQESGQTLKASIMS

SEQ ID NO: 2305 - protein, 185 aa, M.catarrhalis
IFLLGVIMSTPLDLTIMISSEQIATKVKELGVQISTHYQDSNKELVLVGLLRGSVIFMADLCRQIDKTHEIDFMTVSSYINKTTVSSGDVKIIKDLDSEIQGKDVLIVEDIIDSGRTLSKVVEILQTREPNSIEICTLVSKPSRREIPMTVKFCGFEVEDKFIVGYGLDYDQKYRHLPFIGEIGL

SEQ ID NO: 2306 - protein, 251 aa, M.catarrhalis
SIPLEKMMKTVFHAADSRGDAEHGWLKSRHTFSFAEYYDPQRMGFGVLRVINDDCVEGGMGFGRHPHQDMEIISLPLSGDLAHKDSMGNGSIIKNGDIQVMSAGTGITHSEMNANADKPVKFLQIWVLTRKNGIKPRYQQVTIADQAKPNDFQQILSPNADDDGVWIHQDAWFSLANFDKDTSRYYQIKKSGNGVYVFVIKGSANIGDRQLGERDGLGIWDTDGFELTATSDAQVLLMDVPMDIAPNTNQP

SEQ ID NO: 2307 - protein, 488 aa, M.catarrhalis
AKVSVMSEEQKPKKKPRPAPEKIIPTSKDMDATKHRVHPRFAKGKYTNIRLISMYLILLGFLIAPWLRWDGRQALLFDVIEPKFYIFGATFMPQDFYFFAFVFIIAALMLFMVTVYAGRVWCGYACPQTIYVHLYQHVEKWILGERNKRIKFDKMPWNAEKIIKTALIHTIWGVFSAITAVTFIAFIVGTDYLFFNGHPLFFMGWGKMTWIFFILIVFVTQTNAGYMREHMCVYICPYGRFQSVMFDKDTLIVSYDYERGEPRGARKKDTTPAGYGDCVDCTMCVQVCPTGIDIRNGLQVECIQCAACIDACNEIMDKVGYPRGLIRYTTERQLVEKQKTKIIGWRIFAYTGVLLACIIAATMVLVSRAPLEMEIRHDRKQLSTIRRDGMVENSYVLKIVNKTNERQVYQVRLDAENTAGMTLRSRFKELPLQASELYDLPVSIIGDPNIIKPGSTPVTITVYSKDGQYSASAQDVFIYEPKKSKQPK

SEQ ID NO: 2308 - protein, 137 aa, M.catarrhalis
QVLPKTPLLLISNRDEFYARPTLPLHACDGIIAGRDKQAGGTWMSVNLSGRWAVLTNFRDGQDKKLYATSHGTLVQNYLDSQMTPLQFLTCLKPSQTDYAGFNLIVGDRTQAAYMSNKGVAPTLLAWRVYLIKWSYQ

SEQ ID NO: 2309 - protein, 168 aa, M.catarrhalis
LIPFGIKPNNDKDAMMSQQDIFQALTESHDRQRKLCDKIESLMDSDLDAAKKVYPELEIELQAHAAAEERHLYAPVMEYDDGLDLSRHAIAEHHEMDEMMHKLNDGRISDDTWKETCHALIHELRHHLKEEEKKFFIQAKKLLDEEQQERLGALYEVEHNHFERNNNE

SEQ ID NO: 2310 - protein, 66 aa, M.catarrhalis
LCKPMKLFSVLAIFMTCTLLSACVHKVVTVPAKIAYKTTKVVVKGTVAIGKAIIPNDSNDKKDKKK

SEQ ID NO: 2311 - protein, 423 aa, M.catarrhalis
LCVTIDTQDQSKSSFFTRFDKTATLNKSGCTGKYPMSLYKSAVAPLSVDHEYEITIVRFFTIMAVFWGIVGMAVGVFIASQLAWPVLNFDTSWLSFGRLRPLHTNAVIFAFGGSALFATSYYIVQRTCKTRLFAPYLAWFTFWGWQAVIVSAVITLPLGVTSAKEYAELEWPIDIAIALVWVAYAIVFFGTLIKRQTSHIYVANWFFAAFIITIALLHIVNSLVVPVGLFKSYSLFGGATDAMVQWWYGHNAVGFYLTAAFLGMMYYFIPVQIGRPVYSYRLSIVHFWALIASYMWAGGHHLHYSALPDWTQSLGMVFSLILFAPSWGGMINGVLTLSGSWDKLRTDPIIRFLIVALSFYAMSTFEGPMLSIKAVNAISHNTDWTVGHVHSGALGWVGMITIGSIYVLFASIFNKAKEVFNQA

SEQ ID NO: 2312 - protein, 144 aa, M.catarrhalis
CLFLTLTDIIKQSRTIIMAKFLSQAWFDQVNELNQAAGNLNLPPNLANVLLNAKVTGDDGAKLHLKEGKIFQGLTENAISTVTVDSETLSQLIATGDANQAIEAFMLGKIRIDGDMSQIMTLQSAKPSQEQKELFKKILQITEF

SEQ ID NO: 2313 - protein, 243 aa, M.catarrhalis
LMKTTIYPLIVAAGTGSRFGANKPKQYLKIGTKSILTHSISRLNHPDLDALTVVIAHDDAYIQGEMLDMQSSFDQAIYYTTGGDERWQSVMNGLDKICAEGGLDGDWVLIHDAARPCLPYTDLDRLIHKIKSNQCNAAILATAVVDTLKFAKDNHISHTVSRDDLWQALTPQAFKIGVLKSAFEFVITNRLQITDEASACEAMGESVAIVPASRMNIKLTYPDDLPLMEKILSGLFDELVKLS

SEQ ID NO: 2314 - protein, 158 aa, M.catarrhalis
HFYLYYSQTQLNRFYMTTTISAKPAEVVHDWYVVDAEGKTLGRLASEIASRLRGKHKPSYTPHVDTGDYIVVINADKIAVTGKKAQDKKYYRHTGYPGGIKETNFTKLLAHKPEDVLFKAVKGMLPKGPLGYAMIKKLKLYAGTEHPHTAQQPKALDI

SEQ ID NO: 2315 - protein, 96 aa, M.catarrhalis
PFCAVNQRKYVSNRNEIALIVAAAGKVITQAKPIGFIKRQLVFLFTKPIPSTAPTKMCVLETGMPKLEAPMTTAAAASSAEKPEAGCISVRLVPTV

SEQ ID NO: 2316 - protein, 216 aa, M.catarrhalis
QSLANIMKLTPKPNKQANIWYKNYMVLIFVIGLPVLVVVICLFFIFYSIKIQDSTVRDDWYMDGKTLYQDSSRDQLAHDLGVFGVMRLSWHANTTDIRFELNYPTQNLSTQNFHNDTPLTYPDELSVHISHATDDTKDRDFTIVHQKDNVYVGKVQLDDTPAKYYLQISSPKPQNWRLIQHENLPKSNIIFLPLSSFDEERRILPDQRNKRPSAKP

SEQ ID NO: 2317 - protein, 233 aa, M.catarrhalis
WVVAIMSNLMAFDTVFEQCSIALLADGTVIYEQTVPGGRGQTEIVLSLVDEALSQTNIKLSNIDCLAFNRGPGAFSGIRINTAVVQALSVAHETLCVGVSSLTALADTAHQIHRFAESSYITAVMDARQNQVYAGNFMIKHDNIQPIVDISNVYGNEFLVDYGSTMPADIIVGDGVSLINTNANIKLKIQPTASDIARLAWGEYQQGHAVRAEHALPVYLRDNAWKTLAEQGK

SEQ ID NO: 2318 - protein, 96 aa, M.catarrhalis
KPIYLGEFKMDGWIIWAYLALNVLILIQNFTQKTRIQKLEDALFVYKKQEWLEYAQSQANLPQVKAIKAIRAKFPEISLRQAVQLYVMVSPPKNHS

SEQ ID NO: 2319 - protein, 134 aa, M.catarrhalis
HQPYWHGVYTLSNGLISDEWFKCTHLRMHFYQEILPLVRQLDFDGLIITPKLSQAVWQVLEDTQKAKDNQLPNTGVDLYLERLLSSIFIQSSNYGTRVSNLLCLQNHHLTWQEKQQQGKHMGQIFSWSGHLQYK

SEQ ID NO: 2320 - protein, 751 aa, M.catarrhalis
MVDFGPIENKSLNKAFVSSGVTAQNLQTIMKNIRGDEAVTNQNSEQNRQALDKYTINLTERAMAGKLDPVIGRDDEIRRTVQVLSRRTKNNPVLIGEAGVGKTAIVEGLAQRIVNGEVPESLRNKSVLSLDMGSLIAGAKYHGEFEERLKAVLNELAKQDGNIILFIDELHTMVGAGKTSGAMDAGNMLKPALARGELRCVGATTLDEYRQYIEKDPALERRFQKVLVDEPTVEDTIAILRGLKERYELHHGVKIMDSAIIAAAKMSHRYITDRQLPDKAIDLIDEAASRIKMELDSKPESLDKLDRRIIQLKMQLEAVKNEEDAGAKSQVKSLEQQIDDAQKQYSELEEVWKAEKVGVEKSKQLQAKLDTARITLEKALREGDYARASQLQYGEIIALEKQLAEEQTDEPEHAPKLLRNKVTDNEIAEVVSHATGIPVAKMLQGERNKLLAMEDVLHERVIGQNEAVAAVANAVRRSRSGLSDPNKPSGSFLFLGPTGVGKTELTKALANFLFDSEDAMVRIDMSEYMEKHSVSRLVGAPPGYVGYEEGGVLTEAVRRKPYSVVLFDEVEKAHPDVFNILLQVLDDGRLTDSQGRVVNFKNTVIIMTSNLGSHAIHEMTDSPYEDIKTAVMASVTGHFRPEFINRIDEIVVFHGLGADQMTGIAEIQLDRLRTRLKERELGLSVSDEAMNHLVSVGYDPVFGARPLKRAIQQEIENPLAQLLLSGEFTTGDTIFVEWLNDQFTFNKLRYS

SEQ ID NO: 2321 - protein, 211 aa, M.catarrhalis
PHTQYGNIPILFLEEVLMSHAEGVNIKRRRVLIATTAAIGAVGVGAIATPFVRSWYPSAPAEAAGAAVVQDISGIENGQMITVKYRGKPIFVVKRTEEMVANLSKVTPKLSDPNSEASVQPEACKNETRSLQPELLVVEGVCTHLGCAPTYRPEVGAADLGGADWFGGFFCPCHGSLYDLAGRVYNGVPAPTNLPVPIYSIDGSILTVGEA

SEQ ID NO: 2322 - protein, 191 aa, M.catarrhalis
HANQLSSDAITDLMDKFKNYLKPIIRRIIMPSFDVVSELQVFEVKHAVQNTEKEVANRFDFKGSDISIQLNEKAKTVTITTDNELQSDNVYAIFEKQLIKRGVDLQSLDPQDKSQSGKQTKQIIHLKDGLDSDTAKKISKTLKESDLKVSASIQGDKIRISDKKKDNLQLAMAFLKEKTFGVPLQFNNFKD

SEQ ID NO: 2323 - protein, 213 aa, M.catarrhalis
TMSNITHELVEKNTGLLVIFIVIAVSFATLVEIVPLIYDETVAEEGGVNKPMPNMRPWTALELEGRDIYIREGCHVCHTQMIRPLRAEVERYGPYSRAAESTWDHPFLWGSKRTGPDLARVGGRYSDQWHVDHLTDPRSVVPESVMPSYPWLATNEVNGTKVQEKMRLFKDRFGLPYTEADIEAAPDQVQGATELDALVAYLQQLGIAMQGQR

SEQ ID NO: 2324 - protein, 61 aa, M.catarrhalis
IYGKFYKTSHADSSQSIFWFAIGWNEYLFYPMGLGLHNASAGAIVYDCKFLWYFYGIQHWR

SEQ ID NO: 2325 - protein, 455 aa, M.catarrhalis
PYIKDIHMSNATILQHLPIGKKVGIAFSGGLDTSAALLWMKQKGALPYAYTANLGQPDEDDYNAIPTKAKQYGAVKARLVDCRLQLVQEGIAAIQCGAFHVTTGGMPYFNTTPLGRAVTGTMLVTAMKEDDVHIWGDGSTYKGNDIERFYRYGLLANPELKIYKPWLDQTFIDELGGRTEMSQFLIDNGFDYKMSAEKAYSTDSNMLGATHEAKDLEFLDASMHIVEPIMGVRFWDDSVRVATETVTVSFKEGVPTALNGEHFDSPVDLMLKANEIGGRHGLGMTDQIENRIIEAKSRGIYEAPGMALLHIAYERLLTGIHNEDTIEQYRINGLRLGRLLYQGRWFDSQALMLRETAQRWVAKAITGEVTLELRRGNDYSILNTKSPNLTYEADRLSMEKVEDAAFTSLDRIGQLTMRNLDIADTRQKLGLYVQSGLLGFGGGNAVPQLDHQDKH

SEQ ID NO: 2326 - protein, 271 aa, M.catarrhalis
SDINKGVAVLVIFLLCLILYIGSGLYLAYALFQDTPIHRLVLGILIFAILLHGWVLTPEIITLYGLNFNLFNTLSLTSLFFVLFYVLFGLYRPILSLGILAVPMAAAGVSLGYFGQVAYKPLTDLSNTLQIHILLSFAAYCVLLMAAVQGVLLRLQIHELKRKTIHRFWVSRLPSLQSMESLLFDMVLTGFVILSIALGFGLVATYDILDQHLAHKMVFSLLSWLLYGLLIAGHYRYGWRGKRAANFAVYGFLLLAIGFVGSKAVMEFLIG

SEQ ID NO: 2327 - protein, 102 aa, M.catarrhalis
LMTNTPKTPTRTEIQTPELWNFPMDYPMSIIGHEGHHETLINEVKLILAEIFPEFDAATMQVRPSRTGRFHSVRVNLYLTDADQVNRLYTALDKAATVRTAV

SEQ ID NO: 2328 - protein, 71 aa, M.catarrhalis
ACRKFCGIWIFIAGDRFCRLKGGDGIFNRLAFDDTTLILTKFPHLISTPKSFRITHDQYAKNPNTHRNSNA

SEQ ID NO: 2329 - protein, 558 aa, M.catarrhalis
FLVKFYFTSNRYITMSTKFIFVTGGVVSSLGKGIAAASIAAVLEARGLKVTMTKMDPYINVDPGTMSPFQHGEVFVTEDGAETDLDLGYYERFLRRSKMSKANNFTSGRIYQTVLAKERRGDYLGGTVQVIPHITDEIKHKIRTSGEGYDIAIIEIGGTVGDIESLPFMEAVRQMQVELGRTHSLLMHLTLVPYIASAGESKTKPTQHSVKELRSIGLQPDVLICRSEQPISEDNRQKIALFTNVEPRGVILCEDAKSIYQIPRRLYEQDLDDLICERFGITAPEADLSDWDKVVDDLFNSQGEIVVAMVGKYVELPDAYKSVNEALLHAGIHNKTKVSIRYISAEALETDSEAMNQITDVDAILVPGGFGERGTLGKMKAIQFARENNKPFLGICLGMQLAVIEYARNVLGIEANSTEFDRKTANPIIGLITEWFDEKGELQTRSDDSDLGGTMRLGAQEAELVSNSKLAEIYGSHNITERHRHRYEMNNRYIEPLENAGMKISGYSAKQHLVESVEIDNHPWFVAVQYHPEFTSSPRGGHPLFNSFIKAAIDVKQA

SEQ ID NO: 2330 - protein, 355 aa, M.catarrhalis
MMTKTLTLIQPDDWHIHLRDGEALATTVRHAATSFNRVICMPNLVPPVKTTNQAIAYRERILKALKDSDLPATRKDSFDPRMVLYLTDQTTAKDIDDAAQTGIVSAVKLYPAGATTNSADGVTDILARSLVFEAMQKHGIPLLVHGEITDSNIDIFDREKRFLDDVLNKIITQFPNLKIVMEHITTADAADFCLAQGNHIAATITPQHLLFNRNHLLVGGIKPHYYCLPILKRAAHQKRLLEVATSGNPKFFLGTDSAPHATHTKESSCGCAGCYSALHALPLYAMAFESVNALDKLENFASRYGAQFYGLAINTTQITLIKQPQTIPESFHYLGNKTLTPLLAGEVLPWQVVGI

SEQ ID NO: 2331 - protein, 70 aa, M.catarrhalis
DVAKSAEPPNAKITALVCSGLSRPKDSHDVSKFNTGHANCDAMNTPTAMPTIPQNTAMIVKNRTIVISYS

SEQ ID NO: 2332 - protein, 141 aa, M.catarrhalis
FGKNTVANVNQILKYMVSNQLRLIISIIIATVVLVLMQIQYWYGDYGHANLIAVKNQLHEQNRLNQEQINKNNILLADVKDLKSGLSAIEEHARLDLGLIKPGETFIQLSNAPITYSRQPLLEIDESIEAVDSVPEPMPNH

SEQ ID NO: 2333 - protein, 519 aa, M.catarrhalis
HIGKIMFDTLTERLSGSLRHIAGTGQLTEDNIKDTLREVRMALLEADVALPVARNFVARVKEQALGQEVLKELAPGQAFVKIVYDELTEMMGSANQTLEMTGKPPLVYLLAGLQGAGKTTTAGKLAKFLQDKQNKKVMLVSADIYRPAAIKQLEQVAAQVGASFVPSTTDENPIDIARRAIDEAKLQYQDILIIDTAGRLHIDDEMMSEIKELTKAVNPVETLFVVDSMTGQDAANTAKAFNDALPLTGVILTKTDGDARGGAALSVRAITGKPIKFLGRGEKLEALELFHPERIAQRILGMGDVLSLVEEVEQKIDREKAEKMAKKIQKGGEFDLEDLLTQFQQMKNLGGMAGFLDKMPGLGGADIQKAMEEARPEEKVKEMEALIHSMTPFERQNPDKITPSRKRRIAAGSGRQIQDVNRLLKQHKQMAKMMKMISRPDGIGKMMKAVQGLARGMSGGGPLFGNKDANQAGTPNMQDMQKSMQDLGLKPEDMPSMEEMQKKMQEMQSQLPPNFKKRF

SEQ ID NO: 2334 - protein, 1298 aa, M.catarrhalis
IKMKILKLSFENINSLKGKWQIDFEDAAFYHHALFAITGPTGAGKTTILDAICLALYGETPRLSISATQNELMSIGTAFAASSVIFRANDKIYQVSWSQRRAKQKTDGNLQAVSREISLLQHANDTHGKILEEKASLVNKEVERILGMNKVQFTRSVMLVQGEFAAFLQSDATERGQILEQITGTHIYAKIGQAAFEKHKEQLNLLKNLQIKLGEVNLLNTEEYDGLIKKISEITQQKNLLETQIKLMSDRQKIANEYQTLNQEMAHYQAKLIEHQEALTNFEPNIQRMKHAHDAKNLQPLYTAFHEYHLEYNNKQDQLIILNHRLNEIQLSHQKRSQTHSELKEKFNKITDDYENLKPTLQAVRRLDQHIASLRKEHQSMIQTLEKTKQDYTSTQNLLKETQSNQSALVQDIDTIQQKIKGIDSENLKKNLKLCDNHISQYDTLIQAITHAHQQQLWRINVFSNHLHELKDKREHFKSVNLNLQSIDNQIGTINIKIIDNLNLTKKDDINVDILQKNIEDQYEKIKQQTHHLYTLERILKDYEQYARIQSDISDTNRKIINLQEEKIKIQDILETVSQNIHQASQTHKAILENYELHKQILYMKMHFDQLQDGSPCPLCGSTEHPFKLQPNHLDDEHAKQAKEKLVFCENQLNELNHTATQHTTTLHKLQMALDDHQEHLNTAQNTSNSLYHDLNALWQTIASECSLEHANTLPSRNTIGKFIKNSQDKIKNLEESYQLSSRLLHELNQLIAQKDRQMIEKENLKINGLKLRDDALVLMREIYDGKVHFCDQLLSAFYQLIQAQNTISLPNELNAIKQHLSKITTWYDNITHHTQGDVLPEAEAFNPSPLTLKEEEFGKVQYVLSQTKQMLENQANQATALNEDYINKQTKLIHLDAQINAHTKKIQELTPVIAELEHTMANKVLEIKTQTNERITLLGDKNPDHTENNYQDKLTQIRQQLENATKNVHDDIADLHAQKATIESLNLTIKELANKLSQSKVSFEQALMASEFDTQAEFLAALILEDELIELKTAHDTLINQLSQTTISINNCQEKLDNLIKSNPNVHQFKLEDLHTELINLQQQLESVNQSIGELNAIKNSELQNRQRHTQILKDIQRQEQENAIWAKLDMLIGSADGKKYRNFVQGLTLDLVLHHANQILAKMNDRYLLTFDADSSRTLEILVTDLHQGDAVRSSKNLSGGESFIISLALALGLSQINSQNIQIESLFLDEGFGTLDETALDLALNTLFELQQSGKSIGIISHVASLKERIDTQIIVEKHAGGYSTLHGAGVKNLS

SEQ ID NO: 2335 - protein, 548 aa, M.catarrhalis
KPWKLRLFEVVFSFIFGEFMVNSTKQATPIAVNLFFGLLLAGMSIYFIQWGLVYTMHQQVLLFMIASFFGIFMAFNIGGNDVANSFGTSVGAGTLSVTQALAVAAIFEVSGAVLAGAAVTDTIRSGIVDIGQLGVSPNQFIYLMLSALVAAAFWLLFATKRGLPVSTTHAIIGGIVGSSIVLGISIGGVDFAFSTVKWSKIRDIALSWVISPVLGGALSYLLYSIIKKNILAYNDKAELVVKTIKAKKKALKREQKEYFETLDDKEKLPYTNALLRDQEAFKDGDCQRDDLETQYYRAIFDLERRRDNLDTLKALKTWVPLIAALGAVIMTAMVVFKGLANTGLQLSILQAGLVMGMLGALVWLTAFIYTKTIRGKHKEALGKATFVMFSWMQVFTACAFAFSHGSNDIANAVGPFVAIMDVIKNNAVEAQATVPAPVMLTFGVSLIVGLWFIGKEVIQTVGTNLTEMHPASGFSAELAAAAVVMGASSLGIPVSSTHILVGAVLGIGLVNKNTNWRLMKPIGLAWVITLPAAATISAISFLLLTYFL

SEQ ID NO: 2336 - protein, 485 aa, M.catarrhalis
SCNCAYRCLTQDRCLRSFFDNLATVMTIFKTHLTHQSPITPALPKPKDSLRLLHTSDWHLGKLLYNQSRYDEFAKFLDWLIEALILHQVDILIVAGDIFDTMTPSNRAEYLYHHFLASAFKNHIQHIIIVAGNHDSPTSLQKTKEVLGVLNTHVIGSVSQDKSDELIVLTDDVGIPSAIVMAVPYIRDRDVRSGIDANSIHQKNQLLLEGVAEYYHSLTNLAKDKQQAVYHTHQKTIPIIATGHLYATGAAVSSTDDGMRDIQIGTLGQISSQIFDDAIDYVALGHIHAAQKVGQKNHIRYSGSPIAMGFGEIGRHKQVLIVDLPLNKSVPISKLPKNDDLHGENQDNNAISIHSLPVPIFHSLAKICGDMAFITNAIDTLKTHDEPIWLEIEYVGDTLVANLKQHISNLLEGSNIAAISIKNKAIHQGSLKLHTPTLNLEKLDEMDIFYQRLDKENLNQDEKNDLIGAYQELIKAIQETDHKAV

SEQ ID NO: 2337 - protein, 67 aa, M.catarrhalis
LVMLVKLSVKNWVYAKLVNAHNFQNASSHLSFQKSSRFIESFFTLIFHQLINQIIVVSQKYLSVLLV

SEQ ID NO: 2338 - protein, 350 aa, M.catarrhalis
ADFSIEKSFWNPIKSTVHQNSSNDLLGRLRNVMLQAIGFAFSIVLPNLFLMALGYDMKRRSALNAEFIEVASSIVFNYCLPCLLFFSVLKSDVQILAQSKLLLAGFITTFTLFFLAEIYAKFFISELKDKGVFVQGVFRSNMAIVSLATVFNAYGSEGLGVGAIYMGVITILYNVLAVITLSRTTQKADSVFMQAKSILVKIIKNPLIIALVSAFVYKALDLPMLPEFINKTGGLLGAVALPLALICAGATLNIKSMISLSGLSMQASIGRIVIAPLLAVVVGVAFALEPLQFGVLFLMVASPAAAASYVMAKAMGGNDILAANILGFTTVFGMIGMAVGMALLRVLGWA

SEQ ID NO: 2339 - protein, 421 aa, M.catarrhalis
YRWLNLDRWGGLIMSIAKKFMSWVDARYPATETYEYHMSKYYAPKNFNFWYFFGVLSMVVLVNQLVTGIWLTMMFNPSAEGAFASLEYIMRDVKGGWLIRYMHSTGASAFFIVVYLHMFRGLLYGSYKKPRELVWLIGMGIYLCLMAEGFFGYLLPWGNMSYWGAQVILNLPAAIPFIGDALAEWVRGDYLISGITLNRFFALHVIAIPLVLVGLVFMHLVALHHVGSNNPDGIDIKKLKDKNGVPLDGVPFHPYYTVHDMVGIVVFFICFFAVVFFVPEGGGYFLEKPNFEVANALKTPPHIAPVWYYMPFYAILRAVPHKLGGVIAMGAAIAVLFVLPWLDRSPVRSIRYKGMLSKIALAIFVVSFVTLGYLGGTASTPTATIIGRICTILYFLYFLLMPFYTSIEKCKQPPERVTGGH

SEQ ID NO: 2340 - protein, 252 aa, M.catarrhalis
TTTRTRYRRPLMKVLNSLIKFGAGAVLATVGAFASTNALASGGHGCGEYTEADGTVVTLECSKAPIDLTNKGSLQRGAAMFMNYCAGCHSAQYVRHSRLAQDLNIPPELVEKYLLVTGDAIGDHINAGIDPELQSQWFGAAPPDLSLETRLRGDDWVYTYLLSFYEDPSRPWGANNLVLANAAMPHVLHNLQEELGKEEYEARVGDLVNFMAWMAEPVRHDRKIYGAFVILFLLILLIPVYLLNKEFWKDIK

SEQ ID NO: 2341 - protein, 68 aa, M.catarrhalis
YTGSKHFRVYDSLWDDWHGGGHGIVKGAWLGLTSIIFLCIQTAAQTQQMISSKFWLNCYYKNNPMKDG

SEQ ID NO: 2342 - protein, 87 aa, M.catarrhalis
PSSRCNRAGCPGCLFATVGYCDARSTLMNWGVLHSIATVAAFITFIGIAWWAYSPKNKKRFEEDAQLALDDQDIQRLSSDKRTKDIQ

SEQ ID NO: 2343 - protein, 322 aa, M.catarrhalis
LKASCAVVRHGKPTKESLMKNLKTHAPMTVNEKFIAWLQLTRFDKPVGTELLLHPTLWALFLVYAGKNALPNFWYIVIFALGAVLMRAAGCAINDFADRKVDGQVKRTHARPLADGRLSPKTAVLTFIGLSLLAACLLFFLPKSVFYWSLGAVLLAFVYPFMKRFTNMPQLVLAVAFGWAIPMAFVAVQGVPDLWTWVLFIAYMCWTVAYDTEYAMCDRDDDLKIGVKSTAILFGRYDVTIIIGLNLIFTVLMSVSFWHYFDDLPKWLCIMTFMPVLAMFFRQYQLIANRERLACFIAFKENVWVGRYILTMTVIFCLIYFR

SEQ ID NO: 2344 - protein, 60 aa, M.catarrhalis
SNVGSFRPPGQVILSPGTIKVLQAPENYAAKAAIEFVPIEWLILALLRINHSIKPLYHQV

SEQ ID NO: 2345 - protein, 653 aa, M.catarrhalis
QVFIKLKLLIWPIKQVYWKQSMNAISYTHPKTFDVIVIGGGHAGTEACLAAARMGANTLLITHNIETLGQMSCNPAIGGIGKSHLVREVDALGGAMALATDKAGIQFRVLNSRKGAAVRATRAQADRILYKAAIRHTLENQPNLTIFQQSVDDIIVENTRAVAVVTATGIRLNTRAVVLTSGTFLGGVIHVGLDHQSGGRAGDMPAIRLADRLRELKLPVGRLKTGTPARIDARTVDFSVMTVQSGDTPLPVMSYMGDVAMHPRQINCYITHTNERTHEIIRANLDRSPMFSGKIEGVGPRYCPSIEDKIHRFADKDSHQIFIEPEGLTTHELYPNGISTSLPFDVQLEFIHSMKGLENAHITRPGYAIEYDYFDPQNLKPTLETKSIDALYFAGQINGTTGYEEAAAQGLLAGLNAARMALDEPSWVPQRHEAYLGVLVDDLITHGTKEPYRMFTSRAEHRLILREDNADARLTAIGRELGLVDDERWARFSQKMESIASETARLKDIWATPNNAIGQDFMANTGEILTKENSLLDLLKRPNITFDDIAKVSDSTVSAKVGEQIEISVKYQGYIERQNDEIEQMKRLENTLLPLDFDYKSVSGLSNEIVQKLSQIRPTTLGQASRISGVTPAAVSLLAMTIKKLKKTQAVMT

SEQ ID NO: 2346 - protein, 767 aa, M.catarrhalis
VKLMAVWLFVFVALAVLAILGSIEQFWLDETWLSILASDQCILLITAGLLLCLLGWSLIPTSKLAKINRLLKACLLVASIVLLFVVRTLVAYVTYEIHTPNARYMVSADAHIHTLSDGIYDDILGTSFRQVATLHNIKPIIPSAHHPSTLKIHNPFGEFNPNPSIMPTQEDLDKLKLMEGMTVLLSANPNATQADLSKLAKVQPAMRLTAEILITPIDKTPSASGFDTNQWLRTRHIHAQAKILSVGEIAPLEAESLAQRFYFRLEQFRHRLRTHFYQDWHKLSASQSQAPAVSLSLMTGDRALIDKHTKELYQLAGISHLLAISGTHVLFLAVILSALVTFMTDKFAQHIYAHLPRWQIRMMVMVLASLVYALFTGFDVPAVRTVYLLIAAWLVRYLILPTGMISVLAWVALLMIWLDPYVLWQAGFWLSFIAVLLLMRYESKINMINETNQNQGQLVRRWLQFKQAVRLQFWLFFSMLPVSILLFGKVSIWGLVVNLFAIGLFGFVVVPINFLAAAVFGILPELSQLLWGTSSAVLYWLHDFLYFGLSSQIGSLGAWLYAPFGMAGFLLSFMVVGLWILPNVLPRVLIILPLVAMIFLGLPKQIPHFKLIILPSDTPNISQMLLSYHNANQQKHWLILNDLGAKSLRANHTQTLTDQLYRLGAAQYGIDGIIVQSPSAIFLPVVGQLAKALPVHRFWQAGNHEPLANIHHTPCRAGLYWQSEGIGIKALTGWHEIGDERVQHCEYEGLPDLPLNTQNLIEDRFTP

SEQ ID NO: 2347 - protein, 131 aa, M.catarrhalis
GDIMERNYGTGRRKTSTARVFLSKGTGNIVVNGKSLDEYFGRETSRMVVRQPLELLELTDSVDLYITVVGGGINGQAGAIRHGITRALIESDESHKPALKAAGFVTRDAREVERKKLGLRKARKRPQFSKR

SEQ ID NO: 2348 - protein, 132 aa, M.catarrhalis
GMIMTPKRPYIVRAFHEWIEDNDFTPYLMIDATHDDVVAPLEYAQDGRLVLAASYQATHNLQIHNDAISFTARFGGVSSDIWIPMAALMAIYAKEDPKHGAFFDPGEYANHQSPKTDEDRPTLKGSTLRVLD

SEQ ID NO: 2349 - protein, 281 aa, M.catarrhalis
LMDILLIIKAIIMGVVEGIAEFLPISSTGYLILSADIMNFLSGEFRNLFIVFIQLGAILAVIYDYWGRLWGAFIGLITGHSPDLTKPRQLGFSLMIASLPVVVVGFTMADFITNALFHPLVVATMLILGALIIIYAEKNPRPIHAPEAENISFKTALGIGLCQCLALIPGTSRSGSTIIGALLLGTSRKAATEFSFFLGIPVIIGAALLDLIKHFDAIQTLTDWLILLIGTGVSFVIALLCIRLMVAWVSQKDFMIFAWLRIATGVLVLIAFFGFNYQIQA

SEQ ID NO: 2350 - protein, 169 aa, M.catarrhalis
ELIMTIDRRIVIDTQSQCLTLYQGNILLRQFAVSTAKNGTGQLEGTGCTPLGEHVIGQKIGGGLPPNAVFVARQFTGELYDVQLGQNFPNRDWILGRILWLEGQINGYNHGVDKTGALVDTKLRYIYIHGTPDTEPMGRPMSHGCVRMRIDEIVWLFDKVEVGDLVLIQ

SEQ ID NO: 2351 - protein, 358 aa, M.catarrhalis
GYTMSFFWSSWITILSLGCWLFIFGVLVWTLRSRPVLEEDETTGHSYDGIREYDKPLPKWWLVIFFGTMIWGLGYFILFPSIQPNTWKGVTTVEVDGESVPWTSANELNSQLQANNRVFTENFEQNILENAGASEATVVLAKLNDLQSQRKAGEENAELQTQIDEQVKLLAPYVDKLASDPEAQKIGNRLFLQNCALCHGSNARGALGYPDLTDNDWLYGGNADQILLTIHNGRVGSMAAWQQQLGESGVRAAAEYVLQLSGNQNDYELDAAKVAQGKVLFEANCVVCHGPDAKGSAAIGAPNLTDDIWLFGGDRDAVQTSIRHGRAGVMPEWQTKLGNERIMLLAAYVRSLSQTAAE

SEQ ID NO: 2352 - protein, 241 aa, M.catarrhalis
SFTLASGWYMSKIVKPTKTLIAERFRGFLPVVIDVETAGFNAATDALLEIACVPILMDNDGNLYQGEPLNAHIEPFDGANLEPAALKFTGINPDSPFRKAISEDEKTALRRIFKALKALKKEHGCRQCILVGHNAHFDLGFLNAAIARTNSKNHSPFHTFSVLDTVSFAALTYGHTVLAKTCMIAGLEFDNQHAHSALYDAQKTAELFCHIVNQNTLLSTNHANLTQNDTPTNSHQTPSLT

SEQ ID NO: 2353 - protein, 67 aa, M.catarrhalis
VYALNLGKTGTATSNQTTVIISTNREPMLWQLWEMLWLSDEELKLGTPVGYHSGGLTPTHAGCAHHG

SEQ ID NO: 2354 - protein, 445 aa, M.catarrhalis
VIAIGATMYAEDTKNIVEIKDIIAREILDSRGNPTIEADVILANGIRGRAAAPSGASTGSREALELRDGDTSRYLGKGVKKAVANANSQIRTVLLDKDVTQQTQIDNILIELDGTENKGNMGANAMLAVSLAVAKAAAIAQSLPLHQYIANLRGQTSLTMPVPMMNILNGGAHADNTVDIQEFMIEPVGFASFSEALRAGTEIFHALKSVLKAQGLNTAVGDEGGFAPNLRSNEEAITVIMQAIDKAGYKAGENIFLALDCAASEFYKNGQYILAGEGNKAFDSQGFSDYLTSLCNQYPIISIEDGLDESDWEGWAYLTKQLGKKVQLVGDDLFVTNPKILQEGIDKDIANAILIKFNQIGTLSETLDAIYLAKQNGYATVISHRSGETEDSTIADLAVGTAAGQIKTGSLCRSDRVAKYNQLLRIEQQVRAAYRGREEFIGLRG

SEQ ID NO: 2355 - protein, 290 aa, M.catarrhalis
GFEMTQPMIAAQSNITVSGIEIGNDKPFVLFGGMNVLESRELAFEIAEQYIDICQRLNIGYVFKASFDKANRSSLHSFRGPSLENGLTWLNDIKEAYNVPIITDVHEPYQAAPVAKVADILQLPAFLSRQTDLVSAIARTGKIINVKKAQFLAPHEMRHIINKCLEAGNDQVILCERGSAFGYNNLVVDMLGFDTMKSMNVPVFFDVTHALQEPGARGDSAGGRRHQITTLARAGMATGLAGLFLEAHPDPDKAKCDGPSALRLNQLEPFLIQIKQLDDLVKGFETLDTQ

SEQ ID NO: 2356 - protein, 274 aa, M.catarrhalis
RAIVRLSLIYDKPNTVVDELLSICQAYDLPLDWAVHRHNKLNDKQILQLKQTGDTPIIAILKNTPTLIKVEDKTIIKSTLNWSALQHRIVTAGRKSELILQACKPQAGMTVLDGTAGFGHDALILASSGAHVTLCESNPVMALLLYYEYQAMVQVANWQGLLGRMDIIYKDTSEMTGEFDCVYLDPMFPKDSYKAKVNKQMQALHELAAPPTQSEAHQIFCRSMNMIKPNGRLIIKRPIGAPYFVQQPPNHSIQNDALRFDRYDKNGYSALHLG

SEQ ID NO: 2357 - protein, 62 aa, M.catarrhalis
FKLVGLHMAGMLCVHWGVLYMWVVCLSWLIIGYRTIKMPSVPEHIAEPKEVNTGSEQARAQA

SEQ ID NO: 2358 - protein, 335 aa, M.catarrhalis
SHQLIKAPPKGSCMNLQKVDLNLLFYLDVLLREKNVTRAAEQLGITQPAMSNILRRLRSLFNDPLLVRSSEGMTPTERAFELQPRIREVLLDITTLLEPRTEFRPYSTSRVFRIMTSDYAEATLVPRLVKALRSEAPNVILDFLTPSDVSYRDMEQGRVDLAINRFNEIPQSFHQVLVWRDTFSCLLSADSSYANRFNLKNYLKAHHIWVSKTGMGVGFGVNPEKSGGLGSIDQALQRLGQKRQISVFTRHYQMPAMLVANKDLIATLPTRVARLQADNHPNIIIKEPPFFIPEFELTMAWSPLLQHHPAHRWLRQLILHVARQVIAEENQVIKA

SEQ ID NO: 2359 - protein, 223 aa, M.catarrhalis
SKNSDTLRGSFISSLHMANLPHLSLTQFILYADHGINSHIVRLLLEEKHLNYETVFIGEERPEELIELNPYYTLPILVNRDISLYEHNVIFEYLEERHRVPRLMPDAPSERAKVRQLAWRLQKDWLKHGYTLLTHSDSFDIQAATAARKSLSDSLVTIAPLFGHKPYFMSDTFGWCDVLLLPLLWRLNKMGVHLPTHLIRPLIHYQEQQFARPSFINSISFKE

SEQ ID NO: 2360 - protein, 506 aa, M.catarrhalis
WPSSRSPNQAGGIIMNPMIFESILSILPAVIVALTALIVMITIAVKRSHFWAATLSVVGLNMALLAVISQALGLVPAGVSFGELFIFDGFAIFNMGVILIAALACCTLAYGYFETLQDHKDELYLIMLISTLGAMLMTGAAHLAAFFMSLELLSVPMYGMLAYTFLRSRSLESGLKYLIMSATASATLLMGMALIFADAGTLLFKDLARNLLIGNLSGLSVAGVVMMLAAAAFKLSAAPFHSWVSDVYEGAPAPIAAFLASVSKVAMMALALRFFVGSMFTAMPAFETILIVVIVLSILMGNLLAIRQNNIKRMLAYSSIAHIGYALTALLSIGAGSLPLVSMYMAVYALTSIGAFGVITLMSSPYRERGRTSISGEADDLRFYQGLFWRRPVLTAVLTVMLLSLAGIPLTAGFVTKFTIFFAAVQGMHFLAAGMIILGSAIGLYYYLRILVNLYQKPKVNLEFDAHQHWGVKAGGVMAMIITALIVIFGVLPEAMMQMAARAVML

SEQ ID NO: 2361 - protein, 75 aa, M.catarrhalis
WSGLFLFLTPKIRQMITEPMNTKLLETIAAIIKIMASMANIQSILYPFIIMSTPYHLKITHTNKHCQSIGGAIMS

SEQ ID NO: 2362 - protein, 60 aa, M.catarrhalis
SVKSIQISSLSSQITQTCQNSYLPHPYLIELMGYSTDKLHTYCILMIYLTFYQLLLCQFI

SEQ ID NO: 2363 - protein, 216 aa, M.catarrhalis
CAEFVAMIDVLKAFLANGSVVGFYVLSLVAIWASLRVVTHANAVHAILSMIVSLLAVAGIFFILGAPFAGILEIIVYAGAILVLFVFVIMMLNLGTDTTEEKTWLTANAWAMPVCLMMIVGAVLIGFIGYGTDQSIQLQSDTISAKDVGVRLFTGYVLLVEVAAFLLLGALVAAYHLGKKALDDENISHSLTCPDVTSNTWANQDKEQQERADAKL

SEQ ID NO: 2364 - protein, 276 aa, M.catarrhalis
LTNTYQGQIMYTDSHAHLTYLKLDHYDNRPENLLKAMYQAGVRRTMAIMCQLSEYDDIHAWVEMSADTMPDIGMSVGVHPCQDEHTLAAISPDELLKRDHEKVWAFGETGLDYYWDKDKSSAQKHSFAAHIDAAKTAKKPIIVHTRSAYQDTLEVLTAERCEHGIIHCFTEDYAFAKRALDMGLYISFSGILSFNKSQDLREVAAKLPLDRVLIETDSPYLAPVPKRGRDNEPTFVPYVAEALAKIYQKSAEEIGHITSHNFITLVNQYKPIISRL

SEQ ID NO: 2365 - protein, 211 aa, M.catarrhalis
MDLTDYRQSYEKYSLADTGLPSNPLTLFRAWFDEAVAAKLPEPYAMSLATCGGDNRPSVRIVLMRELTEQGVVFYTNYDSAKGQDIADNPNAEVLFFWHSLERQVRLSGQMVKVSAEKSAAYFAKRPRESQLGAWVSQPQSGVVDNRQTMEEKFLALERQHTQNVPYPSFWGGYELIIDHAEFWQGRLGRMHDRMAYTKQGDEWQIMRLLP

SEQ ID NO: 2366 - protein, 259 aa, M.catarrhalis
MSLTPKSIALLPKYPAIIALFLMIAMIASMFVLQYTWLLLLSGINELLNPSFIAKNTLTIMSLILTAVSLVWIIVIWQYLRIKTMGHTTKTTILIWQCYFGFHAMNSKAFFKALAVLLVGIILSSGFVAILSDWLKPMPSIDVKSLVDDSTPMWLFALLVLICAPIYEELICRGLFWRLGEDIFSPFFTQERHTNIAVSLLSSGIFSFLHFQYNYIDLVMMATLSLILCYTRLSTQSIFAPMLLHSINNSLVLLLMIFS

SEQ ID NO: 2367 - protein, 182 aa, M.catarrhalis
MFATLKNTAVGMFTIVRSMWMVNSHALRPRDTILYPEQPVPVPPRFRGRIVLTRDPDGDERCVACNLCAVACPVGCISLQKAEREDGRWYPEFFRINFSRCVFCGMCEEACPTTAIQLTPDFELGEYDRQNLVYEKEHLLISGVGKYPEYNYYRVTGMATDDKPKGSHEREAEPVNVRSLLP

SEQ ID NO: 2368 - protein, 61 aa, M.catarrhalis
GVFATPVGKVVRQIGQSAQKNIFIHLGLGDIVNDFTALLWVLLGMLVWFGERIFHRLNLAG

SEQ ID NO: 2369 - protein, 215 aa, M.catarrhalis
YPHFIKLRSHGVIMPAEWSAIVYLLASLGLVVFMLVVPRLLGGRSSGSQKQENFEAGVVSAGTARIRLSAKFYLVAIFFVIFDLEALYLYAYAVSVREVGWAGFASAFVFIAILFVGLVYEMRLGAMNWAPADKRIKKKRILSRPADFDLTAITAFHGIDELHTDPTGKVPAQSSGRIFAGRKGLQAVLDKDSEQMTNIDHINTTGQVTTQDFNS

SEQ ID NO: 2370 - protein, 452 aa, M.catarrhalis
MMSYFGTDGIRGQFGVFPITPDFLLRLGFGAGQVLMRQSLNKRPSVLIGKDTRLSGYVIEAALQAGFNAAGVDVHMLGPLPTPAIAHLVKSFHADMGVVISASHNPYQDNGVKFFNHEGKKISDEMQNAINDQLTALVDDTNASLARLEGIKADAIGKNHRIADANGRYIEYCKGSFPYHLNLSNLKIVIDCANGAGYSVAPRVLQELGAQVIAIHNTPNGININDNCGSTHPNIIQAAVREYGADVGIALDGDGDRIIMADNQGNIIDGDGILYILAKHLKPVGVVGTLMSNVALELALANQGIGFYRAQVGDRYVMQALQERGWSIGGEPSGHILCLDKSRTGDAIVAGLQVLSCIAETGKSLRELVLDYTPFPQTLINVRLTQMSNPYDNDELNTIFKNAEEQLSDQGRLLIRQSGTEPVIRVMVEHQNQAVCQEVAQKLAAEVRRVLA

SEQ ID NO: 2371 - protein, 328 aa, M.catarrhalis
TYYLTLMMTNKRISLAPMIDYTTMDFRAFARLFNPNIHLYTEMISTSAILKGDAKHHLRCHPTESPVVLQLGGSNPDEMAKAVRVTEALGFGYCEYNINVGCPSDRVQHNKIGACLMAEPQVVADMVRAMKNETDKPITVKHRIGIDDCDSYEFMRDFVQTVAEAGCTHFITHARIAWLQGLSPKQNREIPPLRYEEVYRLKQDFPDLTIEINGGISHLDDIKTQLAKVDGVMIGRAFYHNPYLMAECHLLWGSQPPSHRQIFENLISYLKKRADEGVNLAVLTRHYLGLFQGMAGARRWRQDLSGKSVLTVDEIYQSGDRVLSQNGQ

SEQ ID NO: 2372 - protein, 63 aa, M.catarrhalis
IGAQIRTNSANNHMGVLSSTKLLTSIDGMGFSQSLSMATNPLDKMIPTNKTAKALKNAFEFMA

SEQ ID NO: 2373 - protein, 579 aa, M.catarrhalis
WWCNMALEQNWILPALIAIPLIAGFLCWLIEKISDRLPRWIALIGMVITFILTLVLWQQGNFNTLLVTDTAVSGETLPWAAQFILPWIPSFGIKFHLAMDGLSLLMIALTAFLGIMAVGCSWGEIQRRVGFFHLNLLWSLGGVIGVFLAIDLFLFFFFWELMLLPIYFLIALWGHNATGGKSKEYAATKFFIYTQASGLIMLIGILLLVIIQFSQTGVLSFDYHDLLGVNLGDWEYAIMLCFFIGFAVKLPIFPLHGWLPDAHAQAPTAGSVDLAGILIKTAAFGLLRFVIPLFPNASAQFAPVAITLGMIGVFYGAFLAFAQTDIKRLLAYTSVSHMGFVVLAIYAGTLVSLQGLMVQMLAHGLSSAALFIMAGQIYERLHTRDMTVMGGMWGQFRRLAPFMMFFCAALLGIPGTGNFIGEILILIGAFAIHPIFVTLATVSLVMAGLYSLMIIYHALFGQNTTLELVKQNHGTLKDLGKRELVLLLSLAIGLVWLGLYPQPVMDKSEGSMQWIASAYAHDVIMADEPMHGIRLIEGNMGDYMHAHHHQLHGQGYDAGIHHHKGSDGHHHDHQTKQGE

SEQ ID NO: 2374 - protein, 266 aa, M.catarrhalis
ELLNRHLYRTVMQEIIQSIVFIAAAILHGITGMGFPMLGTTALAFIMPLSKVVALVALPSLLMSLLVLCSNNKKGFYQEIVYYLKTYKLLAIGSVVGSILGVKLLLILPVSWLFLLMAVITLYYSVNGILNVCAKAKNIQVVANNKNMVLFGFLAGIIGGSTNAMSPILLIFLLSETEDKNRIAKASNLCYLLAKIVQIYMLKDQYLLLSKSEYGLIFLLSVLSIIGLYVGIWLRAKISPNFFKMLIFIVLLVLALKIGHSGLIKL

SEQ ID NO: 2375 - protein, 270 aa, M.catarrhalis
IKLNTINFFHTSFITTKRKIIMAFKDMTGQKVPNAVFHTRQGDQWVDVNTDELFSGKKVVVFSLPGAFTPTCSSTHLPRYNELADEFKKLGIDDILCVSVNDTFVMNAWADDQESDKITLIPDGNGEFTEGMNRLVSKEDLGFGKRSWRYSMLVDDGMIVKIFDEPEKDGDPFEVSDADTMIKFLNPDWEDKPSVTIITKPGCAFCAKAKEALKSHGVAYEEVVLGRDASMTSVRAITGHDTVPQVFVGGKRIGGSEELETYLASDACAV

SEQ ID NO: 2376 - protein, 1046 aa, M.catarrhalis
TTQNHNKTRWGCNMAVIHIDGKTYDVDGSDNLLSACLSLGIDVPYFCYHPALGSVGSCRQCAVKQYNNAEDYQAGKGRLVMSCMVAPSDDMYISVDDDEAKAFRKSIVEYLMTNHPHDCPTCEEGGHCHLQDMTYMSGHHRRRYRFTKRTHHNQELGPFIAHEMNRCIACYRCVRFYQDYAGGDDLGVYASNNRVYFGRPEDGQFDSEFSGNLTEVCPTGVFTDKTHSERYNRKWDMQYAPSICHGCSAGCNISAGERYGELRRIENRYNHDVNGYFLCDRGRFGYGYVNRADRPTHPLKKVNGQFVKTSADLAVDGVADLLKGKNVIGIGSARASLESNFALKRLVGANNFSTGERAAVKDVVELGVVLLRHEAVHQASLAQIETADSVFILGEDITQTASRVALSVRQAAKNKSRQMASALKTEHWLAEPVKRIGQSAYSPIYVACVADTKLSDIAKVSAVATPDDIAKLGFMVGDVIKAYADTLDEIGKSENAIFAKEKQTDLVIDDDMAMQFLAHHIAYDLIMANRPLVVTGTSLTSKAIVQAAGYIAQTLTAKRAKIAHVEREFIEVQNAKIRDEVARQFIDPDKDAKTDGTHTTERDPNDFEKELSSRLLKTNTLYADKTGVYVAMPEANSVGVNLLGGQAMEEVLAQAFEAVVVLEHDLSNLTPSQFDKLTQKTLIVLDHQSYEWHDKADFVLSSASFAESDGTLVSAEGRAGRFFASYDKKYYEPTSELKDSWRWLHALDNAMTNKMGEPIWRHLDDVIDELVVEYPHLAQIKDAAPESDYRITGLKVAREPRRYSGRTVLRSPISIHEPMQPKDLDSGLTFSMEGYVGDKTNPSLIPFAWSAGWNSPQAWNKYQNKVGGRLKGGDVGIRLFETLPKTQMVFGRVDIDNANVATSIFYGRAVIVPVHNLFTSSRMISRSPVVASQIKPAMWMINHDDAERWMVKVGDKLTLSQHGAEITLPVEVVDYLADGCIGYPDGAVPLMVGIPTTVKKADKDTPVYVPDHQKSMQRLASIKRENIFTPKAGFNNAPFAMNKVGA

SEQ ID NO: 2377 - protein, 619 aa, M.catarrhalis
GGMNLLALTFIFPLIGFLILTMGQGRIGEKPATIIGVGAMGLSAVCAFVSIFGFLTKGQQAMSVPLWTWLSVGDFTPKFGLYLDGLSVTMMGVITGVGFLIHLFASWYMKGEAGFARFFSYLNLFVASMLMLVLADNLLLMYLGWEGVGICSYLLIGFYYQNRANGRAAIKAFTVTRVGDVFLAIGLFLLFVVFGTLDMAAINAKADAMFAVNDPMLLLIVAMLIGGAFGKSAQIPLHTWLADAMAGPTPVSALIHAATMVTAGVYLIARMHPLFVLTPQMLLYWVGGVGALSMLVASFCALAQTDIKRILAYSTMSQLGYMFIALGVGAWQVAIFHLMTHAFFKALLFLASGAVIVSTHHEQNIFKMGGLRHKIPLVFWSFVVGGGALVALPFVTVGFYSKEAILWETYATGHMGLFWAGVFGAFLTSVYTFRLIYLVFFGEQKTHGESLKGISYALPLVVLLLLSTGIGALIHPPLANVLPMSVGSTLTDAKHTAEIIAVGFTVCGLVFAYFLYVINKGKILTKWTNSTFGTACVYWCYHGLGFDALYDIIFVKPFLGITKALKSDPIDRLINILAIGASWGNKLTTKTQTGLLHTHAISFGVGLAVILILALMMVV

SEQ ID NO: 2378 - protein, 213 aa, M.catarrhalis
HAYLRSPLLRNIKMCGLKKNEKDKVSSIQEPAMGYAMELKLRNAHPQNPNKATEKRIALDQKDLVAVEGDLTNVPFDKNLIEYLKKSPEVVSKFNEQKGGIENNTRLTHKDSSLSSEQKEAKVKEALDNALTQFAQEKYKELIENAHDKKSDARNRDLKYVKSGFNYLSGYTATDHDKKPIIVAIMVRCIIKAAKPPKSYHKQVQNIKVTGNL

SEQ ID NO: 2379 - protein, 61 aa, M.catarrhalis
YNFENCVHQMMQTKPYALGLDMRHHGYQRHLCGIWIFGRALIDQSNGIEILEYALCIYPSS

SEQ ID NO: 2380 - protein, 281 aa, M.catarrhalis
DDNDKENIMSDDKAVTLTVLSKTVWSPNLFSFTTTRPKGFRFEAGQFVRLGLCADELIYYQDKHQDTPKSESVSPIFRAYSVVSSPYDETLEFFSVVVADGEFTSQLQYLQAGDQLYLNTIPFGFLTLSRYQEPTPKTLWLLATGTGLAPFLSILQDLYAWEHYDNIVLVYSARTQSELAYQDKIHSLATSFGGLVDNPARFYYVPIVTREKVAGCLSERIPSLINNGELAKTAGVALDTQSHVMLCGNPQMVEDTKEALKAQGLSMNRRGVGHIAVENYW

SEQ ID NO: 2381 - protein, 156 aa, M.catarrhalis
LMVEYAKIRLMSVCANAQKLATSMDNAPTPPTQYRSIWGVSTNKGCMRAIKYTPAVTMVAAWIRAETGVGPAIASASQVCSGICADLPNAPPISIATMSSSMGSLTANMASALALMAAISSVPNTTNSKNSPIAKNTSPTRVTVNAFIAARPLARF

SEQ ID NO: 2382 - protein, 70 aa, M.catarrhalis
LSFWIYRHRPRQKTNYRGYYGALYYKGSETAKELPQTSAKYKGYWELMTDATFDNKYTDLPGIARQTQWG

SEQ ID NO: 2383 - protein, 491 aa, M.catarrhalis
GHLWPCAAVRGRSIIGAICMNKPNVSEQIDARKNGLAPSQLNRQKTPIWGVGLADGQAPTSLTHPLTWRLYHHDALLTLADYEALDGFVGLKNALTKSPKEVGEMIKTANVRGRGGAGFNAGLKWTFMTPPDGGVRYLICNADEMEPGTFKDRLLMERLPFQLIEGMLISAYAIGASVGYVFIRGEYVLAAKRLQNAINECVANHLLGDGILGTEFNFTLHIHTGAGRYICGEETALINCLEGRRANPRTKPPFPQVSGAWGRPTVVNNVETLNNMPAILLNGVDWYLNLPKAKGKSTTPGTKIMGVSGRVKDAGLWELPFGHTARELIELAGGMQEGLSLKAWLPGGASTDFLTASDEHLDLVMDFDPIMKAGSRLGTCLMMVVDESQDMVSLSKNLQQFFQRESCGWCTPCRDGLPWGVKILDAMDNGQAQADDIDKLSELTRDLWLGKTFCAHAPGAMEPLMSALKYFRHEFEQKVNNSKPQQNKVGV

SEQ ID NO: 2384 - protein, 63 aa, M.catarrhalis
HRQCHCFVITHDVLFVIIILITNVILTDIGLLLCILTDNLALVKSSVTHQIQKIALIAFKIIT

SEQ ID NO: 2385 - protein, 342 aa, M.catarrhalis
MSIRVIPDVPSWLGAWSFEWWSFVFMTVQTLIIFLGLVMTAALMIVYERRMLALWQDRYGPNRVGWQGSLQLVADMLKIFFKEDWTPNFADKRLFTLAPAIAMFGALASFAIIPLSPTLGAADWNIGILFFFAMAGLAVYAVMFGGWASANKFALLGGLRSAAQTISYEVFLGLSLMGVVAMTGSFNLREIVLAQADVWNVIPQFLGFLTFCVAGVAVTHRHPFDQPEAEQELAEGYHVEYSGMKFGMFFIGEYVNVVVISALMTCLFFGGWLAPFNLDLPFVPPVFWFLIKTLFFMTLFVLIRGSLMRPRYDQVMNFGWKVCLPITLLNLLATAFVILMVN

SEQ ID NO: 2386 - protein, 516 aa, M.catarrhalis
RPVLDHLSIDDIAEKLEIAGPGFINIFLKNEWISKHANQANISRTLGVNAAQNDTVVVDYSSPNVAKEMHVGHLRSTIIGDSVVRTLEFLGNTVIRANHVGDWGTQFGMLIAYLEKVQNDDVKDLDLSDLEAFYRAAKHAYDSDEAFAKKSRNYVVKLQSGDEYCLTMWRKLVDITMAQCQHTYDRLNVTLTRDDTMGESLYNPMLPSIVQTLKDKGLAVEDDGAVVVFLDEFTNKAGDPMGVIIQKKDGGYLYTTTDIAAAAYRYHTLHADRVILFTDARQTLHAQQAWLITRKAGFVPDEFVMEHFTFGMMLGKDGKPFKTRTGGTVKLADLLDEAIERATTLIEQKNPDLSAEEKLAVVEAVAIGAVKYSDLSKNRNTDYVFDWDNMLSFEGNTAPYMQYAYTRIRSIFARAGLDMADIGGEIVIHEDKERALAVKLLQFEEVLLLVAKDGMPHLLCQYLFELAGIFSSFYEACPILSSDDKTKTSRLRLAALTAKTLKQGLQLLGIKTVEKM

SEQ ID NO: 2387 - protein, 235 aa, M.catarrhalis
NNASLLTSKIKTMKYTLTKPNQHTKQYPQQSREIIDDITQAEVDKNVFLGRLSDLTHNLANWGRKNSLWPFNFGTSCCYVEYATTLTGVHDLSRFGAEVIRASPRQADVMIVAGTCFVKMAPVILRLYEQMLEPKWVISMGACANSGGMYDIYSVVQGVDKILPVDVYVPGCPPRPEALIQALMLLQNSIQEERRPLGIHLNEQGVIQPIMTPERDHKMADRIATVNLRSQDDAF

SEQ ID NO: 2388 - protein, 416 aa, M.catarrhalis
QIHRFARYRQTNPMGVVWFLLMSMQHSCQPKIPSPSNYNGAYGHSSEFDVNFANKKVTGKLISNQLSGKTVTAKERYKIEADIHGNRFRGSAIASEKTDESKSKHPFTSDAKDKLEGGFYGPKGEELAGKFLTDDNKLFGVFGAKQEGEAKPTEAILDAYALGTFNTNDATTFTPFTKKQLDNFGNAKKLVLGSTVIDLVPTDATKDVNEFTKNKPESATNKAGETLMVNDKVSVKTYGKNFEYLKFGELSVGTSNSVFLQGERTVTTGEKAVPTTGTAKYLGNWVGYIAGKDTGAGSSKGFTDAKDVADFDIDFEKKTVNGKLTTQGRQDPVFNITGQIAGNGWTGTASTAKANAGGYNIDSSSSTNKSIVIKDAEVTGGFYGPNANEMGGSFTHNADDSKVSVVFGTKKQEVKQ

SEQ ID NO: 2389 - protein, 548 aa, M.catarrhalis
LCKRWCKKIGMVLSGVVMVLLMIITTPSHATAKLLPTSQENPTKTMVDSFGRETPRGAVQGLLRAIAAEDYELAANYLDGRYLAKTQTPNREIVEHLVVALDAGGKLYPDLQISHASEGDLSDNLPSDIDKVGELHLMNEHIDILLNRRVTDDDMVFWQVSSQTLSSLPKMTTHAQTLSERLGLSDDTTHAQTKYWLELSALVLLVTVLYLAINLAVWILYWVSKGLYTTLTKKPFRIMPSVIMPLSLVVLSLILPIIMISVGVPLTLRSSFGRIKDIVAWGATAWLMLRLLDGIFRRAEANSLKRGRPEQVSILNLLRKVAKALMIILAVILIFGNLGFDLTTGIAALGVGGLALAFGAQKTLENLIGSVVVVADRPVYVGDYCKFGTYEGTVIDIGIRSTRIRTLNRTIVTVPNGEFSSLQIENFTARDMFYFLHDLFIKRTADLAEIERMITNLQEFLATHRLTNHEWNQVWIKQLRQECYVIEMRAYIDADGAQDFYAKQSVLILEILKFLESYHIEHALPSQSITVHQNHDQTTPKHEKNPKT

SEQ ID NO: 2390 - protein, 584 aa, M.catarrhalis
IRMSINHTHDFGVLEELTANNHTYITQSTADGIPTIWVACDELLDVLLFLRTLPKPFVMLVDLSAIDERLRQYRHGLPDSDFTVFYHLMSLERNSDIRIKVALKEGEHVPSATKIYPNANWYEREVWDMFGVVFDGHPHLTRILLPKYWEGHPLRKEYHARATEFTPYFLNTAKQEFEQENLRFVPEEWGMKRSGRDEDFMFLNIGPNHPSAHGAFRLVLQLDGEEIVDCIPDIGYHHRGAEKMAERQTWHSFIPYTDRIDYLGGVMNELPYIMAVEKLAGISTPERANVIRIMMSEFFRITNNLLYWGTFIQDAGGMTPVFYMFADRQKAYDVIEAVTGYRMHPAWFRIGGTAHDLPNGWQRLVREFLDWMPKRIDEYVKATMTNSVLKGRTQNVAQYDAKHALAWGVTGAGLRATGIEFDLRKARPYLGYENFEFDVPVFYNGDAYDRCLVKIEEIRQSLRIIEQCLNNMPSGAYKAEHPLAVPPPKERTLQDIETLINHFVSVSWGPVMPAGESACMVEGVKGLNSYYVISDKSTMSYRTRIRTPTFAHLQQMPSVINGSLVSDAIIYLASIDIVMADCDR

SEQ ID NO: 2391 - protein, 294 aa, M.catarrhalis
LVFGILSIPKTESANDAFWQPLQPYQNCYISQPFNQFICIFYVDCHTVIWQNKNRCYQIYHIALYQEYQGKFMLTSTLKTAVVNAVISGAIMASVMMPVALTTVAHAAAASQSQATKNLNSQLSGIRSMTANFSQTTQAGNKKTNFTGMMGVQRQNQFRWETKSPAEQLIVANGNTMWIYDKDLQQATRQSVGSQIGEVPALLLSGDPSQIDRHFNVSQPDANKNYFILTPKSSNANFGSLSLSFNGGRPVMMVLQDSIGQTTTIQFSNIALNKKLPATQFNFTPPNGVDVINQ

SEQ ID NO: 2392 - protein, 62 aa, M.catarrhalis
KTEGLNSYYVISDKSTMSYRTRIRTPTFAHLQQMPSVINGSLVSDAIIYLASIDIVMADCDR

SEQ ID NO: 2393 - protein, 416 aa, M.catarrhalis
GLFMSAIIAIPKTLKTIIFYGVAFGSFRMLIGGISTLYLLSKNIDLIDLGLLKSFQFGLMMIIDLPLSYIADRYSRKLSTILGILFGSFWLLTTAFASEIWQFYVAEAFNAISLSLFGGAYISYLIDIKNKQYPDLDNKTLLSYDNKYNSLGMAICAFVGASFLEPASNIIWIIAGTLLFIVSMGAFLQLPSDIYQSTHNNISDLKINTPNFSENLGRLISILKTKQEICYGLIVLSILLIYFQTILQLWQPVIKNFNTGNLGWIYGMFFSIVSLAQLLSSYAINSNIKNKYTYILICLFLSLLLMLSAITLFQHSTKGVVLIVISLFIMFFGIKFLMIEASAKFHDIIPNNYRSLLDGMAFFISRTILLIIFPAITYLIQKMGFIALPLIFSILITLYMFIGHQFKTNINNNTSV

SEQ ID NO: 2394 - protein, 313 aa, M.catarrhalis
IIVIKTLNQDDLMTLTQIHQLNKLPKSIKTGKPLLHFVHANGIPTPTYQVMLDRLARYFTIVSINELGTHPNYPVDHHWQSMTHQVGDSIDDACREHGVSTLVAVGHSLGAMTTLQTLIANPKPISQAVLLDPSLLTARSAFLYHVAKTMDKYIGRIPKFQYHLIDQLTPAQKSKYRKDVFDSRDDAYQALRHKALFASFDERSFQNYIKYGFKPTADGKYTLSIPKSVESAIFRTMPSLYWLKSISPAKPVALIAGQDSDFTKIGSYDDAHKKFDIPVYYVLGSHMFPLEYPEQTADDILNTLIEQLQLECH

SEQ ID NO: 2395 - protein, 78 aa, M.catarrhalis
FFTIKGYAMKQIKIKIEGMTCGGCVSSVQKALQAVVGVEAISVSLEDGLAVVAYDESDCDVPAIVEAIEEAGFDTQLV

SEQ ID NO: 2396 - protein, 145 aa, M.catarrhalis
HALMSPLIHGQIKTKSNRREPMQNYNVDTLNTPFAHEVAKLASDMGVPAHHGLILAAILFVIGLAGVMARRNVLFMLMSLEIMMNSAALAFVVGGNMWGKADGQVMFVFILTLAAAEAAIGLAMLLQFYHRFRSLDVNHASELKG

SEQ ID NO: 2397 - protein, 174 aa, M.catarrhalis
MQKVTMKIVTDKTPKVDIHAILTPQEIDGIHHHIHHYPQPRAAVLDALKLVQKRNGWVNDAQVVAIANMLGISVADVEGVATFFNRIYRLPVGRHVILVCDSIACYLTGYETLLAEFKAQLGIEFGQTTADGRFTLLPICCLGNCDKGASVLIDEDTYGPVLPSEVGLLLEQYV

SEQ ID NO: 2398 - protein, 101 aa, M.catarrhalis
LMLSKLIPDIITPKDIPKGLILLLIVACLLVGLSGLRYGGVEGWLHVLENWLVALVVIPALTALISLPLKWRDSTFDVRMVYYSGMFVALLFMLAKLRYWR

SEQ ID NO: 2399 - protein, 939 aa, M.catarrhalis
KYESPKNMGGSYFLNCYHGLCYNTLLFQTKIWTFMTQHRPSYFADLKNFDVNEFTVIVTCADGLEAALQIELNSFGLSSDVLRAGRVAVIVDLAKFYHICLYSRVASRVLLPLGEYHFKQKLSQATTNQPVEVLDEDVPEALYQFASRIDWINLFGLEHRFAIRLSTDKRLSVNQQFATLRIKDAIADTFNRAFGARPDVDAKQPDFQIFATANHKFAEIFLDLSGVSLHRRGYRVANTAAPLKENLAAALLYECGWHQGIHDAIIDPMCGSGTFITEALLMRADYPVGLEKAADEFGFYCWQHHDDKLWDEMVSDATQRFHACLSHLQNNPLTVIACDADAYVVQACHKNLIAAGLSPILDQVTLAQRALYRLPKLLSTLTCSKPLIITNPPYGERLGDTDFIKPLYHGLGLHIAAAMRSVSANTGQAIDATIAVLASHVEYADTLPIINPQTLRCHNGALTVYFRHGELNLSEPSDLIFEWQKQEIIHPDAQDFINRLQKNLSNLKRQATKIGVTNLRVYDADLPNFNVAIDVYGDKIHVQEYAPPKQIPADVAKTRFNLVLQAVREVFGVPREAIFIKTRAKQSGNEQYTKNDNATKRKKMWVVRELGAYFYVNFTDYLDTGLFIDHRHMRAKIGDASRAKRVLNLFSYTCTASVHAALAGAKSVTSVDLSANYLDWGKQNFALNGLVLDAFYDDGERYQFIAHDVFEWIKHHTEQYEVIFIDPPTFSNSKKFKGTFDVQRDHVALINRAMNRLTSDGVLYFSNNYTRFEFDESLMARYDVKDITHETIGFDFDLKKPIHRSYEIRHKNAVKSMTVITNKTMDQNAQHHMPKNHDQPKRFTKTRNQSTDKKPHQKFAKDGKKSHTDRFGHFDKSAKRATPNARRSNHSEHTPNQPSIKRVYVNPKSADENLAKRLTDKLAEANLQGEKRYTIKKKS

SEQ ID NO: 2400 - protein, 293 aa, M.catarrhalis
IIMSIENILIKQLKKYSWILLIFVLSEMTAFGHQKEISNIINNDTANVSTQPSKNHSNQAWLDDQQEVHGVFDQSSTKLKSIPKKYTPKPEKIHPEVYNSLIDMIDKAQKDNIKLSVVSAFRSYQRQKQIWENKWGNRPNDDINHAKNILKWSAFPGTSRHHWGTDVDFNSVETAYWKSKEGVKVYNWLQNNAPKYGFCQTYDDGRQHGYNSEPWHWSYMPVADRYLAQISNPAVLEVVLNQGVKGSEAVRQSGDLMNYVTSINACQVTYPHNQQQNIQTPQDLPPNDTNQSE

SEQ ID NO: 2401 - protein, 89 aa, M.catarrhalis
NMVYFTASAFIFQRKFDANKLGLLNSTFIPNKPQRFYLLGVYFNDKHLPTDKSAISSDNINQIQADAPLHLIYELLAFLDQYKHQSYLC

SEQ ID NO: 2402 - protein, 63 aa, M.catarrhalis
INDYTLKQSCQWVKLTKLMANFYPLKSTKYWLNLLTVLTLLFMIGTILIGGILSQVDIFRYES

SEQ ID NO: 2403 - protein, 517 aa, M.catarrhalis
LVFHEKIIMPANQLPSQHYFSAILITSLIASVAFFDFAIFIYLSDLLRQIFFGGTEYTWLSRLQLFGLFSAGYIARPLGGLMIGYYGDTKGRRPALFISLLGITIFTLFIGLLPQYSQIGFIAPIIFIVARVIQSLAIGGIMPSVWVYVTEHLPTRHIGVGCGAILSGCVLSLIFLILLMNWLDDTLTWAQMMSFGWRIPFICGGLLSVILILISYKHLQETPIFLEAHSERSFRPKHESMLSNMSLSTLTNSQIKQLDHLPAIEFQLSEDTKMPDHSISPSSMTPPPKINEIDQRTVTTAMRLTSKLTSFARSSISFFQIICNKNMLISIIPAIMLISIMVSLLIFTPILLVDLIDGSFRISETVLWFGNVLAILFMAIGCLIFGILVDRLNPGIVLTFGSLFLAMQVALFFNHLRNGGEYGLIFFALFGFASGIIGAIPSVVVRLFPAKIRLTSVSIIYNIIIALIGGLLPFVLHSASAHIAFAPMIFIVSLSLLTMFISFYIYYIPRTDLDMNR

SEQ ID NO: 2404 - protein, 275 aa, M.catarrhalis
LNIQYKNRYIIMSYPNQNLPIIHALWIGDTLGKLSAACLSSFVQQGHRVCLHAYTPISDVPSGIDICDANLIIPKEKIIKHKATGSYALFSDIFRYELLNKTDHGIYVDCDVYCLKPITMPNHGYLLGYEDDTKINGAILALPKESELLHALLKSAYDPYFVPPWYKSRKQKILKIRKQFGFSRHVANMPWGVIGPDAITYYAQHYQIAHFAQSIDVFYPIHHHCIGHLLNSRLSIKDIITPDTLCIHLYQERLRHLDLSCLPQNCILDKIINSH

SEQ ID NO: 2405 - protein, 543 aa, M.catarrhalis
VMTHHFRSLFVISIHTVMLVLLVGCKNLPDTPHLPKSLALTKQVQERHQMVKHGGSSDGLISAINAQSHHHPNQSGYYPITTGANAFAARSTLTDVANQSIDIQYYIWHNDEAGQLMLKDLWEAADRGVIVRLLLDDFNSSPELDQLLLRISKHKNIAVRLINPMPYRGFRSLNYMLHPIRTNRRMHNKSMTFDNKISVIGGRNIGNEYLNNAPVNHFADLDVMLVGHVVGKITQSFEIYWASPLSFDIETLVKHDNKDDISGIKPVVFDELEKVKDSSDADRELRTYRQAMQNSTIGQDLLAQQVPFFWTEIDLIADNVIKLNGHSDPNEFLVSQLQTQLGQPSKKLSIISSYFVPTKEGIDTLITLAKMGVEVRILTNSFDATDVGIVHAGYAHWRKQLLAAGVHLFEIKSSAQSIQDNENRFWRTRQHSTTSLHAKAFAVDDDQIFIGSYNVDPRSANINTELGVLIKDSKLAGQLHKALSNSQAITHQAYELKLDAKGNINWHTIENGQPVILHHEPHMNHKDRIIIWLAGLMPIDWLL

SEQ ID NO: 2406 - protein, 476 aa, M.catarrhalis
IKNQECTMSNKLFDLIESSGAKWVDFRFTDTHGKELHLTFPASTVDEDTLEDGKMFDGSSVAGWKGIESSDMILLPDAKTAYLDPFYESPTVVVSCDVIEPATMQGYEKDPRSIARRAETYLKSTGIGDTAYFGPEPEFFVFDDVKWQIDESGAQHSISSEAASWSSNKEYAWGNNGQRPALKGGYAVTAPMDYYHDMRAVMCDRIEDIMGEGRVEVHHHEVASGQLEIGVSFNTLVKKADEVQQFKYVVQNVANQFGKTATFMPKPIVGDNGSGMHVHISISKEGVNTFSGDEYAGLSMTALYFIGGIIKHARALNAITNPTVNSYKRLVPHFEAPIKLAYSASNRSASIRIPHVSSPKAVRIEARFPDPAANPYLCFAALLMAGIDGIENKIDPGEAADKNLYDLPPEEEALIPTVAENLETALKALKQDHAFLLKGDVFSKDMIDAYIDLKMQEVHKLNEAVHPLEFDLYYRC

SEQ ID NO: 2407 - protein, 255 aa, M.catarrhalis
TMIQNFVISVKTATKRREHIMCEFGKQGIAFEFFDAVTPTDISKYAQKLSIPIINNQRLTDGEKACFLSHVALWQQMIDENLDYMAIFEDDVYLGNDSQQFLQELTIWLQQNAVDVIKLETWVEKIHIKKAVTVLNHRQLCPLKTFHTGTAGYVISQQGAKIILDYLSTLDAFEFFPIDHVIFDAIISKMSVLQVNPAMVIQAHLVSEDDTFKSLIETQRKQNVNQHRRRTLADYGKKYYRSIGKRTFFQRIAFQ

SEQ ID NO: 2408 - protein, 354 aa, M.catarrhalis
YHQQLRKFMSDVRHTQMMEFLNANLATDFRVESLSGDASFRRYHRIYLPMRGEVGGHEMTYLLMDAPPDKESIQDFIHVAGIMSETVNVPDIMACDEAMGFLLLQDFGTVEFAHAIAKDTDNKDGYYTKALQTLAQLQTIKGADLPKYSNEKLAQEMDLFSEWFLPYLGIGLTQKDAQKWESLKQTLIMQINKQPQVIVHRDYHSRNLMMDKGSDHLGVIDFQDAVIGAYTYDLVSLVRDAYIDYNEVWAQKRMHEFYQLIKPSVDLGTFISQTNIMGIQRHLKVLGIFIRLSERDGKHRYLKNIPKVMSDLVAELSWLSERSHDAIYGEFMAWLKNSVLPAYSTKFGYLSERL

SEQ ID NO: 2409 - protein, 60 aa, M.catarrhalis
KIILSIWCNLMTLMRDIEQILRMAWLVLADLDLRVTLTDWYHLAGDLEEFVYFAVDCVDM

SEQ ID NO: 2410 - protein, 80 aa, M.catarrhalis
PSTKTSVALPEPTIAGTPNSRAIMAAWQVRPPRLVIIALARFITGSQSGSVISETNTSPSCTLLISVKLVTMRTLPLPTR

SEQ ID NO: 2411 - protein, 346 aa, M.catarrhalis
PRTKRNTESTHPISFGGLTMKILHVLLTSLPIPPNDYGGTERVLWALYQGQTALGHQVRFLLKANANHAPYVQVFDESKPLHEQIDDWADMVHFHFPYEGELHKPFVCTEHSNSEVEKEFPINTIYLSSKHAENNHATCYVHNGLYWPDYGEPNFKPKDYCHFLAKASWRIKNLQGAVRIAKKANKPLHILGGNRFNIRRNPYCYLSSRLHFHGMVGGVKKNELIANSQALIFPVLWHEPFGLAVIESLYLGCPVFATPFGAMSDIVTQEVGLLSDSYAVLSEALKDVAQFDRLACHEHAKRHFSHLSMSNAYLDCYEKVLAGETLNAVKPKAKPDIKARQMMQDG

SEQ ID NO: 2412 - protein, 811 aa, M.catarrhalis
HHAKVFVHQSELTMNKQVQVITFNQLGKNDVDIVGGKNASLGEMISHLGGLGVNVPNGFATTADAFNRFLNETGLLDKINTELKGLDVDDVDLLTQIGAKIRSWIIEQELPKDLENEIRTAFAELSKGEDIAVAVRSSATAEDLPDASFAGQQETFLNIRGIDNVLIAIKEVFASLYNDRAIAYRVHKGFEHAGVALSAGIQRMVRSETGTSGVMFTLDTESGFNEVVFITASYGLGEMVVQGAVNPDEFYLSKVLLEQNRPAVIRRNLGSKQKKMIYGDEGSTTKSTKIVDVDKAERHQFALSSEELTRLAKQAMIIEKHYGCPMDIEWAKDGDSGEIFIVQARPETVKSRQDKNHMERYVINSKGAKVLTEGRSIGQRVGSGKVRIVTNLTEMSKVQDGDVLVSDMTDPDWEPVMKRASAIITNRGGRTCHAAIIARELGVPAIVGSGNATEVLVDGHEVTVSCAEGDTGFIYEGILDYEVQRNSISTMPELAFKIMMNVGNPDRAFGFAQIPNQGVGLARLEFIINRMIGVHPKALLNLDTLPQETVQAVQERMAGYNSPVEFYINKLIEGISTLAVAFRDKPVIVRMSDFKSNEYANLIGGKLYEPSEENPMLGFRGASRYVSDNFRDCFELECRALKYVRDDMGLTNVKIMIPFVRTTGEAKQVIELLEKNGLKRGDNELEIIMMCELPTNAVLADEFLKYFDGFSIGSNDLTQLTLGLDRDSGIVSHLFDERDPAVKKMLSLAIDACNKAGKYVGICGQGPSDHADLAYWLMEQGIDSVSLNPDSVLDTWFFLADKNNQPADDYA

SEQ ID NO: 2413 - protein, 166 aa, M.catarrhalis
IGYNNFLANAVNFMTIQTTKKVALINGPNLHLLGIREPEIYGSVTLTDITNRLTSQAISHGIELIAYQSNHEGAIVDFIGECGLLSSDPVDGVIINPGAYTHTSVAIRDALSAMDKPFIEVHLSNIHSREPFRSHSYLSDKAVGVICGLGDMGYTMAMDWFIKHLN

SEQ ID NO: 2414 - protein, 202 aa, M.catarrhalis
NMSNSDTVNFIHDYEILSKHYAEIISSAGEDLTRDGLIDTPMRAAKAFGYLTRGYHQDLATVANNAVFDSDNPELVLVQNIEFYSLCEHHLLPFYGVAHVGYLPDGKVLGLSKVARIIDMYARRLQIQENLTKQVASAIEELTGCRGVAVIMDACHMCMMMRGVGKQQSTTRTTSMLGEFTTNHDARREFLDAVPRRMPAFG

SEQ ID NO: 2415 - protein, 378 aa, M.catarrhalis
IMTNSHIEHSQAKTTDEQHIADVLLGKSVHITEDGDDGLPPDDEPHELDDGITSGRFKKLQKKLRKEVSWAIRDFKMIEDGDVVMVCISGGKDSFTLLDILLFLKRIAPIHFEVVAVNLDQKQPGFPEEVLPRYLSEQGIPYYILEKDTYSIVKSVVPEGKTYCSACSRLRRGSLYGFAKQIGATKVALGHHRDDILATFFLNLFHGGSLKAMPPKLLSDDKQNILIRPLAYVAEKDIIRYANYKKFPIIPCNLCGSQENLQRAMINDMLREWDNAHPKRLASMFKALQNVAPSQLADRNLFDFEHLTLDRNDDERLFEGDNIQSGVTDELDKMGLPINPLVQSFNPKFQQEGDNSDERQKTDQKDKPYKIPIINPLV

SEQ ID NO: 2416 - protein, 169 aa, M.catarrhalis
NLMKLIFFANVVFIMVMLVACGDEPAVSTSAKTATTDPKQDFYIGCYTIDKNTPASIKISQAQGGYKMQMKEPNDAAKAWDTPEPLLVLTKQDGWKYFSTNAINLSVNDITDQVIVRPDGLLVIAKLHDASTNTNPMLDSRYAVALMGAVNTIYQVACDDKRINLIQAF

SEQ ID NO: 2417 - protein, 107 aa, M.catarrhalis
RVRKNGMGFLGYLLMGGIVYTIGFFINLKRLHPKRQAGAVICVTHPIMIGYLLGCFMIMLGVSVLLGRFVLHHDGPDWAFIGVNSLVATVVFYFGLNPDTTKMNLPD

SEQ ID NO: 2418 - protein, 168 aa, M.catarrhalis
NNDEMAIIMTNQISQTMENCQTMNIAECLSFVDDWVYQASDSDEKATLSILHDLFFQKNNGPGDKTLNEPLASSLFSVKWILQHLRDFAQQVKRAIWAAILTPIFKKGPVFQGLTRHGPTLCEGRLMPPKPQVFSGITPPKNKEIGGPKKTLFTGWDPSPAHFKKTHK

SEQ ID NO: 2419 - protein, 60 aa, M.catarrhalis
FEQDTYQRLAYMTNAKVQNYIHVVYHRHKFDKIHIWVHYFAANYKPLHLLLISNRPFPHY

SEQ ID NO: 2420 - protein, 301 aa, M.catarrhalis
VYICTNYIPHFKILCYNGKNFYQKDKVMLLKGQRFVVTGIASKLSIAWAIAESLHREGAQLILTYPNDKIKKRVDMAAEAFDAVAVIECDVGSDESIQVCFDEIAKHWGVGDDKGIDGIVHAIGFAPADQLDGDFTQATTREGSQIAHDISSYSFVALAKAGRELLAARQGSLLTLTYEGSISVLPNYNVMGMAKASLEASVRYLASSLGGEGIRVNAISAGPIRTLAASGIKSFRRMLDVSEKIAPLGRNVSQEEVGNAALFLLSPWASGITGEILFVDAGFNTVAISEKIMMMAGDGEQ

SEQ ID NO: 2421 - protein, 249 aa, M.catarrhalis
HQIWVLIGAVMIQQAMILAAGKGTRMRPLTLTKPKPLIPIAGKPLIVWHIERLATAGVHRIVINTSYLSEVLLTELKTLNLSKKFGIEILLSIEQGEPLETAGGIRFALDQGLLCDLPFILINGDIWTEFEFDRLVHHQLNKHLAHLILVDNPKHHPEGDFGLIKEKVCLKSDDHTALTFAGMSVMSPKIVASLNQGQIAPLAPYLKSAINQQLVSGEHMTDHWMDVGTLDRLAKTEAYVQNKYANAKK

SEQ ID NO: 2422 - protein, 312 aa, M.catarrhalis
LPSCTLGYFMIVRDKSNSFKLLFAWRGTVLPKVLPTILGIMVLSFIAGFVAQFQWYYIATVPAVGFTMFGVIISIFLGFRNNACYDRWWEGRKLWGALVANTRHLSRDSHFLAPNERESLLYQMLLFVAILRDRLRGQNIQRSQFGYTKIDDHYLDWLDQQINAPQRVLEAMQQQLIKLVQQGQMSDVIYMTIQKHVIEMGGIQAGCDRIHSTPLPFPYSALLNRPVYCFCWALPFGLQAVMGFWTPVLVGFISYLLLGLDELARQLEEPFGFDHHDLALDMMVRMIERETLMLMDKPLPKPWEIDKNFNMS

SEQ ID NO: 2423 - protein, 220 aa, M.catarrhalis
LPHRFCLLILPGLGADIKSVLEAGADVVHFDVMDNHYVPNLTFGSMICQALKDYGITAPIDVHLMVKPVDGMIEQFLKVGADIITFHPEASEHIDRSLQLIKDGGAKCGLVFNPATPLYYLDHTLDKVDQILLMSVNPGFGGQKFIDATLDKLAAVRQMIVDSGRDIRLEVDGGVNVANIRTIGEAGADMFVAGSAIFNQPNYKAVIDAMRDELSKVNRS

SEQ ID NO: 2424 - protein, 64 aa, M.catarrhalis
ITIFIIFLVIIIYDDIISFYYDILVRSITVIVIKKIALTSAISVKKYQNFTQSIRQIHLGRVRI

SEQ ID NO: 2425 - protein, 462 aa, M.catarrhalis
QPKLISVKFSLKNKSRCGKINHILPHLTIMTIQNHPADNPPSSWAYPKSQIKQYDIAIIGAGVVGMVCAILLAKRGKQVIILDNKPAPSKASFDQRLTQRDARVYALNLSSIDLLKSADVWDGITRRADYDQMHVWARDDFGELIFQDEHAFENIMLGSMVEPSVLDEALWHRAKAYENLTLKYEISLAAHGMAFDEMPDGVCIRYQADNQAKMVKAKLLIGADGRASLVRREMGVGVDTLNYHQKAICCAIRTDQPHGNTARQVMLPTGTLALLPIANLNQDDQCRWQSIVWTLPKQIAETYLSDYHQNPDSLINRLALASGYVLGDIHKIQSVASFPLSAQAANRYHKGLIALMGDAAHEVHPLAGQGLNLGLSDVKALLALVDVYHAKNMPLSTRLLSDYERTVKGHNSLMMHSFSMINFAYTSALSNISVIRHARSEIVKAISKSPSVMRLLIGRANR

SEQ ID NO: 2426 - protein, 249 aa, M.catarrhalis
VKISKLIKNGLVFGNFGVKLDKFLLEIVMTATDPKLTQKKSAAKAALSHIEDGMILGVGTGSTVNCLIELLPKVRLKGAVASSQVTEDKLKALGIEIYDLNQLGVLDLYIDGADEIDAKGNMIKGGGGALTREKIVAAASNRFICMVDDSKIVNTLGKFPVAIEVLPQARSYVARELVAMGGDPVYREGFVTDYGNVILDTYDLDITDAAKMEFTLNNIVGVVCHGIFASQSADLMLKAGSTGVDTVVF

SEQ ID NO: 2427 - protein, 430 aa, M.catarrhalis
PTSRRLRINSSNFTPLRYVTLRVLCLFFLLDCILLYLTLFISRTIFVMTTPKIAEFFERILKELYQNIYQLFGGSLDDQKLTLAHIGLSILSSGIKIIILLLLVGFIYWFLVYTVKTVRKLFGLPYRYTRIARATLRYLWFMTSLLAVMSQIGITDKTVTATAKAATWAGFYYVLWALSGQMVSSVLKHYDLNASIEQLLKNLLLVMILALAFATVMAKFGFDIFSIVAGLGIAGLAVGWASQSTLANFIAGVVILVEQSFQVGDWIRLGEKEGRVVKISLRATQILDRDNIIIIIPNSTVASSEVVNLTSKKMIRFDVKTRIGLHADITAARSVIMKTLQKDEVVLKHPAPLATVSEIGESGIYLIVRFWVAPLSVARIPIIKENINEKIKRALDESGIEVPFPYMKLIMTADGDQAQRFKFEDDEQKI

SEQ ID NO: 2428 - protein, 627 aa, M.catarrhalis
IQFGKSMLHNLTFGLFSKKDTASFMQLMVYVKPYKMRIMFALLAIIGVAFTESYLAAFIAPLVNQGFVLPDGTDMPMLIGDGILENLKYYIDSFQHAIWGTKHKVWVVPLFFMSLVIFRGICRFISAYLMAWVATTAIGHLRQDMFDKMLLLPSEQYQSMSSGEMLMNMVQMVENSINHASGIFIVLTRDTLIVIGLVCVLFYLNWQLALLIMVMFPILSGLSRYYRNRLKGVINNAQKSIGSLNTVINETHQGHRVIKLFGGQQHSANKFNQVNTLIVQLGKKISQADAARSPISEVVGSTALAVVIFFALWQSQQGMTTIGEFMAFIVAMMQMFGPIKNLANISIPMQTMFLAADSVCAFLDTKSETDQGTTKLSNVQGYIHFNHISVQYGNETTKALDDFNLNIRPGEKIAFVGRSGSGKTTAINLLPRFINPVAGEILLDNINIQEVNLANLRSQFALVSQEIFLFDDTLFENVRYSRPAATEMEVMAALQAANLSELVHKHPKGIHQPIGTNGSLLSGGQRQRVSIARAILKDAPILLLDEATSALDNESERLVQQALERLMTGRTSIIVAHRLSTIEQADRIIVMDGGKIIEEGSHTELLAKGGYYAMLHNTSNAICGQSI

SEQ ID NO: 2429 - protein, 64 aa, M.catarrhalis
QLNGMGDHTKNWIFGPMFDVIGTILLTTNLTFYESFKSLLLFAVACHHHDFFTDGNGIKACIHK

SEQ ID NO: 2430 - protein, 124 aa, M.catarrhalis
VIKGKSIMTIPHHQAQTTHHNPPKPNKPASVVPMGFTIGLCLASLLLSLAGYGFRLMFGDEMSEVLRHAAVVVPVFVIGIPLMTWLGATGLNKLGKTNIHPRNAWTFGWLLSTVAMLSIMGVYS

SEQ ID NO: 2431 - protein, 525 aa, M.catarrhalis
GLFMSKKPKTTQDTDPVALIETAPQTKKSQTFEHVENDQTHPSLISPLDGQRVGLDRSNKNKIKHNYEYDAIVIGAGPAGEAAAMKLAKSGHRVAVIDPRDQVGGNCAHVGTIPSKALRQSVFNIINFRRDPLFKQNKDSYQVPLSKVLSRAREVIRHQVNTHKLFYERNQIQVIHGWGSFIDAHTLEVYINDQEPTKTITFNQAIIAVGSRPYRPEILDFDHPRVFDSDKILQMDYIARKIIIYGAGVIGCEYASIFTGLGYVVDLINNKDQLLSYLDKEISDALSHDFRQFGVRIRNHEEIDHLETHDDCVVLHLKSGKKIKADAILWCNGRSGNTDSLNLEAVGLTANSRGQLEVDKTYRTSIPHIYAVGDVIGWPSLASAAYDQGRNAAGFMVGDEDAEFVNSVPTGIYTIPEISSIGKTEAELTAEKTPYEVGQAFFKHLARSQIIGERSGVLKILFHRETLELLGIHCYGNHASEIIHIGQAVMKCGHTLEYFINTTFNYPTMAEAYRVAALNGMNRIF

SEQ ID NO: 2432 - protein, 94 aa, M.catarrhalis
ADDMMKPSASFGNEVAQFVEHLRKIVMSKEQGVVKWFNDAKGFGFIQRETGEDVFVHFRAIQGEGYRSLKEGQAVEFVVTTGDKGLQAEEVTKL

SEQ ID NO: 2433 - protein, 291 aa, M.catarrhalis
STDMYVHTPTPAQQEKQSNIRSAFFISDGTAITAETLGKSLLSQFSDVEFDIQVIPYVDTPLLAREAVQRINNAYQSSNLRPLVFDTIVSDDIREIINAADAHNLDIYEGLINRIATEINHKPNPHTGMAHSRVDSDDYKARIDAVHFALDNDDGARTNHYDGADIILIGLSRSGKTPTSLYLALQYGIRAANYPLTEEDLDTSQLPRVLKPYHHKLFGLTIDTERLVRIRQERKAGSRYASLAQCQEEQRAIQAIYSHQKIPSLNVSEMSVEEIATRILQITGLKRRIGV

SEQ ID NO: 2434 - protein, 368 aa, M.catarrhalis
SQVMMVCKMIELFFKKFLLIYDVNYHLSILGLLHCSFMKILHVLLTRMPIPPTKYGGTERVLWALYQGQTALGHEVKFLTKHDNKHPDALVFNPNISLEKQVEGWADIIHFHFLYRGEITTPFVCTTHNQQITPASFPKNTIFLGKLHAQRSGGQAYVHNGLYWADYGQPNLNTPKNYVHFLANAKYKDKNLKDSVTIARQAGRPLHVIGSKRYSLKYKAGKYQPYYYQGADLTFYGMLGGDKKNEVIKNSSALLFPVLNYEAFGLAMIESLYLGCPVIGSRCGSLPELIIPEVGISTQSKSEMVEAIKNIAIFNRKHCHEYAQDNFNHLVMSQNYLHYYDKVLNGESLHDQEPSVTQNLPTQFHLVA

SEQ ID NO: 2435 - protein, 115 aa, M.catarrhalis
NVFVDNSNFIKVTVSNKVDMVSIYLHFKFLNKCLFVRCGAYYIEIYHSVKYFLDKLFDILDKFYKLLIFNWLFFSIGIFILDIGFGLGKPIKRANIHPVICHMLATHQLLIDGRF

SEQ ID NO: 2436 - protein, 551 aa, M.catarrhalis
LPIVQCFIFNPFSKLIIMNTAKRYRLSVVMIVKNEADNLKVSLPAIADWVDEIIILDSGSTDDGQKIAQSHGAKWHVNTDWQGFGRQRQLAQAYATGDWILALDADEVVTPQLKNSILKVIKNPPTDTVYGIKRLDFVFGHQIDNALWGVKAHWRLYPKKFQYDNNLVHESVILNDATTKKLSGFLHHHTAPTPLFWLNKRLDYAKAWADDRHAQGKKGKFYKVVVNPLWAFIKQYLLDGRFLQGRYGLIYSLFFTQYTFNKYACLYDLTHNQAEHAFLHSVAMAQNLKPINVSQKKSTLSLVMICKNESKHLKACLETVHDIVDEIIVLDSGSTDNTRQIAESYGAKWHVNTDWQGFGKQRQLAQAYATGDYVLVLDADERLDQPLRQAITDVLKNPVQTDKVFSVARVNTFCGIEVQPRWWYADKLSRLYARQHFQYSDLKVHESLNQYGKPSMVLDGYLKHLTNDNLHHFLLKNIRYSYDWAKDKFTHNKNTSLIAGFFRAVFSFIREYVIRGDLLGGAYGYILAMASMGYTLDKYIMLWWLNNKDKP

SEQ ID NO: 2437 - protein, 514 aa, M.catarrhalis
GLAVIRSRILCASLMHTAHHHRSKTYLTTAIRYALFGIASLPFVIPTYAELNTSRSLTVVGADSSKNLPDTPNTKPNTVLALDAHLQSHDDTANAFDGFDFEVITQQAAEQTSSQANQGNHQMSQLDAFASKSDNPSLNTARLTDKHDTPSASKSLAKLAENYHIKSDPDAHRCQGMWMQPIHQATHTNRPTTPKLDENGNPITEDGIFAQADYGYYDAQTYAELSGNVIMEQNGRRVTADKLTLDTQTGQATASGQVQFSDGGASDHSAGIIGMAENLVYHTDGQTATAQDVAFASTTINAHGYASQMDKISSSEYRLQHVMFTTCPPTERKWYLDTDSIDINTDTGRAIAKNTTLRIKKVPVFYLPYFNFPIDARRSSGFLLPSMGFGASDSFEISTPYYLNLAPNYDATITPTVFTNRNPMLTGEFRYLTQDYGSGVLTASYLPKDQQYHDKDRSRIQFDHTWQPKQFDTITTYAQYQSVSDANYLSDFNALGVERAKLSSPRGWKDDGGL

SEQ ID NO: 2438 - protein, 70 aa, M.catarrhalis
LLTVGLVMAFNARACLIIPPIKYNAVIDKPAYSSPEKVFTPSFEMEICTCMPEPLSPTIGFGIKVAVLPN

SEQ ID NO: 2439 - protein, 327 aa, M.catarrhalis
SRKFFVKMLQCRFIFTLMNLGNWMQGIITLLLILSPMFVGFALPTSQKLAAFGGQALTYLIYLILIVIGIELGLVDDLVQKVGDIIKYLVVLITLTIGFGAISLVFFDKFTQKNQLSKHTLPNQKPKISLRGSLAQLICLAIGFMAAKFLPAGFIPPEKTTTILLMALLFLVGVSLKGSGIGLKQALVNKTGLQVSVIFIFCTTLSGIIFASIFHEVTLMQGLALASGYGWYSLSGTIMTDAYGAVWGSVALLNDLAREVIALIFIPWVMRYSTSVAVSLGGVTSLDFTLPTILQAGGTQIMPIAISFGFIVNIVSPVLMVLFSSFG

SEQ ID NO: 2440 - protein, 65 aa, M.catarrhalis
GKTSIATGNLPSVLTIFESSTIQINRFEAAATIFSRVNAPPPPLIILPLASISSAPSIYKSSTPN

SEQ ID NO: 2441 - protein, 125 aa, M.catarrhalis
LIHKENIMKKLAFSLIVATAGMMAISANAMSPKTVQYTCQGGKSVNVKYIFNDADLPSKAVASFSGKTVGMPINLNASDMTSSIFGFGGYTMTADYIDAKNYNQVGIAVITDPKNKTLFKNCNPR

SEQ ID NO: 2442 - protein, 165 aa, M.catarrhalis
LLIKVEAEPNLYTKPFKFELLNNNIWRYSMKILALAPATALALVGFIGAAHAQVDHAQEAHDSTVLKRQVTYACQSGGQATVTYGFNQQRLPTYASAYVDGKNRFMPFNLNRSDNVDSVFGDENNYSLMTDAMTLYNYHKLGINITSPSGDFAHKGCNVRYVTKL

SEQ ID NO: 2443 - protein, 699 aa, M.catarrhalis
GCLSFILKNAISHNKQRTHVMKKTKLFATVGAAVLSASILAACSNNTTTASQGGGDLTTYKYVFSGDPKSLDYILANQVVTADVTTQMVDGLLENDEYGNLVPSLATDWSVSEDGLTYTYTLRDGVFWYTSDGEEYAPVTAHDFVTGLKHAVDGKSDALYVVEDSAKNLKAYTEGKVNWKEVVVKALDDKTVQYTLNQPESYWNSKGTYGDLFPVNAKFLQSKGKDFGALDPSSILVNGAYFLSAYASKSLMEFTKNDNYWDADNVHVQSVKLTYTDGSDPGSYYRNFDKGEFSVARLYPNDPTYQAASEKYQDNIVYGLIDGTTYYFTFNLNRSAFANSTKTPEQQESAKKAMLNKDFRQAVMFALDRAAYQAQTVGEEAKTKALRNMLVPPTFVSADGEDFGQMVKKDLVGYGTEWQDVDLSDSQDGLYNPQKAKEEFAKARQTLEAQGVTFPIYLDFPIDQADSNRVQQAQSFKQSVEASLGQENIIINVIETETSTYESQGYYAESPEQQDYDIMMAGWGPDYQDPRTYLDIMSPIDGAMLQKTGIHRGGDKALVKQVGLDTYQTLLNQASVISNDNSARYNAYAKAQALLIDSALQIPMVAIGGVPRVSKGVPFSGSFSWAGNKGGSWYKRLKLQAQPITTEQYEKAYQAWQSEKSASNAKYADSLVNRVKKSDTAASDAAPTDAATRIRTTAN

SEQ ID NO: 2444 - protein, 325 aa, M.catarrhalis
EGIMSQTVNTTTQQTAPKKLVEVKDLEISFGEGKKRFVAVKNANFFINKGETFSLVGESGSGKTTIGRAIIGLNNITGGQIIYDGKVISNQPKDAELICKIQMIFQDPAASLNERATVNYIISEGLYNFKLYKDNADRLAKIKQMMAEVGLLPERLTRYPHEFSGGQRQRIGIARALVMDPEFVIADEPISALDVSVRAQVLNLLKKMQREKHLTYLFIAHDLSVVRFISDRIAVIYKGVIVEIAETEELFKNPIHPYTKSLLSAVPIPDPILERKKQLIVYDPTQHDYSSDEPSMVEIKPNHFVWANKQELERYQQHISNQTVV

SEQ ID NO: 2445 - protein, 63 aa, M.catarrhalis
AAPMNPTSAKAVAGAKAKIFIEYLQMLLFKSSNLNGFVYKFGSASTFINNQFSKAIGIITLGF

SEQ ID NO: 2446 - protein, 340 aa, M.catarrhalis
KLNVWLVRFTVRKRFLTGIRNISLKFHEGEILALVGESGSGKSVLTKTFTGMLENNGRIASGDILYRGQDLPKLTNNEDWLKIRGSKIATIFQDPMTSLSPIKTIGAQIVEVITKHQKVSRKEAKIQAIDYMRKVGISNPEKRFNDYPFEYSGGMRQRIVIAIALACRPDILVCDEPTTALDVTIQAQIIDLLKSLQQEYRFTIIFITHDLGVVASIADKVAVMYAGEIVEFASVNEIFYNPQHPYTWSLLSSLPQLVNDSGELYAIPGTPPSLYSPIVGDAFALRSEYAMEIDFEQRPAIINVSDTHWAKTWLLHPDAPKANKPEAICDLHEKILQKLS

SEQ ID NO: 2447 - protein, 221 aa, M.catarrhalis
AFYPMDKQYQVLARKYRPKNFSELLGQSHVAQALSNAIDTGRLHHAYLFTGTRGVGKTTIARILAKCLNCETGMTSQPCGVCDTCISIDQGRFLDLIEIDAASRTKVEDTRELLENVPYPPVQGRYKVYLIDEVHMLSTHSFNALLKTLEEPPDYVKFVFATTDPQKLPITIISRCLQFVLRPLPQACLSDHLAKVLDAEKIPFTENALWQLGKHCKRFGA

SEQ ID NO: 2448 - protein, 214 aa, M.catarrhalis
KNLPLLNSWQSKNGFNRHEFLALANQGESLGQMSEMETRIIKNSLALGMINVEDILTPRSVVSAFDENMTVGDVFASYPKLPFSRFPIFDEDLDNATGFILKSDLLIAKANQEIHTPIKQFRRDINFVFAKMKLFDLLDLMLKEQVHIALAVGEFGEVKGLVSLEDVLETLLGLEIVDEFDRVDDMQILARQLMDKRMARLGAKLEEDAPFDEK

SEQ ID NO: 2449 - protein, 967 aa, M.catarrhalis
VRPPKDITMKKHTKSSISTQILKPLSLAISSCILVACSSTGTPAKPVSQTPKPIPQAKPSQQINISSGNTNLGNTKTGADVDVLDVQMLDALEALLQATDMSMVEGDELAIQRYGNLWDRVRRGYRINEMTNARIEAQKSWFYTRQTYLDRLTARASRYLHHTVAEAERRGIPSELALLPIIESSYDPTATSNAAAAGLWQFIPSTGRIYGLNQSATYDGRRDVIESTRAAYDFLTSLYNQFGSWELALAAYNAGPGRVSRAIKANQDQGLPTDYWSLKLPTETMNYVPRFLAVAQIVRSPNTYGINLPAIANHSHFRTVPVNYGVSLSEVATVTGLSVSELRLLNPALLNFTVDEIGPNRIVIPDSLPNQIDNQLASLKGYGFGGDYIATAPAQSITYVVPKSGATANTSSQQELIAANTLPTTIAQVTPNNTIVQEPALSKSEINLIAAEIQKTSPEVPAISPQDGNIQLNAVQTGQSVLDARGETKMLSFADGPKTQAVAQQPTQPVQVAVTPPAQPVQITVVSPTPEPISQPKPQLPPVTASIPVVSSPPVLVPPPPSRPRPEPASRPKPKPESYTVRAGDSLTSVAATHGLTVGQLASYNNLANDAHILIGQRLWLVAGKVKRQPVSAQTPSRQSTSTANTNSATHKVSAGESLTAIARKYNISLHALAKENGLSVTDGVLIGQTLKLPSDAKTANTTMANTSSSPSVNKPESYTVRAGDSLTSVAATHGLTVGQLASYNNLANDAHILIGQRLWLVAGKVKRQPVSAQQTSQATQSTKNNQSTQSTATHRVQSGESLTAIARRYNISLHALAKENGLSVTDGVLIGQTLKLPSDAKAESSTPSRLGNTKNNSTRTPANTNIGITENYTVRSGDSLTMLSNRFGVAIGDLATANGLASNANLRIGQTLKVPKLTTTYTVKAGDGLIALARRYGISTQELAKMNNLEPTADLRIGQVLTVPNK

SEQ ID NO: 2450 - protein, 237 aa, M.catarrhalis
TVLPHANKVLNDMQLMRHEINDLQDFHQGKVRIATPQQLSAFSIPRLIRLFKEAYPDIQVTLIDCSIEEVASHVQMLDADIGLGPDLLHSNDLIQTKLFRSSFGLVVRADHPLADSEVLTWQDLSEGDLITVQAPFADHIREKLTLDICTRLFRSDYQVNFLSTALGMVKEGLGITMTLGYAKTWVDEQGLVMIPIHEPQIGYEFLLYKHRQRSQTPAMKSFENFLVKAAKDWLLHI

SEQ ID NO: 2451 - protein, 135 aa, M.catarrhalis
YADTYHKISQYSVQMEFLLYLLDTPMNITFRQLRAFASIARHHSFSKAATELHLTQSSLSGLIKEMEKQLDTRLFDRTTRQIHLTESGERFCPMPIRCLTICNLCVMRSMIYKTFIKVKCVLQHPSNCQHSRYQG

SEQ ID NO: 2452 - protein, 344 aa, M.catarrhalis
PWCAVIVILPRMGHWAVWLMALVHQRLNMCLRPNVWVAKKMKNMLVRVDGKLGKGVTPKDVVLAIIAKIGTAGGTGYAIEFGGQVFCDMSIEGRMTVCNMAIEGGARVGLVAVDDKTIDYVKDRPYAPTGDDWERAVTYWNTLHSDDDAHFDAVVVLNGDEIEPQVSWGTSPEMVIAVSQNVPTLDMARDDVQRNDWMRAYQYMGLTAGQPLSDIVLDRVFIGSCTNSRIEDIRAAAEVVKGHKVAPSIKQAMVVAGSGLVKAQAEQEGLDKIFMDAGFEWREPGCSMCLAMNADKLQAGEHCASTSNRNFEGRQGNGGRTHLVSPSMAAAAAIAGHFVDVRTF

SEQ ID NO: 2453 - protein, 219 aa, M.catarrhalis
KFHLYAVLTYFMISISILASIIYQKYHQPNTEYFMADLFENPMGLCGFEFVEFASPTPNLLEPLFEKMGFSLVAKHRSKDVLLYRQGGINFMVNREPNSEAMYFAQEHGPSACGMAFRVRDAQYAYHRAIELGAKPVEIPTSVMELRLPAIRGIGGAPLYLIDRFDEGKSIYDIDFEFIDGVDINPVGYGFKVIDHLTHNVYLGRMDYWAGFYEKLFNF

SEQ ID NO: 2454 - protein, 131 aa, M.catarrhalis
IICYNTWYIFIEFLSNSHIKKLHIGYIMSSQNQPQRSEAAISENELIAQRRTKLDALQQKAKQAGKSAYPNTFKPKNYCGDLQAQFDGVDKATIESGDKVYVKVAGRVILNRGSFIVIQDMHRPHSVICGS

SEQ ID NO: 2455 - protein, 173 aa, M.catarrhalis
EIRYFDIKGEYTGLTSRAMIAPDGLIRIPLNEESKQGGGQIEEYLMAFGGEGIQHIALLTDNLTDAIDQLKAAGVPLMTAPNDTYYEMLDERLPNYGEHVDSLKTQGILLDGTTQNSHPGLLLQIFSETALGPVFFEFIQHKGDYREGFGEGNFKALFESLERDQIRRGALKI

SEQ ID NO: 2456 - protein, 61 aa, M.catarrhalis
DQCHKSPLIKASLSTNLNEPPFLGQFGGFYCPLAIQMVAKFVKIRHYYRSKIKLGYFANPP

SEQ ID NO: 2457 - protein, 100 aa, M.catarrhalis
PPRQVLDLSLTETLRRTIMTVGTVFVVVVAMLFLGGDGLYWFSVALFIGLIAGTYSSIYVASSIPLMMGLSREDFVVKVKPEFEEEVVVFADPNLQNSKD

SEQ ID NO: 2458 - protein, 201 aa, M.catarrhalis
FLQHYSVMPRPRTQNLANLSFVSIAIFTVSVAAIFIPSTAFAAFELGGTPTNLALLIFFICLSLVVSFLCSISEATLLTMTPSYIDTLEEDNPKGAALLKSVKVDHIEKSISTILTLNTVAHTLGSLGAGPHAVIGFGNAWFGVFSGVMTFIILIGTEIFPKYIRTGLLPTNLLCLGRIMCLPIIVAFFPIIGWTEKIYRC

SEQ ID NO: 2459 - protein, 103 aa, M.catarrhalis
VMAKAKSSYICQNCGAIYGKWAGQCTDCGEWNTLVEAPNTSLPHHHKSKTTTAPRKTANYAGAGNALMTLDHVGVTLETRMPTGIGEFDRVLGRGTWGRLRGV

SEQ ID NO: 2460 - protein, 312 aa, M.catarrhalis
LCHNYPNNTIGSSNQSPNHCTLFNKRLPVCVWYFVLGCIKFTKSHQKLLQYQIIKKYTFKEKIMTTFVSFNINGLRARPHQLEAIRDILGADIIGLQETKVHDALFPVNMVQDLGYHVEFFGQKSHYGVALASKIVPTFVQKGFPFGHDDAQRRLIHARYDFDGRSIDVLNGYFPQGENRSHEIKFPMKREFYADLNRYIDELQADGRELIIMGDMNISPEDIDVGIGAANAKRWLAKGTCSFLPEERAWYQMLMSTGLTDTYRLFYPKSHDEFSWFDYRSRGFEDTPKRGLRIDHILCTDTLKNDCVGSRH

SEQ ID NO: 2461 - protein, 171 aa, M.catarrhalis
TVYNDWGIGYLTQSYCLDNYGKVMVNFQKTYKVYINHTDAGGIVYHANHLVFFENCRRDWLTTLGYDGYFLSLDDDANKESRKAVHFVVSHADITYHTPLLVDDELAVTVDEVRIRPASLMIHQSIYRPNQNKPATTATITLACVINDKKTIRPHRLPKKFVQTLISATAV

SEQ ID NO: 2462 - protein, 293 aa, M.catarrhalis
FEVNMLDNLRGMAVFSSVVRHGSFSGAAKELGITTSAVSQQIRSLENDLGVSLLHRSTRKLSLTEAGESLYSSATQMVKAAEQGRDSVIQLKDELSGSLRIATTPELAKAYLLPALSDWLVEHDNLSLNIISRDNLDMIEDRVDVALLLSEQAQGIALKTVEQMLIASPEYIKNHGDVENVKALATHTMIICGEKPSESIEFKDANGKQSVRVSSRIITNNHAIALNLAAEGYGIAKTNAVDAKALLESGKVVKILPNHSLPILTLSAVTISKEQTTVKAQKCIEVLEAHFKN

SEQ ID NO: 2463 - protein, 227 aa, M.catarrhalis
LIKNNHFLETIMEKYTTEQGIVAPLDRSNVDTDLIIPKQFLKSIKRTGFGDNLFDELRYLDEGFLGQDINKRPKNPDFVLNQARYAGATILLARKNFGCGSSREHAPWALEEYGFRTVIAPSFADIFYNNCFKNGMLPVVLSDGDVDDLFNECFANVGYQLTVDLQNQTVISPNGGQYHFEIDAFRKHCLLNGLDDIGLTLQHADDIKAFEEKAKADRPWVFAELSV

SEQ ID NO: 2464 - protein, 97 aa, M.catarrhalis
HMKKILPAAVFAILLAACSQQTQDSASQAASSVAEDTKANATVVAQEAEAAAQATGNAVENAAETASNAAKNLGAAVNEVTANEQSAEAKAPEDQQY

SEQ ID NO: 2465 - protein, 555 aa, M.catarrhalis
MQKKSLLQKMPYGNWASTAKGSVRDALSLTDQAIAFGGGRIQTDTVLSMLGLVNRTDVLEIIETIYHDDRMAISQLITNMRDKMVDATAIFDELIDCIHQMALMQVLPDIPLDMNDEQAHQIKRLSSAISSDILQLYYEILIKSRDGIRLASTPMQALEMGILRLLAFRPLAEGQVTVLNDTPAKQPEDADNHNNMPDDIVDGLKDQACAAGEINALSTDSHFDSDKQDDLNDLASQIGTELILDQLDNDDVNTKDGQDTNQFAHIDQAQSTNIAVNLTVSEENFWVKQPQSDPPELLQTDEDSPSDHDTLTQMATEPSLAVMSDSSDTDELTADFTEDLQSVPAVTVAALVKVDSKKKASHQADLTAHQPASHNLDQQPISHFDHINPLKPLAHLSSQPMTKPQMLEQLKPTPIELEGGWTSEKWDYWVHLAREEGHFAPDELALMSTSVMAGDIAGESRLLVAEINSQVQSSFENLHAKFLEHYPQIKLSLEPVLVDCALEVPKSRLSDRHRQVQMQAQHQLVDSPVFQTLWQGGFIIDDGTSVLNQSKLLID

SEQ ID NO: 2466 - protein, 230 aa, M.catarrhalis
LLNETKYNNLPSYFKLTVLFWLKITPSYIMAYSFIDKYIEYKGWFMKYSTRSVLRKAVAASMLTAVIRSAIQLTGRSFGKGASIGLFIGMIGVQSLITTNAYAISEQDVSRYASSMSSAANAQNIAQISRLIDDDAIISLSRGGKTTSLDKEGYLQLLQKSWAISSDYRYRINVADVVVTGNQARAQIVTTETWTQDGKPVTIKTASRATFSQVGNNAVLLRSVSQVTVD

SEQ ID NO: 2467 - protein, 417 aa, M.catarrhalis
SKTCTDRIQLYVDRKGLPSETLELIKSLDLGDIVAASGYIGRSGKGDLYVHLEAFELLTKSLRPLPDKFHGLTDTEVKYRKRYLDLMVNEETRNTFAIRAKVVAGIRAFLTQERFMEVETPMMHVIPGGASARPFVTHHNALDMQLYLRIAPELYLKRLVVGGFDRVFEINRNFRNEGVSTRHNPEFTMIEFYQAYADYKDLMALTERMLETLAMDILGSTDVSYQGEVFSFKGPFKKITMFDAILEYNSDFSADDINDREFLAKFVKDELKQEVKPSFGLGKLQTIVFEETVETKLRQPTFITEYPAETSPLARRNDTNPHVTDRFEMFIGGRELANGFSELNDPIDQAERFRAQVAEKDAGDDEAMHYDADFIEALEYGLPPTAGEGIGIDRLVMLFADAASIRDVILFPHMRHK

SEQ ID NO: 2468 - protein, 169 aa, M.catarrhalis
GFMSIQYWRMQLHPDHSTFSSFYAHTSIAKGFIGLDFKQESNAGDLLTLQDDDKLGYQKSYLPFARDMKIGDIVLIVSHHNPIAIVKITSDYNYIRQVIPELGIWFRHFRQIDKDNIIYYSDFETNKNNYQSITMTNTISPLKNDDSQSMQLIQEMIKWEKSHNPDSVY

SEQ ID NO: 2469 - protein, 467 aa, M.catarrhalis
GLFMNSDTLLTMRPIKAVAIAGVLVALLGLTMIAWSWVPHLSLLVVIAALLFFGLLNKLKFEQMQACMIGSVGSAMGAIYLFSFIGLLVSALMMSGAIPTLIYYGFEILSAKVFYLSAFILSSVVGIALGSGFTTCATVGVAFLGMATAFGANPAIVAGAVISGALFGDKMSPLSDTTSIAASLVGVDLFDHIKNMMYTTVPAWVITAIIFWYLSATNTISDLAGIAILKEQLFSSGLVHGFSLIPFAVLVILAILRVNAIYTIIATIITALMITYTHSSPSLTDLGGWFFAGYTPAEELALGDVAKMVSRGGLQSMFFSQLLVILALSLGGLLQGLGILPALLDGMRHLLTHASRGVAAAAFTSLGINVLVGEQYLSLLLSGNAFLPEYQRLGLHPINLSRTIEDAGTVINPLVPWGVYGGFLAGTFGMPVIEYVPYAFFCYWCFLLTLFFGITGLTITRLSPKLT

SEQ ID NO: 2470 - protein, 218 aa, M.catarrhalis
IIVILKVCYNGKITQSMTVLENKMAGKTLYDKLWDDHLVRQRDDGSSLIYIDRQLLHEVTSPQAFEGLALNGRTPWRLSANIATPDHNVPTSLMERKQGMAGIADDTSRIQVKTLDDNCKSFNVMQFGINDIRQGIVHVVGPEQGLTLPGMTVVCGDSHTATHGALGCLAHGIGTSEVEHVLATQCLGCQKNEKHAGACGWQIGQRRYPKRCRACHHR

SEQ ID NO: 2471 - protein, 628 aa, M.catarrhalis
EYSMHYPAWKYILIVVVLFISGIYALPNLYPDEPAVQITGASAGTQLTQDVLTQAEGLLTQAGLNHHNGRFENNSALLRLSNAEDQLKAQEVLRRDLGEQYVVALNLAQTTPEWLRNLGAAPMKLGLDLRGGVRFVLEVDMAKALEQRLATASQDVRRTLRGEQIPVQSLRITDNGMVLTFINTDDRGRAQSILQNQVGADFALRPFADTEGAALELTYTDAKIQEINEYAVGQNLTTLRNRINELGVAEALVQSQGTNRIVVELPGVQDTAEAKRVLGRTANLEFRMVSEHDMNYAGGIPPAGTEAFAFGSLDGQPMLLERQTIITGERVQGAQSGLDENGRPQVNITLDTAGGRLMQNATRTAVGKQMAVLFIENKQKVSFQEDSSTGELVEVRTPYTESRIINRATIQAVLGSSFVITGLDSDAEAGELALLLRSGALAAPMYFVEERTIGPSLGQDNIDKGLFSTQVGYLLVFLWMIVFYRAFGVIANIALAFNVIIMVAIMSILGSSLTLPGIAGIVLTIGMAVDANVLIFERIREELANGTRAKSAIVAGFDRAFSSIFDANITTLLIAFILFAIGTGPIKGFAITLAIGIISSLFTAILVTRAMIQIWYGHRKNLTKLSIG

SEQ ID NO: 2472 - protein, 359 aa, M.catarrhalis
GNLMTKKIAILNGDGIGPEIVAQAVKVLDKLIEQGLDVSYKYAKLGGEAYDTYGLPYPSQTQEIVQKADAVLLGAVGSPKYDDLDRPLRPERGLLAIRKDLNLFANLRPAILYKELADASTLKPEVVAGLDILIVRELTGDIYFGEPRGIVTLDNGEREGFNTMRYGESEIRRIAKVSFEAAQKRRGKLCSVDKANVLETTELWRQIFTEVGKDYPEVELSHMYVDNAAMQLVKNPKQFDVIATGNIFGDILSDQASMLTGSIGMLPSASLNETGKGLYEPSHGSAPDIAGQDKANPLATILSLAMLVRYSLNDEQRAVQIERAVQKVLEQGYRTADIYEDGTTLVSCDEMGEAVLNAL

SEQ ID NO: 2473 - protein, 62 aa, M.catarrhalis
VTIMPYIILATYFKLPMVAADHTAVALISVWTNFLGKRWGRIVFLSLMTQAKVIVAVVAGLF

SEQ ID NO: 2474 - protein, 613 aa, M.catarrhalis
DLNMTAKITAPDFVRHQALIHWVAEIAALTKPAAIEWCDGSEEENQRLIDLMIKNGTMIKLDEDKHPNSYLAFSDPTDVARVEDRTYICSKEEIDAGATNNWVEPSQMRTKLNDLFDGCMAGRTMYVVPFSMGPLGSHIAHIGIEITDSPYVVVSMRKMARMGKEVYDVLGADGEYVPCVHTVGSPLTEGQKDVAWPCNDDKYIVHFPETREIWSYGSGYGGNALLGKKCLALRIASAMGREQGWLAEHMLILGVTNPQGKKHYIAAAFPSACGKTNFAMLIPPAGYEGWKVETVGDDIAWIKPSEDGKLYAINPEAGFFGVAPGTNTKTNSNCMSTLGSDVIYTNVAVTDDGEVWWEGKTKETPANLTNWKREPHTGAERAAHANARFTVSAKQCPSIDPQWENPEGVPISAFIFGGRRADTVPLVSEAFDWVDGVYKAATMGSETTAAATGQQGVVRRDPFAMLPFTGYNMADYFNHWLQMGENLGKKAKAAGNQLPKMFKVNWFRRDTNGDFVWPGFGQNMRVLQWIIERCEGTANAVRTPIGLVPTYDDINWDQSDFTKAQFELVTSQDKDAWIKELESHAELFDKLGERMPTALKAHNAKLKADIEQA

SEQ ID NO: 2475 - protein, 207 aa, M.catarrhalis
LLSMIGMISGQVQYLNAPIACILTSNGVGYEIELPIPSFCQLTIGAQTAVYVHHHVREDAINLFGFMDRHDRDIFRKLIKINGVGAKMALAMLSTLSVAEIKHAIETDYDAALVRVPGIGKKTAQRILLDLKGKLNEFGEMHPMTAEGLFNQPADNSMLIIAEVESALMNLGYKEKEAQVAIKNAQSDAKNNTSDLLKAALRQLSGF

SEQ ID NO: 2476 - protein, 289 aa, M.catarrhalis
IPQILPLLLQLCRQAASLVLPKKLYITQPAVSKRIKNLEDEFGTALFDTVGRSIIPTAAAYDLLPFVRRWLDDYEACKASLQHAKEVASGRLVIGTSHHIGLHHLAHVLKRFIQTYPAVQLEVRFVDSEEAHKAVLEGEISLAFLTLPPTFDRRLNYHTLWSDPLYFVTGTLSPLAQKSKVSLLQLAHYPAILPAANTFTSQITLAEFAKHNLRPYATMSTNPLESIRMLVSVGLGWSVLPETLINQDLIKIDMAENIELQRHLGLVTNPNLTRSASMQALLSMLSIND

SEQ ID NO: 2477 - protein, 287 aa, M.catarrhalis
ELKMNNENNPIDPNAAQPPRRRRVPRRDGKGANAATNQDALADQSLIADAGDEAAEKAGGVKLIANQRIIPFMKLEKPMIVFSVLSILIGLIAIIVKGLNFGLDFTGGVSANVAYEQPVEQAQVIKALADNGFNDAVVQYLGTRQELLVRLPPQDGSAENLSASLDQILNFPNNPSTIDSISIIGSQLGNEIYLNSLLAMSVALGMMLIYVATRFQFKLALGAVLALFHDVIIVVGIFAIMGWPFDLTVLAAVLALIGYSVNDTIVVYDRIRENFRRVRGLTTPSGA

SEQ ID NO: 2478 - protein, 114 aa, M.catarrhalis
ELLMLDLAITAAHASTGAPAGQQSLLMNLLIPVAFFAIFYFLIIRPQSKRNKQHKAMVDGLTVGNEVVFAGGLIGRIKKVEGDYAVITLNHSTEVKIQRASVVMVLPTGTIDNI

SEQ ID NO: 2479 - protein, 348 aa, M.catarrhalis
ESMMALVSLRQLLDHAGEHSYGLPAFNVNNLEQMRAIMMAADKTDSPVIVQASAGARKYAGAPFLRHLILSAIEEWPHIPVVMHQDHGTSPAVCQRSIQLGFSSVMMDGSLREDGKTPADYEYNVAVTREVVKMAHACGVSVEGEIGVLGSLETGMAGEEDGVGAEGVLDHSQLLTSVEEARQFVADTNVDALAIAVGTSHGAYKFTRPPTGDILAIDRIKEIHEALPNTHIVMHGSSSVPQEWLKIINENGGNIGETYGVPVEQLVEAIKHGVRKINIDTDLRLASTGAVRKFLNDHPAEFDPRKYLTASMKAMEEICVARYEAFGAAGNASKIRPISLEKMVDYYQ

SEQ ID NO: 2480 - protein, 387 aa, M.catarrhalis
FMKFIKQNSHHLAMLLAMTTGAHQAHAFSVDNSQQRITVQPTYVQPAQVITSQSVYVEPTAQVTTTTNVSVQAVPQAPQEHVVSQEGYAQTQLNIQPQVISSTKTQTTAYTTTSNAQTAILNDQNSYTNSFYALPISTRSAAVLVYDLQDGKLIYGKNADVQRSIASISKVMTAMVILDAELDMREEITLIASDLIGAKQASTRLKAGDRMTRSEFTLMMLMRSENPAAKALARTYPGGYDAFIAAMNQKAYDLGMYQTKFSDSSGLDPHNMSSANDLLIMMKAVNSSPRYHSIRNFSTAPHYDFYIANYGSGDRIYKGNNTNRLVREGAYPIGVQKTGYIREAGYSVVMETNINNRPAIVVLLGASNSANRWSDAETILTELAYRQ

SEQ ID NO: 2481 - protein, 588 aa, M.catarrhalis
VSRLTLRHRTMSLKHNQTHNTTFTKFLKSNSFWSKGFWSNRHHRTKDLKGLDAYLFMAIVAIFLTTTANVTFFQQVMSVYPLANYALFIASLAVVLTGVLLLLLVLLGYRHTLKTVAICFILIAAFAGHFTDTYGTVYDTTMLQNALQTDTAETKDLLSMKLLIRVVLLAGLPICWIIGQPLSFGTLKASLMKRLVTYLVALALVGLPILAFSSQYASFFREHKPLRFFTNPVTVMYSAGKLANMSYKNATKPTETIMHANDAIQKTTASTRKPRLVVMVVGETARADHASFNGYQRATFPHMDKLIGLGQVHNFGNVTSCGTSTAYSVPCMFSYLGAEKYDVDTADYHENVIDTLDRLGVAILWRDNNSDSKGVMNRLPAKQYQDYKNSPLQGGNNTICHTNPYDECRDVGMLVDLDDHVKAHANQDILIVLHQMGNHGPAYYKRYDDEFAQFLPVCTSSELAECERQTVINAYDNALLATDDFLKQTIDWLAAQTHADTAMLYLSDHGESLGEKGVYLHGMPKAFAPKEQLSIPALLWLGADTPFAVANSPTAGFSHDAITPTLLNLFDVSTQATADKTAFVNPLD

SEQ ID NO: 2482 - protein, 80 aa, M.catarrhalis
LRRLLMARFYRRRKFCRFTAEGITHIDYKDVELLKQYISENGKITPSRITGTSTKYQRQLAVAIKQARYLALLPYTDNHK

SEQ ID NO: 2483 - protein, 530 aa, M.catarrhalis
LIMLWFFFCVTILLVGYFIYGKVIEKIFVINPNKNTPAYTMADGVDYVPMSKGKIWLIQLLNIAGTGPIFGPILGALYGPVAMLWIVIGCIFAGAVHDYMCGMLSVRNSGASMPYLTGKYLGIIPKHFINLLAVVLLILVGVVFVASPAQLLSSITIDIFGTAATGTISVDNAESMAAVTGTSSNTVFGMTKETIIVVWTAIIFIYYIIATLLPIDKIIGRVYPIFGGLLLFMSLGMTYGLVMNELGSTQSYFYSSMGGLSFDAFFQNLQPKGDLPIWPLLFLTITCGALSGFHATQTPLMARCAMNESEGRFIFYGAMIAEGIIALIWCTVGLSFYPDLVSLQEAISVGSPSKVVYDSSIAYLGAIGGVFAVLGVVILPITSGDTSFRAARLIIAEFLNVEQRTLLKRLGIAIPLFVIGFIISKVDFQILWRYFSWANQSVAVVMLWTAAGYLYRYRKLHWVCTIPAIFMSAACYTFLAYNKIGFGLDYQLSVYIGFGLTILTTAAFFLFVKRERVAGDPDALVFEPKV

SEQ ID NO: 2484 - protein, 143 aa, M.catarrhalis
LLYPNLLILCYTLITLNKKLHQGDKPMTITIYGIKNCNTMKKAFDKLNELGKTYEFFDYKNEQLTLDKFGKFVAIFGDKVINKQGMTYRKLDDDAKAILNGDDVSAMYEIVKTNQSMIKRPIILGGMKSVIGFDDAEYEQIFG

SEQ ID NO: 2485 - protein, 373 aa, M.catarrhalis
SKFAKIRNLLLTISSAMTQQTQPVLLSDYDYHLPDDLIARYPLNERTSSRLLHVSKNSCQDLRFTDLPNLLKSGDLLVLNDTKVIKARLHGQKQTGGAVEVLIERILPDEINNNLYKALCHVRSSRSPKVGQTLNLANNQMQATVIGRQDNLFILGFRSPILADLDNYGQMPIPPYFERKADETDDERYQTVFHNPTKSASVAAPTASLHFDDALLTQLRKKGVQIAFVTLHVGSGTFTPVKVDNLADHVMHAEYAHLPASTATLINNTKSAGGRIIAVGTTVTRTLETAHRHRIHGELVEFLGDTQIFIYPPYEFGVVDCLITNFHLPKSTLLMLVSAFAGTQTIQEAYNHAIKNKYRFFSYGDAMFLEKAQ

SEQ ID NO: 2486 - protein, 367 aa, M.catarrhalis
TMTAPQRTPLFDAHTEHNGKLVDFGGWELPVNYGSQIDEHHAVRTDAGMFDVSHMLVTDISGDNAKAFLQKLLANDVAKLGFVGKALYSAMLNDDGGVIDDLIVYRMNEDESAYRIISNGATREKDSAHFAKVGGAFGVTLTPRHDVAMLAIQGPNAITKLLAVKPEWTDKVNALKPFVGVDLGDDWFVAYTGYTGEDGVEVVMPADEATGFFDELIKAGVAPCGLGARDTLRMEAGMNLYGNDMTDDVSPLEAGMAWTVDLKNENRDFVGKSALIALKNDGVKMRQVGLLLAKGGVLRASMEVITEDGSGITTSGVFSQTPNPPIAIARVPASFTGEHAKVIMRGKEMDVRVLKLPFVRHGKKQFD

SEQ ID NO: 2487 - protein, 240 aa, M.catarrhalis
QMNFSTFWQTAPLSLLLILSFIGLAIVQLLMGVDIDAPSTHDLLRFGANFMPLSMVGEPWRLLSSGFLHIGILHLLFNSFAMYYFGQVTEIIISSVHVGLLFILAVVGGNLLGNYLAWQAVFLGTPLAISAGASGGIMGLGAFLFSLALLQAPIALKLNTKTLGFVMAINLLMGFAVKEIDHAGHIGGTLVGFTLGVVYRYALSYRQYTNLILTGAMMGMAMLFGVIWYWLHWQIMAVIG

SEQ ID NO: 2488 - protein, 121 aa, M.catarrhalis
YFKYQKIRSAKFQQSWADFIYPIFFYLLINQADDEYSLNLKLSNKYDFIKIESYNFLYILVIFRYFIPNCCKHRLPKIFLGGSNSICWIIDYVMVLFLCNHFIGWLLYLWQSHRKNFRHQS

SEQ ID NO: 2489 - protein, 142 aa, M.catarrhalis
TLEYTWNRWFDFIGNHPVLVGLLIVLIIAFFAIEGKRSGRKVPPSELGLLVNNQNARIIDIRPANKFANGHITGSQNIPFNDLKNHLAELQAIEVPVILVCDIGMQAGAAVQLINRPNFMRLEGGIQGYQSAGLPLVGTNKK

SEQ ID NO: 2490 - protein, 591 aa, M.catarrhalis
PMSQFWINIIFVSLSFALYFGIAIWARAGSTKEFYVAGGGVHPVVNGMATAADWMSAASFISMAGMLAMGGYAASAYLMGWTGGFVLLALLLAPYLRKFGKFTVPDFIGDRFYSKTARLVAVVCLILACTTYVIGQMTGAGVAFSRFLEVDSNTGLIIAAIVVLFYAVLGGMKGITYTQVAQYCVLMVAYIIPAIFISLNLTGNPIPQLGMFGNDVSTGMPILQKLDMLVADLGFAQYTADVPNKLNMFLLTMSLMIGTAGLPHVIIRFFTVPKVSDARISAGWTLIFIALLYTTAPAVGSMARLNIINTVYPQGLNQPALAYEARPEWMKNWETTGLLKYEDKNNDGLIQYYNDKNEEYATTVTAEKGWQGNELTANNDILVLANPEIANLPSWVIGLIAAGGLAAALSTAAGLLLAISSAISHDLIKKTIKPDINDKGELMAARISMTIAIVVATYLGMNPPGFTAQVVAVAFGIAASSLFPALMMGIFSKRINSTGATAGMIAGLSATCIYVFLYMGWFFIPGTNSFKNVEANWILGVSPLSFGAIGAVINFIVAIAVSAMGNPPPKEVQDLVESIRYPKGAGGAINH

SEQ ID NO: 2491 - protein, 89 aa, M.catarrhalis
SMSQHEHHHTSGYWAANVRIITICLIIWALVSHGFAIWLRPMLSGIQFGGADLGFWFGQQGSILCFILLIFFYSWRMNKLEERFGIKED

SEQ ID NO: 2492 - protein, 961 aa, M.catarrhalis
LTFKAQHKENFMSFNDFSELFYENAFVHRHLGKDANEQQALLQTVGFDDLDSFVDAVVPKAVRLNKDLDLPEAMSEHNALAKLRAMADNITVAKSYIGQGYSPTRLPAVIQRNVLENPGWYTAYTPYQAEIAQGRLEALLNFQQVCIDLTGMDLAGASLLDEATAAAEAMAMARRVSKSKSNAFFVDERTYPQTLDVIHTRAKYFGFEIVIGDFDVAKNGEFFGAFFQYVGKDGDVVDLTDVITAVKDNGAYAIVASDIMSLVLLKSPADMGADIALGSTQRFGIPMGFGGPHAAYFAFKDKDKRSAPGRIIGVSKDAQGNTALRMALQTREQHIRREKANSNICTSQVLLANLAGMYAVYHGAAGLKRIATRIHALAVAFAKAVKSSELAVRHDVFFDTVLVECKEQAQAIFKTAKDKGYNLWQHDNGGISVSFHELTDEAEFDELCQIFGVKGSLDALQIQLGDLLRQDDILTHPVFNSHHTEHQMLRYLKSLEDKDLAMNRSMISLGSCTMKLNATSEMLPITWDEFANVHPFAPSEDTKGYIQMIESLQAQLKAITGFDEISMQPNSGASGEYAGLLAIRRYHESMGQDERNVCLIPRSAHGTNPATAQMMGMKVVVVATDDNGNVDIDDLKAKCDEHSDKLGALMITYPSTHGVFEEGIRDICDMIHTHGGQVYMDGANMNAQVGIMQPADVGADVLHMNLHKTFCIPHGGGGPGMGPIGLKSHLAPFISNHRVAPVFNAQSDCSAVSAAPYGSANILPISWMYITMMGRDGLLSATKQALLNANYIATKLSEDYPVLYTGKNGRVAHECIIDIRPLKAQTGISETDIAKRLMDYGFHAPTMSFPVAGTLMIEPTESESKAEIDRLISALKQIKQEALKVQTGEDGWTPDDNPLVNAPHTAFVITGEWTHPYSREEAAFPLPYIKAHKFWPSVGRVDDVYGDKNLICACPSIENYE

SEQ ID NO: 2493 - protein, 138 aa, M.catarrhalis
PPFNSPNSQERPMSNIPADLKYVASHEWLKLEDDGIITVGITDHAQDLLGDVVFVELPEVGREVSADEEIAVVESVKAASDVYAPIAGEIVEINDELVDSPELANEDPYGKAWFFKIKPANVADYDDLLSAEEYQSAL

SEQ ID NO: 2494 - protein, 82 aa, M.catarrhalis
WSQNTTEGVNGIALSTAFPIIAQVNGLKILGRETYQHNLENGKLPTEGKKMMIKSNLASSLKISGQRTDGVLILVLFFNVIF

SEQ ID NO: 2495 - protein, 410 aa, M.catarrhalis
LIQKSCLIDGLLNIYYLNIYYLKTLEKFMKFTLHHTDGGNNHARRGTVSLAHGNVQTPAFMPVGTYGTVKGMLPRDIHGIGADIILGNTFHLWLRPGMEVIRHFGGLHHFIGWDKPILTDSGGFQVFSLGAMRKISEEGVAFRSPVDGAKVFLSPETSMQIQNDLNSDIIMQFDECTPYPATHDDAKKSLELSLRWGQRCLDEHHRLGNKNALFGIIQGSMYKDLRMQSLQGLLKMPFDGYAIGGLSVGEPKEEMIKVLDYLPCAMPNDKPRYLMGVGKPADIVEAVRRGVDMFDCVMPTRNARNGHYFVTGNHDNKGVIRIKNSQYRTDDTPLDEHCDCYTCQNFSRAYLYHLHKCKEMLSAQLATIHNLRYYQRLMVDIRQAIEHHAFDEFVVQFYARWGMVVPPFNS

SEQ ID NO: 2496 - protein, 399 aa, M.catarrhalis
DMFELFKKKKPTTDPMQAVIDEMMLYGQPFRQYIEKMDIVDDKILQLQMRIFESDDTAELEKQYHKLQQKLYPIGIKEVNINVTVSSKDNGSDNTHDHTTQPNLVKTHHPTKKTDAISAQHDDKPPTKAATKQSQLNAHPRITHIIAVASGKGGVGKSTTTVNLALALQKMGKRVGILDADIYGPSIPTMLGVATKKPIVENDQFIPIDANGMAVLSIGNLIDAENTPIAWRGIKATGALMQLYNQTNWPQLDYLLIDMPPGTGDIQLTLAQRIPLTGAIIVTTPQHIALLDAKKGVEMFHKTDIRVLGIIENMALHTCTHCGHTEAIFGTGGGDEMAKAYDVPLLGQLPLDASIRVAMDNGKADELIDANLAWHYEHIAKLVNECAIQFTKKSSERFF

SEQ ID NO: 2497 - protein, 109 aa, M.catarrhalis
NIHEKPYIRCGPNLMEMAMQKVTIYTTPTCPYCLAAKQLLNNKSVAYDEISMYDINAEDREALSAKTNGYRTVPQIFIGDNFIGGFDQLNKLNADGKLDELLAQSFSHF

SEQ ID NO: 2498 - protein, 106 aa, M.catarrhalis
MHCDVYKFPKNEGWYVYIGRPDYPNDTENLKDLLGCLPATMRNKTGFWQFIMHLDLSSRQKLAQADIHQVKAKLNEQGYYVQAPPSEMLAAQAAIKAQDAQDKQFD

SEQ ID NO: 2499 - protein, 316 aa, M.catarrhalis
LYGLRSLGHCANHKKPNHKATNVSSSPTARPHLYSRGSRIGLRGSEKLKYDYEVLYKLEYRLENDGDFRNEKIKQPDGTEKTVAKTRNFEARDSWIGVKHKKYGTIKAGRMLSLDPYVRYTAYLASGVDGVRTNNTIAYESPKIKDVSFQAMYILDENKETDTIDRDGYSLLVKKNTDTYNVGAAYAYFGKAKTSYGKINYTARVTGNYKINEDYKVGGIYQHVGYANDDSAKNNTEQAVGVALQHFKDKWTHTAHMNLVNNPSGKKGDGFELIGAIDRDISKNVSAGMDITYGNFNYATEKESYINPTIYATVYF

SEQ ID NO: 2500 - protein, 289 aa, M.catarrhalis
TNLCIMALCMPEKNLLKSSINHSLIKNKIYIIIEGTDTPAGKLFDVLILVAIITSVLVVMLDSVLFLRLQYGRLFFVAEWFFTILFTIEYALRLYSAPNLRRYVTSFYGAVDLLALLPTYLSLFFAGTHYLLVVRILRILRIFRVFRLKSYMQQAGFLAAAFKTSQHKITVFFLSLLLLVTIFGSVLYVVEGPENGFTSIPLSIYWAVVTLTTVGYGDISPKTPLGQAIASMVMITGYAIIAVPTGIFTAELTRTMRPQLQPISCPNCGKFGHATNAKFCDRCGHDLHV

SEQ ID NO: 2501 - protein, 143 aa, M.catarrhalis
ASIWRLIRPSLVSWRLCNEIASFKPTDNNDIAAHHEAIVALLTLLSLYAPHVGEYLLEALKIDARTQAFPVLDKSALINDTITMVVQVNGKVRGKMEVASGTDQAELIREAKNIEGVSKYLIGDIKKEIVVPNKLISFVVAGA

SEQ ID NO: 2502 - protein, 361 aa, M.catarrhalis
TVLCAWQSDTYALAMQKRFLAVTESLKNPTMTLSGLWLLHSDEPLMIQWLIDACHPIWQANHQVMKRIDLTSPKSWHEVTQELISLSLFEESTAIILSGKHKPDDATLSQLIDFAHDAKAGTSTHHLIWLLPKQDKKSQNTKAFKLFDQHGLIIHGTIQNESERRALLVAKAQDFKLSLTANAWQMLMGHTQHDLLTAYQTLWRLSYAHTLPSQSQLSVIDVPDLSTLLSEGGVFSVFDLSDALIQRQPNQCLKIINYLYQTDTAPSIILWAISKDIHLIAALKHGQDPQKLGIWRNKVLNYQNLANNISDGMISHWLTQVYEIDKAIKGLSQDNAWRLIRQLVLSICGIDIQGLHSHHER

SEQ ID NO: 2503 - protein, 178 aa, M.catarrhalis
THQLCCGGCLMQIKSMIQAGAMVLTLLSLTACGFGLRGISETGIQLVPTYSHVNIITENNAVSYALKHKLETQMAQLGVVSDTNAAHQIQVSNLRYREYKLLGVLSEIRLVLTADIIYQMNGQTIRRVVQAERSYQYNEAGVSTKDQQGEIVKVWLQDSLAHRIAEQYYALGSQIHTP

SEQ ID NO: 2504 - protein, 165 aa, M.catarrhalis
NYIFYTHIKDKPIMMFWEILATIFSGFLLAGLVMPIRLFYKRAPKWIVPIAAGLGMIGFQVYTEYAWANDAIAKLPDQSIVVAKVEKSTWFRPWSYVKPQVFQFVVLDKGNTRIDFNNPAIKHSTLYFFERRAAVHPLGISVDCTHPNLAFNDTTNQNIIDALCL

SEQ ID NO: 2505 - protein, 170 aa, M.catarrhalis
PNFIFGQKSMNWLKNLPLEKIGEALAGFFGFWGRLTEGVPASQLPFIVYVVCCGLVLLLWLVVMRLIPQPFKGISLAVLAAVMFTPGQAAGNSGEIAPAMIGVFYAILMKDFSAALGAAVPIFAILAALLVVGAAWQMVRGVLVANAEKQAWVRQVQKQKQQLPQSEDKN

SEQ ID NO: 2506 - protein, 136 aa, M.catarrhalis
GVLMRHYEVVLLVHPDQSNQVADMVTKYRSIVEDNGGNNHRLEDWGRRQLAYPISKIHKAHYVLLNIECNDETLAQLEELFKYNDAIIRSLIIRRDEAITEQSPLAKEAEDKRTRKANRRNDVRTQEAESDNTASE

SEQ ID NO: 2507 - protein, 157 aa, M.catarrhalis
AVPMKSVQVKILNPKIGSHPDFPLPTHATAGSAGIDLRACIDEPMIIAAGETKLVGTGLSIYISDPNFAGLILPRSGLGHKHGIVLGNLVGLIDSDYQGELMVSIWNRSDTNFELKPAERMAQYVIVPIMRPDFEIVDTFSDISTRGSGGFGSSGRH

SEQ ID NO: 2508 - protein, 151 aa, M.catarrhalis
GIIMSEELQPQLGLERIYTKDISFEVPNTEVFTKQWQPETDVSISTSDNDLDEDYKEVVLTVSVTAKLGESVAFIAEVQQAGIFLMRNIPEADMPHLLQAYCPNILFPYAREAISDIVTRGSFPQLLLAPVNFEQAFLQSQLETQNDEGNA

SEQ ID NO: 2509 - protein, 268 aa, M.catarrhalis
NHQMSILRPVSPISPINQALLALAVIVMTAVFIEHGSVDVTISSWFYVEQGRWLLSKDQFVFSMLFYKLPKWLLIVFGAYLLTTLVWRQFITDTKFIADTNTMADKTDNSAKSLFGRRDAPIYAPLANFGQSDILYVFAVLALTPLLVATLKSLTHVPCPHELLIFAGDKPYLSLWQDILSQQRAKCFPAAHASSGFGLYGLAFVPALQHKRWRYVILVSAIGWTMGLYKMMIGDHFFSHTLASMALAWFVASGLSAVFFTKKHDIDF

SEQ ID NO: 2510 - protein, 185 aa, M.catarrhalis
GNQIMAKQVAVLIGSASQTSVNRLAFNYRESVAPSSLQFKVVEIADLPLYDRDLDEQDVPAYNRFREEIKAADAVLWISPEHNGGCSAMIKNAIDIASRPIGQSVWTNKPLGLISVNANGSSRVTDQLRTIATNPALNMPTLPFGAYFGGIFTGAFNEQGELVSEHGQATLKNFIKAYAEFIEKF

SEQ ID NO: 2511 - protein, 153 aa, M.catarrhalis
LLEICYVFEVDSVNEEVVDILIASNFIPVIASLGVDVNSDTYNINADLVASRVAKFLGAERLLLLTNIKGVLDKQGRVLTHLSAKDIDHLIADGTISGGMIPKIEGALEAIRSGLHSVTIVDGRVPHACLLEIFTEEGVGTQILCNKSSNPMQ

SEQ ID NO: 2512 - protein, 127 aa, M.catarrhalis
YLVFGIGYDAKHEKFGGNLYITRVSAKNAEDTYNLFWKEEQANDSTLRWRSGGYTTVDLTGYYKPTKNLTLQLGAYNLTNKKYMTWDSARSIRPFGTSNMIDKKNDKGINRFLAPGRNFKVSLEYVF

SEQ ID NO: 2513 - protein, 82 aa, M.catarrhalis
GSLVQLVEQLTFYSIGRRFESCTTPIYSPIAQSVEHRTVNPCVPGSSPGWGAKFKNSLAILIAKEFFYIIKNFIYYQYPKNQ

SEQ ID NO: 2514 - protein, 160 aa, M.catarrhalis
IMQVILLQRVVNLGKLGETVDVKAGYGRNYLIPQGKALPATEANLAKFEARRAELEALEAEELLAANARAEALADVNVIMRAKSGDEGKLFGSIGARDIADALTKSGLEVDRSEVKMPEGAFRQIGEYKVTIQLHHDISTDILVTILSEDAPTADEDDSE

SEQ ID NO: 2515 - protein, 766 aa, M.catarrhalis
LSLFLNFPLFLDSNMSQISLEDYNFSAIEKQLQTQWESDKRYHTNNETTDKPTRYMLSMFPYPSGKLHMGHVRNYAITDVLSRYYRQKGYEVMQPMGWDAFGLPAENAAIANAVAPAKWTFDNIANMREQLKALGLSIDWSREFATCTPEYYRWEQWLFLQLYKKGLVYKKLATVNWDPVDNTVLANEQVVDGRGWRSGAIVEKRDIPMYYFKITDYADELLDDLKTLEGHWPKQVLSMQQNWIGRSQGMELDFTYSIDDHDAVLRVFTTRPDTIMGVSYLAVAAEHPLAQHAAKQNPAIAEFCAECKQGSVAEADIAKAEKVGINTGLTAKHPITGTDVPVWVANYVLMSYGSGAVMAVPAHDERDFEFANKYNLPIPQVIDFKNKPSNYSTNQWQDWYSDKTGFCINSGILDGLSYHDAVTKVNEIITEKGLGQTTTQYRLRDWGVSRQRYWGCPIPMVNCEYCGTVPVDEADLPVVLPTDVIPDGRGNPLKNMPEFLQTTCPKCGQPAERETDTFDTFVESSWYAQRFVSPHDDSQMIERTAADKWLPVDQYVGGVEHAVLHLLYARFFHKVMRDEGLVSKDEPFANLLAQGMVLAGTYYRSNSDGSTTYYFPHEIDFVMNGTEIEGATLKADGKPVTIGKIEKMSKSKNNGVDPQEIIEQYGADTVRLYTLFTAPADQTLEWSDSALKGPHNFIKKVWRTVGEHLSAIQNHQSNDLTINKDTLSKDAKNLRRKTHETIAKIDVSLGEHLALNTPVSSLMEAL

SEQ ID NO: 2516 - protein, 85 aa, M.catarrhalis
LTSLLRSLYLPWAIHRQKKFKIWLKVFVIQKVQAVQSTTNLPSYKKSLRILGDFLISLNSFFGDTHKIVIIFMAFYAVVIYNIYS

SEQ ID NO: 2517 - protein, 321 aa, M.catarrhalis
ILISVIQGRPYAKPNMIMMKVPNPKLLTTSLLVLTSAIAVFSFSACYQIGDVVNEAAAEATQQPPIRTPKQTAKLNAFENSTYQTATDELLKAYNWTLISAEVQGAPIHSYENIIKNRAGSLSFSNRGLYFNVGCNHHSQHYQLSEGVLSIHHRTSTLMACHHSDSHSPDLAQVESKFAQDLNGSNLQIKTGPDEYTATLLLQKGAQVLTWQGDMKPEVRFGESVLLFWEIEPNKINCIDEIGQEQRCLKVRNVTYNEQGIKTGSGAWRTFYGQIHGYEHQPNLRQIIRLNAYNNPDSKENPYYIYDRPVEIYYLDVPVSQ

SEQ ID NO: 2518 - protein, 527 aa, M.catarrhalis
DEASIKLTKQDINTKARTDDYCDGEHCQALSNPLGLQLKDGKVVDKNGNPFTVAADENGKAVFHANGKVYSDFDSRRVDQYWFDCDAFDCDSPVDVYEANYGRFVRTTQVNLDRRKTDPNTNKTYATTSQYSHKILMSFPSSQGYLENLYSDRDLNTNTKQINIDFKKRLDKGSVSHHMTYGASYETTEKSMVNKSGYNAWSSTWWSDKTLGWDFSEKLRTCDNSSTFNGLLCPRHTTFSFLIPVKTKDGSVYLNDSVLIGDRVRLELGYRYNRIKYQPNYIPGQTAKIPDDLVKGLFIPLPSNDVGEEPKWWSSKYSGRNDPKFRTDLADYHAKKEAYETKLAQNPAKNIAYIGQPKTHSQHSYSLSPAFDVTKNINLQVKYSKGFYTDFIDFVFRGLEDIERKSSRKWPVYQSMNRQNAKAEGIEINFVLKLGELVPAIDGTQVSYKMTRQKGRADGNIPMNAIQPDTSFLVLVMMLNMKNLVEIYTLPVSVPKMLKIPTIYFGKRSKQTIVRLDGEVAAIRRLI

SEQ ID NO: 2519 - protein, 301 aa, M.catarrhalis
NMRFSHLMMQISLVVISMKKLEELFSKADRFGRIVANRFNKIKDLNDIRGIGAGKTVLITGASSGLGAMMARKFAFLGYDLAICARRLERLEAIKAELEGDYGITVHIKRLDVTDYEQIFEVFGEFTKQIGQIDKIIVNAGVGDSRVIGHGRFNINRATAEINFIAAIAQCEAAMQIFRRQNSGQLVVISSMSAVRGLPRHLTTYAAAKAGLARLAEGIRADMIKEKLPITVSTIYPGYVRTDLNIGAKYLPFEVEEDEGADVIIKAIEAKVDEAYVPLWPWLPIGLGMKYLPLRLITKFM

SEQ ID NO: 2520 - protein, 395 aa, M.catarrhalis
IKPSIGIMWVLICAYLDKLIGTSKIKQGAIMSHPMTHNPITQHKEIDDVNIEKFIPLITPNCLKSELPLSELAYHTVLNGRKTIQNILDGIDKRILIVVGPCSIHDPVAAHEYADKLKVLSEELKNELFIVMRVYFEKPRTTTGWKGLINDPDMNDSFDIEKGLHIARKLLLELNEKGLPCATEALDPNTPQYMQDLISWSAIGARTTESQTHREMSSGLSCPVGFKNGTDGSMTVAVNAMQAVQSGHSFLGLSGDGQVSIIKSKGNRYAHVVLRGGNDKPNYDETAVAAAENELAKGKTNGKIMIDASHANSGKDPYLQPMVIQNVASQIQNGNSSIMGLMIESHLKGGRQNIPVNLDDLEYGKSVTDGCLDWEATVETLRTFAKTVKAHLQNR

SEQ ID NO: 2521 - protein, 73 aa, M.catarrhalis
GDQSRRPQVLYSCFTLNIVKIESIAMRIWVIMHQSSLNQNSKAFATDIMTKDIDFIDYLKLPNSHNAICGLGI

SEQ ID NO: 2522 - protein, 1242 aa, M.catarrhalis
KIMSFVHLGIRSEYAIIDSIVRIKDLVKAAVADGQDTLALADWNNMFAAVKFYKACIDASIKPIIGAEVVVGEHSDKDAADARHSVILYAMSHHGYQNLMRLISDAYTNRPMNNHGSVEFETPVITKAALAEYSDELIAILTHRSEIAQPLLSHNPDNALPILQTWQDIFGDRLYIGIRRVKASDDKFNESAIIQAAKLGIAIIAHNDVRFIHASPTETNDKNNTVSTDFDAHEARVCIANGYTLADDRRPREYTELQYFKSQKQMAELFADLPQAIENTRLLASRCNVTITLGINVLPDFPIPKGETIETFFKKVSADGLNRRLEKLYPVEERGDDWDQVRKPYDERLDYELDIILKMGFPGYFLIVMDFIRWAKANGVPVGPGRGSGAGSLVAYSLNITDLDPLSYDLLFERFLNPERVSMPDFDIDFCIEGRDRVIDYVAQTYGRQAVSQIITFGTMAARAVVRDVTRVQGKPFGLGDRISKMIPKTPGIKLEDAFDQEPQLKELLTNPDAPDHELALEIWEMAKKLEGLTRNVGKHAGGVLIAPNRISDFSAIYCDGEGHPVSQYDKDDVEAVGLVKFDFLGLRNLTVLQAAVDNINQTRQAQGQSSIDLETLPLDDADVYTSVLQEAKTSAVFQLESSGMKKYLAQLKPSNIEDVIAMCALYRPGPLESGMVSDFIDRKHGIQEVAYPHPQFQHELLQPPLESTYGVIVYQEQVMQIAQVLAGYTLGGADMLRRAMGKKKPEEMAKQRSTFVDGAIEQNIDGGLAAQIFDLVEKFAGYGFNKSHSAAYGVLAYQTAYLKHYYPAEFMAAVLTSEMDDTDQVVFLLSDCRDNFGLTIIPPSVNHSQWKFVVRDAKTIVYGLGAVKGVGEEAVNSIVAARKDGAFKDLYDFCNRVDIKKVGKRSLEALIKAGCFDILAETLKPHYITDHSDCSYQIRRGLWRQLPEAMAAADQNRQNQLIGTMDLFTDVDDSLFVAPPLEDVYWQPQDRLRYEQATLGLYLTGHPLDEYRSELPLYTTVKSVVDLKDTAKGFAWIAGLIYDVAFFGERIVVKLDDGKGRIEMSCYGETFNQFKEVLTAGKRVLGIDEEYKPLYTKGERANMTIANIVIAKISVRENDDGRIFTRLHHIESIENARIRRLKEIHLKLACDDTQALEGILSVIKENSPPPELIKRGSHPTSEHDDIDISQVGDLCVPLSLYLYDECSVARIQTNDRLRLYPSDHNIAQLKNHITDDHLVFR

SEQ ID NO: 2523 - protein, 111 aa, M.catarrhalis
IGLYVDAPVMAKLAPEFWHEPEHALAAVQMGLDLVHQILYHAPDYLTKDGLLVCEVGNSEWALRQAYPEIRSDWLTFEKGGSGVFAITCEELLEYREDFAKQVERVQGLTH

SEQ ID NO: 2524 - protein, 208 aa, M.catarrhalis
NGRYMKIRVKWPMVMAMGLVLSACQSTPIPPKNNPQLAQIRTQIAISLLDMGKLDQAKQQLDAALSADRQFAPAYRTLAKVYQASEDATHQTKAQRLFEKAIELNPKDMQSYMDYGFYLVQMGDLSGALIYFDKPSRAIGYEGRVVAIENMAYIYYHQYEAAKSPTKDDYNNAKSALERALISGTQHDEIKKSYDKLLSDYKLLSDYK

SEQ ID NO: 2525 - protein, 173 aa, M.catarrhalis
VWIYDGTKPTSVNPQASKTAITDNNIYKSNTVMSNPSFKDLLSKSLQEDLKQMTKASTKPEMASDKPNETVNLPSSKAILHEVKRFNHDAINDDTVLFMQAMSGVIPLKTDAVVSHTKPTQTDENMLRRRASAEGDEPIQGVLSDMQALLNPVASEAFLSYKNPPYKTKSLSS

SEQ ID NO: 2526 - protein, 154 aa, M.catarrhalis
LSQYPYSYRHNHEIIIPNGDIMTSASINYSSLPNRRVDVEVGIGYNADIREARKVMIGLAEAHPNVLDDPKPTVIVTALADSSVDLVLRVWTNNDDWFMTQADLLEQVKYAFDEAGIDIPFPNRTVQIEGLQMDKFKTIFESNAKHPEPNSSNL

SEQ ID NO: 2527 - protein, 200 aa, M.catarrhalis
DKYLDLANRLKGYKNRIDGKVMSQSNKVANSESNTVVRTVADTAETAKEVVTDAARLTKDTLEHGANDTLQFLGVPIDINTLTQLAIDFSGRLVLALLIFFVGQWIGKRIVGVAKHIMVKSRLDRTAANFLGNLLYGLMLVTVILASLNKLGVNTNSFVAVLGAAGVAIGVSLKDQLSNLAAGVLIVILTIWRGDWLRLR

SEQ ID NO: 2528 - protein, 387 aa, M.catarrhalis
LSRHVFGQLNKNNGNTMSIHNPIKRRPTKKIYVGNVAIGGDAPISVQSMTNTNTCDIDATVAQIQRCVDAGADLMRVSTPTMESVAAFAEIKKRVSIPLIADIHFDHKIAIAVADVGADCLRINPGNIGNDQKVKEVVAAARHHNVPIRIGVNAGSLEKDLQKKYREPTGEAMLESALRHIDILENLNFQNYKISVKASNVFLTLDAYRLISAQIDNPLHLGVTEAGVYRTGTVKSAIALGGLLLDGIGDTMRISLAAAPEEEIKIGFDILKSLGIRSNGVNFIACPSCSRQEFDVIKVMNELEARLEDIREPLDLSVIGCKVNGPGEAKEATIGVVGASPNSLVYKHGAKSHLIDTKKLVDEIEAMVRAQVKDIQDKRANEIIRIG

SEQ ID NO: 2529 - protein, 413 aa, M.catarrhalis
LVLNQKIVKLKVYIKHKVCQILSHFLINFETIMTDNIRFCLPKGMSHKTFLAEYWQKKPLLIKGGLPDLIGMFEPEDILGLALEEGVSARLISQSDKNINQWSLKSAPLDEDDIYQTPKLWTILVQNLEQWSPELGELWSHFDFIPKWQQDDIMVSVAPKGGSVGAHYDEYDVFLAQGYGARRWQLGKMCTSDTPFVPNQPIRLLDDMGKIIFDEVLQAGDVLYVPPRLSHHGIAMNDCLTFSFGFRRPNLVQIMDELADVATNHANLFHVLTLPQADQPDAYELSQDSIQALKDQLITLLNSKEGDALLTDAIGELVSQRQYELLAFEDELDADTLKTRLEDGECLVLNPACRFVHVRDVWYINGEKVDLSDDERAYLKHLIHGDAITAEDANLQNLPWLSQWLNDNWLILV

SEQ ID NO: 2530 - protein, 253 aa, M.catarrhalis
VLKNHMTHTISPKLMNDCTIFTKPNAVLSSHAPIVGIDEVGRGALFGNMTVGAVILPNELSGRFDEIDLTNTKISLLNDSKKLSEKRREQLFDIITDLALDYAIVDVPSTIIDQINIYQATMLGMKIAIETIIIKNNLNEKNTTILIDGNQLPSMDGSLGEHFHQIYAMIKGDATHSSIACASILAKVHRDRLMIQHAKSYPEYLLDKHKGYLTAKHKAAILEYGILPEHRRSFSPIRELYNQGFINSNYWHS

SEQ ID NO: 2531 - protein, 67 aa, M.catarrhalis
FHEKWFLNKLENIYQISKNKSRQGATLAHDILLSDEWFDQDFLSPLTLFAEILKYIVLAWYLYLELP

SEQ ID NO: 2532 - protein, 446 aa, M.catarrhalis
IWHDNTANLLINLLISIEKIMTNTSSLTIGIVAGEVSGDALGGDFMQKMNALHPNIRWVGVGGRSMATQGLSSVIDMGRLSVMGLAEVMMHLPDLLKAKKQIITAFKTHQIDLFVGIDAPDFNLRIGKILKPQGVFCVQYVSPSIWAWREGRIHHIKAATDLVLCLFPFELGVYQKYAHPAICVGHPLLNKLHAHQDSPKVRLENFIHQYHNHHHGVTTLIKASHIICLMAGSRTSEIRAMLPLLLTSAQNIHQQIPTVQFVLPVVSAEHARLVHEILHTHHANLVNCVHILDDHNRSQKQNQPAISHACMTISDVVLLASGTATLECLLLERPMVVVYQVNPLTFMIAKRLVKIPYVSLPNILAKQYLGHPIVPELLQSDATAEKVSTKALGIIHHPNKQTKQLSNISAWLRSQSHQNSAKAVLDHYFMSTKKSYDTHHITKAYE

SEQ ID NO: 2533 - protein, 403 aa, M.catarrhalis
LNTCIECTVNKIPVITSAEQSDQAAKKVNLLGMSKDELSAFFVSLGEKSFRATQVMKWIYQFGVTDFFEMTNISKKLQHKLHEVACVVPPTVKYKEFSQDGTRKWVFEVAGGSLVETVLIPADDGKQFGRKTLCISSQVGCALDCSFCSTGKQGFERDLTPSEIIGQLWVANQSYMENVPPTERENRVTNVVMMGMGEPLLNYDPVVASMSLMLDDHAFGLSKRRVTLSTSGVVPKMYDLAKDIDVALAISLHAPNDELRNELVPINKKYPLKDLIKAAKSYVYDENPRHKKHITIEYVMLAGVNDSDEHAHQLVDLLKDLPSKINLIPFNPFPHAPYGRSSNNRIHAFSHILNQAGFVCTIRQTRGDDIDAACGQLVGQVADRTRRAKKWQESIQKRQSHHE

SEQ ID NO: 2534 - protein, 485 aa, M.catarrhalis
EDLLRNGGVKLNDRVQATLEIESGANDPLAILLVTVMITLNLDPTSQGIGDIIFMLISQIGIGLVLGLLSGWALSKMLPKVYLADGMYAILILSAGLIVFGITNLLGGSGFLAVYLAGVVIGNTKVRATEHVLRVMDSFAWLSQAVLFVVLGLLVQPSGILEVIHYSLLIFIFLLFVARPIAVFSSLLPFRFGIREIGFISWVGLRGAVPITLAIIPVTMAVPGADLAFNITFGMVILSLLVQGATIPLMSRLFRVWVPTNNEPKAEHEIWVADQANITLYEFEVKQGAFAIGRHPQSISSKFDAQALSLFALVRHNKLVNVNEDTILKMGDVVWYAMRGDDAPSIAKIFNNSATQYQKNSEFYGDWLLSPHARIADLPFYNLAARSLATNSSSRLPKPVASALDIFTVPPQVGAMTGIDEDLVNKLTEAKNQTVEEFMMQYFKTEPVKGDEVYLNETWSLIVRDVDGRGRLRGVGLKNKIKKEV

SEQ ID NO: 2535 - protein, 273 aa, M.catarrhalis
RKGSLMTIDTHFDADDLAEYDFDYTMNENGQLTQAEIATLYTELGEAEQALVTIRDFIRFVVTKLRQYDVVVAQGTTDEFAEAAAIVLHSLSLEWSADEQILACKLTPSEKQEVLTLLSERIIQRKPLSYLINLAYFCGLPFYVDERVLIPRSPIAELINQQFYPYFDVDDVRKNSFFSHGLEESQLAAPERILDLCTGSGCIAIALAKAFPDANIDATDIDKDALEVAWTNVEHHELAHQVNLLESNLFAKLPAENQYELIVTKLAFMWMHR

SEQ ID NO: 2536 - protein, 110 aa, M.catarrhalis
GFFILQKPTLQNKVFEQLKQGKLRWYDAVDLHGSSIDDARNAVLLLISQAINHGETVVKIVHGKGKDAILKTCVNGWLRQMPEVMAFVSAPAKDGGNGSVLVLLKKVAQS

SEQ ID NO: 2537 - protein, 395 aa, M.catarrhalis
GYFMYQRFINTALVAALAVTMAGCGTKAIKPTERKPAKLVNIQAPVAVLTQVSSVRLDQGRSGFSRRNANLRKDVIDLQIAPLADGMIAASRSGIVSGYMGESIAWQYNAEDVITGGVGIDDQGSVAVIGTRSGKLIALDARTGAPRWAVELASSSLTPALISGDKVIVITNSGTIFGLDINSGATVWQYATQVPNTSVRGMAKPLALDARTVLIGGADGRIHALDTMTGAPVWTRRVGLAMGSGEIDQLRDVDGTPTVVDHYLYAASYSGQLTGFDMTTGRTMFVSELSSTKKLTTLADAVIGSSTDGDVVAFNRLTGEKLWENHDLKYRGLTNPVTIGTYIAVGDADGVVHILNHQGQIISRVNTKGALTNLTVINHRLYAQSADGVVTVWQF

SEQ ID NO: 2538 - protein, 425 aa, M.catarrhalis
GIFMNKITAIRGFNDVLPEQTPAWRAMERTLIEVMDSYGYSQIRLPLVEETQLFARGVGEATDIVEKEMFGVVHGGNKGDEGSSFTLRPEGTAGCVRAIVEHNLTRGDTPKLWYLGPMFRYERPQKGRYRQFHQLGVEYFGAELPDADAELIAMTYHMWQKLGIGEHVTLQLNTLGETDERVAYKSALVEYLTTHQEALDDDSKRRLNTNPLRILDSKDENTQQILQNAPKLGEFLGEASLAHFEKVQNYLSALGISFEINDKLVRGLDYYNKTVFEWVTDKLGSQATVCGGGRYDGLVGIIKGKAEQSEPAVGFAMGLERLMLLIDAVNPYQVTSWCDVFVIAHPDYYIDGLKYAESLRLRQDNLRVKMASATGLKSQMKKADKSGAAYTVIIAEDEVNANQITIKTMATGEQRRAPIDYQFIR

SEQ ID NO: 2539 - protein, 328 aa, M.catarrhalis
GKIMLHTSKKPIELHITHLNNAQKDTKNKIKTIQSEHHGASHKFKDKLCQLFKDIKKLDKKCQQSTDDHTQKAAIYVLDFDGDIKASAVAHLREEISAIISVANRGDEVVLRLESGGGQVHAYGLAAAQLVRIKEAGLKLTICVDKIAASGGYMMACTADKIIASDFAVIGSIGVVSQLPNFHEFLKKHDVQFEQFTAGEYKRTVTIFGENDDEDRAKHQADIERIHELFKGFIHKYRPQLDLERVATGEVWFGEDALELGLIDEIGTSDAYLLDQLKACEAYLLHSRSKPTLAEKIGLAEQLGSSVTDVIGKTGNLLGQALAKFSRP

SEQ ID NO: 2540 - protein, 280 aa, M.catarrhalis
SLIMIDTPKNDNNFTDQKSLNALKLHGEKIIYAVLLVLAVFFGWQYYQKNYAKIDTVAADAYTSISVRDERLAQAYLNPQLDEVAKQALAEEEKQLFGDIDALVAANDNTVYAWQALMIKARHQTNNNDLDGAVATLSQATSINLDDDGLTAIAKIRHARAMLANGDTNGALSIANEAMPTAFEASRQELLGDIYHAKNEIDNAKSAYTNAWEALRERQENRAVLALKLQSLGVNVEPIEPTPSVVSIPNTQPVIEGGEVFEMIEHDSPVADTQNPHTGN

SEQ ID NO: 2541 - protein, 205 aa, M.catarrhalis
SLIITFDMNNPIAKTVNRCSWCLSDPLYIHYHDHEWGKPIYDDQRLFAQFCRETMQSGKSWITILKKRDNYYHAFDEFDAIKITQYDQAKIEALMQNTGIIRHLGKINAIINNAKAYLAITEHQSFSDYLWGITTPDGKPVINYPKTLADIPTQNEVSARLAKALKQQGFKFIGSTTCYAFMQAVGMVNDHLIDCDFRKKALVSS

SEQ ID NO: 2542 - protein, 321 aa, M.catarrhalis
AKCMSDQDKLGFLDLAVHAMKMVNRPMTTMQLWEFVLKNKLHRRLRSYDVSTESFIGKSPERTFGSSITRNKHIFKEVPNTNTKPKQYILKSQQTKLEVIKNLDQTTHRLAKYHERELHPVLTYFLKFDKYFQAYSKTIFHEISPKGAKGEDKWLYPDMVAVHFEYANYQKNHVLGFITKFNKPPIKIYSFEIKKELNFSNYKESFFQAVSNSSWANEGYLVAAQILPDGQFIESLKKLSQSFGIGIIELNRHNVKQSKILSPAKFKEMMDYSVVDELANKNDNFSQFLKTIIDFDVNHPHRYDSEFDKILNLYEPNDSNH

SEQ ID NO: 2543 - protein, 473 aa, M.catarrhalis
NMSIKPVVALIGRPNVGKSTLFNQLTKSRQALVADLAGLTRDRQYGDAHFENKSFIVVDTGGIGEMDDGSGNIDDYMATQSYTAIHEADIVVFVVDARAGLIGADSEIAHFLHTLGKPVFLVANKMDGVHEAAYAEFFALGFGEPYATAASHGRGVTNLLESLTADMPEDVPEDELDGKALKLAIIGRPNVGKSTLVNRLLGEDRVVVFDMPGTTRDSIYIPFEREGRSYVLIDTAGVRRRGRIDEKVEKFSVVKTLQAIKDANVVVVVIDAKEGIVDQDLHMLGYALDAGRAIVVAINKWDGLSQDQKDSVKIEIDRRFNFVPWVKIHLISALYGNGVGKLYPSIHKAYEASMFKVSTNQLTRILEDAVASHPPPMVGGRRIKLRYAHLGGHNPPVIVIHGNQTSSLPKSYQRYLENVFRNVYKLEGTPLQVEFKQNANPYEGKKNPVVKNKAKLMREKKRIQRFKRAEKKR

SEQ ID NO: 2544 - protein, 271 aa, M.catarrhalis
EKYMLKKLLKLKNTITDDVKAVLARDPAARSQMEVLLTYPGIHARIMHRGAHYLWNLDHKFMARALSHFSRCTTGIEIHPAAKIGKRFFIDHGMGVVIGETAEIGDDVTLYHGVTLGGVSWEKGAKRHPTLGNNVVVGAGAKILGGFRVGDDAKIGSNAVVVKAVPAGATMVGSAARMVVKHKQEQISTKHHAQSKELFNAYGLKPDSKDPVASSIAALLAHIQERDKQICELTAAVKKLDPNFNPQGIKSLCKDDLDVFDGEGLELDYHI

SEQ ID NO: 2545 - protein, 77 aa, M.catarrhalis
LSMIHQWQTHKTHTLAISAYKRPVNYGQINLIKNSKVRIFYVSALYQYRIGCSFGGNYGRLWHQSHQANRTQTCQIG

SEQ ID NO: 2546 - protein, 109 aa, M.catarrhalis
DSVFDFKTDLSIMNNAQLTYANIQAMVSEDVAIMDKQVLASLNSKVQVAMSVSKHVIDSGGKKLRSLITLLTALVVHEEQRHHSLQLAAITEMLHTATLAQDDVYAAFF

SEQ ID NO: 2547 - protein, 300 aa, M.catarrhalis
SFGVSIMMNDLLKSWLSRIRIVMVGTTLPANIGSAARALHTMGLDDLVVVNPRLPIDDSSYANAAGAGILLDKACITKDIKHAIGDCTLIFAASARSRQMPRPVLTPSMAAQVALKQLSQTVSKNTLATSLDHMNQSADDSVNALPKIAILFGREDRGLTNEELSLADYHIQIPANLNYPVLNVASAIQVITATFFDQFASTLTPSSLVSTKQIQGMPKEEYSLPIHIRSDWDEPAITQAQSANLESAIITLMQRLNLAHDDDLKHLPNRLSRLNRRLQLDQKEYALVRALIAKINKNLP

SEQ ID NO: 2548 - protein, 87 aa, M.catarrhalis
LKRFTSCKIAFELGKLTVSLGLSLAISGLVEALVICFKSSCRDFDNKSLKLGLLITVLLLYMLLSVIAVFDAWGLTLVGFVPSYIQT

SEQ ID NO: 2549 - protein, 85 aa, M.catarrhalis
VAFLRFSFIQIRKIVMSQKVLGTVKWFNESKGFGFIAQDNGGQDVFAHYSAITGSGFKTLAEGQKVAFILGEGKKGPQAEEIEKV

SEQ ID NO: 2550 - protein, 175 aa, M.catarrhalis
YAGFIMPNSTAQNFKHLAKTCHLTIALPPTIQDTFISSEPIQAYLKKLNQAIDDQVVAYGMHAVHHIANLLKVRTLAIDIILRQLFDFYQFPKDFALFAVGGYGRSELLPASDVDILLIGDEIGKATKPIESFVAMLWDIGITPAFSVRSVDELRAAVRDQTIASAMLEARRFGR

SEQ ID NO: 2551 - protein, 411 aa, M.catarrhalis
NFLFTVNTIDAIHQGAYMSLANPTLVLNCGSSSIKYALISEDGGSRIEGLAEGLGNPEARIKHKNLEGEATIIDIPNGVHADALKVILEDLIKAHKPVVVGHRVVHGGDKFKSATVIDEEVLSTIEALTSLAPLHNPANAAGIQAINAIYPDLPQVAIFDTAFHQTMPEYAYRYAVPKNLYTEHQIRRYGFHGTSHAFVSNRASQLTDAKGVHGWVVAHLGNGCSATAVYDGKSLDTSMGITPLEGLMMGTRSGDVDPSLHIHLNRTLGLSLDEVDTLLNKKSGLLGVSGISNDMRNLEAADKEGSADARLALDMFAYRTAKYLLSLTAALPEFTGIAFTGGVGENAVEMRADIIKHLKHLGAKIDTTKNDKLMRGAEGSFHAEDSSIELWVIPTDEEYQIASESRAVLGL

SEQ ID NO: 2552 - protein, 161 aa, M.catarrhalis
KYSPTIKNLKRFQMANFSPSINFAKRWLATPFKARTVIYQELDDIINLLDNELLVKDFCFRHADFNAAITQEMHKNSNTQTNRLIHTIETISLKDDDEVKVIQSPNFDELEARLTHNLSVQIDEFLGEHMAQLSEDLRAWVKMAVRHELANYQSEEKLSQN

SEQ ID NO: 2553 - protein, 299 aa, M.catarrhalis
KYIPTIDNLIIFMPKYHLAICVNIEIIVMNIKPIITTLSMITLMITMPTLANTISTHGFDDDDLPACAATPLPEDAKFAIIGSDCGYAEGLAPIIKDDHYGYVNTVGELVIPAVYQAAYPFSDGLALYRENDHYGYLDTSGQSVIAPQYTKAWEFSEGRAKIEQNGKYGFIDTTGKIVIHPNYEVIGDWFEEGLVLFKQKDKYGFLDKSGNIAIRPQFDSAKGFSEGLAAVTMKTDKVDEHGRSPHKYGFIDRTGKVVIDIKYDLAYDFLSGATYVVDGDNAYYIDKSGNPTAMPNYFE

SEQ ID NO: 2554 - protein, 92 aa, M.catarrhalis
SQIPTQHKYLLTADDGIAKAVHGDHVTQTMSVTAWQNCAAAHQTDKRPAHSSELSYKHLSFWLLSSQKTAKIQRDIIKTLSMNYNDNIRSQL

SEQ ID NO: 2555 - protein, 62 aa, M.catarrhalis
IATPTSDDANQNYRPMSVIKIMPLILPENFHLANLFLVLFKNLSNKSVISLPCLPIPPLYSP

SEQ ID NO: 2556 - protein, 351 aa, M.catarrhalis
KGHTMQNAPIVIMTAAMLTACSQQSTYQTVSGETMGTSYHIRFEYADHLSDAASIQAAIDERLQAINDSMSTYQENSTISRFNRLPAKTDLVIDDDFIQVLTDSQTVYQLSHRAFDPTVYPLVQLWGFGGQMSIERLQSPPTEDDIAKAKQWVGLDKVTLNEQKLSKSIDGVGLDFSAIAKGYAVDVIANTLHHDYGVVNYMIEIGGEVATLGVNDKGDPWTLGIDAPIIDSGVKNRTVLTTLTQPIGEPMHLATSGGYRNSIEYDGVRFSHTINPVTGWPVANNAPSVTVLHDTVALADAWATALTALPYTEALALANAQGLMAMFVIENPTKTGFDIVQTDAMQQKFAK

SEQ ID NO: 2557 - protein, 123 aa, M.catarrhalis
LIYTANRQGIFMKLISAIIKPFKLDDVREALSEIGVNGITVTEVKGFGRQKGHTEMYRGAEYVVDFLPKIKIEIACRDEMVDSIIESIIKVANTGKIGDGKIFVSPLERVIRIRTGEFDESAL

SEQ ID NO: 2558 - protein, 72 aa, M.catarrhalis
IFFAIFTTSQIGKVGGQTSAGRWLIVFIKTLSMHSALKLCGHVVTSWLKFKDEILNRIFNLNKSEIFFKEDE

SEQ ID NO: 2559 - protein, 162 aa, M.catarrhalis
RRFAKDIGDKLFHRNKKQDAAQPTAAPAATPAEEPTAQEIANLLLARIQAQNVNISGLKVNYNGDTDTVTLSGVAKTQADRERARLAVGNVQYVETVVDDIEVESAEPESRFYTVKSGDSLSKIAKEMYGNANDYMKIFDANKPMLSDPNKIYPGQVLRIPQ

SEQ ID NO: 2560 - protein, 353 aa, M.catarrhalis
CTKAMIYFKHPKQISAWLLVIMMSATSTAHANDSAINSAEQLTTHITTAIKQTIVKSTDNDRLYQDPNQQADGEIVGVRSFDDSFSDCQNQFANRQAPTLIGKQGERLSTMARALCFEGFATLHSGIARTPLWSASHLTQARISQARTLARVDSFHAESRLPADERAELSDYRRSGYDRGHIAPNGDMATTGSQYDSFSLANIAPQNGEHNRHLWRHIETQTRQLAIEYGEVYVVTGVAFLGKTSERIGGRVLVPSHFFKAVYIPKLSTAGVYFSSNDSSENYQIISLDELARLTGINAMPSLPTQIRQTAYDLPRPSSNKNPEQKVLDHQPSSWFDLVISAMRYVFETLNRT

SEQ ID NO: 2561 - protein, 319 aa, M.catarrhalis
HMKAVFLDAGTFSKQACLPTPKGVTEYQTYSQTPQDDEIIIQRCCDAQIVITNKVVITRNILKALPKLRLIQLTATGMDNVDKQACQDLGITLKNVAGYSVNSVPEHTLMMMLAIMRGAKYYHQRATDGTWQADGRFCLLNEPLFDLYGQTLGIIGAGNIGRRVGELAKAFGMHVLYAEHQGKTPRSSEYTEFETVLNSSNVISLHCPLTDATKHLINTDTLTKMHQKPLIINVARGGVVCGADIVDALINDHILGYASDVFESEPFAKNDPLLGIADHPRVLFTPHNAWGSLAAQEKLWEILANQITDFINSHSTHNP

SEQ ID NO: 2562 - protein, 62 aa, M.catarrhalis
VRWATVLVTKKRVAGGWTKNHCLGSKIVNLKASKQIHLTPPKSIMQMMIAKTDQHKNTTLTI

SEQ ID NO: 2563 - protein, 212 aa, M.catarrhalis
ACIYQSMQTHIMNHTTVIIIITVIISIAAWQSRPLLERLIFYPPAVNKGQYDRLLTHGFIHANGMHLLFNMFTLYFFGRVIERFYIDKFGNLGFVGFYISAIIIAMLPTYARNKNNTYYSSLGASGAVSAVLFAYILFAPWNTLYLFAVLPIPAIVFAIAYVAYSIWADRRDGGNINHSAHLFGAVFGVVATIAIEPNLIVHFLHRLLNPSL

SEQ ID NO: 2564 - protein, 610 aa, M.catarrhalis
SYGQIHSNSNPSMSFKKTMSLNYHISFERFNEHLADIRIHHTALSDTPAFSMVTWIAGSYLIREFSKNITTVYYQIGDSPIRHRAEKIDKKTFVLPNAKQGDDITIHYEVYCRDLSVRTAFVDATRIFGNFTSLLLLPEANKQTQANITLFVPKTFLANHLKCTIACGLKFEQTSTSDGLEYRFNGLAAFEYFDFPFEIGNQDEISFEIIKDKKTCLPHRFFLAGHHHGNLHRLKADLTKICQSYVNWLGDAPFADYTFMTMVTDKDYGGLEHINSTALISPRGDMPAFDEPQIPNEHYQRFLGLCSHEYFHAWWVKTVKPDVMMNNTLTEEAYTPLLWVFEGFTSYIDDLMLLVSGVIDKSSYLKLITAQINRYQQTEGLLHQSVAESSFDAWIKLYRTDENTNNQGISYYNKGALVALLLDMMLMDKTDGKYRLFDVIKACYIKTNNQPFGLTTQILGEIIAQMMGQEAWQDFYHRYVIGVDPLPLTDYFTKFAIQAKFQDKHKTWGISFNEHAHGLTITHVSRQSAASHAGLSYDDTIIAIDGLKATSALLNRLVKHQNTTGSPLTVHAFRRDELLSFTINNQKTIHQTVKLEGDGGLWLNFADLTS

SEQ ID NO: 2565 - protein, 416 aa, M.catarrhalis
TNYQTYTKNANLKNKISFLGIQKAGIADKSDESLFGNFTNFSIIKMAWFCIFDFYDEKGMMMTIVTDFLMTHDKRRIAIITLNRPDALNALNLEMVAAIQACLDKWAIDDSVAAVLLCGAADKAFCAGGDIRGLYHGYNPKIFPNPTAKAFFSTEYALCKQIKSYTKPIIVWADGIVMGGGMGLAVASSHRIVTQTTMMAMPEISIGLFPDAGGSYFLRHMPNKIGLFLGLTGARINGTDALALGVADFGMASDDFDVLIQALTTADWSDDATKNHQMLNALLGQLHHNHTLPTGWLLPHRDEIERMMQQAGDLAAFDTLARLGFNIEYIQQAFKTYIAGSPTSAAITWHMANQVENMSFDEVMDLEYIVAIHCSHNGEFAEGVRALLIDKDKNPKWQYTPDSLPDGYIKSHFKAW

SEQ ID NO: 2566 - protein, 543 aa, M.catarrhalis
LMTQQTTQSPNMTGHTQTKDAAAHFRELQDIIARGEIAMMSGAEMLVQALIDEGVEYIFGYPGGAVLHIYDALFKQDKIEHILVRHEQAAGHMADAYSRTTGRTGVVLATSGPGATNTVTAIATAYMDSIPMVVLAGQVPSSLIGDDAFQECDMVGVSRPIVKHSFQVRHAEDIPTIIKKAFYIAGSGRPGPVVVDIPKDMTNPSDKFAYIMPKTVNIRSYQPTNKGHGGQIKKAIETLLSAKRPVLYSGGGVVLGNASKELRQLADTLKLPVTNTLMGLGAYPGSGEQFVGMLGMHGTYEANMTMHHADVILAVGVRFDDRVTNNVKKFCPNATIIHIDIDPASISKTIMAHIPIVGDVKLVLNEMLALLAEIDKCIDEHALNDWWQQINEWRKRHGLRYDADDMTAKTHAIKPQHVVETLYKLTNGEAIITSDVGQHQMFAALYYKYDEPRQWLNSGGLGTMGVGLPYAMAAKLAHPKKTVVCITGEGSIQMNIQELSTCLQYNLPVKILNLNNAQLGMVKQWQDMLYEGRHAQSYMQSLP

SEQ ID NO: 2567 - protein, 179 aa, M.catarrhalis
QLWHPPKRWQFVYQEFLMTTINKDTVVQFNYTLTNAEGEILDQSRDQPLVYLHGHHNIIPGLEKQMMGKSAGDTFKVTIAPEDAYGEYVQEAVQEVPRANFQGVDNIEVGMQFQSQTDDGHVMLVTVKDVNDEIVVVDGNHPLAGVELTFDVEIVEVRAATADEIAHGHAHGAGGHQHS

SEQ ID NO: 2568 - protein, 150 aa, M.catarrhalis
NRYNECYFDIDKSFMPDFSLEVVFIALSLMIAIFVMIESTLLERNGGKLLLKNSIFMFISLSTSAWMVAACLAWYFLDLVGLGLVVAMVYPLYGLLGLAYSAMLMRGIEVDDPAEVALPKKYLSFCKSFGLVYSILCLTALLESVGLIQI

SEQ ID NO: 2569 - protein, 202 aa, M.catarrhalis
FFGNHCMTLIIGIDPGSRLTGYGIISTNNDQLTFLDAGTIRTNSSDITERIAQIFAGVSRIVNHYQKYSNKPIQAAIEQVFMANNPDSALKLGQARGAAIAALTAQDLQVSEYTARQIKQAVCGYGAADKEQVTAMVCRILSLDIIPQADAADGLACAICHAHSSHSMHKLFGVSTLGNRTGNKKKGRWRLDEESLLRLKNR

SEQ ID NO: 2570 - protein, 330 aa, M.catarrhalis
PRGNNMTTQFQCRVHTQRFDENYEPATSTRLTTNFANLARGENRKENLQNAIRMINNRFNDLAHWDNPTNDRYSVLIDIVSIDVDVAGKGEFFSGLEWLKTSVVDHKTGKTTPGIIGNSFSSFVRDYDFSVLLREYNKDKAEFSVPEGYGDLHGKLFKFMIASEEYKAHSKKAPVLCLSVATTRTYHRTTNTHPILGVEYVQNDYSLTDEYFAKMGLKVRYFMPPKSVAPYAFYFDENADLLNDYTNLELISTIATMEAFQKIYRPEIYNANSVAGQIYKGSLTYEDYAVPKVDYDRVERNDLAVKQGKIAEEQFIKPYQEILDAWLAEK

SEQ ID NO: 2571 - protein, 123 aa, M.catarrhalis
ANTKFIECKENMMSELITISGQITVDDVKSLANQGYKTLVNNRPDGEEPNQPSSDDIAKVAGEYGIEYRHIPFAGGMLEMHHVQEFADFYNQSQRPLHIFCRSGNRSSIILQAARDHDLLDEE

SEQ ID NO: 2572 - protein, 66 aa, M.catarrhalis
RCTNTCCTKLIILLLVMSFRLGQMNDNIPILQVLLITKTNRNQPKNQITHRSFGSWVVFIGSQYMM

SEQ ID NO: 2573 - protein, 403 aa, M.catarrhalis
LPANRINMPQTAEEILSSGQADLVQMARPFLADSDWVNKAASNQAHLINTCIGCNQACLDHTFANQRASCLVNPLACFESEISVKPTKKPKKIIIVGAGVAGLSAAVTAASRGHQVTIYEQHTHIGGQFNMAKVIPGKEEFFETIRYFREQIKHLNITVHLNTKVDKAILNQSRADHVIIATGVVPRMLPSLEGANLPQVISYSDLLTGKKIAGERVAVLGAGGIGFDVAEFLTHGSSVSDAVNDATYKPKAMDVDTFFTHWGVDQQACYQTKGALVEPNYTTPVRQVYLLQRSEGKLGKTLNKTTGWVHKAAIKQAGVIQIAGASYDKVTNEGLWITIDGKSQLLRVDTVVLCIGQESVNDLMPKLGDTPKADYQVIGGAKSSAQLDAKRAIKEGFELAARL

SEQ ID NO: 2574 - protein, 546 aa, M.catarrhalis
IMAKDVSFGSNAREKMIDGVNILADAVKVTLGPKGRNVVIDKSFGAPTITKDGVSVAKEIELEDKFENMGAQLVREVASKTNDVAGDGTTTATVLAQAILVEGMKTVAAGMNPMDLKRGIDKAVRAAVEEIRAISTPANDHKAIAQVGSISANSDATIGELISKAMETVGKQGVITVEEGSGFEDALEVVEGMQFDRGYISPYFANKQDSLTCEFDNPFILLVDKKISNIREIVPLLEKVMQTSRPLLIIAEDVENEALATLVVNTLRGGLKTCAVKAPGFGDRRKAMLQDIAILTGGVVISEEVGLSLETAEIEHLGTAKKVTIGKENTVIVDGAGDKASIEARVESIRRQVEESTSDYDKEKLQERVAKLSGGVAVIKVGAATETEMKEKKDRVDDALHATRAAVEEGVVPGGGVALVRALSALSDLKGDNEDQNAGINILRRAMEAPLRQIVSNAGDEASVIVNEVKNGSGNYGYNAASGEYGDMLEMGILDPAKVTRSALEHAASVAGLMLTTEVMITDKPAPEAPMPAGGMGGMGGMGGMM

SEQ ID NO: 2575 - protein, 259 aa, M.catarrhalis
HILNTKKHKMTKLVLFNKPYGVHSQFKKDHDGMITLADFIDDKTMRVAGRLDKDSEGLLLLTDNGRLNHAITTPPTAKNAKDKYTKCAKTYLVQVENIATNVQIQALEQGVMLKDGKTLPAKVQKLDENELPIRLWQRNPPVRQRVNIPTTWLKITIVEGKNRQIRRMVAHVGLPCLRLIRSQIGIWQLNGLAVGESRVLQLDQQTLLKLGLSAQPTPKQNKPTNLISSNTKGAVNPKSGKIHLLKKPSWRVRPPKFRA

SEQ ID NO: 2576 - protein, 282 aa, M.catarrhalis
NKMKQYLELLQHILNHGTDKQDRTGTGTRSVFGYQMRFNLAEGFPLLTTKKVHMKSIIHELLWFLKGETNTSYLTDNQVTIWNEWATAEQTARFGRAEGELGPIYGHQWRNFGASKKSDGSYHDDGFDQIAWLINEINTNPNSRRLIVSGWNPTEATEVALPPCHTLFQFFVSQGKLSCQLYQRSADVFLGVPFNIASYALLTHMVAQVCHLDVGEFIWTGGDTHLYQNHFEQVKLQLSREPLPLCSLRLNPKVRSIFEFGFDDIQIADYQAHPAIKAPVAV

SEQ ID NO: 2577 - protein, 268 aa, M.catarrhalis
YFKKSMMTKHIPILDDVAIDKMKTAGKLAADVLVMLDEHVKTGVSTGVLDDIAHQYILDHGAIPAPLNYNGFPKSICTSINHVVCHGIPDHERLLKEGDIINIDITVIKDGYYGDTSKMWIVGQGSVMAQRLCQVAQKALYAGMKVVKNGAHLGDIGAAIQAVVEPERFSIVREFCGHGIGQTFHAEPQVLHYGKAGTGIELKTGMAFTIEPMINQGVWQTKIMKDGWTAITKDRKLSAQWEHTLIVTDNGCLVTTARPDEDLSFLSS

SEQ ID NO: 2578 - protein, 414 aa, M.catarrhalis
QFFEMTTTKTTDVCTIAQMSEQGVYPSDEQRHSFAKRLLTWFELHGRHGLPWQYHHQPSADIYAVWVSEIMLQQTQVVTVLKFFEPFLARFATVQELAVADWQEVASFWAGLGYYARARNLHAGAQQVADFIDTHGRFPETVNEWQAVKGVGRSTAGAIVAMGVKKFGVICDGNVKRVLARHRAVCGDITKSATDKRLWEIATALTPKEYSGHYAQAMMDLGATICTRTQPKCHLCPVTDDCIAYALGVQSQLPVKKKAPPKPHWHSIALSLTHCGLTLWLHRQNGGGIWDGLWSLPIFMLPLDDNQKLDNNTLSDAIFKAWQSDEKVHDLLHSQLIEILPIPTQTLTAYLRHTLTHVHWHLYGMSICLNNSQFNQINQTLTGLGIDYLWTDTPYNLPLPAAMHKLLTLSNSSC

SEQ ID NO: 2579 - protein, 95 aa, M.catarrhalis
TVLDKTKIIEEYTMIHPFENDEQALTIGDLTIENHFDVVQIFGELSITKCQDGLTQAMALQDFANRLVAALKNEPLDEIKAHDMLPSEQIDNPFA

SEQ ID NO: 2580 - protein, 83 aa, M.catarrhalis
MTHESNAKKTLLDCLKNMLKFRAYHPSLQITFCKFSKSRCPSVSVMTSHRTGISHAITIFKTASHQDYPDQSTKHQSPSTNPK

SEQ ID NO: 2581 - protein, 311 aa, M.catarrhalis
DTNDITKNKDRPMLIEFTKMHGLGNDFMVIDLVTQRMTLTPELIRLLADRRIGVGFDQLLIVEPPSRPDIDFKYRIFNADGSEVSQCGNGARCFASFVQARKLSFKQRLRVETSSGIIILSTNRYGWVQVDMGKPKFEPDQIPFTPKTITKVGRAYRLDVDGIPVQLYVANIGNPHAIIKVDDVLDADVDRLGKLIESHEAFPERVNVNFVQVINQRHVRIRVYERGVGETQACGTGACASVATGIREGWLDEGVDIRAQLYGGSLAIRWQDGYSLIMTGPTAFVYEGVFSPDGLAASAGIKLDPNADDIY

SEQ ID NO: 2582 - protein, 404 aa, M.catarrhalis
HTIEKFMSNNSHCSDIIIVGAGPAGLAFSRFFKGSDVRLTLIEKSSLAALQNPAYDGREIALTNTSKEILQNLGAWQRFAPDEIYPLKDAKVYNGNLNYALHFQVPKLMHRQRSLDRLGNLISNHNIKKALYDEVATMDNVTLITDATVTDVNTDDTKACVTLMNGKQLYADLVIAADSRLSGMRRMLGIGAHMHDFGRTVIVFRVTHPLSNHGTAQECFLYGRTLALLPLNETMTNCVITLDNTQADELLKMTPEQLAHEAQRMFGDGFGTFTIAGTVHHYPLMGVHAHKFHANRAALIGDAAVGMHPVTAHGYNLGLQSANTLAPLILQAHRRGLDIGSNHLLSMYNRRHQAHTRPLYHGTNAMVTVFTTDTLPMRTVRDMALRLSNNFPPVKHWIAKQLVG

SEQ ID NO: 2583 - protein, 296 aa, M.catarrhalis
VWIDMAIVHPQINPVALDLGMIELHWYGLMYLFAFVVAYFLAWVRTKSRTDFTPEMVSDLVFFGSVGVILGGRIGYVLLYNFGELIANPLYLFRVWEGGMSFHGGFVGVLLAMWYFAHKYKKAPFAVLDFIAPCVPTGLFFGRIGNFINGELWGRISYADVSHLMYFPQAARVDFEMIQANPALQDITANIGGYLLLPRHPSQLYQAATEGILLFVVLWWFSAKPRPRYAVSAVFLLVYGLSRFITEFFRQPDVGYALIFGWMSKGQLYSLPMIIAGVVLMVMAYQKQIYDWNKIK

SEQ ID NO: 2584 - protein, 69 aa, M.catarrhalis
VVFWHKNYQIINSWYIFLFFKTDIGTNCLQRSSKLSYFKIILNVIILINNHRLNEVLKILTQCLNDRRF

SEQ ID NO: 2585 - protein, 166 aa, M.catarrhalis
TSSCHRSRCAFGDTGQTVASRQLMKQSQALRRIKPIKPVHQALRITWYAWIFMTLVGYPVAVSLTTDASLWAGMGVQSLVLVPAVIFAPTIHQGKSPYALMWVSMIMLIYLGASGVLTLLRIYEQSPKAVAAAELIEFLLLLTINSQLLILLKRLPAMHTKHTHPK

SEQ ID NO: 2586 - protein, 63 aa, M.catarrhalis
YLKWHDTVLYDIKCQTNIKPKEKSPKQTAGVIYSVMNKQSFAYHSSDVIDMFLVFAKEVICFF

SEQ ID NO: 2587 - protein, 141 aa, M.catarrhalis
YNISQLMIWCCVMTGKLIKTAKNTVCQVALGLGICVNDAHSTMIFQSVGVFGEPVFSQIAPIGKPPTAIKVHYFSVPKNHQNTQACHYLKTSLNTLKSGGVIYEIGENGQQTKLTPDLIQQKIHHIQTAIDNHCRNSVYAH

SEQ ID NO: 2588 - protein, 803 aa, M.catarrhalis
LVMRLAKPPSRLSLLWRCFGILVSHLLFRCEVSMSCVLPSVTKPLLLPCLRQDVLAGNEDLSWQPIQAVKEVWDIGSFYDAKMAESKARYLAHNATEYNLEPNIKNAPGGLRDIHMIGWLGRFYFGSSDIKLLATTDFINENECTILQAGQRYLWCIRHHLHTLAGRGEDRLLFDYQKAIAERFGYYTRTLDTTHQDITQALETMMRVYYQHAMKIAAFSEVLCKYFYENYLSATARLIDIDETFYLIQSGSDHQSRPAKIAIRRPDAFLVDPANLLKIFLVMGQKGIRQIAASTLRAIYASSDLIDEEYRKNPVHRQLFLANLQELNYLFHRLRLMKRFGVLGNYLPAFGKIMGLMQYDLFHRYTVDAHTLLLVRILHRFGDDRLDNQDKYGLVAEIYQRIARKDILVIAAIFHDIAKGRGGDHSKLGAADAYEFCLAHGMSEADSKLVRWLVLEHLTMSLTAQKQDISDPEVIAKFAEFTSSITRLNHLYVLTVADMNATNSQLWNTWRATLLKQLYTSVHQVHSLGVHVVDKDRVIDDRKNKAQDLLPMVDNHRLKALWDGFGEEYFLKQKHRDIAWQSAEILAAEHRLKQGKPIIAIREHSDVSLRGMQLLICAPDQDNLFATTVCILDQLGLSVLDATILSADIDGTSTAVDSYVIIDRLLPTDSSIPLLLSPERTSQMILGLEHGLKTGGVPVPSRVFEVDGKLKHFIVPTQVYFSEATSLAHQGHHKMHLITKDRPSLLAKVGAVFSELNIQVHGARITTLGERAEDIFYLSGLHGVSLNDDALAKLKSAIIQALS

SEQ ID NO: 2589 - protein, 176 aa, M.catarrhalis
GTSGCMMENIQLVHVVAMSQNRAIGKDNQLLWHIPDDLQHFKRITHGGVIVMGRKTFESLPNLLPNRTHIVITRQPIDYEGAVTAHSLQDAILLAKAYAHAKRQNKIFIIGGGEIYHQSLEMADVLEITEVDTVIEGDAFYPDIDEKFIKTDETKTFYCDKSGFQFRFCTWQKVLT

SEQ ID NO: 2590 - protein, 327 aa, M.catarrhalis
QATGQGLAMPLPFLKQRLTKIIPTKALSTNPQAPIPNSNYPHLFEPLDLGFTTLKNRVVMGSMHTGLEDRFYHYGKLATYFEARAKGGVGLIITGGIAPNRTGWLIPAGGTLNRLGDIVHHARITRAVHKHGAKILLQILHSGRYGYHPFVVAPSPIKSPISPFKPRQMSQNNIQSTIDDYAHTAKLAKKAGYDGVEIMGSEGYLINQFLSARTNKRTDSYGGSLENRMRFAIEVVRAVREAAGINFIITFRLSMIELVEDGATMQDVITLAKALELAGVSIINTGIGWHEARIPTIVTSVPRAAFTRYTAAVKHAVSIPVIAGQSH

SEQ ID NO: 2591 - protein, 343 aa, M.catarrhalis
GNFMSLNIYYDKDCDLSIIQSKKVAIIGYGSQGHAHALNLKDSGVDVTVGLRQGSASWKKAENSGLKVAETSEAVAGADVVMILTPDEFQRELYKEVIEPNIKQGATLAFAHGFAIHYNQVEPRADLDVIMVAPKAPGHTVRSEFTKGGGIPDLIAIWRDASGGAKQLALSYAAGVGGGRSGIIETTFKDETETDLFGEQAVLCGGAVELVKMGFETLVEAGYAPEMAYFECLHELKLIVDLMYEGGIADMNYSISNNAEYGEYVTGPEVINEQSRAAMRHALKRIQDGEYAKMFIAEGQTNYPSMTARRRNNAAHPIETTGEKLRAMMPWIGGNKIIDKQKN

SEQ ID NO: 2592 - protein, 253 aa, M.catarrhalis
IKFICQAGTKQMCLRCHQSLVDILEQILRKNLTAVLIMTLGGLSATAMAADLTGYLATYRVSADGKTGTATRTLTKTGNNYRYTVNARAAGIATLSQEARFSLVNGNIIPQSSMMSARILGIGNTHSVRFNRANKSAVSTYKGKTVTLAMPKPAYDDLSLETQIRQELINGKFNGSYQLVKRDQIETTKFRRAGHGKITVPAGTYDTVRIDRIHDDQNRATSFWLAPSLNYLPVKVSQTADGKVIFMELTKIN

SEQ ID NO: 2593 - protein, 469 aa, M.catarrhalis
ENIMSKKYAVVGLGSSGLSAVNFLVNHGHKVSIIDGNPNPTLADKLPTGVHCHFGSLDSELLSSADQIIISPGINPRTPSIVAAKAQGIPVISDVQLFIDTLKARDLTQATNTPIIAITGSNAKSTVTTLVGEMAKHAGMIVGVGGNIGTPALELLTIQNMDLVVLELSSFQLEHISNLAAQGATILNLSADHLDRHDGMVDYLAQKLRIFENCQTAIICQDDANLAKQCLTTLTSVAPNHTIITTNSLLSHQTADFYLFDDGDGMALYHQKNKLLPIHQLKIKGKHNLLNALSALALGTAANLPMDAMLDTLKTFKGLPHRCEYIDDIDGKAYFNDSKGTNIGSTIAAIDGLGTVYGISSLALILGGLGKGQDFSELSAYVMQWVDSVYLIGQDAPIIEQDLLKGDAHLASKIYQVGTLDRAVLAASQSTARAVLLSPACASMDQFKNYNERGDKFVNMVHALAHAPI

SEQ ID NO: 2594 - protein, 260 aa, M.catarrhalis
EPIMFFLLSPAKNLDEKTAVPLPSHTVYSSPRFIEQAAQLMQTLKNYDVIDLQELMGVSAKIAELNVIRNQHWAYPFDENAKPAIYLFAGDVYTGLDAYHLNENQINYLDDRLGILSGLYGLLKPLDLILPYRLEMGTKFQTKQADNLYQFWGDKITDQINQHLKQSDGILVNLASQEYFGAVHPKQIQGRIITPRFEDAKNDGYKVVSFYAKKARGLMVNYAAKHQIQDVEDLKYFDTDGYYFAPSVSDENHWVFRREW

SEQ ID NO: 2595 - protein, 438 aa, M.catarrhalis
DNVMTFSPVSHHQDGALYIDPQALANALPHFEYIDGTLHFDGINTHTLKEIYGTPLYAYSQRTLLENYQSYTDAFDAIDHQICYAVKANSNLAILKTLAKAGAGFDIVSKGELARVLQVADAKKVVYSGVGKTADDIEYALKADIHCFNVESLSELDTINEVAGRQNQIARISLRINPDVDAKTHPYISTGMKDNKFGISHEQAVAAYVYAHHLPNLKIVGIDCHIGSQLLDTDGFSDALDKLIELIDTLTDKGIKLQHIDLGGGLGVRYIDENPVSIDQVATVLLPRLKQLGLKLYLEPGRSLVANAGVLLTTVDVLKPTEFKNFAIVDASMSELIRPALYESQMAIIPAKLSRDTAKTWDVVGTVCESSDFLGKDRILSLQVGDTLAVTGAGAYGFSMACNYNTRPRPCEVMVNHGTHRLIRKREALDDLWKDELI

SEQ ID NO: 2596 - protein, 181 aa, M.catarrhalis
YVVIKRGAYLMPNQVHKHLISVLMENEAGSLSRVVGLFSQRGYNIDTLNVAATDDPTISRLTLTTITTHDKIEQITKQLHKLIEVVKVQNLSELSGGHHVERELMLIKVRATGSNREEIKRNADIFRAQIVDVSTNLYTILITGDAGKLDGFIDVIGRDRILEVVRSGVIGIARGEKTLAI

SEQ ID NO: 2597 - protein, 500 aa, M.catarrhalis
YQSIIYLLRVHMKALLLIPTFDAPNFSTIAENFAKSIGAAYIAPFDGEGDSKLRVAVTEGRLDEMLEKVVAAQSAKLTVVKGLATLPNTPYASLVNRDLANGLDADVLFVSQNAEELAVFAAAFGGLKSERVLGVIAAGVDEFGVTVWATIDGEQLTVDEEVIKNYQATTRVKKLSPYAFRNQVVQKAQAAKKRIVLPEGDEPRTIEAAVICQSRGIAQCVLLGERTKIEAVAAERGVVLPNDIEIIDPASIAEKYVAPMVERRKGKIDEAGAKQALQDTVVLGTMMLHMGDVDGLVSGAVHTTADTIRPAFQLIKTAPQYSLVSSVFFMLLPEQVMVYGDCAVNPNPTAEQLAEIAIQSAKSAKAFGIDPKVAMISYSTIDSGSGVDVDTVKQAVQIIREKSPELKVDGPLQFDAATVKNVGKQKAPNSAVAGEANVLIFPDLNTGNTTYKAVQRTADVISVGPMLQGLNKPVNDLSRGALVDDIVYTIALTAIQAIDE

SEQ ID NO: 2598 - protein, 467 aa, M.catarrhalis
PICMLLDITRFEYRTYKKELSALIHLSTPMLLAQIAQVGTSFIDTIMAGGAGKGNLAAVALGGSVFITVYVTLMGVMTSLNPMIAQLFGAKKSHEIGEMGRQGLWYGVLMGVLGMILMWLSITPFGLWLDIDESTFIITKQYLWFIGLAMPAAMIHRALHAYASSLNKPKIIMWVSWLCFLINIPLNWIFVYGKFGMPALGGAGCGLATAIVFWLNAIILFILIQKDKQLQAFGLMDKFSLPNVKILHEITRLGIPIGLSFFIEVSIFTCIMFLVARLNGNTEDYVAAQQIAISLTSLIFIIPQSLGISTTVRVGYSLGCEEFNRARYISGVSIATAILISIVTAIFLVAFRYPLVSMYTDDMAVIGIAGSVILYAAAFQLGDAIQCVASYALRGYKVTTIPMVIHIIAFWGCGLIPGYFMAFHGGMGIYGFWTTLVVSLGVAAVLLLWYLEIHSKKVIAQTRIRTL

SEQ ID NO: 2599 - protein, 523 aa, M.catarrhalis
KSCITGSFWAYFSLFSIHFMSFAKVFTRSVVGLQAPQVFVEVHLSQGLPALTIVGLPEASVRESKDRVRSALINSGYEFPNRRLTINLAPADLPKDGARLDLPIAMGILAASGQIDDKVLAQFEFVGELALNGELRPVSGALAIARAIKSSPCDGKPRTLIMPSINADEAVKVGDMTVLAAENLETVCRHLDVVSGISQNQEHLLSPVTLPSQPQVMQYAYDLADVKGQHHARRALEIAAAGGHSLLFTGSPGSGKTLMASRLPSILPPLTDAETLEVASIYSIAGVNYAFGERPFRAVHHTISATALVGGGSKPKPGEISLAHKGAIFLDEIPEFDRKTLETLRQPIESKQITISRANAQVSFPADFQLIAAMNPCPCGYYGDTTNRCRCRPEQIKKYQDKLSGPLLDRIDLHITVPALPIEDLQNAPKGESSDDVRQRVVAARNMAIARQGKANYELTVNELDQFAILGQKEQQMLKMAQSKLNLSARSYHRILRVARTIADLAASEHIKTAHVAEALSYR

SEQ ID NO: 2600 - protein, 415 aa, M.catarrhalis
NFHIFNSKIRYNKQFIQNQLTAALMSQFSDKFLGFFDKLNPRTVLLTSLSLIICISLLMIASASIPFSAARDLASLRFFWYQLAYVVIGTMIAMIVYRIPLRVYYQRTHINVVFLMWVTALGLLILTAMFGDVINGSRRWLDLGIFNLQAGEVAKAVMVFVTADYVVRRSAELRSNVFTGVRLLAWYLPVGGLLLFQPDFGTVLVLFATLIVIIFVSGAPALQYAWILFMAIVLGGIAAWLEPYRRERILSFTDAFDDIQGSDFQLARSLIAYGRGQLSGIGYGDSVQKLSHLPEAHTDFLLAITGEELGFLGVATVLFLEMLIILSIMVISLRALKCRQLRLSYTIFGFAVVIFGQVIINAGMTMGLAPTKGLTMPFFSFGGSSMVVLLIMIGFILRVDKESLEIHAQRLNDKY

SEQ ID NO: 2601 - protein, 149 aa, M.catarrhalis
ENIMSKILLPTSTACSLPKPSWLAEPEKLWSEWKFEGDELLQAKQDALLVSLAEQTHAGIDIVSDGEQTRQHFVTTFIEHLDGVDFNQRETVRIRNRYDASVPSVVGEVSRPISVFVDDAEFLRAHTDKLIKWALPGPMTMNGNLDDGH

SEQ ID NO: 2602 - protein, 176 aa, M.catarrhalis
NSSILYHSTKKFVNETFNNCPKCYCTHFVKAGLGNGKQRYKCKGYHHYFSVKQRSNQKSNGIKKQAIDTNSKQILGFVCGKTDTNTFKRLYQQLNTHNIQLFFSDYWKSYRQVILKPKHITSKAQTFTIEGYNSLIRHFIARFTRKSKCYSKSEKMIENTLNLLFAKRNGSLRYVF

SEQ ID NO: 2603 - protein, 333 aa, M.catarrhalis
YLLMSRLSHFIAPTHSSHQSDPSSPAWGYLSSWCDELRLQNYSKHTITTYQTALIQFFNFLESDNYLGGDPLACRRQDLTRFFSTRLEEEKIKPISAKLSLSAIRIFYQFLIKQGVIAVNPTTGYKIKSAPRKLPTVADELLIKQLLDQKTPEDTAKAYLWIRDKAMFELMYSSGLRLSELAGLNMGDVNFDIGIVRVLGKGNKTRQVPVGKKAMIALQDYLPHRNLWQKKNCKALFISERHGTRLSTRAIQLRLKVCATMAGIELNMYPHLLRHCFASHVLSSSGDLRAIQEMLGHQNISTTQIYTHVDFGALTKVYDHAHPRAYRTKNNHG

SEQ ID NO: 2604 - protein, 202 aa, M.catarrhalis
FMKIPYILVLYDTNQDATKNLAYLIAQGIHDAGLRAMIRRVPKVSAVSEQSHPAIPDEGDLYCTADDLRACSGLAMGSPTHFGNMSASLKYFWDNTVSIWLAGDLQGKPACVFTTSGSMHGGQESTLLTMMMPLLHHGMLLMGLPYAHPELSVTVRGGTPYGASHVSGVKHQHVMTVDEQALAIAQGVRLATLVKQLQADSL

SEQ ID NO: 2605 - protein, 506 aa, M.catarrhalis
IFDLDIMTNFLNKLPFAHHAWFMYLRLLVRHFIDDDTQQKAASLTYTTLLALVPILTVVLVIFSSVPALEGLREQVQQTISANLFPTASEQVAGYIRSFAEKSSNLGLVGVAGLFVTAIMTLNTIEYAFNKIWRVQERSGGAASIIRYWTIITLGPVILGVAFGASSAIQSMDFLNRQIAGYGIDWGIWAYLVSLALMTCGFILLYWFIPKAQVPIKNAAIAGIVTAILFESIKQVFGTVMTNFTSYEAIYGAFAALPIFLLWLYISWNLILLGVQISYTLTIFDTKEVPVRHPLLSLLDMLNLTYKRYQNGEAVSEDELRGMLGRKELPKWSMYLDQLVSNDFITETKNNEYILKTDLRTINFWKFYKSLPYPLPIRHELDQLESADYDPWFIELHHHLDKVEDAAIKELDVTLAELFETTPLREKQEIVRIVSENTDELGESKGFDDNARRTIDESGNVVIIPDGKASFTESKLTKVLRLLKKAYHFFGKNKKHINDIRRMIGK

SEQ ID NO: 2606 - protein, 105 aa, M.catarrhalis
ASTVAVVVPSPATSLVLEATSRTNCAPMFSNLSSSSISLATDTPSLVMVGAPNDLSITTLRPFGPRVTLTASAKMLTPSIIFSRAFEPKLTSFAIIYSDFLIFSL

SEQ ID NO: 2607 - protein, 927 aa, M.catarrhalis
MPAVSISYFPKAKKHGVYAKASALLSRVVFSVGDDITDQEGNLYQVARCEEISGVMRYHLACGKSLMETRLAANITLSKPLERLLAGRIEGADWYELRQDALRIQAMLARHPLRGLIGARVDIIAHQLYIAYEVGKRLAPRVLLADEVGLGKTIEAGLIMHQQILTGKVNRVLVLVPDSLQYQWMIELKRRFNLDFALFDLVRTAAIKEHNPDQNVFLTEQFIIAGIDLLLDHHDLYEQAYAAGFDLLVVDEAHHLHWDAEQGGNDKYDLVADFAASIAGVLLLTATPEQLGVESHFARLRLLDPHRFDDLDDFIATQDTFADVAMVASLLIDGQELTAKQICAVANLLGFEEIELADINANERLRTHIINELLDRHGTGRILFRNTRDSVQGFFGRTSIPYPLPLPTAWQNTHYTQGKLREQLWGEEQYPDGAWLEHDPKVAWLIELLRHKLKHKKVLLIARSGATIESLEAALRLHAGIKTAIFTEQMSLLERDQAAAYFADDAGAQILLCSEIGSEGRNFQFAQDLVLFDLPANPDTLEQRIGRLDRIGQIAQIKLHVPFVMGTAQERLYNWYDGALNIFNQISPTAQSVQDAFIAELKPLLEGADTPQNRENLATLIAQASIYRQALEEALQAGRDRLLEYNSCRPNVAARIEIAMRELDDNKLLPLFLDRYLTAVGIDYSVQRDGSWIIHPIDASEVDVEGIESLPLDEDGMTLTFSRQQALAREDIHYMTYEHPLIQAILEMILTGTFGNTQVGLLKSAALPKGMLMIENQFRIEVIAAKSLNLSAYLPKQSLRIFLSERGDDLSQVATSEKILPLIDCLDKGRARQVAKARAGVIDARTQDAKRIAGMQLDQISTQAKTAFGDYMNKEIGRLVRLQAVNPNVRDDEILALEQRKSQGLQALDSLSLVPDSIRVLVTVAPD

SEQ ID NO: 2608 - protein, 66 aa, M.catarrhalis
YHCVYLQLGKWPVSASFGYINTMKTIITNFIKKGNYFSSLMTNKVIAIKNHGNPSSIHHLIKLNLN

SEQ ID NO: 2609 - protein, 213 aa, M.catarrhalis
YYSVFYLYIFIYLLDLKEMGVGALVGIALIWFVIEMLLWYLVAQFISGWYVFFWFIIAAIIGIMMIKKAAKSLNPMAQQMKAMQRGVIPNPSNQPAESTLVKSIAMGVAGLLLLLPGLLTDVAALVLLVPFIQTRLTAAAKNYAAKNQDKMMQMMASQMGGKNPFGGMGQNPFAQGGMKSNPFGKHGGFGTTVDGEAKTVDKQVKRIRSANDE

SEQ ID NO: 2610 - protein, 552 aa, M.catarrhalis
LMSLINKLNERITPHVLTSIKNQDGDNADKSNLLTAFYTIFAGRLSNEDVYQRANALPDNELEHGHHLLNVAFSDVSTGEDQIASLSNQLADEYHVSPVTARTAIATAAPLALARIKEQAGALSVPSFIRTQLAKEENRLPTWAHTLLPAGLFATAATTTAEPVTTASAVVKEPVKPSVVTEPVHPAAATTPVKTPTAQHYENKEKSPFLKTILPIIGLIIFAGLAWLLLRACQDKPTPVAAPVATDTAPVVADNAVQADPTQTGVAQAPATLSLSVDETGQALYSHRAQVGSEELAGHIRAAIAQVFGVQDLTIQNTNVHTATMPAAEYLPAILGLMKGVPNSSVVIHDHTVRFNATTPEDVAKLVEGAKNILPADFTVEAEPELDINTAVADSIETARVAIVALGDTVEENEMDILINALNTQIINFALDSTEIPQENKEILDLAAEKLKAVPETTLRIIGHTDTQGTHEYNQDLSESRAAAVKEYLLSKGVAAERLNTQGASFDYPVASNATEQGRFQNRRIEFVLFQEGEAITQVGHAEDAPTPVAQN

SEQ ID NO: 2611 - protein, 140 aa, M.catarrhalis
LGFLMVNHYEIKKLKKWLEIYHCDSKKQSQLFNFPLSKLINGVIMKIRPLHDRIVVRRTEEEQKTAGGILLPGSAAEKPQQGEVIAAGNGLVRENGEVRPLDVAVGDVVLFGQYSGQTVKVDGEELLILKESDVLGVLEA

SEQ ID NO: 2612 - protein, 342 aa, M.catarrhalis
DFSFNFSIKIMPKFNNLRYDKAFINDPFIIKYLNTMSNHFIFDLSTHHITAFIQNANHLDQVRQWQSKNLPNLLDIILTHSSLPEPLNKACRYAMSNGGKRVRPLLVLSTFLTLIKTGHQTDDLTKKIQMLFRAMMAVELIHSYSLIHDDLPCMDDDALRRGQPTCHIVYGEDVALLAGDALQSIAFEVLFECYDKNSADDAIAYKLAKLLSCRARRMVSGQMLDIKGENQMLSQDKLEAIHRDKTGALIEAAVMMGAICADVQTDTLGYLKHYARAIGLAFQVQDDVLDITADTITLGKPAGSDEKLEKSTYVKLLGVKGAQEYANQLFEEARSQVKYWGG

SEQ ID NO: 2613 - protein, 68 aa, M.catarrhalis
FCKLAESYGHKGVKITNPATMQEELKQALEMDGLVFIDVYVDKGEHVYPMQVAGQSMRDMWLSKGERT

SEQ ID NO: 2614 - protein, 149 aa, M.catarrhalis
VNNSHLYHQSRSIIPKYFQYGSYIKGAYMKLSTKLFTLGAGVLLSVSAFANDAIVGKWKMSEKGEEKAIITISQAGNGYQGVMTQGLTDKAKKREGTIVLTNISSQGEGKYKGKGAHPTLPIKGTVNITVNGNTITIKSIAGTQTGVRQ

SEQ ID NO: 2615 - protein, 290 aa, M.catarrhalis
FGRQKPSVIILIISLLSMNTEQKHYRHQYVIGDLQGCFGAFNELLSALNFDETQDKLWLAGDIVARGEDSLATLREAKRLSDIDALSTVLGNHDITLIATWRGVLTPKAKDKTLPIFEASDCDELLNWLRQQPLLVFPDDRTVLTHAGIPPNWSITEAAGYAKELEKQLSGNLKQLDRLLPNLYCKKSEVWSDDLNGHQRMCAIANYFTRMRLCTQSGRLEFSFKKSLKDDMPMDFRPWFSWFVVRERRILFGHWAALNAEVATKFVRALDGGCVWGGVFTTGLEGPQIS

SEQ ID NO: 2616 - protein, 528 aa, M.catarrhalis
LSSDLLMIFLSKLGIFEDSHKVFMVQFKFFYGIFSSRILSLFIAITKHKSYLYDLLHKPNTDMTNTNDKKDSLLTLQPPHSIEMERSLLASLMSINDSFEDIENIINANDFYGERHKKIFDAISHLARVNEPYDSIMVHDYLSRIGQLVSAGGEDYLITINQSTANYFNLINYAEKVREMSVYRQLISSANHMLNLAYHPKKQTITEILDTIESDIFRIGESFAKGSSKTGPQRIDDVMANVVTQLNDIRLRPNGLIGLDTGFIELNNKTLGFQNGNLIILAARPAMGKTALALNFAQSALMSNKAVAIFSMEMPAESIAMRMLAAWGSIDMKRLMSANMNEDEWGRFMNGVTLLQDKHLYIDDRSDLSPSEIRATCRRIAKNHPDGLGFVLIDYMQLMRVPGMGDNKVNEMGEISRSLKALARELNCPVVALSQLNRKVEDRPNKRPLISDIRESGQIEQDADLILFVYRHHYYHQDKDDIKHLAEVIIGKNRQGERGKVPLKFIGEYVRFDDLIPGDMPEDYDIDE

SEQ ID NO: 2617 - protein, 382 aa, M.catarrhalis
IILRIMNTMRSTSITIHPNALTHNLQIIKSQLDRTTKVLAMVKADAYGHGIDATVPALIHADGFGVACLSEAMAVKQVLDGMNHKKPIVLIEGAFSLDEWKVAIDHDFGCLIHHENQLIWALSHRPKQDQFCHTIWLKYNTGMSRLGFNDDHIITAAKSLADAGYRLILTSHFACADDKSHPLNAQQISKFDQALACIRSFAPDTLASLCNSAGIFNFKHQHHDWVRAGIALYGSKPITDQSAKALNLMPAMTLSAQVMAIHTLAAGDSIGYSALWAAQKPHQIAVVSIGYGDGYPRVVMGAKVSVTDTSGNRHLCDIIGRVAMDMFMIDIDGLDIATNTPAVPWGDSPTIDEVAMCAGTIGYDLMCRFAVFAKGCQDQRSS

SEQ ID NO: 2618 - protein, 327 aa, M.catarrhalis
SLPINRHLLHEPKVLIKVGKLSKIPDFYVIDVPDKIDHITENWLDSQLTDNLKIQSKTIPLVIVLNIICCDEVIAGQLNTANAAMVERQLHLAHVLAKMHQIRAIITAPIQKSVMIQAGICLDNGDIFSGHTEYFMHKSNCHKVVMMLANRVMKVALVTTHLPLKDIFDAITANEIQETIRITHQGLVTQFGILSPKIFVCGLNPHAGEDGHLGDEEICIINPALKVLMAEGINISYAMPADTLFTPQHLADCDAVIAMYHDQGLAPLKSHGFGDTVNITLGLPYVRTSVDHGTALDLAGTGRASSSSLKQAIFYANKMSISDFDLA

SEQ ID NO: 2619 - protein, 295 aa, M.catarrhalis
SQFLFSVQSLIMHIIPKSPQQAKHAPRKRFGQNFLHDTHIISQIVTAIRLDRQDNLLEIGPGLGALTEPLLAEVDGMTVIELDRDLASQLKINIGANSYSDFTIINDNAMHVNYRALAEQIGKGVFRVVGNLPYNISTPILFRLLEFSDVIKDMHFMLQKEVVDRITAEPNSKEYGRLSVIMQYYCQSDYLLTVPKGAFNPPPKVTSAVFRLTPYKTKPITAMDESVFALVVRESFNHRRKTLRAIFKANGLLPTLDESDFEKIGINPSARPETLCVHEFVLLADLVVKNRQSSS

SEQ ID NO: 2620 - protein, 1096 aa, M.catarrhalis
PILSIKKIINNLSTKRTAMPKRTDIKSILIIGAGPIVIGQACEFDYSGAQACKALKEEGYRVILVNSNPATIMTDPSMADATYIEPITWQTVEQIIAKERPDAILPTMGGQTALNCALDLDKHGVLAKYGCELIGATKEAIEKAEDRELFDKAMKKIGLECPKAEIAQSMDDAFAIQAKVGFPCIIRPSFTMGGSGGGIAYNREEFIEICERGFDLSPTHQLLIDESLIGWKEYEMEVVRDKKDNCIIVCSIENFDPMGVHTGDSITVAPAQTLTDKEYQIMRNASIAVLREIGVETGGSNVQFGINPKTGRMVVIEMNPRVSRSSALASKATGFPIAKIAAKLAVGYTLDELKNDITGGKTPASFEPAIDYVVTKMPRFNFEKFPQAESVLTTQMKSVGEVMAIGRNFQESMQKALRGLEIGVTGFDEQLDFEQNDDSIISTLKLKLKTPTPERIFYIADALRFGLSVDDVFADTNIDPWFLVQIEDIVHTENQLKTLGMGDLTPNLLRRLKRKGLSDARIAKLMGVSEKQFRKTRWNMGIYPVYKRVDTCAAEFETSTAYMYSTYDEECEANPSNKDKIMVIGGGPNRIGQGIEFDYCCVHAALAMREDGYETIMVNCNPETVSTDYDTSDRLYFEPITLEDVLEIVRTEQPKGVIVQYGGQTPLKLARSLEQAGVPIIGTSPDAIDRAEDRERFLQMINKLNLRQPSNSIVKSSEEGIREAAKVGYPLVVRPSYVLGGRAMEIVYNEDELKRYLRDAVQASHEAPVLLDHFLDDAIEVDVDCVSDGKEVVIGGIMQHIEQAGVHSGDSACSIPPYSLSDDIQDDMRRQTVAMAKELGVVGLMNVQFAIKGETVYVLEVNPRASRTVPFVSKCIGVSLAKVAARCMAGQTLAEQNFTQEIVPSHYSVKEAVFPFAKFPGVDPILGPEMKSTGEVMGVGQTFGEAYYKATLGSGDRLTGLPQEGETKTVFISVRDSDKAGVVDVAKRLAGFGFNIVATGGTHDMLVGAGVACKRVNKVSEGRPHIVDMMKNGQIHLAINTTEGKQALKDSFPIRREALQNKILVANTLNAGRAVCEAYETTLPFDVYKLQDLYAS

SEQ ID NO: 2621 - protein, 138 aa, M.catarrhalis
VMNPLDKAVINTMSEADWQNRLDDLSYYVLRQKGTEQAFTGLYTDTEVEGIYRCKGCHTPLFDSSAKFHSGCGWPSFDKVIADNVVDETLDLSHGMRRIEVTCHHCGGHLGHVFPDNYVTDTGLRYCINSAAVVLDKT

SEQ ID NO: 2622 - protein, 126 aa, M.catarrhalis
IMSTIKVDRHTNSEPATLDLSQALTADATPNDIESAIAHQDCLIFLVANFMDGRIFSLIRHTRHQGFQGEIIVGGEFALDQANYFVKSGATAFLVDETNVETLTKTLQDLATGYDGKAVSHLPLFS

SEQ ID NO: 2623 - protein, 111 aa, M.catarrhalis
IIITTMNHLPSLDDDGHLKNHTDWTPKIAQRLADTIGVTLESEHYQIIGEVRVFFETYHHSPSTRPLIKYLMASLPNLDISNQKLQKLFNTGLVARHVNRIAGLPKPPNCL

SEQ ID NO: 2624 - protein, 93 aa, M.catarrhalis
MAKASSMLCAISALGHSKPIFFMALSNSSRSSAFSMASLVAPISSQPYLASTPCLSRSSAQLSAVCPPMVGKMASGRSLAMICSTVCQVIGSI

SEQ ID NO: 2625 - protein, 309 aa, M.catarrhalis
QLIYSRNFMAIDIVINQRHLQIQLKQLETVWHTVVNGYNLSQAAELLHTSQSSLSKQIAALENQLKADVFTRQGKRLTGLTPIGRALLPHIEAIFAEIRTIENLSLDFNNAQAGTLTVATTHTQARYVLPQIVKEFREKLDKVNLVLQQADPETIAQMVIRGQADIGIATESLLNNAVLRCHRYYDWSHVVIVPKTHELAEFADVPDGVDLPTLASYPIVTYHGGFTGRGTIDKDFDKARFYPDIVLAALDSDVISTYVSSGLGRGIIAEMAYQPKHYPDLVAIPVNHFGRINHWIAERDHSEISKIWS

SEQ ID NO: 2626 - protein, 70 aa, M.catarrhalis
LLIYNINLKYYKLYYAVIFILAKNFDKKIQKLNYCGFCVNCSHVTIGYLSFKFGQNHLPNLLNKSFGTGV

SEQ ID NO: 2627 - protein, 65 aa, M.catarrhalis
LPLYYIKKYYIKNNYLDCIKNNYQKIAQRTSPPSDRICNWLKNNYTAKFHTNQSTNMSDLSSIPR

SEQ ID NO: 2628 - protein, 558 aa, M.catarrhalis
MYQYSYADQKLVDERVSQFRSQTERFLSGELPEEQFLPLRLQNGLYIQRHAPMLRIAIPYGLMSSHQLRTLAEIARDYDKGYGHFTTRTNLQLNWVKLEEVPDILAKLAANQMHTIQTSGNCIRNTTTDPYAGIHAEEIADPRPYCEIIRQWSTFHPEFAFLPRKFKIAVIGTRTDRAATQVHDIGLHLVERDGEIGFEVIVGGGLGRTPIIGKLIHEFLPRRHLLSYLDAILRVYNLEGRRDNKYKARIKILVESLGKDTFIQKVNDEWQTLKDGDLTLSEAHFAKAESYFTTPAYEQIDRLAVQTQLDEFLADKDFYNWYEHNTVAHKINGYKAVVISLKAGVVDGNYVPAGDITDAQMFALADLADEYSLGEIRATHQQNLVLSDVKITDLYILWQKLSALDLARANIGTLTDMIVCPGFDYCALANATTHNIAESIEKQFNDLDYLYDLGNIRLNMSGCMNACAHHHVGDIGILGVDKKGEHWYQISLGGNSGEHAKLGQILGRAVAADEVAQTIATIVNVYKNERIESHGHIESFAQVIERLGITPFKTAVYH

SEQ ID NO: 2629 - protein, 328 aa, M.catarrhalis
IIRYWSMTVTIAINSQNQKPIKRLGLIFGVITTCILAGCASKPTYNSTSGSGSHRTSGSGGLAIGSQVITDSQGVPNRYQVKQGDTVSKIAQRYGLNWREIGHINNLNSSYTIYTGQWLTLWSGDLKVRERSISSGVNTAHTPSPVAVQSSRPPVQQHPAVQKPTPPVVVVKKPTPTPPVVQQPAPVAPPVTEAPFATGSSGVMQFRYPVGATNPVVRRFGTATVAGSTVTSNGMWFSGRDGDLINASNAGTVIQADHNMDGASIVIQHTNGFVSSYIHIKDAQVKTGDTVRTGQRIASMKNQPSGAALFEFRISRNGVYVDPLTVLK

SEQ ID NO: 2630 - protein, 66 aa, M.catarrhalis
VPIQHFAEFMNMPTLSLPLLLLCQKIKKMLLNDWLIKNPIKKASKTLAFDGLTVGMSFIVLNRIKY

SEQ ID NO: 2631 - protein, 478 aa, M.catarrhalis
RVTHKASATRLVKPMMPTPSHLTTISIIGHTNVGKTSLLRTLLRDSDFGEVKNASATTRHVVAVDILSKDNVPLITLHDTPGLEDATGVMDFLQNHTDGRADGMERLSVFLQAIHHNDARLEGDFSQEAKVIKSLLEADIALYIIDAKEPVLGKYKDELAILAGSGTPILPVFNFINDPNHHMQAWREMLSRRALHVVNAFDTVAFDFENEMALWSNLSLLSNHDQNIEKLKQERSDTWHELLEIGSEMIADFLINVAAYRQKIASGADTTPTLRQMQNAVRQAESVLHDNLLNLYQFYHQNIVSDCPDIKSQTQDVFDGELLAQYGIRTAGGSVTGMIIGAGIDVATLGASLGLGTAIGGVIGGLLPNSTTLKDKAMGVQTLMINAPTMTLLAARAQNLHHHLRHRGHASLLDITASDKNLPWQSDKLPSPIKKARSHPNYSSLTDNDDDKTALRSDLAQHLAEILVMHLQRLDINH

SEQ ID NO: 2632 - protein, 364 aa, M.catarrhalis
YNIKAVMRHFLFDIIFTFVCLVIAAWWGYSHGGISEMFLALGITAILAIMEISLSFDNAVVNASILKGWNDFWKKIFLTVGILIAVFGMRLIFPIAIVAVTANLGMGEVIHLALNNPVQYAEHLNAHHAEISAFGGMFLLLVFLNFMFGDKDVHWFKWLESRLVKFSKVDAMSVFVALVVLMISMSWVEEAKQGVVMVAGIWGILVYLGVSVLSALLEGDGDDKAAVYDAKGREITNTAGVSSTILKGGIAGFLYLEVLDASFSFDGVIGAFAITNDVIVIMIGLAIGAMFVRSMTIYLVNKGTLSDFIYLEHGAHYAIGALAIIMLLSTRFHVPEIITGLIGVAFIVLSVFNSIQYNKRHANS

SEQ ID NO: 2633 - protein, 219 aa, M.catarrhalis
SLIKGFLIWQLYTLIFAARPLIVSEFFGIKGLSYQKNFINLKQSQQTTKAYHQTNPQGLVPAWEDDSGSYGQSFAIMLLLEDKHPTPALLPSDPAKKAEILSVVQHIACDIHPLNNLRVLNYLKNKLHLDATGIDDWYAHWIQLGFDALETTLSQTAGRYCFGDTPTFADCFLIPQMYNAIRFNVDLSAYPTLCRIYEYANTQPAFIAAMPKNQEDAVE

SEQ ID NO: 2634 - protein, 554 aa, M.catarrhalis
KNKKSIQNSANSGKMQRKISPIFTPFWHYYLIPLKLDDMIMSRITQSYTKPSAWQAFYHAYFNKHSVALLFLGFSAGIPILLIFSSLGLWLREAGIDRATVTMFSWAALGYSFKFIWAPLVDALALPILTRLLGRRRSWLLFTQILVITALVLMAMTNPQSGEAMLSIMAAGAVLLGFSSASQDIVIDAYRIESAPADMQPALSATYVMGYRIGMIVSGAGALYLADFFGSMMEAYSYLAWQKTYLIMAAVMGIGILTTLVISEPKTVVKPITQTSKNDLRLVVVFILSVLAFILVFRGMGSILPETDDVLLQFVYGTVRFMLSIIAFGLVSFGLVQAKIAPKEMVIKTWVDPMVDFFHRYGQKAVLLLVLIGLYRISDIIAGNISNIFYQDLGFSKTQIADAVKVVGVVASIAGGFVGGWLAQKINIIKAMSLGAILACTTNLLFIFLFYTPTVPMMYFAVITDNLAAGLASTVFIAFLSALTSIRFTAVQYALFSSLMTLLPKLIGGYSGSIVDATNYAFFFGFTFVIGIPVLLLIYLVNKHIDINQPQIDE

SEQ ID NO: 2635 - protein, 98 aa, M.catarrhalis
NKVEQALNELNHLPISNTHHILRTMYYMMRHQLFWDGNKRIAMICANYELIMAGCGMLNINENQLETWHTLLSAFYESNDDNKIVAWTYENCLYGMTV

SEQ ID NO: 2636 - protein, 162 aa, M.catarrhalis
WQACPTLILAIKSYKNCLIQAWLLGMSTALQAYPSHQIVYNYLILGFTMSGFCTLNIASTDLTMTVLMTPDMANFSGNVHGGTILKLLDQVAYACASRYAGGYVVTLSVDQVIFKEPIYVGELVTFLARINHVGTTSMEVGIRRRSRKYPNSHSTSYQQLLF

SEQ ID NO: 2637 - protein, 76 aa, M.catarrhalis
KMPWTDWIVFLPKSVENLEQINPSVMIKTPWLLHGAFFMIGHGDNIPKITTHIPFLNLNFWYQTLNIMQNKSAKPK

SEQ ID NO: 2638 - protein, 323 aa, M.catarrhalis
NNLLFWKAVMNFNNREYRDKCRALTLKLMSDNKVRKRQEIYQGVIQLGEFSDEILTLRFNSGQPKVENAIAWSISSRTKAGILNRISKATYQITPIGLKMATLWQNKTHISEKLYDEADLPDWKSYLKSRAEIKRKKKLSDKTSIETDDNDDMDFETQAKNAIKNLETEISVELLNKLQKGTPLFFEKSVLKLLLAMGYGGKENLFEHTGKSHDGGIDGVIKQDPLGIQNIYIQAKRYASDNMIGSKELQSFSGALQGNGVERGVFITTSSFTKSAQGFSQKLLGRIVLIGGQELVGLMIKYKVGIQVKEVLEICEIDEDFFE

SEQ ID NO: 2639 - protein, 615 aa, M.catarrhalis
KLARCLFVLGHNMTNHPSDFANLPHSSYLSLLCQADSSLTPSNFISMQDLLAYQNLNSSIKFVKYNLQLMILWHKIINCNTGYITMNDPQNTITKQGLRLKLRRKALGLSAEALASKMSELGVPVSRGAIANWECGKNGIVMSKLPILAAALGVSESYLISGDHLTLQTTKRKTVNEIWPKSTLIKSSVNQTPIILSSEYAIMPQTKPLKKSNKLANVCYDIRGELLQTANRMEAEGQRIIKLNIGNPAPFGLLAPEEIVRDVALNLPEASGYSDSQGIFSARKAILQYYQGKGLLSAIDVNDVYIGNGVSELIVMTMQALLDDDDEILIPMPDYPLWTAAANLAGGKAVHYRCLEDDHWQPDLKDIESKITSRTKGIVIINPNNPTGAVYTDEILKSIAALAKKYDLVIMADEIYDRILYDGVTHTPMCTITNDCLVLTYNGLSKSHRIAGYRAGWLMVSGKKHHATDFIEGLTMLASMRLCANVPAQYTIQTAMGGYQSMQALTAPTGRLYKQRNLAVERLNAIKGISCTMPQGAFYCFAKIDRDIYPIDNDMKFMMDLLIEEKVLIIQGTGFNWDQPDHFRVVFLPNLIDLEDAMDRLDRFFAKKRREFGTN

SEQ ID NO: 2640 - protein, 349 aa, M.catarrhalis
VDILLFTIKDYPMQGKFIIKTLTAAVISCTSLVSQASISGNSHDGIVAVVNDEIILKSELNQATELVATEIQKNGGNVTQDQAQTLALDELINEKLQLAIINRAGVIPNDEVIDQQLLQIAQSQGVNSLSEFQSKLDAERAGSYVALRANLIQDAAIQALWQNQIQSRVRITDDQIDAFLSSPESARLNQVQYRLLHIRVPYLDNTASEQNRQQAALVAERVKSSLDAGMNLDQAMQNARGDYTPDLQGADTGLINATALPPAIAAKVDKLTIGQTSTPIVTVNGIDIVKVVNKQQQNQVIVPKWQTSHILARIDSNQSSDIAEQKINAIYQQLQQGADFGTFGGNLFR

SEQ ID NO: 2641 - protein, 66 aa, M.catarrhalis
NTNRLMMSQSDFNEILLPKPEYPEAWECCGSECGDYCVYEIYRRDKIDYDAQQKRLKEFLDKKTAE

SEQ ID NO: 2642 - protein, 200 aa, M.catarrhalis
ELFIWHDSLKHHSLKIPLIRFIFLISMEKTSMTMILSILILFFIIRLLFLAVSIKHEKALIAKGAIQYGKTNSTVLAVVHTLYYLACFISVWLSDTAFNGISLVGTLMVGASFVILALIIKQLGEIWTVKIYILPEHQINRSWLFKTFRHPNYFLNIIPELIGIALLCQAWYVLLIGLPIYLLVLFKRIRQEEQAMATLF

SEQ ID NO: 2643 - protein, 126 aa, M.catarrhalis
FMILLLVTSSPHSHAGKLAVEYATKQLHLGNQISVFFYGDGAYTANRLMWQTADVPSVAKQWQALSNNHGITLPVCVSTALARGVCDAQNATRHGLIGDNLLPPFSLVGLSELAMMIDDTTSVVQF

SEQ ID NO: 2644 - protein, 166 aa, M.catarrhalis
IINIERKIMQRYPMTPEGHKALEDELKQLKTVERPRITTAIAEAREHGDLKENAEYHAAREQQGFCEARIRDIEAKLSGAQIIDPAKLPKEGRVVFGVTVVLENMDDGAKRRYKIVGDDEADFKVGKISVNSPIARGLIGKSEGDEAKIQTPSGLAEFEILEVIYA

SEQ ID NO: 2645 - protein, 940 aa, M.catarrhalis
GGCMVSLHFMPNQAQLDCLSLASPFASQIYQKHSDDAQAFLGEYGFERSLSSLDFDALVRRFVGLGKTNYLDFTNEEMVMSGLRKLRQMLMLKWIWQDALSVISLEELTHELSDFADSCIQFSKDFVYHKLTKRYGEPMIRQKNKTLKDELAIIAMGKLGAQELNLSSDIDLIFVHINNGETNGKKVIDNYKFMRDLGRGIIKLLDENTEHGFVFRVDMRLRPWGDGSPLVMHMAALDKYFSQHGRTWERFAWLKARVVNDISDEFGQTLNQLSRNFVHRYYIDYSAFSALREMKAMIINQQIQRQDLDNVKLGVGGIRDIEFIVQAFALIYGGHHIRIAENPACLDCLTVLTELNYIDNDESKQLAAAYRFLRRLEHAIQARYDQQTQCLPSDSDEMLAIAQTLGYESVKAFRSVLDAHRHNVSRPFGRMVTDRQSPKQESLDIAQIRSSLDDVLGDNSVVVLDEFMSSRLVTGLDDVAKDRLNQAYPIILHALLTHAQKGGAELAKIALPRLIALLEAICRRSIYLVMLSENPDATVRLIPTLSASLWIARELAHHPVLLDTFLQKRYLHLPDKAELTDILRQSLLRVEPFDDEGYLTTIRLFKKTQVLAVATADVLGLRHTMKVSDSLTYIAEVVLESALYRVFHELSVKHGFPLLNTHERASIADCGFAIIGYGKLGGLEMGYASDLDLVFLHRIDEKSETDGEKPISGMKFASRLIQKLMNYLATQTRDGRAYEIDTRLRPSGNAGVPVISAHAFKMYQTDKAWAWEHQALVRARGLTGDVLVLQAFDRIRKQVLTTPRQETQVRQNVIEMRQKMQHHLGTKTMRRAYGETEQFNLKQDFGGLIDIEFLAQFMVLAYANKYPNLAIWPDNVRIFEEVEKTGIWTANRCQKLTQAYLDLRKKTHELALSEQKNIVDDQAWHELRQFVREVWEDVLG

SEQ ID NO: 2646 - protein, 311 aa, M.catarrhalis
FMSMATQEGKMWLDGALVEQPDAKVHVLTHSLHYGLAVFEGVRAYQTPDGRTAIFRLQAHTERLLNSAKIFQLNCTYGFDELVQAQKDVVRLNNLASAYIRPLIWVGSEKLGIAAKDNTIHAAIAAWHWGAYLGEEGIKKGIRVKTSSYTHHHPNITMCKAKAASNYPVSILANQEVTRNGYDEAILMDPQGFVCQGSGENLFLVKNGELHTPDLSGGALDGITRRTIIEFAKDLGIKVIERRITRDEFYLADEVFMTGTAAEVTPIREYDDRMIGNGGRGELTEQLQTLYFDVVQGRSDKYQHWLSYIDE

SEQ ID NO: 2647 - protein, 163 aa, M.catarrhalis
MVLISSKWLISNNKIKSSYLNGKPAIFWLVLIAIKAVISLNKKSMPFINNYNKVPILGPLAATYSDDTGSASQHGSLGWVNEGDMVPEFETMMKNTAKGDFSTPFRSQFGWHILKVNDIKQHDITEQYRRNAAHEYLFLRSAPQAQEDWLQELRSSAYIKIYE

SEQ ID NO: 2648 - protein, 125 aa, M.catarrhalis
SLEIFMKHLHMLLAIIVLFIFILQALPMFMGKTPKASNTLKILNHVFYTAVILTGLGLFWQIYQVAGTQHWALAKLVLLIVAASATIKAQRHYTNTPSQAKAGLMIASVAYVGIIVLAITKPTLF

SEQ ID NO: 2649 - protein, 265 aa, M.catarrhalis
KLWINCGSIRCVMDSHTVDGHLTDDEMMRYARQILLDDWDVTSQIRLKNSHAIIVGMGGLGCPIAQILVRAGIGSIDIIDHDVVDVSNLQRQILYTALDVGKSKAMAAKDALQKQNEWVSITAITDKITQTNTDQFIKHTDLVIDCTDNFLIRDILNRTCHQHKLALLSTSAIAQTGQIALYTTDTACYQCVFGDALGDEMNCSTSGVLASTVSVIGALASQVALSFLGKHINPIANELLIWQGEQFQLKKLNICRDEHCSVCGA

SEQ ID NO: 2650 - protein, 296 aa, M.catarrhalis
AMQVSNRLALTGLTIKQIRAIFKQLQSDVLPMHWLDGWLMHVLDKPFIFLMTDEDYQPTLEESSKITAGIMQLSAGKPLAYLTGQQSFWGRHFLVNAHTLIPRADTEILVETILNYAKAQQKIRQTDNKNLVNILDLGTGTGCIGITLALELEFAQVVLVDISSEALKVAEQNNHRLNARCQLLQSHWLQKVSGQFDIIVSNPPYIKENDEHLVNLKHEPITALVAAEDGLTDIRHIIETGRAYLKDGGLMAIEHGFDQAEAVRNLYLSSGYLDVYTIQDYGGNDRVTLGRYKNCG

SEQ ID NO: 2651 - protein, 455 aa, M.catarrhalis
NNKVSIMNTLPLFFNLNNKTVLIVGGGDIAYRKAQLMAKAKAKLVVIAKHFEAEFLDFLQSHHHVFFQKSFEPIDLNQHTPTLVIGATDDHEVNLVIHRASKAYGVPVNIVDTPDLCDYIFPAIVDRNPIVIGVSSNGKAPVLARLIRAKIESSLPSRLGELADKAGKFRDTIKNSLPTITERRYFWESIFDRALKDETIGTLSDELNQFKNHDTRLGEVYIVGAGAGDPDLLTFKALRLMQQADIVLYDALVSNDILELCRRDSQKIFVGKKRKDHTKTQDEINQLLVDYAKQGHRVLRLKGGDPFVFGRGGEEMLACQAAHIPYQVVSGITAALAASSYAGIPLTHRGIATSVRFLTGCYQTNEPFNGLNSTYQTDETLVFYMGLHALTKIIDSLISAGLPNDLPIAIISNASLPTQQVLTGTLTDIIDKKHQSNLIAPAIIIVGHVVDLYQP

SEQ ID NO: 2652 - protein, 115 aa, M.catarrhalis
TKSVFGEKNIVEVIHSMSRLENINTTFPQSKTMIDGMSVSGISTHDMQVLLNLKNAWQFILSSDSQFDLAFACKVNGFVAYNESLAWGELRTGNVCISGVSFVPDILLKTRLNKR

SEQ ID NO: 2653 - protein, 416 aa, M.catarrhalis
KIRVKFMTAQIAKKAILALADGTIFHGISIGAMGSSVGEVVFNTAMTGYQEILTDPSYAKQLVTLTYPHIGNTGTNSEDGESGSEHRIWASGLIIRDATIISSSFRNDESLTDFLQRHDTVAIAEIDTRKLTRILRDKGAQHGCIYAIDSDTDITADDENKAVQLAKEFAGLTGLDLAKECCHPQGFEWTQGTWELADNPATTAKYGKTDSPTGGYFKQLGKHISKKFHVVAYDFGTKTNILRMLVDRGCHVTVVPAQTPISEVLAKNPDGIFLSNGPADPAACTYAIDNIKHIIEQTEIPTFGICLGHQLLGLASGAKTIKMKSGHHGANHPVQNLADGTVMITSQNHGFAIDEATLPANVKATHRSLFDGTNQGIELTDKPAFGFQGHPEASPGPHDCSVLFDRFIMEMQKAKV

SEQ ID NO: 2654 - protein, 450 aa, M.catarrhalis
PFQLFHKKTMIMPTFLPKNPVSTAKKALNQSVHVLGRIQKTASVAGLSALRMAKGDKMDAYLLREAFEQMGVTYIKLGQFIASTPSIFPKAYVLAFQGCLDQTAPVRFEQIRQVLIDELETPERGLGDIFSYIDPKPLASASIAQVHKAVLADGRQVALKIQKPGVDTVMQTDLGVLHSVFWVLEKAVPSLKAANLAPIIDEMRARMLAETDFLAESHHIDKFLAHLHQVGNTQVTAPKVHHRLSTKKVLVMDLLVGKSLVDESLVWDGTVGKDSKKIMNDVLDTWFLSLMMTGEFHADLHAGNLMLLDDGRIAFLDFGLMGQIQPSSLQACFNLVQSLQMNDYHGMAQAMVNIGMTHAPNKMNIDHLANDLRRMLGKIMPESTPAPANNDSLNVMMLEMVDIGKRHGIHFPRDFALLTKQLLYFDRFMVTLAPDMELFEGNRLDLVKLN

SEQ ID NO: 2655 - protein, 102 aa, M.catarrhalis
WMKFLIHINTDSELISYEAIALALTLATFDHDIQIELGENVLVLLNNPKSRIYGMIQSLALYDLPKAYHNFQAVNALDKVIQLSLQSGSLALDDYDSKLYFQ

SEQ ID NO: 2656 - protein, 69 aa, M.catarrhalis
SYKACNMIHPHFDSTNPQKSAPIGIFDSGGGGLSVYRHFVKLMPKERYFYYADTPNLAYGNKSGDEILF

SEQ ID NO: 2657 - protein, 233 aa, M.catarrhalis
QDNLAKIRLIFDNLAWFWSNNRNKMMMDKDNINNKNNDLNNSLIQKLTAIQTKQVGKIRKIPPLQSWQPRRTTPLDIEIRDNGEWWHEGQKMTRQSLVDLFASVLWVEWHDDQAIHYLKTPTDKYQIHVADAPLFINQVTQVTDADGEWIKFGTTNGDVIRLDEDHPLYFKRFGDEERVYIDTRFGLTARLMNNAMYHLIQMGRLSQIQENGQNKTVLKLSSGGKIYQIEQHG

SEQ ID NO: 2658 - protein, 295 aa, M.catarrhalis
HINKNMALKIFSPAKINLFLHIIGKRSDGYHDLQSVFRTLDFGDWLSFGLTDTKKPLITLTGAEGLTKELNQNLIVKAVTLLAKHFPNHAKPLIIDLQKHIPTGAGLGGGSSNCATTLIALNQLWALDLSLQALIDFGQQLGADVPFFIFSHFHQQDAIVCGIGEILTPLKLPSARYLLLFPQAHLSTAQFFAHPDLQKNCLPIPNIGSRYDDYGNTMTDAFFNVFEPIAVMHSPAVALALQYLKSRQVFTGTTARLPGTGSTVFLPIPDNIDDAMLKHWQAAAPCPTIMTQNLY

SEQ ID NO: 2659 - protein, 672 aa, M.catarrhalis
VMNWLWRKRRYHSHDVSKLAHQGTPAPKNSDKTLKISKSILTASILAGLMVATTLPTHANIFDPLLRILLPFYKKSPKAEGEAKEPLVEPKEPLKDDIIQTPAHTHTNKEASSVVIPQAETTKRYANIPEILLEDTLIAENVEPILNIPDLYALMDAEFAADRGDIRRALNIYKAESFKKNATNVFERALSLSIEYETPAQSLAFATAWQDRNPDHIPAWFYVTHLALKAGEYNQAAAMISTILHYDPRSDLGQILTGIIPPKREDKRALLYALQGLGENNASISVLRAGILMGLADYQAARLHVNQALSIEPNNLAFITLKLDILRAANQLDELWKYLHQARKQLPKEKELYLYEARHLIEVGDLSQAWQLLTQAVKNTQDKDIILLAGLVGLDSGRYTDAIEILKPLTKNTEIASQAHYYIGIGYERLGNPQQARENFEKVHHYEHVLDATNKVVGFYLADNNTTDAIKTLIRLRDEFENYATDSYILQAEIYLRQNNQQKAKDLLTVANREYPDDDRLLYASFQLLENELEPQDKRQAIDRLLEIDEYNPRYRLADAKLRLSQNANDDDALNTASEISNISFDDPEYDSQLQLDALLVLGNHALAEQNYEAVIDYLQAPYEVMPNLNVGITLLRAYQGLGNNEAVANLLADLQSRFANSSAIADDSQIY

SEQ ID NO: 2660 - protein, 468 aa, M.catarrhalis
HQSCYNSEFLTGKIFGFLVVCMKLAVIGVNHKTAPVSLRERLSFGSDMPQAIEQLSTLANGCTIVSTCNRSELYAGIVDDVVSQHESQDEQSGGLISAKLQAIGEWLAEFKGISFDEIAPYLYTYEDSRALNHWLRVAAGLDSMILGEPQILGQIRQAVALSREYGGVDSDFGWLTQQVFAAARTVRRDTKVGQQAVTLGFATARLATQIFDDPSELTFLLVAAGEMNRLVAHNVAALGVKKIIICNRSPERAQALSDELSEMAQQAGRFLEIELAGLDRLGEVLPHADIVSSCSGSMQALIDTAMVKYALKIRRHQPMLLVDLAVPRDIDPLVGQLDYIYLYSVDDLQHVIAGNIAERKQAAVEAELLVGQLVADIEAQMQGQVARTHIRDYRQMAEARTQVLLARAMSQIDQGDDAKAVLSEFSHTLSQALMHSPSRLIRQIAKTYDADTLDLVSHELIHSYRKPI

SEQ ID NO: 2661 - protein, 265 aa, M.catarrhalis
LSIRFYRIFTMSYMAVFSGSANPKLAQTVADNLHIPLGKADINRFSDGEIAVEIKENVRGKDVFILQPTCAPTNDHLMEVILLADALRRSSAGRITAVIPYFGYARQDRRPRSARVPISAKVVADMLSIAGIDRIMMVDLHADQIQGFFDVPVDNLYGTPVLLRDLKQQNYENLMVVSPDVGGVVRARAMAKLLGDADLAIIDKRRARANESQVMHIIGDVSGRDCVIGDDIVDPAGPLCKAAQALKDHGARRGGGYITQPVLSG

SEQ ID NO: 2662 - protein, 196 aa, M.catarrhalis
ASRRQIVKKIAFAALSVSVLLLSACTNIQPSTQTPTTLPTADTPLKFAVTGKIGVVTTTPEGRQAGSAFYTWTQEDDRFAIELTGMLGIGATQIRYNGTTAALDSERTGTITADTPEALLLTATGWQAPISQLPHWILGRGAPDDSTAGYDHLGRLVSAANGAWHAQFDYDKTSLPSRLRITHTNQHSITMTVTHQ

SEQ ID NO: 2663 - protein, 554 aa, M.catarrhalis
FMQIERDSMEFDVIIVGGGPAGLSAAIRLRQLAIAAGMDEFTVCVIEKGSEFGAHTLSGAVIETRALDELIPDWKERDAPITVEAKEDRVYMLTSEKGSTALPSSIVPSSMHNDGNYIVSLGNVVRWLAEQAESLEVMMFPSFAASDVLYHEDGSVRGVVTGDMGLNAQGEPKNSFEPGYELLAKYTIFAEGCRGHLGQRLISRFHLDKDKDPQHYGIGLKELWEIDADKHEQGVIMHGSCWPLSETGTTGGWWLYFAEDNQVSFGLVVDLSYHNPYVSPFDELQRLKLHPIIRPILEGGKRLSYGARALTKGGLNSLPKLTFAGGVLVGDDAGFLNPAKIKGTHTSMKSGMLAAESIFNAIQAGRSSDEVVEYQTAFENSWLFEDAHQARNFSPSLHRMGTWMGGVFTFVEQNLFGGKMPLTIHDNTPDYSTLDKADHAYKPNYPKPDGKLTFDKLSSVFISNTNHAEDQPNHLRLTDPAVPVSLNLPLYAEPAQRYCPAGVYEIVHKEGKTPKFVINSQNCVHCKTCDIKDPSQNITWVTPEGGGGPNYPNM

SEQ ID NO: 2664 - protein, 74 aa, M.catarrhalis
VSLSLGMVMIESTCWVKASMPLRAAAARRLPSKLNGVVTTATVKMPISFAMRATTGAAPVPVPPPIPAVMNAIL

SEQ ID NO: 2665 - protein, 161 aa, M.catarrhalis
FIQSSKLIIIKTAQIAKDTCIMISLWFNMITLHHHMGIIMQKMTYKAIGLGLVLALTGCSAFRVYTIDLPQGTPLSAAQANQIQVGMNANQVLYLLGSPALRDTLAPNRWDYIYDHTAGTDGKRQKKSDIKNASQYLSIHFNNQGIVTRIDGRDSLPDTRH

SEQ ID NO: 2666 - protein, 218 aa, M.catarrhalis
NQTFQSNHTILYLIIGFFMEKVTIPTPCQQQLNHYCKKWKNDKKLENYRMQEQSLNKLFHELLPLNNDISEILIKSSVLNDFYSTNIFTIYPVAKKIQSLDIDKYLKEGDADLVMDIKNVTINGKNKNFYSFATKYYSHHDAMNHPIYDAYVDKVLRHFRHKDKFYSFKNEDLKDYCQFKLTLIEFQHYYKINCTLKDLDRYLWLLGKAFFNKYKSIP

SEQ ID NO: 2667 - protein, 76 aa, M.catarrhalis
IKYPLSVDNKDQQAQSFKPKISQSMADFLLITFKILNEQTSPKRHTLRMFIFRFKSANWLNAKLFNTSWLDMMISD

SEQ ID NO: 2668 - protein, 78 aa, M.catarrhalis
VINPTTSAIAKASAWSWVTKMAETFWEISRRRTSLERLVRSSTSKFENGSSSKIKLGRGASARTSATRCCCPPDSSCG

SEQ ID NO: 2669 - protein, 66 aa, M.catarrhalis
YVLPLEESHDFLKPLQKMPKLVNEHQFINKILSLVTPSDCKTILISKIHRVNASKIICQSTLQLYG

SEQ ID NO: 2670 - protein, 111 aa, M.catarrhalis
NLKPCAYKQSEPDHLIVLRITMNFYYVYVIQNVDNHDEFYVGFTTNLKQRIDDHNNGTTYSTRARTWRIVYCEAYINEQVARKRERTIKNNGRMRTFLMNRVKSQFDNQND

SEQ ID NO: 2671 - protein, 167 aa, M.catarrhalis
RIKPNLSTFIICQSNEMILLMPNKDDLGKWLPWANDFSENSYREFVKFALHQYADDKAIHTHIIYDDKIIGAVSLNNIYHQLKKAEIGYWLHQDHRGRGVMTCAVRAIMDIAKNIYGMNVVEIKAGEHNIPSQQVAKRLGFEFCGIIANHENINGEIINHAVYMYRF

SEQ ID NO: 2672 - protein, 147 aa, M.catarrhalis
YMAFTNKDLRKAGLKVTLPRIKILELLENAEHHHMSAEDVYRALAAQGEDVGLATVYRVLTQFEQAGIVERHNFENNLSVFEIVQDEHHDHLVCDVCGKIVEFHNSVIEEEQFKVAKAHNFKLSGHSLILYGVCDSPECLKSSDETQ

SEQ ID NO: 2673 - protein, 349 aa, M.catarrhalis
VAVTVVYCFITLLIEGSIMKKLVMAALVMATAAPAFANEIVVYSARADELLKPIAEAYQQKTGTKVTVVSDKAGPLMERLKAEGKNTQADVLITVDGGNLWQATQAGVLRPINSSVLKSNIPSHLRDPKNHWFGLSVRARTIFYNPNKVNPSELSTYADLADPKWKGRLCLRTSNNVYNQSLVATMIANHGQATTDRVVKGWVANLAAAPFANDTALLEAIDAGRCDVGIANTYYYGRLLNSKPQVANNVKVFFANQAGKGTHVNVSGAGVVKHSDNPAEAQKFIEWLSSNEAQRLYADRNFEYPANIQVTPTPAVARWGRFKQDFINVSVAGQNQQKAIMTMKRAGYK

SEQ ID NO: 2674 - protein, 81 aa, M.catarrhalis
KENTMLSEYRELMTKLKAEGDKHFLKLFDEHNNLDTQIDNFEKDPVTSASRAQEIDEMKHKKLHLKDQLKTYLDKVSAERG

SEQ ID NO: 2675 - protein, 303 aa, M.catarrhalis
TIPTNGFIMLEIRHLQMMHALKRHGSLATTADEMNLTASAISHQLKELENYYDITMVNRRTRPISFTPAGLMVLELAERILPQVARTQSDIKRLAHGQAGRLRLASECHSCFDWLMPILNTYRGQYADVELDFSTGFDPEPHQMLVDGEIDLLITSSDLPIDGIDYLPLFTYESRLVVAPTHPLASQSVITPQDLCDQTLIAYPVEESHLDIIAQFLTPNGVTPANIRTTELTAMLIQLVASEHGVAALPDWVVLEYERKGWVVSRPLGTGVHCQLYAATRSSDAQLYFMQGFLNLLKDIQKP

SEQ ID NO: 2676 - protein, 867 aa, M.catarrhalis
KKNATGHSVACSEFAKGHTKKAVLGSLLIVGALGMATTASAQVQGAYIGGNRNVNQATGKYSTVSGGDYNEANGEISTIGGGFFNKASGESSTIAGGRNNQATKENSTVGGGKFNQAKGRNSTVAGGYNNEATGIDSTIAGGRGNQATGAGSFAAGVGNQATGAGSFAAGVGNQANADNAVAVGNKNSITGKDSVAIGSNNTVAQDHTFILGSNTQDVQSNSVLLGNETAGKQATTVKNAEVDGLNLTGFAGVSNAGNGTVSVGSQGKERQIVHVGAGEISATSTDAVNGSQLHALAKVVADNYNDILNNLDDIYNLDDGIKDLDDEVGLLGEEINSLEGEIFNNQDAIAKNQADIKTLESNVEEGLLDLSGRLLDQKADIDNNINNIYELAQQQDQHSSDIKTLKKNVEEGLLELSGHLIDQKSDIAQNQTDIQDLATYNELQDQYAQKQTEAIDALNKASSENTQNIEDLAAYNELQDAYAKQQTEAIDALNKASSENTQNIQDLAAYNELQDAYAKQQTEAIDALNKASSENTQNIEDLAAYNELQDAYAKQQTEAIDALNKASSENTQNIQDLAAYNELQDAYAKQQTEAIDALNKASSENTQNIQDLAAYNELQDAYAKQQTEAIDALNKASSENTQNIAKNQADIANNINNIYELAQQQDQHSSDIKTLAKASAANTDRIAKNKADADASFETLTKNQNTLIEKDKEHDKLITANKTAIDANKASADTKFAATADAITKNGNAITKNAKSITDLGTKVDAFDGRVTALDTKVNAFDGRITALDSKVENGMAAQAALSGLFQPYSVGKFNATAALGGYGSKSAVAIGAGYRVNPNLAFKAGAAINTSGNKKGSYNIGVNYEF

SEQ ID NO: 2677 - protein, 237 aa, M.catarrhalis
LYFAMPIYKGLISKSEYIAAFNFNKVITKVMMVNTLNMPKKGFCVDWSRLIDNRLETFLQTGILVLDEVFDQQDVLSLQKESGFIDYKVATLAHGERQQSIRGDRIRWIDEDCPIGMDYLRSIMLLAKYFNQTLYAGIRRSEAHYACYPVGFGYQWHVDNPKGRDDRVISAVFYLNDDWQTTDGGEILVIDKTGKQQTLQPKANRLVIFDSNLKHQVNITYRYRFSIATWMRRDSHL

SEQ ID NO: 2678 - protein, 397 aa, M.catarrhalis
QNVAKRYLSSCKKSSIITTFITVNVWLHKFMSKKINVLMMAAGTGGHVFPALAVADEMVARGGGIHWLGTPKGMENELVAKHGHTMHHIDMQGLRGKGLVRAIKLPFMLFKAVMASKNIIKNNNIDVVIGFGGYVTAPGGLAAKLCKIPLIIHEQNAIAGMSNKNLARHADKVLQAFDGAFDSDGKKVLTVGNPVRQSIANIAPPKERYLNDDSPLKVLVVGGSLGAKAINEAVVELLKLSDKPLTVRHQCGKDNHNTMLVAYSQAQIDTSRHVFEVMPFIDDMAQAYSWADVVICRAGALTVTEIASVGVAAIFVPLPHAVDDHQTANAKSLTDKEAGILLPQHELSGETLAQILTGLDRQKCLDMAKKAQESAKHHVAKTVAELVLAYGDDKGSQ

SEQ ID NO: 2679 - protein, 74 aa, M.catarrhalis
SFYADDNSKMEPPDPFPNSEVKRLSADGSVVRPCESRSSSAPYFKPLFAEAKGGFVWGLIKSSLALLKFFSMPS

SEQ ID NO: 2680 - protein, 765 aa, M.catarrhalis
AKQAKYGIIPTIVTKSYIDIQGVYMNKSTIIYTHTDEAPALATHSLLPIIRAFGATAGVDFVTSDISLAGRILAAFPEYLTQEQQTPDALAQLAELVTQPKANIIKLPNISASMPQLLAAIKELQAKGYQLPDYPTNPQTDQEKDIQKRYDKIKGSAVNPVLREGNSDRRAPKAVKNFAKKYPHSMGQWSKDSQSHVATMNGGDFFANEQSKTVADATTVSFIFTDTQGNQSQLRKPLALKAGEIIDATMMSKKALLSFLKEQVQDAKQKDVLFSLHMKATMMKVSDPIIFGHAVRVFFAPVFEQYGDKLAEAGINVNNGFGHLLANLDKLDADTRTGVTEAIAQAYATNPDIAMVDSDKGITNLHVPSDVIVDASMPAMIRNSGRMWDKNGNAKDTKAVIPDSSYAHVYQAVIDFCREHGAFDPTTMGSVPNVGLMAQKAEEYGSHDKTFEIEHDGTVELIDDHGTVLSSHTVEAGDIWRACQTKDAAVKDWVSLAVNRARLSGTPAIFWLDKNRAHDAELIKKVHHYLGDLDTDGLDIQILPPADACLASLERMKQGLDTISVTGNVLRDYNTDLFPILELGTSAKMLSIVPLMNGGGMFETGAGGSAPKHVQQFNEENHLRWDSLGEFLALAVSFEHLAQTTNNAKAQVLAETLDRATEKLLLNDKSPKRKVGELDNRGSHFYLAMYWSQALAAQNSDTAMADKFAPIAKALSDNEDTIVAELNQVQGQSVDIGGYYAPDFAKTAAAMRPSQTLEQILAQLH

SEQ ID NO: 2681 - protein, 488 aa, M.catarrhalis
QLRAFDKTRLQHGMDSMTQIRFSEAISKLQSRFGDQLSTNMTTREQHAHTTTWLLNQPADAVLTAKHKYDVADAIKICYEHHMPVIAFGIGSSLEGQLNAPYGGLCIDMSQMDEIVAINEEDLTATVQAGMTREVLNDYLRATGLFFPLDPGANATIGGMVATRASGTNAVRYGTMKEVVLSLEVVLPTGEIIKTGTRAKKSSAGYDLTRLIVGSEGTLGIVTEVTVKLFGQPEVIGSGTCHFPSIDTACQATIATIQMCLPIARIELLDPIQIRACNQYSGLSLPEKATLFVEFHGTKQSVAEQATLFEQIIEDFGGSDFEWGSDEAVRKKLWSARHHAYYAACALRPTARGLSTDACVPISRLAECVTQTQADIQKSGMLAPIVGHVGDGNFHVLLLVDTNNDEERQKAEEILERLAVRAIEMGGTCTGEHGIGQGKRKYMQKEHGAAIGVMQAIKQAIDPRGIMNPGKIWFDLGDNTISTNESKA

SEQ ID NO: 2682 - protein, 299 aa, M.catarrhalis
LCYYDKVLSLLLIRQFYQNIMINLIDTHTHFDIPEYDDKRVQFAQNADKNGVRHLLLIGYLAKYFERMVLVNQAINALKHAPRSHLAFGLHPLYINEQHDDDLGILEDYLNNYPTIAMGEIGLDTYAKPLKQPDIFQKQKRFFVEQIQLAKAYDLPILLHIRKNHADVLKILAEQNYHAHDRGGIAHSFSGGEQEALAFVKHGFKLGITGQITNPNAKKLRRSVKAVFDKYGIEAFVIETDCPDMMPLPCSHLGQFNEPAHLHCVLDELSELFNYDKQLLANQLWKNSCDALRMDWRYD

SEQ ID NO: 2683 - protein, 378 aa, M.catarrhalis
VMKYGMADEFQPETNGQARIIVFGVGGGGGNAVEHMVRQNVLGITFVCANTDLQALNKLSAPNKIQIGADATRGLGAGANPEVGRNAAESNEDEIRAMLEGYNMAFITAGMGGGTGTGAAPVVARIAKEMGILTVAVVTTPFSFEGKRRAAAARNGIDALTQHVDSIITIPNDKLTQAYRNLTMVDAFKKADDVLLHAVNGLTETIVNPGMINIDFEDVRTAMSAKGHAMMGIGRASGTNRASEAMEKAIRSPLLDDLNLRNAQGLIINIIGSGVSMDEVMSIVAIGEGMMDEDAHVFYGLVEDPDMEDEIHVTVVATGLTVNERAVPVKLSGNKQETLRTHTSALAEENQQASIPRQGVPKPISVGTFLQREQQKNS

SEQ ID NO: 2684 - protein, 132 aa, M.catarrhalis
PPHLKDGNAQEIIDGVQELVENQRKTRYETAQGELEKARNEKMVRTDLQQIYRSAVEGNAVTLLVCQGYGVPATIDEQNATLLVAEDATDDGVNDDAVAEIIELVDHNGGEVVFVPREQMNEKEPIALMTRY

SEQ ID NO: 2685 - protein, 402 aa, M.catarrhalis
RNHHLGNAMTNSPELALSIELIQQASVTPDDKNCQNIIAKHLSKMGFDCEFMYFGDPNDSGDHAEIKNLWAIKKGRDLNAPVLCFAGHTDVVPIGDESAWKFPPFSATVHEGKLYGRGASDMKTGIASFVIAAENFIKNHPNHTGSIAMLITADEEGPAINGTIKVAQTLKERGQKIDFCLVGEPSSTQSLGDVIKNGRRGSLNAKLTVTGKQGHIAYPHLAINPIHAACPALDELIKTHWDDGNEYFPKTSLQISNIRSGTGATNVIGGTCEILFNFRYCTENTAENLMAKTHAIFDKHFRHTDATYQIEWTLSGVPFLTEKGEFVSACIDAIKTVTGTNAQLSTSGGTSDGRFIAPIMNAQVVELGVLNTTIHQVDESVDIEDLEQLTQIYEEILISLIE

SEQ ID NO: 2686 - protein, 61 aa, M.catarrhalis
PRVHSIFTAISISLSLCWRQRCHHYAIRAGRNLPDKEFRYLRTVIVTAAVYWGFDQELRLR

SEQ ID NO: 2687 - protein, 103 aa, M.catarrhalis; identical to SEQ ID NO: 2000

SEQ ID NO: 2688 - protein, 97 aa, M.catarrhalis
TVSHTGLSPTMVGFPTPFCYCKIDRLLRVRSPLLTESHLMSFPRGTEMFHFSRFALHSKLCNNQLMLVGFPHSEIAGSQDIATSPTLIAGYHVFHRL

SEQ ID NO: 2689 - protein, 354 aa, M.catarrhalis
PRRQFMAVDFSNTLIVAISATALFDLAKNEAKLAELVAKDKDTAARKFQAYQQVRENEILDKGSGYPLIEALLNLNKHQPPMEYHIESPYVEVVIVSKSSPDIGIQVLNSIRAYGLGITRSAFISGDLVADYIKDFNVDLFLTTNHKDAQQVVDAKICACAVLDATPISIDKLDSHQLRIAFDGDAVLFDDSGELVFKQEGLYAFHARETEMADLPIEKGPYADFLIKLSKLQAKLPNQSTDAPHNPIRIALVTARNAPADMRAIKTLRQWGVTVDMAFFLGGLDKTNVLKTFAPHIFFDDSIKHIDAARSVVPSALVPYHSESQLNILAPQAIPDMEDRAFTPIKPKKPKTSS

SEQ ID NO: 2690 - protein, 583 aa, M.catarrhalis
HQFKRTWYDAQCSQISRILQMPKAKTDATDSTQTSFHTADTTTGQMTFAIIQTNFWVGDIAGNVKKMHALTLDAKARGADIVIFPELALVGYPPEDLLLRPTLGERVREAMAKLAEIEGIVVILGYPHIDHHGTFNSAAILQDGSQKGFYHKQCLPNYGIFDEQRYFQKGLNQVLFDYKGVTIGLLICEDIWHDEPIQALKQAGADLVIVINASPFEIGKQTARKSLLTRHSSTHHLPIIYVNTVGAQDDIVFDGGSLITQSDGRVAHEGVRFLNQLLMARFDTQNKTFDTQAKAPLVLSEESEMYQALVVGLRDYVNRSGFKGVIVGLSGGIDSALTLCIAVDALGCDRVYAVMMPYEYTAQISLEDAEAQAARLNVSYTVCPIHDAVAGLRSALAPLLANSEPDVTEENLQARARGTILMALSNKFGHMVISTGNKSENAVGYSTLYGDMVGGFDVLKDVYKTDVYRLANYRNRLEDNPVIPERVITRPPSAELRPNQKDQDSLGDYETLDSILKMYIDDDLGYKAIVAAGFEPKTVEKILGMVDRAEYKRRQGAIGTKITKKSFGRERRYPLVNGWSIKG

SEQ ID NO: 2691 - protein, 78 aa, M.catarrhalis
LAPNTKPAYAKIALQIKEPNPVNIKKGNKGMCAIPAGMDISERIAGIIRPKNMTDLPCRSNHFWALLTSLAVIKKYLP

SEQ ID NO: 2692 - protein, 241 aa, M.catarrhalis
FVTKISMKTMTVKPWHSALMIIVLIAIFGLLTNYLLNNETVKPIVIEPNQLTKSQFGALQQAIEPIGKVQFFGADLVKIHQTISQLTWVESANVQRDWNNGVVVSVIARKPIANFGSDRLLDADGVVYEPAESSQLMNPNLVNLHGQDTESQQIMQKLKRINTWYAPLDVQVQDLILTPRQTWIIRFNNGMRIMVDHEDAEQKLYNLAIQLQSALANDFGRIDSVDLRYKNGFAIAWRNQA

SEQ ID NO: 2693 - protein, 334 aa, M.catarrhalis
TLHKYTRVRARHSRCLKRLNAVMTQIILSSNQIHRLHHAFFVPQGEIKATLLIVHGMSEHGGRYADFARFLADNGVLVATYDQLGHGQTVKDKYELGFFDEKHPVQTLCKDVIIMADKLKDKARTLTSRPVPHYIMGHSMGSFIVRTVLTHHSTRFDGVILMGTADSFGLLNRMSLVSFGLLNQLFAKQVNQKAAHLMNHVLLSQLRSPISASPFAWLSENIDAVRAFETDPLTGFAFTNNGWMTLFALMQRAMRPDWYTNMPSNYPILLISGNNDPVGNMGQDIQTLQEKLIHANCSVSVQLYPNMRHEPLHEKQAQKVFVDILAWIERHLRV

SEQ ID NO: 2694 - protein, 154 aa, M.catarrhalis
CDGKQAIGDIFFMQIIFLDSHHLPTLPPLALTIGNYDGVHLGHQALLSALADDAKAMGLLPAVMVFEPQPREYFSPDNPPARLTNLTEKAEQITQLGVQYLIVASFDDAFRSLSAAAFVDLLHSLNVSHLVLGDDFRFGSKSCWRQNIFASCRI

SEQ ID NO: 2695 - protein, 246 aa, M.catarrhalis
PILNPKRRCVMDAMITIDDNQLLTNYRLIKQALNTANDQAVQMNPTHRPAKLIAVSKTKPVAMIQTLFHQGQQDFGENYLQEALGKISQLSQLPIIWHYIGSIQRNKTRDIAKHFDWVHTLEREIIAQRLNEQRAGMQPLNVLIQINIDDESSKSGCKPTELPTLIEQIINYKNLNLRGVMVIPSQQTVDAFARTKVLFDAMARRFDLPNWDTISMGMSGDMTQAVAHGSTMVRVGTAIFGERDHR

SEQ ID NO: 2696 - protein, 370 aa, M.catarrhalis
HRLNHHLTAVAALLRLHLEYAMNTPDLMELLRFAHQKNASDLHLSAQQPIMLRIDGNLLPMDITPIDTDGIMQMLRLVMDDTDYHQWQHNLEHDFVLSLDGIARFRVNVFFQAHGAAAVFRVIKTHIPSLQQLSYDEYIYDSMLKIAKLQAGLVLITGATGSGKSTTLASFIDHINQHQKKHIITIEDPIEYEHSSKLSLINQRQVGKDTRSFQNALRSALREDPDVILVGELRDLETIRLALTAAETGHLVLATLHTDNAPKSIDRIIEVFDAGEKHMIRTMLADSLKAVVAQRLLPAQGGGRVAAFEILTHTPAVAHLIRENKISQLPSVIQTSLTQGMIDLTQSLSRLAETGKITPATANEQINMLR

SEQ ID NO: 2697 - protein, 78 aa, M.catarrhalis
VTIKSSKWAWEIMMKLTWQDTLDIAIALSEKYPNEDVQYIRFTDLHQYVCELEDFDDNPDGSNERILEAIQMAWLDEL

SEQ ID NO: 2698 - protein, 115 aa, M.catarrhalis
YSINPQTLWYSNLRFLKISGELAFMFAFILNIIIISVVMWLFLKFMYPKPPKAFFPKEGDDTSVRHCHYCGHALATYRGILLNENQPNERFFCNADHLKSYADTHPKENLPMIND

SEQ ID NO: 2699 - protein, 314 aa, M.catarrhalis
KLKKGKNMSKLNTKDGQNFGKVAVICGGTSTEREVSLNSGMAVLNALLSKGVDAHHFDPADTDISHLRAYDRVFNVLHGTFGEDGSLQGVLDGFNLPYTGCGVLASAIAMDKFRCRLLWQSLGLPNVPYVVLHDDSDFSAVEREFGLPLFVKPAAEGSSVGVFMVEQAGDLAKIYPKLKQYHGEILAEKAMMGGEYAIPLLGEQVLPSIRIIPKGKFYDYEAKYLRDDTIYQCPSDLTPEQERQMGELALKAFRAIGGRGWSRVDFLKGHDGKLYVLEINTVPGMTDHSLVPMAAKEAGIGFDELCLQILRQTL

SEQ ID NO: 2700 - protein, 322 aa, M.catarrhalis
FMKKAAIILVNLGTPDAPTPKSVRRYLKEFLSDTRVIEIPKLIWQVILTGFVLTTRPKRVAHAYASIWMDDGSPLLVILKNQAKDLQDLLSQQGIKTPVYPATTYGNPSIKSVIEDLLADGVSSLIVLPLFPQYSATSTAAAFDKIAKLLLHKRQLPELHFITEYHNHPTYIEALAQSVERYWAVHGRADKLLMSFHGIPKPYADKGDPYPEQCRTTAVLLADRLGLSINEWAMSFQSRFGAQEWLKPYTDELLGEWGAARLSVQVISPAFSADCLETLEELAVENKGNFLQAGGRAYDYIPALNTDELHIQMMAELVKQYI

SEQ ID NO: 2701 - protein, 535 aa, M.catarrhalis
MPMNSSSILPRLWLGLCALLVLVPLSVIVFALNSFDTEIWQFLLDYELPLLLKNTTLLVLGVGIGVTVLGTTTAWLTAMTDFPLRRFFGWAMMLPLAMPAYVLAFVQLGIFDYTGTISTYLRQAWGFENGLPDIRNGFGLTMVMSLTLYPYVYLLAKNAFGSMGNRALEAGASLGLSSVQSFLKLALPMARPWIAGGSILALMEVLADFGAVSVFGYDTFTTAIYQAWFGFYSLDTAKQLASLLIGLVFVFLLLEQLSRGRRRFETTGRASHHRNIVLTGHKKWFATLYCGLILCLSFVIPIIQLTAWAMSSWQQIVLGELLMQIWHSVSISLMSAVAVAVVALFIAIASGLDKSRYALIATKISTLGYAIPGTVLAVGVFVPVAWLDNWLITNMAVFSGSDAIFKGTIFAMLIALLIRFLALGVQSVDAGMKRIRNTHIEAAASLGATPFGTVYRVYLPLIKSALGVSMLMVFVDTMKEMPITLMMRPFNWDTLAVRIFAFTSEGLYDKASFPALAIILTGLIPVILFSKMNQK

SEQ ID NO: 2702 - protein, 344 aa, M.catarrhalis
HSEKTMLRIDNLCISFDHKPILTDISLHLKSGQIACLLGASGCGKTTLLRCIAGFETPDSGEIYIQDKPLYAKNIHLPAHKRQIGMVFQDYALFPHLTVADNIAFGLSAMDKTAKSERVAEMLVLIGMSEYANYYPHELSGGQQQRVALVRALAPRPSLILLDEPFSNLDVELRTNLSKEVRRLLISQNVSAILVTHDQAEAFAMADVVGLITHGRLQQWGTPDALYHQPVNESVARFIGEGVLIDATKVTESNFDASFGRIAVGLPLGSQKALIRPHDVKPSQDPNAIAVTVIDRDFHGGYWLYTLQTHDEQILLMQISMATSHRTHHVGDKIGVMIHRAFGI

SEQ ID NO: 2703 - protein, 156 aa, M.catarrhalis
YHNDQLLCNFYKKFDNTIQSHAKISLAKFCLINLGYLMLAQLQALEQTIIAMKKQYAVTATELANLKQRIAGDDSAKQMETLQAKLNQALVDIDHHNNRVDDLQQTQNALEQQVDELYQANRALITQNQDLKDKNALAISRAEVIRDWLSKIDRSN

SEQ ID NO: 2704 - protein, 329 aa, M.catarrhalis
FMIEPKSCPYGGAFLMLMMPVDDELGIWIMKKIDLHMHSTCSDGTNTPTELIKKVALAGIQMAALTDHDTIKGLDEAKQTAKMVGVELIRGVEVSCTHTLSGGYGKHQEIDKIIHVVALNFSDTLKMNEALQSLQDSRHLRGRQMTQKLASLLMNHPDEEPVLFEHLWQKVLVKADGNARAVGRAHIGQVLYELGYVSSVQAAFDKYLADNKPAYVPIQTISMADTIALIHECDGLAVLAHPTRYKLSATRTQRLISDFAQYGGDGCELPNHEPLSCIEMVGRTIAKHGLAISLGSDFHGDTMPWRKLGSTAVKSDNQIGIWERFGEIY

SEQ ID NO: 2705 - protein, 63 aa, M.catarrhalis; identical to SEQ ID NO: 2004

SEQ ID NO: 2706 - protein, 524 aa, M.catarrhalis
YSREYMMLDQNLLDAVKSYSANMTRPIQLVIGAGEHEKRAELIDFLTKIAGTTDKIQFDAQVIDNRLSPMSFKITTQNRDTGIVFSGIPGGHEFTSLILAILQAGGHALKLDEDIQQLVKHIQEPLKFQTFVSLSCHNCPDVVQALNQFAILNDHIENEMIDGGVFPELVAEKKIQGVPAVFLNGKPFANGKVDTAKLIEKLQEQYPNLLASANEVQLETQDVTVIGGGPAGTAAAIYTARKGLRVAIVADRIGGQVKDTQDIENLISIPLTNGNTLAANLATHIKEYNITVKEHVSVSKLEEVDGGYQVTLSTGASWLSRTVILATGAKWRKLGVKGEDENIGNGVAYCPHCDGPFFKGKDVAVIGGGNSGVEAALDLAGIVNHVTVLEFGDSLRADQVLIDKAEARENITIIKSAATTEITTDGSKVNALIYQDRVSGNSQTLPLSAVFVQIGLVPNSEIAKGLVTMTPQGEIEIDAKCRTSKVGIFACGDVTTVPYKQINIAMGEGSKAGLAAFEYLMMNG

SEQ ID NO: 2707 - protein, 224 aa, M.catarrhalis
IKSLSKKWGIMGMMMQLMDFILTIDQHLAIFLQDYGMWIYGILFLIIFVETGLVVMPFLPGDSLLFAAGALAAVTGAINPILLIILLSLAAVLGDTLNYHIGKYIGPKVFVTNSRWINHQHLVNTQKFFATHGKKTIILARFIPFARTFAPFVAGAGSMHYRYFLSYNIIGGCLWIMSFVLLGYFFGNQPAIKNNFTYVIFGIIIFSILPVIFSFIKQKLNKAA

SEQ ID NO: 2708 - protein, 67 aa, M.catarrhalis
LMICSMSVGSSVGLQPDLLLSSSILICINTLSGCMPARCSLRRWAMISRSKVCTQSKCLAISRVLLR

SEQ ID NO: 2709 - protein, 68 aa, M.catarrhalis
KYFRAACLTRYKTKKIYTNLAAGGRGVAMPLTVRERELPETIAPILMHKGIHFVARRASPVVIFPKLM

SEQ ID NO: 2710 - protein, 119 aa, M.catarrhalis
SSTLAIFAAESEATVLRLPFDAKERVILGNKFATRDLMRDLSEAVNYYVLVVTSENARLLVGTNGTLIKEVVGDSPRQEVHDELAFPIKNTTLPTGSKSDRTGSSDDHSYLKRVYESCG

SEQ ID NO: 2711 - protein, 366 aa, M.catarrhalis
FFQRNCNRAIILILGISMDENKEKALKAALAQIEKQFGKNTIMHLGDETAKLDVDVVSTGSLGLDIALGIGGLPKGRIIEIFGPESSGKTTLTLQTIAECQKQGGTCAFIDAEHALDPIYAKKLGVNIDDLLVSQPDNGEQALEIADMLVRSGAIDLIVVDSVAALTPKAEIEGEMGDSHMGLQARLMSQALRKITGNAKRSNCMVIFINQIRMKIGVMFGSPETTTGGNALKFYASVRLDIRRIGSVKDGDEIIGSETRVKVIKNKMAPPFRQTEFQIMYGEGINRLGEVIDLGVDIGAVGKSGAWYSYGDGKIGQGKANTVKYLQENPAIASEIEAKVREIKLATVTPIVESDESEEHLEDDNF

SEQ ID NO: 2712 - protein, 493 aa, M.catarrhalis
HPNRETVMPNSTKVKTLPKRLIEIPEMRRIQNIHFVGIGGAGMCGIAEVLANQGYVVTGSDIKANAMTERLENLGVTVHVGHDASNIKMADVVVVSSAIDRQNPEIRAALKAHIPVVRRADMLGELMRYRHGIAVAGAHGKTTTTSLLTMMLTEAGLDPTYVIGGKLNASGKNAALGASRYLVAEADESDASFLSLRPMACVVTNIDEDHMETYEGSFDKLKQAYVQFLHNMPFYGLAVLCGDDKELYAMIDDIARPVITYGLEKHNDVQAVDVIADGTKTHFTVLRKDKKPLPITLNIPGIHNVYNALGAITMATDEGVSDKAICQAVEKFAGVGRRFENNGSYPLTDGSGDVVLIDDYGHHPTEIAMTIKAARQSYPDRRLVMMFQPHRYSRTRDCFSEFVNVLSQVDKLILLDVYSAGEELIKGATSNDLARSLRERGQVEPIVLNVNDKEQITQVLKITLNANDLLMTQGAGNVGQLCQELVKNGLFLG

SEQ ID NO: 2713 - protein, 196 aa, M.catarrhalis
ILVRFGLTLAIILYPPMNQRPNTQQGFTLIETLVVLSILVIIGMIAIPAYDSLMRRYESQMVGRYVQEALRRAKIESALHQKDVIICPINTLGVCDRFGQSGLMVFIDKNKNNRKDDSDALVLKESFELKYGMLSMTVALHRHYIKFMGDNAKPRGYMGNVRYCSLNGDAALSHQTTINMHGLSRIENGDVTKLGC

SEQ ID NO: 2714 - protein, 330 aa, M.catarrhalis
NFQRYCFILSNLGTIEPSLSDDKITFLRTVMITLRQLEFALAVAKHRHFKRAAEECNISQSALSLGIAELEKQLDTQIFERNNKQVLITPIGEEILERAQRISSEINDLMTRAHSHQIPLAYPMTIGIIPTIAPYLLPKVLPTLKRLHPHFELSVVEKQTERLIEQVRYGHIDTAIIALPYPLDGLHAFEFWAEDFFAILSENDEHIHTDKINSDDLSKTNLLLLGEGHCLTDQVLSVCALSKSEIQSSFSDASLNTLIQMSLAGMGTTLVPKMALEQIGEKTVHAIPLAEPGPHRRLAFITRLNYARVNDVRLLSEIFGQALASSENEA

SEQ ID NO: 2715 - protein, 80 aa, M.catarrhalis
RWTGTLGLPANGLFTRFVVTHVSIRSCDTSSTPYSAPSQAYTTLPYHLIETIKSAASAPSLSPVTSSAQADSTSELLRFL

SEQ ID NO: 2716 - protein, 74 aa, M.catarrhalis
QAFIHHSQPKATKTHKKAASKLTAFFGDDRQLELVIHTDVIRAFFITTGINRRTSFKRQIWIHTIASTDSNRRF

SEQ ID NO: 2717 - protein, 298 aa, M.catarrhalis
FSLMNYKHAYHAGNFADVVKHILLLQLLSQFSAKAKPFYVLDAYGGRGLYSLASSETQKTQEAQRGVVVLEQAVKAGLDGLPNAVSRYLSDLAFARQKYDQYVYPGSPWWIAHHGEYHSTNAPLRAEAFETVADEYDALNYQLYQLPIGIHHRDAFEGVRAVIPPKEKRGIILLDPPFEQEHKDFSRLVDLLVSSHKKFATGTFILWYPIKNIEAVELFYKKMKRTGIKKQLVCELNLYPNDVAVGLNGTGLLVINPPWQFADNAQEVIEFLAPILKPKDAPQMTLGEMAVVKWLVAE

SEQ ID NO: 2718 - protein, 118 aa, M.catarrhalis
GIIMSQDTQNSPSSAIIAKEEFRPIDISIAGTPHRIVCPVDEIKNLEHGAEYINHKIRDLRREIKHKTPTNEEFLVLVCLELYDEVQALKTQITKTDDEKAKVAAMIDKINQQARSML

SEQ ID NO: 2719 - protein, 276 aa, M.catarrhalis
GVIMSTLATIIETAFDDRANFTAQTVSPEIRAAVDEVIEALDNGSLRVAQKIDGEWVVHQWVKKAVLLSFKINDNKPMNAGELGFYDKVDTKFNGWTEEDFKNAGVRVVPPAVARKGSFIAKDVILMPSYTNIGAYVDEGTMVDTWATVGSCAQIGKNVHLSGGVGIGGVLEPLQANPTIIEDNCFIGARSEIVEGVIVEEGSVISMGVYIGQSTRIYDRETGEIFYGRVPAGSVVVPGNLPSPCGKYSLYAAIIVKKVDAQTRAKTSLNDLLRTE

SEQ ID NO: 2720 - protein, 211 aa, M.catarrhalis
TSTMEQVSEWVLVIMDKLDLVGVSLMMFLENIFPPIPSELIMPAAGFAAATGQINLFAVIIAGTIGSITGALPLYYIGTKLDKARLIHLTNRYGKYFLITANDVSNAQKWFDRHGKSVIFFGRMIPAIRSLISIPAGMAHMPLLPFLILTGLGSLIWSAILAYAGFVLGANYHKVANYVSTISHYIIIGAGLIILFVSYKRIKKFWGTHAK

SEQ ID NO: 2721 - protein, 215 aa, M.catarrhalis
RQTMATDYLSGWDDWVSAFGDWTDISISELHGIMTGIMTVCHAPDTDGWVRLLEEMSFGIPSESALELLTDYAEDVSFALKDKDDAYGYEPLVPDDEHELYERVLALKDWAGGYITGIGVAGVTLSADENELIGTLMEIAAIRLDDEESLEGGEEMWLQLFEFARMVPVSLAVRQRQDVKNLALLKGLPPEAKTANELASEKLAVPVIDVMASKQ

SEQ ID NO: 2722 - protein, 83 aa, M.catarrhalis
QGFFSPFPHGTGSLSVSQEYLALEDGPPIFRQNFSCSALLNMSLKQFRIQDYHLLWLAFPRHFATVKLIGSSVFARRYLRNLI

SEQ ID NO: 2723 - protein, 157 aa, M.catarrhalis
GICMNVLKNCIIGLITVLPTMTYANSHLGLYTNDLAKCMVSSLSANDKQIIQNFTLQSMFSHPSLNQKNPYSQYEINQTQQQVGRLITRLFAKDCTKEWIIAMYYDNKAVEQASETLGFYAMQDLINHPNYKRYALGIERYINTQELEHAIQDVLKD

SEQ ID NO: 2724 - protein, 313 aa, M.catarrhalis
SLIMTIKTLSEVLAEMGESPVSADNHQIQVLDETNFYQLTTTKPPKLNRLPKNNTLKKPSQPKSLVTASSHDTAPISHTPTDKTQPPKALKNQKPKSLSKSQIGELLKHAQGGQDSIAMPKKLADSLSDVAIEPLIQTDKATNYLRWLAFYYLSRREMSQHELQKKLLTKGCEPQAVEDLLQEFAHKGYQSDERFAMMLVRESIRKGRGKNHILQVLKSAKVNLPESVDSIDQLIQQAGADSLTDGTILTCDESETVNWLKLAVEVRTRKYGDTIPTTPKDKAKQLRFLQYRGFEFWVCLEALKLSLADFQEA

SEQ ID NO: 2725 - protein, 105 aa, M.catarrhalis
KNIIMKATLKQLKQTQANPAVSIFVKTHRTHPENEQDAIALKNQLKVAEDRITEEHDKRTADAILVNITAQTDELDHNYNLVRWQFLQLSQKRPYFVCLLMPKSV

SEQ ID NO: 2726 - protein, 350 aa, M.catarrhalis
ECVMKVLGLETSCDETGLAIYDSTMNGRGGVLSQVLYSQINLHATYGGVVPELASRDHIRKLVPLFNEMLDQANITKSDIDAVAYTKGPGLIGALMTGALFGRTLAYGLGVPAVGVHHMEGHLLAPLLASDDPPSFPFVCLLVSGGHTMLVRADGVGVYQILGESIDDAVGECFDKTAKMLKLPYPGGPNIEKLAKNGNPHAYELPRPMQHKGLDFSFSGMKTAIHNLIKDTPNAQSDPATRADIAASFEYAVVDTLVKKCTKALQMTGIRQLVVAGGVSANQTLRRTLTETLRQIDASVYYAPTELCTDNGAMIAYAGFCRLSRGQSDDLAVRCIPRWDMTMLGIEYDN

SEQ ID NO: 2727 - protein, 362 aa, M.catarrhalis
ISLIIRQAMTVQTYTPSPKPTPKKAVQGEKLRGYDKVARIPIKVIPTVETPKKPDWIRVKLSSPAEVERIKGTLRKQKLYTVCEEAACPNLPQCFGDGTATFMIMGDICTRRCPFCEVAHGRPNPLDKDEPKHTAETILGLGLKYAVITSVDRDDLKDGGAGHFVDVINESKALSPNCLIEILVPDFRGREQVALDLLTQTAPDVFNHNIETVPRLYKAFRPGSDYEHSLSLLKQYKARRPDVATKCGFMVGLGETEDEVYALLDDLKAHDVDIITIGQYLAPSKNHAPVDRYVHPDEFARYTEYGKKLGFFNIWANPMVRSSYFADRQYYGEDCPPPVRSSKVLAEEKLAKAERGEKVGCF

SEQ ID NO: 2728 - protein, 79 aa, M.catarrhalis
YQSMAYTHDMIDKITITKIRHIVCIDVLALMFHNDLTYFMDKMADGFLSGQILDKKYFCGRFFIESLIKINPQAHNHDC

SEQ ID NO: 2729 - protein, 212 aa, M.catarrhalis
HDTIVFLLIFMVYNQINQPKKVNIMAAIINQTIPEFSTQAYVNGEFKTITSDDVKGSWAIFMFYPHDFTFVCPTELEDMAAHYEELKGLGVEVYAVSTDTHFVHKAWHDASPAIGKVQYPMLGDGTGKITRGFNVMIEEDNAALRGTFLVDPDGVIKVAEIHDLGIGRSAKDMVRKVKAAQYVRDNDGEVCPAAWEAGQETLKPSLDLVGKI

SEQ ID NO: 2730 - protein, 273 aa, M.catarrhalis
KRAIMSEIQKPETHTASNEHEHDGITFEVIEPEHSGDKRIMTSGVYLIPNLITTLSLFSGFYSIILSTSADYQRAGLAIFVSAFLDGMDGRAARMFNAQSPFGEQYDSLADCIAFGLAPAILIYSFALAPLGRFGMACAFVYAACAAFRLARFNVQIDVVDKKYFIGLASPLAALLIACSVLVAAKYASLMTAIPTALTWFFALWTIVCGILMVSNIKYYSFKEFDKQKVPFIVLLLAVLVFGVVLYDIPVGLLAIGIAYVLSGFVTTLNKKF

SEQ ID NO: 2731 - protein, 435 aa, M.catarrhalis
GNRVTLQAVIHISSTAVCTVVGYFETKGLEKHLRVSAVGLAHTDAFFGGRVDHREYLLSAIHKSVREASDMAGLQIISPVLCMASAMMNMQNMSNEVNIDTADRMVTPEHIRQATQAMSDQIISQDRAPFQMNRQLIFLEDYHVQDAKGLMTDKICVASHVIDMPTNQLKQMISLVEQDDLQVASCLFDGIAGAEYALSEDEKQAGVCFIDIGAGMTKVCIYKDGILIYSHCLDMGGVTVDMDIAKECGILLTDADSFKRQEGTLNRHKYSSGAVVTYKRHTKHEKTMLRRELNQVIEARYRKLFDKVIDEIDASLLVSLDAGIVLAGGGSSMDGLLDFTRNHIGMKVRLITNNPRVKLDPERLSDDNIKLLNKHLCDNTLHTAIGALLFMGSAQYARDQQTQEADELDDSWMTERVSMISQLFGQFTAWIKRVF

SEQ ID NO: 2732 - protein, 278 aa, M.catarrhalis
QISFGKIAVMHCVWIGDMTDTIQMDYDRRFMGVSTLYGQQNHDKFAKAIVYVIGVGGVGSWVAEGLARTAIGQIVLVDMDVLVESNINRQLPALSQTLGENKIEVMAERLRGINPRVQLDCIDEFLTVDNIKTILPNRARVAALKAEGRAVIVLDCVDDMSAKLAIALHCRFNKIKCVIAGGAGAKIDPTRIGVADLRDTTQDPLLARLRSKLREKGIGTSHKEKFGLRCVYSDEPPKLTNNLCQTHLNCGGFGSAVVITATVGMLMVGEALKIISTH

SEQ ID NO: 2733 - protein, 254 aa, M.catarrhalis
PTTVLCRWLPKKQGLGLMSCAYKFYAKRYDVVVYPSSNTPKTVAELIAYFASHGITLCIQRKSVKHLNFRLTQSTLKVSVPSDIDEQVLVDGIYAKIPWAIRSYHALMIEKPYYDTLWGERLDVANWLNIHQANLPCRTLGYLKKLPKQALITWIYRYEIKQQLPSLLSQWQPKVGKKAAAIRLRQMSSRWGSCNTLSAKITLNTHLASYPLGCLAYVLVHELCHLYHANHSANFWKSVENAMPDYKYWHDLLK

SEQ ID NO: 2734 - protein, 84 aa, M.catarrhalis
VLGLLFYLSVINASKNFGVLMLSKSYSLPKIIFLDIDDTLYIKDEQRILQSVKPALLALKNQGVLLAIATGHTWDYTHRSTQAD

SEQ ID NO: 2735 - protein, 86 aa, M.catarrhalis; identical to SEQ ID NO: 2043

SEQ ID NO: 2736 - protein, 245 aa, M.catarrhalis
KIKVYCLQLPQVTLGIIPIEVRKLIDEVGIDYLLTMNGQYNEFAGKKLFDFPLQYQQVKKILEVFEHHNIATAFMTRAEIFCFNQNHNLKTALGALDITPQPANKETFDFHQPIYQILAFYEDHEAEKIILPPDIKTTRWHRYAVDVLDYQSSKARSIARLLNQLNISKSGAVAFGDGLNDMEMFKLVGAAIAMGNAHPMLKQHAHIICPRHDQDGIEKNFKSAKLDLINPQTKPPFASAKRGLK

SEQ ID NO: 2737 - protein, 113 aa, M.catarrhalis
EILFSRIKWATAGVCVRISNAATRPPPWAGNSRWATTAFSESASIVRIMCFSPASNTSMIRSMLFGALSVCKVASTKCPVSAAVSAKRMVSRSRSSPTKITSGSSRNAERRAF

SEQ ID NO: 2738 - protein, 77 aa, M.catarrhalis
YFILLTIKIPQTIVQRAKNQVNAVGIAVIRLAYLAATKTEHAINKAANGLASPIKYFLSTTSIWTLNLAKRNAAQAA

SEQ ID NO: 2739 - protein, 581 aa, M.catarrhalis
IISSYKSYFMKASQFIFATLKETPNDADIASSQLMLRAGLIRKLASGLYVWMPMGLRVLKRVERIVREEMEKIDSQELLMPVTQPGELWHESGRWEDYGAELLRFKDRHSRDFVLGPTHEEVITDIARNELKSYKQLPITFYQIQTKFRDEIRPRFGVMRAREFTMKDAYSFHIDKESLANTYQDMYDAYNRIFTRLGLNFRAVQADTGSIGGFASHEFHVLADSGEDDIAFSSDSDFAANIELAEAVCYDKRAAPTQARTDVDTPNMTTCEAVAEHLNIPLSQTVKTLIVKGRHSQDNPEAPKFIALVLRGDHTLNEIKAEKIADAHTPLTMATEDELKEIGLIKGYISTDLQLPVYVDRAAAALSDFVSGANIEHKHTTGMNWDRDATITQIVDIRNVVDGDPSPDGNGVISIKRGIEVGHIFQLGDKYSKALNCSVLGKEGKPVTLMMGCYGIGVSRIIAAAIEQNHDDNGIIWAEPEDKADSIAPFYVAIVPMKSKDGDAEAKAQSLYQTLKARGINVLLDDRDERAGVKFADLELIGIPHRIVVSQRNLAENKYEYTNRATGDQQMLSLDELLALF

SEQ ID NO: 2740 - protein, 408 aa, M.catarrhalis
KGQYMTTQFKFGQYPDINGYFGRHGGRFVSETLMAALEELDEIYQTAKADPKFWDEFMADLTDYVGRPTPLYFAERLTQQVGGAQIFFKREDLNHTGAHKVNNTIGQALLAKMVGKKRIIAETGAGQHGVATATIAARLGLECVVYMGADDVERQKMNVYRMRLLGATVVPVTSGSRTLKDAMNEAMRDWVANVDTTYYIIGTVAGRTPYPMLVRDFQAIIGREARIQHLQKTGRLPDALVACVGGGSNAIGLFYDFLNDHEVAMYGVEANGLGIDTPNHAAPLQAGRVGVLHGNRTYLMADDDGQILGTHSISAGLDYPGVGPEHSFLKDIERVHYVGVTDDEALHAFKEVTSKEGIIPALESSHAVAYGLKLAATMKPEQSMIINMSGRGDKDLHTVMAKDGMQID

SEQ ID NO: 2741 - protein, 213 aa, M.catarrhalis
SIKQDILALPLKMPKLRAEELLKALGLWDKKDTTARMLSGGMKRRLMIARALMHRPKLLILDEPTAGVDIELRRSMWEFIECINQEEKTTIILTTHYLEEAEQLCKYIAILDKGEIRINTDMKSLLASLDVESFILDFSRPFESPIVLEQVLHYQKIDAQSLEVTLKKGESLNDVFAQLSNQGVQIASMRNKSNRLEELFMNLVEEDISNQLG

SEQ ID NO: 2742 - protein, 213 aa, M.catarrhalis
GDMKQVKFCGLTRPQDVSAAVCAGADAIGLVFYPPSPRAVDVLQAKQLVANIPAFVSVVALVVNIDDDMLIKIAQAVSFDIIQFHGDETADECQRQAALVNKRWIKAVRVDALRYDTKGIQKIIDDYHAKGAASILLDAYHADKFGGTGERFDWSIIPKQSSLPIILAGGLTPNNVALTRQLPIYAVDVSGGIELAKGIKDFDKMKAFIEAVR

SEQ ID NO: 2743 - protein, 285 aa, M.catarrhalis
FDENMMKTRIEMTFETLRQAGKKALIPYIMAGDPCPDVTVDLMHKLVEHGADIIEVGLPFSDPMADGPIIAHAAERALAAGVSTRDALNMIAKFRQTNQTTPVLVMGYLNPVEIIGYDNFANLCADAGVDAILMVDLPPNQADGYAKSLTERTDHPMNQIFLLAPTTKSDRRAKVIENCSGFIYYVSLKGVTGSGALDVAAVREQVAKIKQQTPIPVCVGFGIRDGDSAKALGAVADGIIVGSELVKHFADCGHDEQKIQQAKAGLLNKMDELRKSLDELTSSTN

SEQ ID NO: 2744 - protein, 62 aa, M.catarrhalis
RRRWLCTMTCTAVRHPQSDCSRLKRDDDNEKSCYVFCCCIVSSVNNGNPSTRSCRTCRNSDC

SEQ ID NO: 2745 - protein, 100 aa, M.catarrhalis
SAIMTKSPDYAQPNIPALQLKGLSKTYHNGFTALKGIDLTVPQGSFFALLGPNGAGKSTTISIISSLFPPSAGTVEIFGIDLVKNPAKAKQFLGIGSPRI

SEQ ID NO: 2746 - protein, 281 aa, M.catarrhalis
TMSIHGVLGETTSYPKNYDASILFAISRSLGRDEVLKQTGIQADQLTDGVDVWQAFELSWLNLQGICKVAIARIRIPANSPNIVESKSLKLYLNSLNFTKFGDMAEVQALIQKDLSACVGIKVSVEIVPLGGSGFEVQEPLGVCIDEVLDTEGEVIACDDINSAILSQPPVHQMMTYQFHTNLLRSNCPVTSQPDWGTLSVSITTNKALDYQKILRYVLTFRQHNGFHEQCVERIFADFLVNFEPSALMVQANYTRRGGIDINPVRVLNHALPAVTRQVRQ

SEQ ID NO: 2747 - protein, 260 aa, M.catarrhalis
EYAMDFSKQSVAFFTILKKEIKRILRIWLQTLLPPVITMTLYFVVFGQMIGSRIGEMGGVSYMQFIVPGLIMMAVITNSYSNVLSSFFSMKFQGSIEELLVSPLSKHTILLGYVGGGVFRGIVIALLVTIVAQFFTQLTVVNLGVMLMTILGTSVLFSIGGLINAIFARSFEDISIIPSFVLTPLTYLGGVFYSLDNLSSFWQNLSLLNPIVYMVNAFRFGILGHSDVNVWWSLIAILVFCILLYGWAYRLLVNGSRLRL

SEQ ID NO: 2748 - protein, 186 aa, M.catarrhalis
NEMMTMKKAVMFSVAALLAVSTMATQAQEAVAPAETQTADATEVTTAEAPAQVAAPVEEAPKESPQVQKLVAMYPNLIARIAPYGKVCFDGEECDINITVLAPAVEGQARDGESLYKAICSTCHDAGLIGAPKIGTSDWASRIGKGTATLYNHAINGFNAMPARGGADISDEEVQNAVDYIIQQSS

SEQ ID NO: 2749 - protein, 66 aa, M.catarrhalis
KFLVLIWSKTLQRRSNFWVLVPQEFNFMQFETAQDILINQAGYFGITAKDAQAKSRRVAQSIGFMG

SEQ ID NO: 2750 - protein, 692 aa, M.catarrhalis
SKRSSQHTKRDITMSTVKTPHIFYQKRTLSLAIASIFAALVMTGCRSDDISVNAPNVTQLPQGTVSPTPNTGHDNANNTNNQGNNTDNSTSTTDPNGDNNQLTQAQKTAAAAGFFVMGKIRDTSEKNDPDYSDDLKQQWLGKLYVGIDAHRPDGIGKGKNLRQPITANDIKPLYFNKFPALSDLHLDSERHRFDPKKLNTIKVYGYGNLTTPSKNNTYINHQQADNKKNNKPVDPYENIRFGYLELQGSSLTQKNADTPNDKDRIPKPMPILFYHGENASSQLPSAGKFNYTGNWLYLSDVKKRPALSASDDRVGVYLNASGKSNEGDVVSAAHIYLNGFQYKHTPATYQVDFDTNSLTGKLSYYDNPNQKNAQGKYIKSQFDTTKKVNETDVYQIDAKINGNRFVGTAKSLINENTPTAPFIKQLFSGAANPNNPNPNSDTLEGGFYGESGDELAGKFLSNDNATFVVFGGKRDKTDKPVATKTVYFSAGFEKPNTSFVDNETIGRIINSQGLNDKINEQIEEGTVPVSNNEEYYEYAWGRPKAEFTKKVSSSTQAVPAYFGQHDKFYFNGNYYDLSASSVNKLAPADAVKANQSIKEKYPDAKLIKDKVTTIVLQEASGDKPYTAIHAKSYDHISFGEVLYNDNLGNPTRSYFVQGGRADTSTTLPQAGKFTYNGLWAGYLTHKKDKGYI

SEQ ID NO: 2751 - protein, 159 aa, M.catarrhalis
APTAQIGRPGWAIRLVRPFCYEVAYPETTRKYALGSNFLLTVSNDAWFGTTAGPLQHLQMVQMRSLETGRWFVRATNNGVTALIDHQGRIIKQIPQFQRDILRGDVPSYVGRTPYMVWGHYPMLGFSLVLIFLSIMAKKMKNTTAKREKFYTADGVVDR

SEQ ID NO: 2752 - protein, 606 aa, M.catarrhalis
VYHYQGKVMLNSSNRYQERIGLARQILADEGVDALIIPSADPHMSEYLPKYWQGRAWVSGFTGSVGTLVVTQTFAGLWTDSRYWVQAPIQLAGTGIEFQKMQIGQPTFTQYLADTLPAGSKVAIDGNVLSVNEHDNLKTAFLDKDIQLVTDLDLLSKIWTDRPQLPDAAIYEHPAEFVDTTVAEKLAQVRAQIQQKQADVHLISSLDDIAWLLNLRGSDVEFNPVFLSHLLLDDTKATLFVDINKLDDKIRTSLESMGVQVAEYQAIGDAIAQVSGKLLIDPSRIAIGTLKQLSSSVELIRAMNPSTIIKAIKSEADIEHIREAMRQDGAALCEFFAEFEAKTSLGERITELDIDRMLIEARSKQKHYVSPSFDTIAGFQANGAIVHYSASEDNYSVIEGDGLLLIDSGAQYYNGTTDITRMASVGQVSDDEKRDVTYVLKAHIGLAQAQFPEGLASSQVDALARIHLWRQGLDYNHGTGHGVGYFMNVHEGPQVISVFAPTTPERVLKRGMVTTNEPGLYREGQWGIRLENCAVCVEADRSEFGTFLKFDDLTLCPFDTRLILPSLLTEDEKSWLNHYHQRVHDELIDRVSGAAKDWLIERTKAI

SEQ ID NO: 2753 - protein, 718 aa, M.catarrhalis
LMTKSTQKTTKQTQHSHDDQVKELAQEVAEYDDVEIVAEVDIDNQAVSDVLIIRDTDTKADQADHTDDASKADDETVVDGVKQKAQEAKEDFENKAQDLQDKATEKLEVAKEATQDKVEKTQSLVEDIKDKAQSLQEDAADTVEALKQAASDKVETTKAEAQSLKDDATQTFESAKQAVEGKVEAIKEQVLDQVDSLKDDTDQDNTDQDQEKQTLKDKAVQAATAAKRKVEDVVDDVKHTTESFKNTASGKIDEIKQAAVDKTEEVKSQLSQKADALKSSGEELKQTAQTAANDAITEAQAAVVSGSVAAADSAQSTAQSAKDKLNQLFEQGKSALDEKVQELGEKFGATEKINAVSENVDLATQVIKEEAQALQTNAQESLQAAKAAGEEYDATHEDKGLTTKLGKVGAYLSGMYGISQNKNKHYQGVDLHRESFDKDAFHAQSSFFAGQIFGAKAVAAKNVAAKVVPQSKFEAIGESLYNKVAEWSNAWAIKDLKNDPRFDLINTMNTQERHAFAEDVANQNRALATLGGVAGLAGLKGVLADAAWLLMVSLRTVYQVAAIYDQPLTGKEGTKKAYGVLSGANLEKLQEKQVILTALALGSSMLANAQQTGIKAQLDSLSARYRESQPYAKQFLDLDKFVNLDNLNPNWLHKILPISAVAVGAHYNNELIDEVIGTAMATFSDDFEQSNQLISNSSENTENQEAENTENQESTAEA

SEQ ID NO: 2754 - protein, 198 aa, M.catarrhalis
KGQRLYLMMQRAIKRKGHEDYLLTEDCIFGDVDDDLTASADPQDDDTDADDDGADNVYQKGEIRPEFANKHLPINEPTYEKTFALDGKNTAKFNVNFDTNSLTGNLNDNNGHIVFDIKDGKIDGTGFTAKADVSDYRHEIGNNSSGGFLYNIKDIDVKGQFFGTNGEELAGQLHHDKGDGINDTAEKAGAVFGAVKDK

SEQ ID NO: 2755 - protein, 61 aa, M.catarrhalis
VLGGDVWQVSGRLMSNTTKAHPTPNLAHALTPKVAQFSGLPHHQRYKIFLVWRWYFSFSLP

SEQ ID NO: 2756 - protein, 67 aa, M.catarrhalis
TKLGRLPMAHDASNNNPLKESLTALIGTVLLLVMIAGIAISAWLRPAGEHPAQAEPAEAEVATLQSN

SEQ ID NO: 2757 - protein, 1003 aa, M.catarrhalis
DFFMSKSITKTQTPSVHTMTTHRLNLAIKAALFGVAVLPLSVWAQENTQTDANSDAKDTKTPVVYLDAITVTAAPSAPVSRFDTDVTGLGKTVKTADTLAKEQVQGIRDLVRYETGVSVVEQGRGGSSGFAIHGVDKNRVGITVDGIAQIQSYKDESTKRAGAGSGAMNEIEIENIAAVAINKGGNALEAGSGALGGSVAFHTKDVSDVLKSGKNLGAQSKTTYNSKNDHFSQTLAAAGKTERVEAMVQYTYRKGKENKAHSDLNGINQSLYRLGAWQQKYDLRKPNELFAGTSYITESCLASDDPKSCVQYPYVYTKARPDGIGNRNFSELSDAEKAQYLASTHPHEVVSAKDYTGIYRLLPDPMDYRSDSYLARLNIKITPNLVSKLLLEDTKQTYNIRDMRHCSYHGARLGNDGKPANGGSIVLCDDYQEYLNANDASQALFRPGANDAPIPKLAYARSSVFNQEHGKTRYGLSFEFKPDTPWFKQAKLNLHQQNIQIINHDIKKSCSQYPKVDLNCGISEIGHYEYQNNYRYKEGRASLTGKLDFNFDLLGQHDLTVLAGADKVKSQFRANNPRRTIIDTTQGDAIIDESTLTAQEQAKFKQSGAAWIVKNRLGRLEEKDACGNANECERAPIHGSNQYVGINNLYTPNDYVDLSFGGRLDKQRIHSTDSNIISKTYTNKSYNFGAAVHLTPDFSLLYKTAKGFRTPSFYELYNYNSTAAQHKNDPDVSFPKRAVDVKPETSNTNEYGFRYQHPWGDVEMSMFKSRYKDMLDKAIPNLTKAQQEYCKAHLDSNECVGNPPTPKTSDEVFANLYNATIKGVSVKGKLDLHAMTSKLPDGLEMTLGYGHTKLGKFDYIAPKDADGWYQARPAFWDAITPARYVVGLNYDHPSQVWGIGTTLTHSKQKDENELSALRIRNGKRETQTLTHTIPKAYTLLDMTGYYSPTESITARLGINNVLNTRYTTWEAARQLPSEAASSTQSTRYIAPGRSYFASLEMKF

SEQ ID NO: 2758 - protein, 413 aa, M.catarrhalis
DEIMKRVVITGAGIVSCLGNDLDTVKEALENGRSGIRFKQEYADLGFKSCVAGSIDHDDLDTTGIDRKLKRFMSNASLYAYISALSAIKNAGLSIDTIADNPRVSVVAASGGASTADVVAAADAMREKGLRGVGAMAVPKIMASSVSAALATGLKIKGLSYSLSSACATSSHCVGHAMELIQLGKADIVLAGGGESEHWTQSCMFDAMGAMSTQYSDTPQSASRPYDKDRDGFVIAGGGGMVVVESLESAQSRGATILAEITGYGATSDGAEMVAPSGEGAVRCMQIALAQAGLASVDYINSHGTSTPLGDITELNAIATVFGGAKQTPPISSTKSMTGHSLGAVGTQELIYCLLMMNHEFIAPTINIQNLDDAAKDFDIVTQTRQTALNSIMSNSFGFGGTNAALVIQKFNN

SEQ ID NO: 2759 - protein, 163 aa, M.catarrhalis
FSPIIYCPKWGFALLVESTNQDRCLIDDEFLTTTGENCPMATTNQLIRKGRTTIKEKSKVPALQACPQRRGVCTRVYTTTPKKPNSAMRKVCRVRLTSGYEVSSYIGGEGHNLQEHSVVLIRGGRVKDLPGVRYHTVRGALDCAGVKDRKQGRSKYGAKRPKA

SEQ ID NO: 2760 - protein, 544 aa, M.catarrhalis
SFNMTCLPKTNPALKVKHRFLKQVLLLLCVDTLTAQAYAHSHHTPIHTPTHELPSADALSDEGLGKDLGSLDSLDSPDGLGDGLGDGLGDGLKSDKAPLPINALTAHQTNESQPAPPSVDVNFLLAQPEAFYHVFHQAIVQDDVATLRLLLPFYDRLPDDYQDDVLLLFAQSKLALSDGNTKLALNLLTDLSNKEPTLTAVKLQLASLLLTNKHDKHAQMVLDELKDDAHFLKLSKKEQRWVLSQSRYLHKKYKMGLDLGINYLHLDNINAASTITQPNIKKDAPKPAHGLALSLGVNKYTPLSHGMSIYTALDVDGKFYDDKSHNELAVFAHAGLRKDHQKGYVDVVPFVGRIFATNQQHGRLSPRKDSQGVAFGSHHRINDKWQNAFFARMEKGNYTERYQGYDGKRYHVNDTILLQDGPNRRYSLGVGYQLSHLQDATKSSHATKIHFGVLQRLPNGLTVQGRVSAERERYHGKLLRLVNPDDVYRTDKTLTLQTSIWHKDIHWLGLTPKLTYRYSKNNSNLPALYSHNKQNFYLELGRSF

SEQ ID NO: 2761 - protein, 485 aa, M.catarrhalis
TKTIRPLPFFFFVFCFKICIFICHLIMLKHHFATTYTPSQITALITTHHPDWQVCFLNNAHRPVIGICPKVAWTATFDKNLYIHKKTRQADGVQSLNGRRYPSTYDNWQHELTAYANQMNLDDYHGLNHSSYVHGFMGFISYDLSAHQLNHRITLKPNQPCGYLAHYDIYLQPIKDGYNLIGMGVCSEFFQHITHQLSDLLCRCLPTASPIDFQPIWTKTEYAKAFYQTQEYLKAGDTYQINLTQKWYAHLDRLANHLPDLQDTMNAPFAGFLQLGEFELLSISPELFFEFYKTNGKIHLITKPIKGTRPRHADPIIDDELKQSLANSEKDISENLMIVDLLRNDLGKYAQIGTVKTPKRFAIESFKNVHHMVSTVTATLSDTHPITVLFGSLPAGSITGAPKKRACEIIHELETSPRGAYCGTMGYMNFDGTGSWNVLIRTLQKWQECEIWAGGGITIKSNVDDEYQECQDKIGTILAKMSKPK

SEQ ID NO: 2762 - protein, 229 aa, M.catarrhalis
GAFLSSAVCNSKIKVVTMSEENQTTVLSDDTQNQITQEQYNKLQAEVERLRKHSETLLAEKKQQSEQRKAEQAEKERLAEETARKKGDFETLEKQYQAKIQELNEQIAKRDKERDENLVKSHAQKLSSQLSDNPANQEILQILIEKRLFAKDGQLSVLDDSGAVSIMTLDDLAKQMQNCGKYDSLIIGTKSCGTGSNGQSAKRAGDYSEQERLALAHSNPALFNQLFLE

SEQ ID NO: 2763 - protein, 105 aa, M.catarrhalis
MVNPILLNCLLPKPRLGSFANKQAKKLNNGGRSNLAMISHNLPNQKQDTLQNKFIDMALTPSEIYSLRQDLKDAYKQGKGFFKERARRLQSTYTSQDKILAPKQS

SEQ ID NO: 2764 - protein, 126 aa, M.catarrhalis
GELYNSAKGLLMGIKWNKKLSIEPIADKIDATYRKFAIDCYNNVIALSPVRKGRYKNAHHISIGSPSYAETGGGIELILGIPKHTYPLIYIQNNLPYALRLEHGWSQQAPTGVYGNAFNSALGNLS

SEQ ID NO: 2765 - protein, 75 aa, M.catarrhalis
SPTYKEKFMSLPKDKVKPAFNFTYPSERAYFDESKSTLTNAQVTDPAKSGADYGIKDPQVTEALTGTKSETAKVE

SEQ ID NO: 2766 - protein, 169 aa, M.catarrhalis
SLHLLYKPYLLHLLPPKRYKHHRSTVKNTMICVGGKCLTMKFLTMTAILSLMQVCPNAMWTALMVMCRGYPNFAFEEQYKNDNLTFGQAVELLKGGKKVARKGWNGKGMYLLLATDIDFKTKANLSDMQNENGELTVPSITMKTADNKFAVGWLASQTDMLAEDWVVVQ

SEQ ID NO: 2767 - protein, 189 aa, M.catarrhalis
FCIKITPKLLKVMIMYVLCLFHAEDKLGRNKIPMAYALALSEMLGVDMIWGIVQAKRAYRTSSDGVGRLLKRVSFDGVVLSGHHYMIVDDVITQGGTLADLRGFIESKGGKVILASTLNGKPNSAKLPITKATLGQLRKQAGKEIEQWWQEQFGYDFSQFTESEARYLAKQIHRYGIDAIRDILFASRP

SEQ ID NO: 2768 - protein, 97 aa, M.catarrhalis
GKNNMAFDLTLLKKDAKMSAKREIEFDGLELTLEIQASEAFKRAAAEVQKIANTPKKVTKDSLKRGNQDEIGEYEAMLFILGEYCISLHHGAGRIDG

SEQ ID NO: 2769 - protein, 333 aa, M.catarrhalis
SIIFGVIMAKLREIFNKNVTLSYQVKDNLQRSKFWQSGAFVSDARLRPLLNSGSLTFDVPFIHPIDGNLEANYSNTIMTDIAMPRSIEGSKSKGRLALLNEGFIESRLESYLLGQSPLKLMAQMIDDYWLTQAENRAIATLFGLLNYDQSNGKKLSTDISKATADDSSGFDVHAFIDAEGTMDEMYQGKGLMVVHPLIATKMRKQRLLERVTTADDLKPIETYNGRTVIQSKRATVIGTGKNAKYVSYLLGAGAFAADMVAGHDDLELERTANTGNGSGHTTLWTRRNILIHPQGFSFIGEPSTLTGGTKNEALSASWTDLTTAANWRLDADA

SEQ ID NO: 2770 - protein, 140 aa, M.catarrhalis
HLLSRIYNSLWECLACLWLGCEMGLNAEISTEITQAFDTDLKDAVKDFTGRRVILSDDDWAVNDTQVLSTINYSGRGVFTGFYAHEIDNKTIMQSDVKLICLQDELTEIPQIDDEINEMKIISISHDPAEVSFTIQLRGF

SEQ ID NO: 2771 - protein, 137 aa, M.catarrhalis
NYTSNTGAMMDTAHIEQTLLTHIKSWEHFDDVPLAKENRNFKPPDGIWGRVTILGGVNQVRSISNTPNILQQGTLVIQLFCPQDLGTVAIKQKADSLANHLQTRRFGRLELLAHSIINVPSNDGIYQINVSVPDRYY

SEQ ID NO: 2772 - protein, 81 aa, M.catarrhalis
EDFMKLITASALQALLTSFVATETVQAPPLNRQEYNDLRGWQVPDNEIPNDDGYLVVNAGVSERNVDGFDGYVSWLPKLCV

SEQ ID NO: 2773 - protein, 122 aa, M.catarrhalis
DETMITLDDLTDIDKADEQTVVIVNAWLNKHKLIPFKTIPEPIKQAGRYIAKAWLDGDLFATRTEGQVISKSSKAGDVSVSKTYADGQMGQAMSQNEQIALALIEPYLQQPLGMFGLPLVRV

SEQ ID NO: 2774 - protein, 308 aa, M.catarrhalis
GLGVEIMSSGAFVKTAYAKQTGETLPKTGWKTLPNISNGLTVATELTNSEMLSGSRMAKAGMVTSASVQGDIETELMFGAYDELIAAAFWSEWSAGASPNTLSVGATKHQFAIAKDFSDINVNHVFTGCVVSSFGLTIDTSSLIKLKFGMTGLGYQESKTTSFAKTPTAQADTAKASGLSIGEIKVNGTKLDVCVESFSFELDNQTEVQKCLGDNIYGGNILAMLTNITGSMTIAYSQKAHEMISNQMTGATLSLELPIKFGNSKYVIKIPKFQVSGEIPSPSGTDLVTVDLSYTVVDESPVIEKHTA

SEQ ID NO: 2775 - protein, 148 aa, M.catarrhalis
ILAPIRMNGMMNAATFTPYQPTEGEDYMSDAQLAHFRTILKNWREELITEAERTKTYIHEETNTMPDINDRATQEEEFALALRTRDRERKLIRKIDKSLADIETLDYGYCETCGTEIGLRRLEARPTATQCIDCKTLSEIKERQNHGQ

SEQ ID NO: 2776 - protein, 130 aa, M.catarrhalis
YAHTYSHTGCIALTTHTKIRGIGRVYYFPTTLKQTFGEVDCQNPRAMGGVFPLTTTKKPQRPGRAGGDVLKNHRREGAGKPLKHPKSFWGLGPPSRLCKKFTHTIYALRANFSNRSLGFIFEINKVVFFP

SEQ ID NO: 2777 - protein, 256 aa, M.catarrhalis
PCMTKIKSVNNEPNMADDTATNQLQLTTFHLKLITLIAMLIDHIGWVFVATYSMTAEIMHTVGRLVAPMMAYFLVMGLCHTQNQWAYLGRLLAFAVLSQPIFMAFQYVIGSVDIITQVLWGNVLFSLAASLAALMIWQMSVPMTLRVLGVLAMAMIAEIGEYGAAMVMWVMVFEIFKHDKLLQLTAYALSVPLAHYLIYGWALTVGLGWMNVGMFFALPLIYYHTGQQGHRLGGRYFFYLFYPIHLLMLVCLAQTV

SEQ ID NO: 2778 - protein, 203 aa, M.catarrhalis
LLYATFMRNSAPQDAQNVLADAQSLQAIDTDEISTRLAKLAQTPDQFRKINTFMKRRSHMSHYHEHSLLDAHYRALYVNSTDELGKLDDISTIKDLRVLLTDTLYGNDASLALETEFGMGNSLFEMANSAPETNSVGVEVHEPFFVRSVAWADDSTHHVLFIMEGDAVAILVIYPPTQRTACGWIFLILGKKNNFIYLKYKTQ

SEQ ID NO: 2779 - protein, 100 aa, M.catarrhalis
DKPALCLSNFMFIKKFVKIKILLDTLNGILQNGPTNQPTNQPTNQPTNQPTNQPTNQPTNQPTNQPTNQPTNQPTNQPTNQPTNQPTNSLTTVHHYRLFW

SEQ ID NO: 2780 - protein, 621 aa, M.catarrhalis
IDIHIMTTTHPQAESPTQKRQRLKQHANALPNRPGIYKMLGKSGEILYVGKAKSLKNRVGSYFAKTIEHPKTQALVQRIEQIEIIITRGETEALLLEQNLIKNHRPPYNVLLRDDKSYLYIYISTDKFPRLSIGRGKGRYTQGRFFGPYPSARNAKESVQLMQRLFMIRSCTNSFFAQRQRPCLEYQIKRCKAPCVGMVSAEQYQSDVRAALAFLQGHSHEVQAILVKKMEEAAAALNFEQAAFYRDRLAMISDLQAKQAVFRLQGEADVFAIAADAGAVAVCVLTVRGGQVLGVKNYFPDDIEPAIKSNQERLKEFLLSFYFQVSDDLPDEIISSVAIEEASILADILQVQFGKRTTIKHKVTTHRDDWLSIANLNANNALSAKLKDSRELQARFEQLKQVLAPITTCTIDRIECFDISHTMGEAAIGSCVVFDQNGPKKRDYRQYAIHDITAGDDYAAMRQVLMRRYTKHPLPDLLLIDGGKGQLNVAIEVLSELGKLTDTLLVGVAKGEGRKAGLEVLHFVTHEPIDLPADSKALHLIMQIRDEAHRFAITAHRKKRDKKRSSSVLEVIPGLGQVRRRDLLNHFGGIQQLLGASQDEIAQVKGIGPMLAGTIYKALHE

SEQ ID NO: 2781 - protein, 333 aa, M.catarrhalis
KHAQRRHNASTVRHCLKLKKDKITVNSPLIPRPIGRFAPSPTHHLHLGSLTTAVASFCHIKSLGGDWLLRIEDVDFERCQPKYTDSILHDLDKLGLHWDKEVTYQSKRTDIYDEILSNRLSDITYACQCSRKQLEAHRNQNAKPHALNQPTLYPRFCLHKDLDKSHPKSKIRLQLPNVETAFVDELQGVIWDNPALSLGDVVVKRQNQMINYILACAIDDGLQNITHIMRGLDIMPMTVAQINILHKCRLPIPSYFYHLPLLMNTDGQKLSKQNLATPINTTKPSEMLLYALKLLGQHTVKEMRAAKPHKILRHAIEHWDNTPLTHRHTLAII

SEQ ID NO: 2782 - protein, 769 aa, M.catarrhalis
KIYNLPTMTTSPQQTPKLVAQVALAVPVADFFDYLCPSHLPLPKIGARVLVYFGARRLIGVVIELIDASDSLIAPHKLRPIKQLIDDDAIIDDELLKLASWLSSYYHHPLGDVYCVMLPTLINQGKPIYAKQRYYKAICDDTAIDQLPKTAKKQRQILTHLMAYPAGLGTDKLRQIGATRSALDGLINKGLVITDEHIPPNKQPPPVQLKEPKLDANDEQQIALDAIKTASDLGQYQGFLLDGVTGSGKTEVYLQAMHHVLDQGKQVLILVPEIGLTPQTKGRFASRFHANICVLHSKMNDTERLQGWQACRLGHAQIIIGTRSGILYPFANLGMIIIDEAHDASYKQQDHLRYHACDVAMMRALFAKIPIILGTATPSLEQLKLIQDGKLTPLTLKNRAGGAQAVRMHLVDMRLGRSHAQHLDGTISDTAFVPKTIQAMRHCLAKGEQVLVFLNRRGYAPILICRSCGHQANCPNCDAHLTVHKKSVQPMHGELRCHHCGYRASIPTTCPECHSPNMDSFGAGTTRLVEQLHALFANPQVSHTTYPIYQIDKDTMQKKDAWTQMTKNINTNRPAILVGTQMIAKGHHFENVTLVVIANADLGFLSADFRSPEHTAQRIIQVAGRAGRAKKPGKVLIQTLQPDNTLLTQLVRQGYHAFAHELLHERSQLGLPPFSHAVLIRAESLHHQQAKDAIIAAKGLIPANHPFAINAPIDAPMTKKNNRYQVQMLILAKTRPPLHEFLQTWWPSVQSLPSSKAVRMSIDIDPMGW

SEQ ID NO: 2783 - protein, 739 aa, M.catarrhalis
PLIKVNLYEPSMPDSQDLTTPTNLSHPLVDEARDSLMRAVAYLKPDERADVLRACHFGDVAHIKDKRKSGEPYITHPIAVAEILAGFRLDRDTIVAAILHDTIEDTEVTDEMVTQEFGQMVAQLVDGVTKLKSSGMSKQQSQAATFHKILTATLSDPRVLIIKLSDRLHNMSTLDAVSEEKQKRTAKETLDFYIPFARLMGLNSIADYIELLCYRNLNPDMYNKFTDKLLQHGLGRNFQKTEISTYLQSLLSHLNLDGHVQVLDNRTAMYRQFFKNRGQISQLIRQYDFEVILKDIEACDTLATYLIQKYQIGNHQIHDNIRKPLAGGNQSLTLFYDRDYNHIKITLMTRRMQEAARLGIISNDRAGVSQSVIQASLRNMQDLANAGKAEGDDAHVVIIEELISYLHERKIVCYSPKGRAYELPRGSTALDFAYAVGPAIGNIATGADINHKHGKLGLVLADGDIVSIDTDKNATPRAEWLGFVATNKARNEILKFLKHLPEDQKIHYGKQALDRALSTYGKSITDLTDDDWTDILKWRGISTPDELFMQLSTGMLLPQLVVSRLFSEEIDTADDHEITRSKHLLAGIKGVEVDFARCCNPIYGDTIVGHLSRQGLVVHRHKCYSLQAIRTDTPYQIIHLDWKSDQSLQNQPDALRFPAMLRIYASLNEEQISQVIYEMRVLNIGVEQTHIKTDTKSDQSSKVGTTTLHIVVRSRSHLAEGIEKLRTLLGYPNIMRLYQ

SEQ ID NO: 2784 - protein, 84 aa, M.catarrhalis
RIKNLCQLQTCLWIGGWDFGISKGVFGHDVWLFKCQVVIKCDIVPNLYINGEWIINDACCLNGKNWLDRKVIICILKNYHCLAI

SEQ ID NO: 2785 - protein, 60 aa, M.catarrhalis
NKYLSRVINQNPYIKTYTKSMGFFVKQLCLFFQPLSEMVIRYERSLYKSCPHSPQRWCNQ

SEQ ID NO: 2786 - protein, 215 aa, M.catarrhalis
QTMDILTNFPTQLLIYSLDMIGISACAIAATTLAMYKRFDLFGCILVSMVNAIGGGSLRDIILDRHPLFWMTDLTYVILITTTSIICQLFFHRLGHIDRALKFFDAIGLAVFSVIGLTVALSFDAHPLIAVMMAVMTSIAGGIMRDMICNEIPLVLQKEIYISASIIGSALYLVLEIWGFADWIKQGLALVSIFGIRMLALKFDWHLPSIELKKS

SEQ ID NO: 2787 - protein, 63 aa, M.catarrhalis
MEFCKMDQPTNQPTNQPTNQPTNQPTNQPTNQPTNQPTNQPTNQPTNQPTNQPTNQPTNQPTA

SEQ ID NO: 2788 - protein, 566 aa, M.catarrhalis
GFNWAGESTVYQALQAPTNNTLIPCPAESVDFDTTQNIFIESDNLEALKILQKSYAGKIKMIYIDPPYNTGNDFIYHDDFSQSKKEYEIATGDRNINGELLKSFKKNSKDNGHYHSNWLNMMLPRLHLAHTLLSDDGVIFISIDDNEQAQLKLLCDEIFGGENFVATLPRQTSAQRPSQEKYISITHDYLLVYAKNKNYDFNSVIERDLSNIKKDSNGTYIEGDTSPILASSTQGYSAGGDYDIEFNGKIFKPEDSRGNRRRWLWTKERMNRAIELGIIIETRTTLRVRNYIDKEFQVGTNILVDKNPNLILTSNDLINPNYTNHKGTACLRDLLLENYFDFSKPLDLIKILAKLLNGDNSIILDFFAGSATTAHAVMQLNTEDNGNRQFIMVQLPELTDEKSEAYKAGFKTISEISKERIRRAGAKIKAENPDKTLDTGFKVFKLSDSNFKAWQIDDDDIAKQLEMYIDPLKDNANEIDIIYELLLKMGLKLTADIKFDNGVYWLTCENKSYAIVLNSLSQDEFNAIIAKKPAKTVVLDKAFLNDSEKSNIILQFKDAGLNFESI

SEQ ID NO: 2789 - protein, 79 aa, M.catarrhalis
HSEWNFAKWTNQPTNQPTNQPTNQPTNQPTNQPTNQPTNQPTNQPTNQPTNQPTNQPTNQPTNQQPNDCPSLPTFLVNN

SEQ ID NO: 2790 - protein, 307 aa, M.catarrhalis
YHIRSSMSKTPQSAIIPDHCRAGIFMEGDFITNNTATIADACRQALHTLNELQAKFTGESLGLTIGFGAQAWQRFGYTKEGGQIKPFRPLGNGLAPATQHDVMFHIQSMRHDINFSLAKELVAIFKDIVQIQSETHGFRWVENRGLEGFVDGTENPQDDAVSGVAAIADGDDAGGSYVLLQKYRHDLNKWDKLPVCDQENSIGRSKVDNIEFDKAKRLSDSHLGRTNLKEDGKTLEVVRRSLPFGTVTGEHGLMYIAYAARLWNIEAQLLSMFGETDGKIDLLLKHVSTAVSGAYYYAPSVERLENL

SEQ ID NO: 2791 - protein, 460 aa, M.catarrhalis
SDMSVHSINHAPTAPKDGATNDYYLTRQNQMESNVRSYPRKLPLAIAKAQGCWVTDVEGNEYLDCLAGAGTLALGHNHPATINAIKDVLDSGLPLHTLDITTPIKDAFTEKLLSFFPKDFVLQFCGPTGADGTEAAIKLAKTYTGRDNVIAFSGGYHGMTHGALAMTGNLSAKQKVGNLMAGVQFLPYPHEYRCPLGLGGEAGVDALTYYFENFIEDVESGVVKPAAVILEAIQGEGGVVPAPKKWLQKVREVTARHDIVLILDEVQAGFARSGKMFAFEHAEIVPDVVVMSKAVGGGLPLAVLAINKKFDAWSPAGHTGTFRGNQLAMAAGYNVLTQISQNNLADNARIQGEFLRTELQKIASQYPCIGHVRGCGLMMGIEIVDERQEADHMGSYPADGELAAAIQKACFDNKLLLERGGRGGTVVRLLCPITITTDECEQVITRFKKAVGEAVKAVRG

SEQ ID NO: 2792 - protein, 186 aa, M.catarrhalis
LTRRKTMKTLKTLLAVSASSLLAMSANAAISYGNSADAQPYVGAKIGQVDAKQINGKNTAYGIYAGYNFDQNFGVEAEFVGSDAKEFNAGMSPVKGDVKSFGAYGTYRYNFINTPFYAKGKLGIAKTKVDVTSRNATTYSNKSDKTSLAGGVGVGFKPLANVGVEASYNYLSEDANAISLGTHLAF

SEQ ID NO: 2793 - protein, 62 aa, M.catarrhalis
GCLMCCKIDLNSQKDAAHFLGKVEPTLLPKTADNVAPSNTVYTGEAMSLFDKLVAYFRTKHI

SEQ ID NO: 2794 - protein, 323 aa, M.catarrhalis
SLFIAFNQRVAMFRLPFLEDTTPPPFYQSHLSDDERTRLDRWFIGHRSQAYYLRRFAEFDRVGRLHAKWHWAAFFMTFGWLLYRKRYLDCVVYCVAGWSFIKVNIVIILAVAEYALIGFLADGMQWPVRILIGLAVWVFWSGMVARWADAYYYRTARREIADALELYPRDEAAQKQHLRREGGVSLLGLSVAFAMFGLILSIIVGRFVPMYVKQAEQKLLFDVYSEANAVVKRVDVIMANTGQCPVNLPVTSTHHRADIQVVTQADGINTKCAVVATVLKASYPLSYLKGRTLTIYSTPTQHGLVWRCQTSLSKKQTPKRCIG

SEQ ID NO: 2795 - protein, 212 aa, M.catarrhalis
GHIMAGTLFIITAASGTGKTSLVKELLKCTKGLCVSISHTTRQPRPGEINGIHYHFIDTASFQSLIQASEFLEYAQVFDHYYGTSKQAVIDLLAQGIDVILEIDWQGALQVKAQFDQAVMIFILPPTRQALAERLSNRGQDSQEVIKKRLAGSLDEIRQYDQFDYVVINDRFEMALDDLQTIIKSHRLTLHAQQARHAALIAALFDDTPTYP

SEQ ID NO: 2796 - protein, 517 aa, M.catarrhalis
DIAMPTFEQHKQALLCNDPQSIADYERTMTHAVQAVKTWLQDDNMYTGGSISQLRSQIAFNPTKDGLGIDGALERAINLFLNNSLKVHHPHSLAHLHCPTMVTSQIAEILINATNQSMDSWDQSPAGSLMEVLLIDWLRQKVGYGAGQAGVFTSGGTQSNLMGVLLARDWCIAKHYTDEDGKPWSVQRDGIPPDAMQNVKVLCSQNAHFSVQKNMAMMGMGFASVVSIPVNDNAQMDTQALADIMADLHADGNIVACVVATAGTTDAGAIDDIKAIRALCDKFGAWLHVDAAWGGALLLSNDYRSMLDGIHLTDSVTLDFHKHYFQSISCGAFLLKDETNYRFMHYEAEYLNSAYDEEHGVPNLVSKSLQTTRRFDALKLWLTIEALGEELYGSMIDHGVNLTKQVADYIRHADGLELLVEPQFASVLFRVVPKGYPDEYLDSLNQNVADELFARGEANIGVTRVIDSRQDVQSLKMTTLSPIATLEDVKALLDQVLAEAHRIGDAIKDGTYTPPIG

SEQ ID NO: 2797 - protein, 270 aa, M.catarrhalis
AACIIDNPFAIYVEVWYNIAFYHHLTLKKPNIVTKDTLRNTKIPTTDPQAGLKLTEIFYSLQGEALTAGLPTIFIRLTGCPLRCHYCDTTYSFSGGERWGLDDIMTHIAQYPCWRVCVTGGEPLAQPNAIALMHKLVQSGYEVSLETAGALSVANVPPLVSKVMDLKSPSSGEADKNLWENLAHLTLHDQIKIVIANRTDYEWAKNIITKHALDDKVGTIWLSPMFNIQENTSHAPKLATDLAEWILKDALPVRFGLQLHKIIWADAKGK

SEQ ID NO: 2798 - protein, 228 aa, M.catarrhalis
GKSMQTLSMTGKKLIIFDLDGTLIDSAPDLAAAVNGMYAKLNLPPMPIDIIKSWVGNGSLKLVERAMQAHHIYDTTMIHHAHELFLAEYAHKTIENTQSYAGVIQGLERLKAAGFYLAICTNKPERYLPKILSHFGWLTLFDQVIGGDTLSVKKPDPTPLLYLCQSLGIAPTDAIMVGDSKNDILSGQAAGITTLAVRYGYNYGEKIDLANPDAAFDDFDTLMNHILQ

SEQ ID NO: 2799 - protein, 869 aa, M.catarrhalis
SGEIRMQLKYEHLDYQKQAIDSIVDLFQGEITHHQDDFSLSDKDNMRVIANELSLSKDDIFNNLKNIQTQNQLSLSDKLDNLYFSVEMETGTGKTFVYLNTIFELYQRYGWRKFIIVVPSVAIREGVLQTLNSTKAHFKDEFNSPIYHYGEYSGQKTNALKHFATSTNIEILVMNIQSFEKESNIINQQRENGVLMELIQATNPIIIIDEPQNISSDKRKNAIENLNPLFTVGYSATHKEIINKVYSLNPVQAFEKNLVKQIVVNSVISQDKNNAFIELKEITNKSGLKAKIIFDISEKQQLKRKAITVKLGDDLYEKSKQNPNYQGFIITGIDLENQMIKFSNGIEIARGVNMDCLRDEIMKQQIHYTIKEHLKHEKELNKDGIKVLSLFFIDKVENYRTNAQGELGKFYEWFEELYELETKQSASGVHKGYFSQDKKGNAKNSNGTTKDDNDAYELIMKDKERLLSLDEPVRFIFSHSALKEGWDNPNVFQICTLNETTSVIKKRQEIGRGLRLPVNQKGERIYDEKVNILTVIPNESYEQFANSLQQEYIDDCGIKFEKSHLKNAKNERTVTYRFDAFTDPLFLQIWERIRHKTSYRVQFDSDELIDNASQKIHVMPKIDIPKIEIKKARMVQNSETGIETQEIFSQSEHIQTKFVIPDILKVLQQKTGLTRNTLVQILQQSGRIDEVKSNPQRFIETVAEIINDELYDLMKNGIYYQKLDKVYEQSLFKTYKIYANQYTFNVNKMDKTIYNGVLDLDSNTENQFATDCENYDEQVAFYFKLPKKFKIPTPIGNYNPDWAVVIKKNGEQVYFIAETKNTGDKSIQDGVVVDKLKWEERFKIACAKRFFEINDEVDYQVVQKINELT

SEQ ID NO: 2800 - protein, 95 aa, M.catarrhalis
FKRISMARVTIEDCLENVDNRFELILVASKRARQLANGKVEPTVAVDNDKPTVLALREISAGHVSRAILDEPDEDLFPKSNQSYEITPEQLGNTL

SEQ ID NO: 2801 - protein, 151 aa, M.catarrhalis
AYLINLLPIFAPSTSNASILGFLNIMSKQIIHTDDAPAAVGTYSQAVKVGDTIYISGQLGLDPKTMTLKEGFKAQAEQAMDNLQAIAKAAGGSLSDVVKFNVSLTDLSDFATLNEVFDACLNAPYPARAAVQVAALPKGGVVEIEAILHLS

SEQ ID NO: 2802 - protein, 592 aa, M.catarrhalis
GSLMVRQDSQKTLTLSPRLTEPLNQALRDQLDSSTLARVLQARGVHDISQIDTHICQLLAAADLMGIDTAVTLIDTAIDQGERILIVGDFDCDGATSTALMVRVLRQMGALVDFLVPDRFKFGYGLTPQIVEHGAALYRPNLIITVDNGISSHDGVATAHQMGIKVVITDHHLTTKPSPPADAVVNPNQLGCHFGSRYLVGVGVAFYVMGRLAKHRRQLGKSSASVAKYLDLVALGTVADLGVLDKNNRILVTHGLQLIRQGRCVVGILAILEQAGRQHQTITSDDFGFAIAPRINAAGRMDNMRIGVECLLTDDWGEAHRLASKLNQLNQAPRHVEMSMKDDAIAIVQSLSEFDETPTKGIVLYQDDWHQGVIGIVAGRLKEKLYRPSIVFAPADTALVGKSDDIKGSARSIAGIHIRDVIESVALAHPDLIKHFGGHAMAAGLTIQKADFERFNQALQAVLLDFDDDVFYEQKFTDGALLPDEFSLSFVDRLKNISVWGNGFVPPVFDGKFEVINHRILKDKHLKLSLKMAGVQYPIDAIWFNYQADSWDYRAFGVHILYTLDINEWQGSQSLQLVIKDLAVMSVAALSV

SEQ ID NO: 2803 - protein, 325 aa, M.catarrhalis
NGRIFWEIPSNTMKILLANPRGFCAGVDRAIAIVNEALRRFNPPIYVRHEVVHNKFVVEDLARRGAVFVEELDEVPDGAIVIFSAHGVSKAVEDEAKRRDLTVFDATCPLVTKVHIEVGKFAKGGMDAILIGHAGHPEVEGTMGRFDTSFGGRIHLVEDVEDVAKLDFERDKSLAFVTQTTLSMDDTANVIDALKDRFPAINAPRKDDICYATQNRQDAVKLLSRHCEVVLVVGSPNSSNSNRLRELAERMGRRAYLIDNAGQMSQAWFEGVTYVGVTAGASAPEILIQEVLDTLQLWGADVPTELSGIEENVTFSLPKSLTKAV

SEQ ID NO: 2804 - protein, 289 aa, M.catarrhalis
TSPLPTPTTLPNRPTITSNHTFNIVQLSDLHLTGDIGQAPSYQRFLAVFQTAKHLNPDLWLLTGDLVNDGNSDAYDWLFNQLQATKIPYLAVAGNHDVTHEIGIHLAHQERIHVPILPDRRLKNCFRYTFQAGHDWQILLLNSSVSGEIFGLLTHETLLWLDQTLTTHFEQTIIALHHHPTKVSSDWIDAHLLKNHQDFWHVIKKHAHVHTILCGHVHQVHTLHPLPAHQVQLLSCPSTDRQFMPFVDNFQIADTPAGCRMIQIDNKGIVSSYIQIVQNTHSFCLNNAN

SEQ ID NO: 2805 - protein, 597 aa, M.catarrhalis
KNFTYFYKSMLANMNKSVTPTWTTALPDWQERIVKGESLIPCKPLFTTMSDIALRVFKELALVDVIGCPKIGAVSKAWVFDFVAIIFGAYDPAAKKRLIKEFFLLISKKNSKSTLAAGIMLTALILNERQSCELVIVAPTKEVANNSFSPMQDMIRVDSELSALFNVSAHTKTITHRFTGASLKVIAAESNSLAGVKGAYVLVDELWVFGKRAGAAAMLQEAIGGLASRPEGFVIYLSTMSDEAPAGIFKEKLDYARSVRDGQIDDLRFLPVIYEFPQAYIDSGDYVKPENWYITNPNLGASVDMDYLTDTLKRAKESHDKNTLQTALAKHLNVEIGISLRANRWAGAEFWEQAGRAFSLDELIEASEVITMGGDGGGLDDLLGCAVVGRLPTPKYIYTDDNNVRHEVKQWWVWARAWCHPIALERRKQDEPRYRDFETDGDLVIVENVGDDVAEFADIAKKVYDSGKLDKIGLDPAGADDIVIALESIGIPKDTHMTGVSQGWKLGGYQKVCERKIASGDLTHANQPLMAWCVGNARVKLSGSGVSMSKSESGNGKIDPVIAMLNAVALMSQNPAVPRSDDDIGSSPRGWKEPRMC

SEQ ID NO: 2806 - protein, 101 aa, M.catarrhalis
SLTTSSTRRSVALMTKQTYKSYATNATKPKPKAKARRGACYNFWAKRADTTPPLVYKKNLIWEKNLRFSANGRSNKSYIKLHYKEYRKVKHGNHSEAGSVC

SEQ ID NO: 2807 - protein, 215 aa, M.catarrhalis
FFIYRLSQIFIFKKSFSKIKINPAHPAHPAHFLKSLLKPIGYKCQICAGFCSGFKNLTKPCTAFHNIPKPHQGQTMKHHIPKAQLVAIAESFAGVSRFADACYRYYYYHDQASRDYLLSSLAVEFAEYLTKIPTKHHQPIINTALIEISYPQKNLSRSTFCAKERACCMGISRRQYYNLHAGEAIDNIIGNITGIAKVVAGKVREQLGINLKLGY

SEQ ID NO: 2808 - protein, 128 aa, M.catarrhalis
MMSDDLINHPAHYTSCPSGIECIDIAELLPFCLGNCYKYLHRAGLKGDELTDLKKAVFYARRAYLNDEKLTETAQSLIFKVARHQADEKRKILSCFAAAHIKKFYLFLQEHVSKYEQKRNTNMDNRST

SEQ ID NO: 2809 - protein, 107 aa, M.catarrhalis
QITETMAKLGNLPPRLKPTQSHTPKKKWGQARGGRWWRRLRAEFLARNNYTCQLCGRVGGRLELDHIVNKAVGGTDDKTNLQILCYQCHKTKTQSESKAGGVLQFLG

SEQ ID NO: 2810 - protein, 150 aa, M.catarrhalis
NAWRWGRAMSDKRPPLNFDYIQTQATGHYVSRIFPAVGIKLHGNGKKHQPCPLCGGTDRFRCDDKDGTGSWICNQCGAGTGYTLVRDYTKKDAYETHALMADILGIDGGRQINRSGQTSMGKSPSRTLIRPKTSQKTSTANRCQNRPKPL

SEQ ID NO: 2811 - protein, 185 aa, M.catarrhalis
NYIIKNIERLNMAITQKQEAYAKNVASGMDFHTAALEAGCKNHESARKFVADMAKRENVQARIADLKKVQNALGQDSQNNQDNQNNQDDKNNHDEPTATVPDAPQTPKYETPLGFLTAVFNNADGLYTPKERINAAIALLPYTEHKLAQTGKKEDELDNAKNKSENGRFATLSNQADMFGSELLQ

SEQ ID NO: 2812 - protein, 257 aa, M.catarrhalis
VSVVNSAKTNGNYYMKNLPQIQPHDTLTQAVNARELHAFLQNKDHFATWIKDRIAQYDFQENQDFVTFSENSEKGRPRLEYAITLDMAKELSMVERNEQGKMARRYFIECERVARQVMTAPMPVRPTTPTLSKVDFAVLQTVVRDLSAQMAHPKASEMAIWARLRAVCDVSSIHNIRYGDMWTVQGELSRIGRILRPYADFRKSTEKTLIKRICLGDHNAVWEAIKVMDDTADGYSLFVDDKAFYALECLAMGASHE

SEQ ID NO: 2813 - protein, 797 aa, M.catarrhalis
WLTFWALTAAGRLTEADKQAWAKAQAERLSAQKQAKKQARQTAAKTAQNRFNTATPTDTHAYLAKKGVRSHGLRADDKGNLLIPLYYHNTQTGNITLCNVQSISADGGKLFVKDGLVGGAFYTLGDVLSGDTILICEGYATGASIFEALGSIYPVIITFNADNMVKCASIIRTLYPQHRLIFCADDDKATEIKTGKNTGLMAGNESATLTGSEVISPDFGDDERTTTGELTDYNDLHAHFGMEVVKAQLVHALNRPRPKVITDTHGGYTLDYLNENFAQIKDIGKVTNKIYDLVNHTEMTKTHFMGLVGRELANAWLFGGKQKSIDRREVQDNTAKQFAKAYGSIFEQYWYIQGTKEVFNFKTYKRQPVDTLRLEFPNEFDAWNKSKSRQKVESDNIWFDPTDKKRPQNGENYINTFKPFAIQPYTAQELGIDDKQLNEHFMMGMCSPVINLIKHLCGNDTHALDWVLNWLAIPLQNLGTKMDTALIVHGHIQGAGKSLFFDRIMRKIYGSYLLTLGQGQLESQYNDWVEGKLFAVFEEIFQGKDRYSHMGMIKQLITGNTVYINKKFMSGWTQDNFVNTVFLSNDMQPLSLDENDRRHVVLYPTAVIPDALRHEIGAAIDDPNQSLIRAFYTYLLLKDPKNQNAHSTAINTKAKAQLTEISLASWERFYVYWKNGDLEIPYATCLTTDLYHYYVFWCKQNGERGTSSTKFLTFVSVREHKERIRYQYNLQNGDSFIPKSGQSMAFIIGLDMSKKPDQNTFGICISRFKGAIIKAQSSHPSVNTNNRSSHENSNPFI

SEQ ID NO: 2814 - protein, 294 aa, M.catarrhalis
IILSMSDDNSSTWSMRGLRRWLSTAPETRDDLLKLVQDSRQFLEPDTVDMLEGVLDLPATQVREIMTPRPQVHAIASDDDLSDILSVVLETEHSRYPVFDSLDDDAVVGILLIKDLIPYLKAKADGKEQPLKLADIVRKPLYISETARSDTLLRSLQKAQVHMAIVVDEFGSVSGVVTMEDLLEEIVGDIVDEHDDIDEDSDINNIIPHPDKSGVWLVQASTLISDCNEILGSHFDDTDVDTMGGLVMQALGFVSHLQGAVVQIDEWQITVVDVEARFIHLLELVLIPQLENAE

SEQ ID NO: 2815 - protein, 963 aa, M.catarrhalis
ILLLNGKKSSNRTAHLPIRMDCLSILDGIFSMLTKIISTVIGTKNDRELKRMRKIVTKINSYESSIQSLSDDELRQKTEEFKLRHQAGESLDKLLPEAFAVCREASKRVNGMRHYDVQLIGGMALHEGKIAEMKTGEGKTLMATLAIYLNAISGKGVHVVTVNDYLANRDAQLNRPLFDFLGLTVGVIYSQQAPQEKFAAYRADITYGTNNEYGFDYLRDNMVFSLSEKKQRPLNYCIIDEIDSILIDEARTPLIISGQAEDSAHLYALIDNIVERLVRSKDEEDNKNNTDGDFWIDEKNRTIEISEKGYEKIESFLAEVGELGENESLYSPARLPLLAHAQAAIRAHHLFVKNIHYIVQDGEVIIVDENTGRTMPGRRWSDGLHQAVEAKEGVEIQAENQTMATTTFQNYFRLYDKLSGMTGTADTEAAELKSTYDLDVVIIPTHRPIARIDMDDQIFLTKLGKYKGIIREIKQITEKGAPVLVGTATIEASEELSYLLNQEGIAHNVLNAKQHEREADIIAQAGRPRAVTIATNMAGRGTDIILGGNWQAELETHEVITDEMRREALTAWQARHDEVLAAGGLHIIGSERHESRRIDNQLRGRAGRQGDPGQSRFFLSLEDDLMRIFAGDRITSMFRAVGLKEDEAIEHKMVSRAIENAQGKVEARDFDARKSLLKYDDIANEQRKVIYSQRDDLLAEMDLQAGIQAMHHEVYHALINQFVPPGSIDDQWNIDGLEDEIEEAFRFDMPINDWLDADRRLDEEGLRTKIIETAIERYQTRREQMGEQTAAQLERHFMLTSLDRHWKEHLTQMDQLRKGIHLRSYAQKNPEQEYKRESFELFQSMLGAIKSDLIQDLARVHVPTPEELAALEEQRRQQAEQMRMMFEQQAQLDDAQSLDNRPAEETPRPLGRMTVTLGTTSVAHKAADITTDEALVIPKNTHRNAPCPCGSGLKYKQCHGKLS

SEQ ID NO: 2816 - protein, 102 aa, M.catarrhalis
GNNPMKKLIWQALALSAMIVLSACAQKTKEATAKPVEEKEVPMSAEPAEPMIVVPSDSSDSSIEQVVPEAFAEGDSTQIAEVIEIDETAKTATQDAEVQEGQ

SEQ ID NO: 2817 - protein, 270 aa, M.catarrhalis
GAPPMIKYQAWWGICFKANELASKFMVNTDTEEIGEVYMGCAGGIDADLSLPLMWQKNPFDATLSLTIKGLRGGHSGLDIDKNRANAIKLMARVLVKLLGQFDGQFAISHIKGGTLRNAIPREAQVVISCQQSSLSALIDTINDATAQIFDELKQAEPNLIAVIDTTKLGPKDNVLTWASSCQAIHLINALPSGVVRQSDIAKDTVETSLSFGQLKMDDDVLKCVLLIRSLVDSGKEAVCDTLSSIAHLSGAQITFAGELCGVNSRNPFW

SEQ ID NO: 2818 - protein, 69 aa, M.catarrhalis
NPSTISSSNIALPARIAKGLPDSVPAWYTPPSGAMHSIISRLPPNAPTGNPAPIILPKVVKSGVMPKCA

SEQ ID NO: 2819 - protein, 244 aa, M.catarrhalis
YHPTQKDNFMTITNRTLTTTAPDGTPLLSHIALPNDTTKTGKARAILVAPEWWGVADHPKTVAERLAAEGFVAVAMDVYGEGKMTTDAHQANEWMSQMLEYSDELMNRCQAIYQDVANLPEVDKERIGIAGFCFGGKIALDMARLGTPLKAVATFHGNPAAITPATKQKFIAKVLVAHGAEDSMVSMQAIDDLKKELEAADVQYQVDIYDGAKHGFSNPHADERARDNGIDLGYHSQAAQRKLG

SEQ ID NO: 2820 - protein, 442 aa, M.catarrhalis
FIYHKDAVMTHIRPANEKLFNDAKRHIAGGVNSPVRAFAGVGGVPVFVQRAKGAYIYDTENNAYIDYVGSWGPMILGHAHDRVIDAVKAAAEDGLSFGAPTPSETTMADLICQIIPSVDLLRMTSSGTEATMSAIRLARGYTGRDKIVKFEGCYHGHSDSLLVKAGSGMLDIGEPTSKGVPIDFAKHTVTLPYNDIEALTACFHEFGHELACVILEPIAGNMNMIIPTQAFHQTLRQLCTEYGVVLIFDEVMTGFRVGLGGAQAHFGITPDLTTFGKIIGAGLPVGAFGGKREIMECIAPLGGVYQAGTLSGNPLAMRAGKAMFDELMVDGFYETLGQKTTYLIDGLKAAAAKHQVAFQACSVGGMFGMFFSDSLPKNFNDVANLCDAQKFAKFFHGMLDLGVYLAPSAFEAAFMSAAHTYEDLDKTIQAAEQVFLQLSQAS

SEQ ID NO: 2821 - protein, 241 aa, M.catarrhalis
QLLNKRQTMTDFCYFEMTGTDSEKFLQGQITANIADIGEQFLPTAICNLKGRVQFGIWIARTLAGFDIVMSSDMADNFIMHIKKYGAFSKITLSSANPIYPDVIDDIPTFNKTQQTDTKLWEQLSIKTGNYWLTAKTSEMYQPQELRLHQKGGVAYDKGCYLGQEIIARLYFKARPKAYLHRILGVGAIPATGGDMGRMSIVNALATDTGFEALVIARPEDLTTVEILPLPKALQEDIGRN

SEQ ID NO: 2822 - protein, 80 aa, M.catarrhalis
PDLGSRTLILRLSMQGFEGGLISKSHLIWDIVPNWSYHQKMPTHLIKWWHIESGAGILRLFDRDFGEAPNLNVKSSFAIS

SEQ ID NO: 2823 - protein, 159 aa, M.catarrhalis
QYGIVMIYDELRPKFWENYPLDALTDAEWEALCDGCGACCLVKFLDDDNVKLTEYTDVACQLLDCSTGFCQNYAKRQTIVPDCIRLTPDMLPDMLWLPRHCAYKRLYLGQNLPAWHRLIKHSQNHGAGFAKVSTAGRCVSELGMSDEDIERRVVKWVKP

SEQ ID NO: 2824 - protein, 115 aa, M.catarrhalis
GEIMNLPDCPQCHESYTYADGMLLICPMCTHEWQEGGETEALPIIKDAVGNILNDGDAVTVVKDLKVKGSSTPIKVGTKVKSIRLIYDAPDDHDIDCKIDGFGAMKLKSSVVKKA

SEQ ID NO: 2825 - protein, 175 aa, M.catarrhalis
GDLISLIQLTHFSHFYYEILACHMRTATNSIRPKTTTRQLPLPISVMAALSAGAMFSLALAPYFIIPIAGLSPMLVYALVKKCDSPKRAFWLGELYRFGTWVVGAFWLYHSIHYYGRIPSWGCPCIKLGQCPSLLGLVHALDRIGHLFHLMPKQPNIFLHEFWIPPTKVKNIGVY

SEQ ID NO: 2826 - protein, 69 aa, M.catarrhalis
KSAIALSGPFGWVNSTDLGLGWSAPFGYITPFTTMGEYQVGAALVLNWGNVPHYWGLFMPLIALAICSI

SEQ ID NO: 2827 - protein, 117 aa, M.catarrhalis
IKTHIKDLPMHSQITLYKQIHPKQCDGLAKLGFKSLINLRFDDEIKGQPKGYDIAQSAKNAGLSYHTLPIGIDDIHLAQAQAFADLINNAPKPVMVFCGTGSRAKRLYQCAVVSGLI

SEQ ID NO: 2828 - protein, 82 aa, M.catarrhalis
LHSESIPHTTLIKKAQNAQIGLSASDMSIGVTSGRHGIYPKISWKIDANSRAYIAKKQMLSYLYGEHARHCIFIQGIKIYGE

SEQ ID NO: 2829 - protein, 255 aa, M.catarrhalis
RHIGGASTTSTGVVGADRKQLLLISSQEIMQLSHQAYLQTINEARTKGRLDNNTAQVRRLHRIANRLIPQTAVLRPDATRWDWKVHAITDNQINAYVMPSGKIVFYTGIIERLRLTDAEIAAVMGHEMAHALREHSREKASRHIATQGVLSIAVNALGLSGGQAQLVGLAGRLGLDLPHSRTQEAEADKIGIELMARAGYDPNAAITLWQKMQSAGGNGVPQFLSTHPSSTNRIANLKALVPTVMPLYQTSQNIH

SEQ ID NO: 2830 - protein, 185 aa, M.catarrhalis
SMHGSWINPMPSVLALLFSLQFLSGLNSGLVVGLLASFAMMIYRTHQVHIAIVGRVGDSEHFRNIERHTATTFDGLLLLRIDESLYFGNAQSVHANLMRLSDDTNIHDIVLIMTAVNHIDLSAQEMLCAFNQSCIKRGQHLHLAEVKGPMMDILKTSPVIENLSGCIFLSANQAVQSLTKPSTDL

SEQ ID NO: 2831 - protein, 255 aa, M.catarrhalis
RHRGSFQPRGEDKMTLTDADILRMNALELSHDDLFFHEFAKSITIYEDEDIWVLDKPAGLLSVDGRMLKVSLQSRLLCINPNIRLIHRLDMDTSGLIIFAKSSEAQTHISKQFIDRIPQKEYQAVVFGTLMIDDKKGVVDVPVRYEPTTKPRHIVDMDWNKRALTHYEVMHHELRCDDNGRAYPVTRVALKPITGRSHQLRVHMVHLGHVMIGDPIYAEDVALKLSNRLNLHAHKLRLKHPTHGIWMDWVSPVPF

SEQ ID NO: 2832 - protein, 109 aa, M.catarrhalis
VIIMNNQTAKALTAALQALSPSILSLQNESHMHAGYFEGKESHFKLVIVSDAFEKQRLAARHQTVYALAQPFLTVNGGMVHALAIHAYTPSEWVQLEQTPNSPLCASRR

SEQ ID NO: 2833 - protein, 380 aa, M.catarrhalis
PMSIQGLLPRWILQLIQHPRTALSDIPAGLMMAVLVIPQSLGYATLAGLPPIMGLYAAITPVIVYAWIGASSVSSIGPVAITAIMTASALSGYATGSLQYISLAIVLAFMVGGILLIAGLIRLGWIMQFVSRGVASGFISGAAVLIIFSQLKHIIGIPLNTDSLINLFLSIYTSNQPIHLPTALLGIGATLLFIISRYGESIIWGWLPAQWRGFGNRFFVILIVAISIWLSHHIGFEQMQIRLLQPLPTGLPKITLPNFSATTLLDLLPSALLIALIAFISSSTISAQQARIRGESYDAQQELGGLGLTNIPHRPLGGFSGPRGHFTHQPKTFRGCQNNHGHPSFGLLGVLLILLVSGQYLTRPALPLFSKQSSSVLSSQ

SEQ ID NO: 2834 - protein, 61 aa, M.catarrhalis
SLKACAVIATKSHNTPIILQLDQVSYRVSDGDLVSGVRLNIHAGEMISLIGPNGAGKFHLS

SEQ ID NO: 2835 - protein, 70 aa, M.catarrhalis
HLFYDSGNKIWTYRHTRSKPMARNFIPYNFFSLGETIQTKELVILFDSKGIVSNYTFRETANQSKAGLAE

SEQ ID NO: 2836 - protein, 150 aa, M.catarrhalis
LKIYNWFIISSDRQRLHEKSRKSLVVLPLFLRKSFKAFNMLNHHIRLTISALLTALLVTGCVSTGNVAMKEQNQQTIEQTIIKGKTNKQEISSRFGSADSISFMIVVIKFGHTAILAPNRWQEILSLIISFLWVKPYRPKNLSFYLTAKA

SEQ ID NO: 2837 - protein, 60 aa, M.catarrhalis
FSPYIDKFDCGLTIDFIFISYIIAVVVIINQDHHFKLYYKQNQVIIQFLWQVLCYKITFL

SEQ ID NO: 2838 - protein, 144 aa, M.catarrhalis
SSLLIKIKIMKLMSRPAQRNKKSAIYQVQMRQIWVVLGVMIFGLVLSYVMADGDRLIAKGLSIGALIAFIGQLIFTRIAYHTVGAKHARQIMLNTYLGFVIKWATTLALFASVFLKIQSISPASVIIEYLILIISQNKVLIKMK

SEQ ID NO: 2839 - protein, 302 aa, M.catarrhalis
TSGYLSMTTFALRTLFKSSVLYQSLKAVILLPITTIFSVSAMAGMVSVSNYPLALLSHEVTQGQHDAKVLLTAGDVGHHGSLSPSKVKLVEDSDYVIWFGESLEQNLVKTLADAPNAISLLQFNAFNRLPLRHIDGSQKPDSEDAHIWLDPENAKAIVRALSVVHGHANPEHKAKYAQNATDFERRMDKAVQSVQVNGMTPYWAYHDAFQYIEQAAGLKFAGALTPDHHLNPKASQFKRLNQTRPQPFMCLASQGVVSDGIKNKLGNVNVTIIQEDMSGMGEDFISAWVAQVNALQTCAGIK

SEQ ID NO: 2840 - protein, 496 aa, M.catarrhalis
RNRQPIQSWFGRIKNKISKQENAMSGRIVQIIGAVIDVEFSRGDVPQIFDALHVDGTETTLEVQQQLGDGVVRTIAMGSTEGLKRGLPVSNSGAPISVPVGQATLGRIMDVLGRPIDEAGPVNAEQKWSIHREAPSYDEQSNSTELLETGIKVIDLLCPFAKGGKVGLFGAAGVGKTVNMMELINNIALKHSGLSVFAGVGERTREGNDFYHEMQDAGVVNTEDFTQSKVAMVYGQMNEPPGNRLRVALTGLTMAEYFRDEKDEATGKGRDVLLFVDNIYRYTLAGTEVSALLGRMPSAVGYQPTLAEEMGLLQERITSTQSGSITSVQAVYVPADDLTDPSPATTFAHLDATVVLSRDIASQGIYPAVGPLDSTSRQLDPQVIGEEHYSVARGVQEVLQRYKELKDIIAILGMDELSEEDKLVVYRARKIQRFLSQPFHVAEVFTGAPGKYVALRDTIAGFKAIINGEYDDLPEQAFYMVGGIDEVVAKAEKLKA

SEQ ID NO: 2841 - protein, 520 aa, M.catarrhalis
IKGNKAMQQLNPAEISNLIKQRIQDLDVSATAKTEGVIVSVSDGIVQIHGLEEAMYGEMIEFEGGVYGMALNLEQDSVGAVVLGEYLSLQEGQKAYCTGRILEVPVGPELLGRVVDALGNPIDGKGPINAKLTDKVEKIAPGVIARQSVDEPVMTGYKAVDTMIPIGRGQRELIIGDRQTGKTALAIDAIIAQKNSGIKCVYVAIGQKRSTIANVVRKLEETGTLAYTTVVVASASEPAALQYIAPYSGCTMGEYFRDRGEDALIVYDDLSKQAVAYRQISLLLRRPPGREAYPGDVFYLHSRLLERASRVNADYVEAFTNGEVKGKTGSLTALPIIETQAGDVSAFVPTNVISITDGQIFLESNLFNSGIRPAVNAGISVSRVGGAAQTKIIKKLSGGIRTALAQYRELAAFAQFASDLDDATKQQLEHGVRVTELMKQKQYAPMSIADQAAVIYASNEGYLSDVPVEKIGAFEEAFLRYLRNDHAALMSEIDETANYNDDIESRLKAAVESFKASASY

SEQ ID NO: 2842 - protein, 160 aa, M.catarrhalis
QRGDWMINLTIFGQLIAFAIFVLFCMKFVWPPLIGAINERQRKIEEGLNAAEKAKADLVSAEKQVEAEFAAAKTEAASIIERANKTANQMIEDAKEQARLEGERIIVAAHAAVEQEAAQTREQLRSQVASLAVLGAEKILQDKINEQEHASMLEQLAAKL

SEQ ID NO: 2843 - protein, 296 aa, M.catarrhalis
VKIRSLFMAAEQTSTEYIAHHLTNWTFGHHPELGWKVAHDAAEAQQMGFMAIHVDSMLWSIGLGIFFLALFWAVGRKATSGVPTKLQALVEMIVDFVYNSVRESYNGPSKLIAPLSLTIFVWIFLMNLMDLVPIDWIPSLAQWVGSLMGHDPHHVYFKIVPTTDPNITLGMAIGVFFLIIGFGLKYKGVGGFIAEFTLHPFSAKNPILQAILIPINLVLEIVTLLAKPISLGLRLFGNMYAGELIFILIALMPFWIQWALSVPWAIFHILVITLQAFVFMMLTIVYLSLISAESEH

SEQ ID NO: 2844 - protein, 65 aa, M.catarrhalis
PFFGMFPPIIFIPAHYVNLQVSSPFVQFETKIPSTLFFFPQISNPNTSLLGFLGTPQNPPPPNPI

SEQ ID NO: 2845 - protein, 174 aa, M.catarrhalis
KVVMHSAHHHCHSHHHDSYHQNPEQRLADAKAYCAKRGARFTPLREEVFQLILQAEKPMGAYDLISALQQSRLSDANAKKTNIAPATVYRSLEFLIEEGLIHQLSSMNAYVPCCHPRDRHAASFLICRCCQKVEECSNLPVDRMMNFAAKDANFLVERSTIELKGVCRDCHQKP

SEQ ID NO: 2846 - protein, 202 aa, M.catarrhalis
LEDIMAELTTLARPYAKAAFDYAKEHNAISNWEAFLLIASDVVRNEDFASLLNNPAISAQQKADILMDAYGKLTAEQASQALTNFIKQLAEHDRLALMPEITAHYTKLKSQELKQVDAYVTSAFPLTEAQSKKLQERLALSTGSIVILHESVDPNLLGGATIKWGDKFTDGSMRWEGKTIKNSTNCGSRQLAKSKETRQCNN

SEQ ID NO: 2847 - protein, 84 aa, M.catarrhalis
GDIMDPVIAQYTLLAVALLIGAGALATGIGFAILGGKFLESTARQPELGSQLQTKMFIVAGLLDAVPMIGVGIAMLLLFANPFA

SEQ ID NO: 2848 - protein, 309 aa, M.catarrhalis
ALVLTHHKPFYNKSSIGIIMASLKEIRAKVTSIKSTQKITRAMQMVAASKMRRAQERMELGRPYSDGIRRVISHLVQAQSDYKHPYMINRPVNRVGFVVVTSDRGLAGGLNINLFKNLLKTVKSYQEQSVEIEFAVIGAKGVGFFKNFGGRVTSAVTDYGDNPALEQINTPVQTMLDDYLNGKLDRIYLVYNQFINAMAQKPVVEQIVPLAESEFDDTELQAHSWDYIYEPDTKTLIDSLLLRYIESVVYQSVRENIASEQSARMVAMKAATDNAGNLIKDLQLVYNKLRQAAITREISEIVGGAAAVS

SEQ ID NO: 2849 - protein, 139 aa, M.catarrhalis
RLLVYWENDMATFKCRVVSAREEIYVGDISMLIANGHSGEIGILAGHTPLITLLKPGPMRMKSADGSSEEVVYVSGGVLEVQPHVVTVLADSAERAYDLDEAKIAEARRNAEQALANQSANIDTTAALTALAESLAQLS

SEQ ID NO: 2850 - protein, 71 aa, M.catarrhalis
AIYSVDVCSAAINKLLILTQKRKIGDKRQIKKRSYHLTLFNPLLAAWLINILSTVLPLSINFDKIHTFALI

SEQ ID NO: 2851 - protein, 561 aa, M.catarrhalis
LNTLSAALIHLRGEDWLSEAPYRMIQNNLHPDVAENPQSLVVYGGIGRAARNWECYDQILASLKQLEDDQTLLIQSGKPVGVFNTHENAPRVLIANSNLVPRWATWEHFNELDRKDLFMYGQMTAGSWIYIGTQGIVQGTYETFAEAGRQHFGTKKGDKSTDNWKGRWILTAGLGGMGGAQPLAATFAGATSLNIECQQSSIDFRLRTGYVDKQANDLDHAYELIKEHTSKGEAVSIALLGNAAQILPQIVQRAKNGDIKPDFVTDQTSAHDLIHGYLPIGWTVDDWRAAQQDPSQHAKLTQEAAKSCAIHVQAMLDLQKMGVPATDYGNNIRQVAFDAGVKNAFDFPGFVPAYIRPLFCQGKGPFRWVALSGDPEDIYKTDQKIKELFPENTHVHNWLDMAKDRIHFQGLPARICWLGLGERDKAGLAFNEMVKNGELKGPIVIGRDHLDTGSVASPNRESESMKDGTDAVSDWALLNGMLNVAGGATWVSLHHGGGVGMGYSQHSGMVIVADGTEAAAKRLANVLVNDCGSGVMRHADAGYELAIETAKNYGLNLPMVK

SEQ ID NO: 2852 - protein, 357 aa, M.catarrhalis
EIIMTPPNVYHQAPDFKAYTGRAEPFENDKACYWYQYIQAFDDALNRKNNQKNQPKIALIGFACDQGVNRNQGRIGAKHAPDAIKSSFAKLPISYQTQQAFQSMAGIVTDAGNVVCDDDDTICPNLLEIAQQDYADKISTVLNANALPIGLGGGHEIAWGSFLGLWQHMASASTPLANIGIINLDAHFDLRQDQYATSGTPFRQIAEHLDIKEQPFHYLCVGISQFSNTASLYEQAFDLGVSVIGDDDCHRLDWQAIEQKILAFIAPLDVIYLTIDMDCLAGSVMPAVSAVAAKGLSLDFVERCVLLIINTGKVKVIDMAEVSPKYDIDGRGLKVAGRLLAVMVEAVLSSSFKSLSR

SEQ ID NO: 2853 - protein, 434 aa, M.catarrhalis
PFVMYDKTMKNTMMKTHFDLLITHANIATMNSDFGFHLDNQSNQTTKTATPYGQLTNHAIGINDGKIAWIGHHDDASSFTADRLIDAQGKWLTPALIDCHTHLVYAGNRSDEFEARLTGVSYEQIAKNGGGIISTVNATRQASFDELYAQSEKRLKALLAEGVATLEIKSGYGLDLQNERKMLQVARKLGQDYGITVKTTYLAAHATPPEYKDDDGNAQNDAYIDKVCEWLPILHQEGLVDAVDAFCENIAFNKQQVNKVFELAQSLGLPVKLHAEQLSDMGGGALVASFDGLSADHIEYLSDDSIQRMAQSGTVGVLLPTAFYVLKETQLPPIDKMRQQGVAMAISTDCNPGTSPSASILLAMNMACTLFKLTPEEALAGTTLNAAKALGLQDSKGKIAIGYDADIALWDIERPADLSYLIGQNKCVDVINAQ

SEQ ID NO: 2854 - protein, 78 aa, M.catarrhalis
PMAILPLLSCNPNALAAFNVVPASASSGVSLNKVHAMFIASKIEADGDVPGLQSVDIAIATPCCRILSIGGNCVSFNT

SEQ ID NO: 2855 - protein, 525 aa, M.catarrhalis
NKLLFGETMNSLILTPRNLTFAQLRQVYDGPVKISLDPTAYEAIDASRQAVQAIIAKDKPAYGINTGFGLLAKKRISDDELELLQRNLILSHSVGTGDRLPDEVVRLIMVMKVSSLAQGVSGVRREVVDSLLGLINHNIIPHIPAKGSVGASGDLAPLSHMTLAMLGFGDVSVNGEKMSAKKALDDAGLTPIVLAAKEGLALINGTQTSTALALRGYFMAQDLLAAATVVGSMSIDAAKGSDAPFDARIHDARGHHGQAQIASAHRQLIADSQIRASHKEDDERVQDPYCLRCQPQVMGACLDVINQAGKTLLIEANAVTDNPLIFNDNDGPVAISGGNFHAEPVAFAADMLALAISEIGSMSERRIALLIDATLSGLPAFLVKNPGVNSGFMIAHVTAAALASENKSHAHPASVDSIPTSANQEDHVSMATYAGRRLYDMACNTATIVGIELLAAAQGVDFHLEEGLHTSPKLASVHQTLRQSVAHYDKDRYFAPDIENAKQLVIDGKLIDSWRELRTDWFLAK

SEQ ID NO: 2856 - protein, 296 aa, M.catarrhalis
RPVFHSLSDEQQGYLFTFITMCIWGAFGLMARMNAYWHIQIWDVLLLRFGIAAAVLLPILWWKKDYQFLFDFKLLILALVGSIGYCIFVYSGFFYAPVAHGVVFLNGTFPLFAALIGYIMLRSPIDRQTGIGLSIIVMTLLLMTISIIIGDGHFGRGDLMFIASGLCWGLFSVLLRKWSFSAWHIMCGVAIWSAVIYSLIYALFITPAFYTALPTHLAIQGIFHGIFVVIIATLTYAKAVAKIGIFKAGSIANLAPFIASIIAVPLLGEMLNTTLVMGLIGMAIGALQPWRWFIGR

SEQ ID NO: 2857 - protein, 253 aa, M.catarrhalis
FMMSTLLINTRPKHRGQAIRQMTGMPVIDLPLLDIQTLPMTETKASMMRAWLDHDYDVLVVTSVESARRALEYLDKLHGGHHWQSKLPNAPIVAVGLATAKVLTDRGLPVVLPRVTNNEGMLAMTEIRSLISGSRVLIWRGAGGRKLLHETLKARGVQIDVIRWYERFIPMDLMDNFQKNLKIINEKADVFVIISSEMAYQAWRRLPHHRQYHYLALGERLKNIIHAYEPDVMVDELVTLEPTEIYQVIHQNF

SEQ ID NO: 2858 - protein, 614 aa, M.catarrhalis
LMSFFSYFEKRLESFPDISLPTHTHSLASFIYACTLGYRGWLLLFTVLTAIAGIYWAYVYAWIGQIVDWLSVYSPSEFWTQKKSDLLIMLAISAFIPLVLLFETTIHHQVLQGVVPMRLRWIFHQQMLGQSMQFYQDEFSGRVSAKVMQTALAVRDVVMTLIGVFVFILTFLVGAGAVLTGIHPLLTVPFVFWILAVSALLVFVLPRLQRTSRIQADARALMTGRITDAYANINTVKLFSHSHRESGYAKEAMKHFLGTVHDQMRLVSLLEILVSVIAVLTVSGSVAMSVYLWMSGVVGAGAVAVSGALAIRLQGLTHWVLWETAGLFEYLGTVQDGMKTLTTPHHVVDDPNAQVFHVKQGQIDFKQVSFNYGKKDQSQPLLDDFSLSIKAGEKVGLVGRSGAGKSTLVNLLLRFYDIDGGQIYIDQQDIKTITQESLRQNIGMVTQDTSLLHRTVRENIAYGRPDATDDEIIAAAKAAHAWDFIQTLKDKFGNTGLDTQVGERGVKLSGGQRQRIAIARVMLKNAPILLLDEATSALDSEVEHAITQSLDDMMAGKTVIAIAHRLSTIASMDKLVVMDRGHIVEMGSHDELIAKNGVYASLWARQSGGFLADH

SEQ ID NO: 2859 - protein, 110 aa, M.catarrhalis
SVQPNFLLNKMRAIMQTFNPNDHMVFCRKYQQNLPKLPNPPFPNAKGQEIQDTISAKAWNAWLELQTMLINEKHLSMIDPQAKKYLNEQREKFLDNGDYEKPAGYKPLKA

SEQ ID NO: 2860 - protein, 169 aa, M.catarrhalis
CSWPLKKAIFRIGRDLKRPKIAYFRGIHLIKIWSFTLQKPRKKSVVYIASDINCPYCKFLHERIDELNLQGVTIKIIGYPIYDESRLPMNHIWCTTDNAKRAALLSAAMKGIIPNSQAQCQHNPNPLSAIQKQVMPLAIMGTPAVFDAQGREFTGDLSNHEIYQFLNLR

SEQ ID NO: 2861 - protein, 61 aa, M.catarrhalis
CVLTALALLHDRTGRLENTDMRLVILLILHDRTGRLEIKIYAIQMLNELHDRTGRLENALA

SEQ ID NO: 2862 - protein, 75 aa, M.catarrhalis
TPRAFNVSCNSLRPPAPRQIKTRLPDISDRISVIASIPSLLVTLGKTTGSPRSVNTLAVAKPTATMGALGNLDCQ

SEQ ID NO: 2863 - protein, 118 aa, M.catarrhalis
RLSACVFHCFLSDLCGREGEKWIFVANWRFLSDLCGREGTQSPSINTNTFLSDLCGREVDKVLVSMCKDFLSDLCGREEPTMQCFHIQHFLSDLCGREEATCAVVKTNSANRFSSNIF

SEQ ID NO: 2864 - protein, 93 aa, M.catarrhalis
ISEAYHKNGKYPSKNNAYQRPRSQGPLIVHLDSFVAKIGDLKYQDWQGGVLEQKQAHVLGMSKARWHFCFVCRSAGLSLAGYDKLVRNHHLRR

SEQ ID NO: 2865 - protein, 277 aa, M.catarrhalis
LHFLHDHTGRLEIAPPSRPHTHILHDRTGRLEKAINPLTNCSVLHDHTGRLEILFYGYADYLKFLCQSLENFILNHYEDGEFILTFLGQFMTEQTTEQTTMEEIMTEQTTEQTTMEEIMAETTTEQVEALHSQIQALENEVKEAKETAARANAESYNAQRRMEQETDKAKKFALQKFAKELLEVVDNLERAIKDAEETGADDASLEGIRLTHKVLLSVLEKNGVVAVGNVGDTFNPEIHEAVGIFPEAEKDIIGQVLQKGYILNERTLRPAMVMVGA

SEQ ID NO: 2866 - protein, 276 aa, M.catarrhalis
SSNYHPNKDIVMNKLKIGIMGASGRMGRMLIESTMNHPNTELGGAYVRSTSSLIGVDAGEFIGGKKSGVALSTLDGSQVDVMIDFSLPEAFDEALNQCVTHKIPLVMGVTGLSDDQEAKLQDAAKHIAIVYAGNYSTGVNLSLNLLATTARVLGLDADVEIIEHHHKHKIDAPSGTALMMAQAITEARGQNITNAAIYGRKGAAKRQRGDIGIHALRGGEIVGEHTVEFMMDGEIIQITHKAQNRATFATGALRAALWAAQQPAGLYDMQDVLELK

SEQ ID NO: 2867 - protein, 67 aa, M.catarrhalis
CCFQSCQFCLHDRTGRLENREIIAKIQPNLHDRTGRLEKYKLSSTVCSFLHDRTGRLENQRQAGGRC

SEQ ID NO: 2868 - protein, 414 aa, M.catarrhalis
ENDQLCDYNLIIYSFLVILSFEKDMNHLHTFYHDSQALINAAIEPIGPWQDSGLLDNIATASKQLLDPIAIDKGYYPTAEMSQLAKLGAFSVHLSAQGGRFGNAILATAKISETCGTTGFLSWCHQVCALYLDQSDNHTLKSDILHRHALGESFGGTALSNPMKTFANIESMILRAQRVNGGYVVSGTLPWISHIAPNQYCGAIASVEHGGQIDKDIFFLLSFDEARKDNWQLNPCPTFSGMEGSSTWQIALTDYFVPDDSLIADPAKPFIERVRGAFVLMQLGIGAGIIQGAIHDITAVEVQLGHVNQFLEDQAGTLQTQLDALIERTLVLAKTPFETHKDFFLEVLDTRIQGAELSLQATQASLLHQGAKGYLMSANPQRRIREAHFVAIVTPAIKHLRYLSHQLLTEKSPK

SEQ ID NO: 2869 - protein, 493 aa, M.catarrhalis
IKYHHIPPKIMLYFGDILSFKVIQGISMSEQTSSMWGGRFSEATDSFVAEFTASVNFDKRMARQDIQGSIAHATMLGMCGIITQDESCQIINGLTQIQAEIDDGKFQWLVVLEDVHMNIESRLTTLIGDVGKKLHTGRSRNDQVATDIRLWLRDETDNILVLLAKLQSGLLDLAANHTKTIMPGFTHLQTAQPVSFGHHVMAWFEMLVRDSERFVDTRHRINQMPLGSAALAGTTYPIDRTITARLLGFEGICQNSLDAVSDRDFAIEFTANASILMMHLSRMSEELILWMSAQFGFIHIPDRFCTGSSIMPQKKNPDVPELVRGKAARVFGQLTTLLTLMKNQPLAYNKDNQEDKEPLFDCVDTLTGSLLAFADMLPNIIPNVDNMRAATMKGYATATDLADYLVKKGLPFRDAHEVVGKAVGLGVSKGVDLSELSLDELQSFSPLIECDVFDCLTLEGSLTARNHIGGTSPNQVLSAIKRGRERIINPKTA

SEQ ID NO: 2870 - protein, 409 aa, M.catarrhalis
RQNHALIDKDLSMDKHTQLICDPRQVPMQINSLQPPVYHASTIIFDNTKALFQRHWRDRYDYSYGTHGTPTTYLLADQIARLEGGKYALLTPSGLAAIVLVNTALLGQGDEVWVTENMYSPNLEHLYELQKRYGVVIKIYNPLDATSFQPTAACKLLWLEAAGSVTLEFPDLQGLINIAKKHHVCVALDSTWGAGLAYSPFDLNGVSVDICVHALTKYPSGGGDVLMGSIVTNDETLHTKLRRMHTLLGFSVSGDDCARVYRSLPSLALRYDKQSKNAIELLTYLKHEPAFAQVLHPANPDTLGHQFWQQNCPNGRSAGLVSVVFDKRYSWTDICRFCDTLQIFKLGFSWGSATSLVMLYDLSKMRTLPQAHLCGRYVVRFCIGLESPKDLIDDIKTALGSLNYDEKSK

SEQ ID NO: 2871 - protein, 319 aa, M.catarrhalis
TLRQGGVFMNDKVRVGCVYFHKMVIYDANTISSPLTYGLPALTGFTGAFHALSRTLMADERFADLALGGVLLACYECTPKTYRAGRYHDHTFNQTRNPLKKDGKTAPIVEEGKCNLVMSFAVEVLASDLLSEKRSQELTQFLSQAIFRQRIAGGSVMNIAKTHPVRYFGFESMHQIVPLLMPAFVLMDASSEFSELIDKAQSTDPKATPLDVLLDVCTLHHLPKLDLDGNTKWHTKSIKTGHGWIVPMPMGYQAISEQFEAGKMDNVRNPEYPSQYVEVVYGLGKWVYPHHLKDNIETAFWRQHYDETGLYLLTQNELS

SEQ ID NO: 2872 - protein, 73 aa, M.catarrhalis
LICFLQPLTASSSVSVMLYNKLAPWRACCWDLPPPNPPNPPPPKACPKISPKMSLKSPPLKPPPKPPEPMPCS

SEQ ID NO: 2873 - protein, 636 aa, M.catarrhalis
IMAKVIGIDLGTTNSCVAVLEGDKVKVIENAEGARTTPSIVAFKDGETLVGQAAKRQAVTNPKNTLFAIKRLIGRRFEDKEVQKDISLVPFKIVKADNGDAWVEVNDKKQAPPQISAEVLRKMKKTAEDYLGEAVTEAVVTVPAYFNDAQRQATKDAGKIAGLDVKRIINEPTAAALAYGMDKKGGDKTVAVYDLGGGTFDVSIIEIADVDGDQQFEVLATNGDTHLGGEDFDLALIDYLVEEFKKEQDVNLKGDPLAMQRLKEAAEKAKIELSSSQSTEVNLPYITADSSGPKHLVVTISRAKLESLTEDMVARTIIPCKTALEDAGLSASDIDDVILVGGQTRMPLVQQKVQEFFGKEPRKDVNPDEAVAMGAAIQGAVLSGDKKDVLLLDVTPLTLGIETMGGVMTPIIEKNTMIPTKKSQVFSTAADNQPAVSIQVYQGERKIANQNKLLGNFDLTDIPPAPRGVPQIEVTFDINADGIMNISAKDKGTGKSQSIQIKADSGLSESEIEEMIRTAEANAAEDEKFANLANARNEADGRIHAVQKALKEAGDKVTTEETTAVESAISTLEAAAKEDDADDIKAKLEALDNAFLPISQKIYADAGAQGAEPQQEQAKPADDGVVDAEFTEVKDK

SEQ ID NO: 2874 - protein, 466 aa, M.catarrhalis
EISKMSDTLSNSAKPNMDSNGNPTDGRGAWKQFLCRACGWIYDEKLGDPDGGLPAGTRFEDIPEDWECPLCGVTKRDFEPFVSRDEVVTPLIGHHSETGVIVIGGGTAGWTAIEALRKLNENLPITLITSDLGDRYMKPQLSIAISQNKTPETLITKKAVDLAQALNVTLVAQTFVLSIDTNERIVRTTRGNFSYQKLILATGATPMLPPSLPAEYVWRVNHIDMFAKLQAKLIAKPNQHITIIGAGMIGTEIAEDIAKAGHQVTLINRDSLPMAEILPTIGGERLRDALTGIGIDYIGNAHITDIKPQDGGYVIIYNDKTLYADEIIASTGLILDNRLAKGAGIDYIRCGIVVNPKTLQTSHPAIYAIGDCIAIDDKPCRFVAPLREQAAAIAHHISDMAHAGYQHKSPLIRLKTKSIIISATGEIEQAKDWQVQENTDDKLILTQSSDGVITAKIEMKTSPQAN

SEQ ID NO: 2875 - protein, 220 aa, M.catarrhalis
NWCNCCSGPPNPTGNVLTDGEMTHLNQLAKKHGIPLIIDNAYGAPFPSIIHTSTTLEWDDETILCFGLSKIGLLGVRTGIIIAHPKIAKAVSNMNAIVNLSPVRFGAAIATPLFENDEIICLSDELISPFYKKQSIFAIQRLQEEFADYPVYIHQPEGVIFLWVWFEGLPISTTTLYQILKQQGTLIIPSEHFFCGNADGGLSTRQRVYPLVDCPRRSHT

SEQ ID NO: 2876 - protein, 321 aa, M.catarrhalis
WVSNLMLPILMHIWTHLPSDTNPQGDYMAHKSLSTKAKGYLLSLLIVLSVIGIWHTATLPKQITAPTDPLRLEYRILMGDIPEFTKPGAIVAIQKSEFPSPTEFAKTAWVHISDPFYDKGLNDKGIGIQLGYSIGRVLLGFFLAMIVAIPLGYAIGMSPVLGSAATPFVQILKPISPLAWMPIALYTIKDSNASSIFVIFICSIWPMLTNTAFGVASVRREWRNVAKTLELSPLKTATKIVIPAAAPTIVTGMRISMGIAWLVIVAAEMLVGGTGIGYFVWNQWNNLSLANVIFAVLLIGLMGMILDMLFAILQKKVSYVE

SEQ ID NO: 2877 - protein, 329 aa, M.catarrhalis
IYQKFGSHMTIRTLTIATRQSPLALWQANFIKAKLEQLYPSLSVELLEMVTKGDKILDTPLAKIGGKGLFVKELEQALYDKRADIAVHSLKDVPMVLPEGLMLGAYCERHAPTDAFVSNHFEHLDDLPTGAILGTSSLRRECQLRQARPDLDIKSLRGNVGTRLGKLDAGEYDAIILATSGLERLGLHKRIRHELDDELSLPAVGQGALAIECRSDDEAIKLLLSPLNHPKTRLCVLAERAMNRALEGGCQVPIAGFAVIEDGMLTLRGRVGSVDGKTLLKAQQSHKLMGEIQLDEQAAEQLGIDVAHELLMQGADDILKQVYQNALNS

SEQ ID NO: 2878 - protein, 185 aa, M.catarrhalis
TRKNMARLTVHTAESAPDKAKERVSMVQKANGFIPNLIGVLANSPQALEMYQELGKMNSRNSLTAEEIEVVQITAAAHNGCDFCVAGHTKAGTKLQMPENVLNALRGRTAIEDNEKYQALAQFTMQLIDRRGKVSDDELAAVKAVGYSDQNILDVVMGVALATLCNYANNVAQTDINPELQAFAP

SEQ ID NO: 2879 - protein, 287 aa, M.catarrhalis
VMLNNQTASPLIQVNALTKRYGDGENIFENVNFNIQKNEFICLIGHSGCGKSTILNALAGLEVASFGEILMYDKPVTQPSLERGVVFQSHALLPWLTVGKNIGFALKAKTPNLSVAETNRQIDFYLGMVGLAKVKDKKPSQLSGGMKQRVGIARAFATKPELLLMDEPFGALDALTRGVIQDELVNIVADTHQTVFMITHDIDEAILLADRIFLMSNGPRAFLAEIVENTIPKPRHRDSIHHHHQYYKIRNHLLDFLVHRSRALQQSPERPKRPKVINFNHAEWDGL

SEQ ID NO: 2880 - protein, 268 aa, M.catarrhalis
FLSDLCGREELVISPIACLCFLSDLCGREEEQALSRRIRTFLSDLCGREAPNIRGGSISIFLSDLCGREDGGGRPPPSDYFLSDLCGREVAAIDSKITTEFLSDLCGREEITLDRMAGKIFLSDLCGREGLVKSKPSTPSFLSDLCGREGLPSEQSNWLIFLSDLCGREGIVSKVMFHPIFLSDLCGREGTRLNLRLNYLFLSDLCGREAPNIRGGSISIFLSDLCGREDGGGRPPPSDYFLSDLCGREVNGMLVQVVIMISKRPVRS

SEQ ID NO: 2881 - protein, 116 aa, M.catarrhalis
FLSDLCGREGEKWIFVANWRFLSDLCGREDSIKRSIFVVSFLSDLCGREVAIGAFILGQSFLSDLCGREDINTVRQLGVDFLSDLCGREESYTQLMITYIFLSDLCGREDLAVFLR

SEQ ID NO: 2882 - protein, 296 aa, M.catarrhalis
SLKDNIMKKRSQKTDNQSFKSSSKEKLNKPHHQAKPAKPKNPYFYGIHAVSMLIKRRPEEVLGLFIQLRDDGQMSSEHQLIVQSAKHFGISIQNAHRERLTELCGSQQHQGVVALARTAPMADETILDNLLMQDDVLFLVLDQITDAHNLGACLRTACAMGVDAVILPRHQSAPITPTVAKVSVGASEVIPVISVTNLARTLEKMKKSGVFIFGTALDKSAKPAFECDFGGKVAIIMGSEGDGMRRLTQTMCDTLVYIPMAEVLDRPQSLNVSVATGMVLYEVMRQRRGFGQMPLV

SEQ ID NO: 2883 - protein, 323 aa, M.catarrhalis
TIKLGACLMDGLLKFTNFVSKTFAVWVVVFALIATQFPDAFKQLVPWIPYLLGIVMLGMGLTLTFKDFGEVTKNPKAVIVGVILQYVVMPVIAFLLVQAFRLPPDLAIGVILVGCCPGGTSSNVITFLAKGNTALSVACTTLSTLLAPILTPAVFYLFASQWLQVDAGGMFVSVLKMVLLPVFIGLIIRSLFKQKVQKVSQTMPLISVIAIILIVSAVVAVSKDRIIESGLFIFFVVALHNGFGYLVGYAAAQIFRLPLHDSKAVAIEVGMQNSGLGAALAAVHFKMNPLIAVPSAIFSVWHNISGPILAMIFSRMNDDKTTR

SEQ ID NO: 2884 - protein, 322 aa, M.catarrhalis
TWICIIMNTLKPTDLKAILHSKRANLFYLEHCRVMQKDGRILYLTETKYQNHYYNIPIANTTVILLGTGTSITQAAMRLLAGAGVLVGFCGGGATPLFSGVEIQWLSPQNEYRPTEYVQGWLSFWFDDKKRLTIAKVFQKQRLEFTQKVWLKDKQLQEAGFDITDYDVVQLHTAFTNKIEQVDSVGDLLLAEALMTKRLYHYAKTKCALSFERDFHASDDANRFLNHGNYLAYGLGACTLWVLGIPHGFAVMHGKTRRGALVFDVADLVKDAIVLPWSFVCAKQNFTEQEFRQKILQKFTEYKALDFMFGQVKLASQYFKGV

SEQ ID NO: 2885 - protein, 288 aa, M.catarrhalis
KMSCQGEIIMKGGYSQDYYRLLGVADDADTATIKRAYRQHIARHHPDRQANSDEDVVHQLNTAYAILKDDKVRRQYDRQLPRIRQKQWLWQQRAKFYEVKQGFGYVANTALVNLGKQQFNRLIVDAHHTKHMAQITQRAAVHLGRIWQRFTDVSAKLGYDTSCTIGLHTVYEGGEILIHWQGKRFKVVLPAGLSHGDIITVQCHGSPVRLRIQTKPVNIYVKGLDINYVIFLSPNQAANGDTVVLPKPIGLTLTIPPNGKYPTKIMLSNQGLRQMASVGDVIVHLNIT

SEQ ID NO: 2886 - protein, 223 aa, M.catarrhalis
QAERGKSALCHGGLGSWWCFWCKWKRIMKFYQEITLIPQADISPHAVWSKLYTQLHLAFVEQKDEQDKTIYGVSFPQYRTIADKKIAYLGCKLRVFAPTEQALSALNLDKQLEHLADYIHISSIRSVPDDIKGYANYYRAIPKMTLDERITHQAKRHGVPYHKAAERFENYKEQSLVYPHIQLTSKSNHRSYPLHIGKQAAEVLTDGRFGTYGLSRTSSVPEF

SEQ ID NO: 2887 - protein, 119 aa, M.catarrhalis
TLFLLDKVHMNTGLTLTNKAAAKLAKLKHTEGNDALMLRVYVTGGGCSGFSYGFDFAEELGDDDTTFDNGSEILVVDSLSYQYLVGSTIDYTEGLEGSRFIVNNPSATTTCGCGSSFSI

SEQ ID NO: 2888 - protein, 353 aa, M.catarrhalis
HKTSYHNFNLNTMKWSDLMSKLTTATVLAFERNLDISDGFMAQKNSQNENSGIVPVRIQEKSIRGTISNRLKNTITNDPAKLDAEIEKANLQKVDSASLLEDNDTLIVSWTCKVLPFDGKPNVCNDPNYQAKLLQTVQGYLQEHGVKTLAHRYATNIANARWLWRNRIGSEKITVNVTCKLADQQQTLTFDAKSISIHNFDTQNPELMTLANWIEQGLTNQSFIILNITAEAVVGYGQEVYPSQELILDTGKTKSKVLYHINDKAGIHSQKIGNAIRTIDTWYPEAQFPIAVEPYGQVTTMGTAFRQPRQKQDFYSLFDGWVLKDNKPSVENQHYVMAVLVRGGVFGASGKES

SEQ ID NO: 2889 - protein, 341 aa, M.catarrhalis
LIIIELIIYIFCRYFMTVQFSKTDFLPPLWLRNAHLQTILPRYIAKNTPDYHRTLLKDSLAQSDVAFDYVMADDQKGADGRYTTPIVVLFHGMEGSSQSHYARTLASHISTKGWHFVVAHFRSCGGVAVSGKVFYNAGDAAELAHYLQVLQQQFTTIYAIGVSLGGNALAKYMGEYGSDAIANRAVVVSAPVDLASASIAMERLLGRYIYTPYLLNPIIKKALDNRLSSEEIAALKSAKRMADFDNAFTAPRHGFRSKNDYYRQASALPYLRHIQRPTLIITAKDDPFLGVTAEPTDVSSDVLLLDTRYGGHIGFVDYDYQKRQFDLGFIPRTALDFFGFL

SEQ ID NO: 2890 - protein, 161 aa, M.catarrhalis
GDNMLKVASIFEPILTGDDRPKLLHDYPVVHVQPIAWGDMDGFNHVNNVAYYRYAESARIAYMRAIGFMAAREDLLTILASSSIQYRRPVTYPDTLLIGVRIKHLGSTSVVQEYAMYSQAQQALVASGEAVIVRTDMNMVKMPWSDEERALIERFENRRFD

SEQ ID NO: 2891 - protein, 473 aa, M.catarrhalis
DFGIIKTLPLRIIMHIHILGICGTFMGSLALLARDLGHTVTGSDANIYPPMSTQLADAGVEVWEGYHAEHLIPTPDLIVVGNACKRGMPAIEYMLNERLPYTSGPQFLYETVLKDRHVLAVAGTHGKTTTTTMLAWILQFSGIDTGFLIGGVPLVNTDDRRLSLAFQHSSYLGKQFFVIEADEYDSAFFDKRSKFVHYRPTTAILNNLEYDHADIFADLDAIQTQFHHMIRMIPSKGQIIIPANTPSLETTLDKGVWTTVVRTSLNGDAEWQAKLDANDGSSFWVHHNNTSAMVRWSMSGLHNVNNALTAIAAAHHVGVSVEMACTALSHFGGIKRRMELIGDVDDILVFDDFAHHPTAISTTLDGAKKRLTPRRIWAIIEPRSNTMKLGSHRPHLAASAAIADQVIWYEPQGLTWGLKEAIGSTPNQRVLDSINAIIEHIKTYAKAGDAIIIMSNGDFENIHGRLLDALSQP

SEQ ID NO: 2892 - protein, 474 aa, M.catarrhalis
YFIMSNIFRPDDTDKPLNFGCRCGNHRSQSECDDKLSLDNRFEGVSDHSRIEHTNTDFIEAVAIKALFPDEPTRRAFFKTVGKTTALAAIASVLPIATLQEAAAIDTLKPEKKSVDIGFLPILCATPLIMADPLGYYAEQGIKANLLKRAGWALVRDQMMNRELDAAHFLAPMPIAINLGLGSAKQNMKVAAIQNTNGQALVMALKHKNNRNPKNWKGMTFAIPFEHSIHNYLLRYFLAEHGLDPDKDVKLRLTTPPDMIANLKAGNIDGFFGPEPFNQRAVWDKAGYIHTLSRDIWNGHPCCSFGTSQSFINDYPQTFLAMYRAIIKANVMANKPSIRKDLSKLLSPANYLNQPELVLRQSIMGRFADGVDTIQDVPDRMGFDVMPWHSVAAWMMTQMKRWGYITGNINYQDIANQVFMLTDAKKQMQAMGYTVKDDEPKITVMGKQFNATDPDAYLDSFAIGHKSTGRLHGT

SEQ ID NO: 2893 - protein, 132 aa, M.catarrhalis
WPIINPLSISIRKIMSIIQKFDSNDTLSEVAVHGSVVYLAGQVPDDDSLDIAGQSRQVFANIDKALALAGTDKNHLLSAQVFIKNLEDFEGFNNAWKEWMAGSTPPVRATIQANLVNPNWLAEIMVTAATQS

SEQ ID NO: 2894 - protein, 626 aa, M.catarrhalis
GHAMSQPTNPALNQIIAQHDEDAKDLTRVLPASKKVYIQGSRPDIAVPFREISLTDTPTGLAQGGLEKNEPILVYDTSGVYTDPNVQIDLNKGLPHVRQNWILERDDSEELSGLTSQFGRERLKDIRTQNIRFAHISKPRRAKLGKNITQMHYAKQGIITPEMEYIAIRENQRQREGIDMRQHQGQNFGANNLIQITPEFVRSEVAAGRAIIPANINHPECEPMIIGRNFLVKINANIGNSALGSSIEEEVAKMTWATRWGADTIMDLSTGKNIHETREWIIRNSPVPIGTVPIYQALEKVGGVAEDLTWEIFKDTLIEQAEQGVDYFTIHAGVLLRYVPLTANRLTGIVSRGGSIMAQWCLAHHQENFLYTHFDEICEIMKAYDVSFSLGDGLRPGCIQDANDEAQFGELHTLGELTQRAWAHDVQVMIEGPGHVPMHMIKQNMDLQLDVCKEAPFYTLGPLTTDIAPGYDHITSAIGAAMIGWYGTAMLCYVTPKEHLGLPNKKDVKDGIITYKIAAHAADLAKGHPGAQVRDNALSKARFEFRWEDQFNLSLDPDTARSMHDETMPKEAHKSAHFCSMCGPKFCSMKITQNVRDYAKGLDVERGLQQMKEKYKEEGSKLYHEV

SEQ ID NO: 2895 - protein, 111 aa, M.catarrhalis
NHYIGVLIKCYTILSNKSATSLHGEAMSDILNQFIPIFFVTFGIFILFFLFMGVGYFVKKKPLKGSCGGVATLMGDEHCQFCGNDPNKCESNIDKIDDTARNKLSKIAKQA

SEQ ID NO: 2896 - protein, 421 aa, M.catarrhalis
EYRMKVLVLGGGVIGTTTAYYLAKKGVQVTVIERQHAVAQETSFGNAGQISPGYSTPWAAPQIPTKAIKWLFQKHAPLAIRPDGSSFQMSWLTQMLKNCTHKRYTINKSRMMRVAEYSRDCFRQLRLDTGIDYEHRTQGTLQLFRTQAQLDQVGKDIEVLKECGVDYELLDKNSLSQAEPALAHAAAQLTGGLRLPHDETGDCNLFTKALAEICKDMGVEFRFNTTIDKITHNNQTITGVIADGELITADSYVLALGSYSRAMAKSLGLDLPVYPVKGYSLTVPIIDESRAPISTVIDETYKIAITRFNQRIRVGGMAELSGFDLNLRQKRRETLEMVTKSLFDGGDLKNATFWTGLRPMTPDGTPIIGQTDLKNLYLNTGHGTLGWTMSCGSGSLISDIITHQTPSISLDGLSLTRYQSA

SEQ ID NO: 2897 - protein, 651 aa, M.catarrhalis
IVMIAFKNVAVRREGRLLFSDVNFQLHKGQKIGLTGNNGTGKSTLFATILGTHNTDVGSISLPESWQIAHMAQEVSATAMSAIDYVLSGDEEWWQLNWQINHQTSLTDGQIAPMYQRFEEIDGYRTPAKAAMILSGLGFGEADHSKQVSMFSGGWRMRLNLARTLMHRADVLLLDEPTNHLDLDAIFWLEEWLLKFEGLILLISHDQAFLDTVCGHILHIEQGQITLYTGNYSQFIRTRAERLAQEQQAFEKQQAVRAHLEDYIRRFRAKATKAKQAQSRIKQLDRMTQLSPVMAENGFSFRFYEPQHMASPLIYLDNATIGYDGIPMLTKINLRITPDARLGILGANGAGKSTLIKALVGELPLIDGIYKVSETLQLGYFNQHQMDSLDDDATPMIMLRRLSGQTSDANLRAFLGGFGFQGERIDTQSRLFSGGERARLMLALLVWQRPNVLILDEPTNHLDLQMRNALMLALQDFAGALILVSHDRDLIMSVCDELLLVFDGRATEFVGDMADYAEHLRRAKKAHQANQKMDKSIHQQSTNTATGQEICLHDSLSKEDRRKKNAQIREQTAPLRKQIAKLEDRLGKLSDTLAILENELSDARLYEDDYKSELLDKLNHQNTLKSQIDDIEEQLLTAMAELEVLEDELSG

SEQ ID NO: 2898 - protein, 563 aa, M.catarrhalis
QRSVTVPSFWWHDCKLCTNNFANKDAWTYNILIVLLIWHLIINQVSAMTSTFTLPFWFKPSLVAGMQRGIEKEGLRMQPDGYSAKTFHPAKLGSKLTHPYITTDYSENLLELITKPMPSIKQALDMLRDLHVLVHRSLENDELMWPLSMPCMTSDTDSDIPLADYGSSNIGKLKTLYRSGLGVRYGRKMQTIAGLHYNLSVGDDLFGVWQHAEGAKDLTAFKNDKYLALIRNFKRLTPLVLYLLGASPAVCGTFVSGRQHNLIPLGTTCSYHQPNGTSLRMGKLGYTNSAQEDLDIRYNHLDEYIKGLQAAIGTPYADFEAIGVDDAHGVPIQINNHILQIENEYYSPIRPKQTATASETPTQALQARGIAYVEFRAIDLDPYSDIGITSVTACFLEILALYCLFTDSPYLMPEEEKRLNQNIDIVVNHGRQAGIAIDTDFGKENLHDWIIHHLTQMQTIADAFDAHHGSNQYRTALTMMQGKAINPDFTLSAQIIADSHRVGGTWALGKLLAQKHQTELLSHTLSRVDEAEFDELARTSLIEQAQLEATDTIGFYDYLKAYR

SEQ ID NO: 2899 - protein, 407 aa, M.catarrhalis
VHGLINGGINSILRHIFVLFMDFDMSKDFYSILGVDRTADEKEIKKAFRKIAMKYHPDRNPDNPEAEEKLKEASKAYETLSDPEKRATYDRMGHSAYEQGMGSGGFGGGFSGGDFNDIFGDIFGQAFGGGGFGGFGGGRSQQQARQGANLLYNITLTLEEAVKGCKKQISYQTSVSCHTCHGKGAVKDSDVVTCSTCHGQGQVRMQQGFFVMQQTCPDCHGTGKQIKNPCPDCHGQGKTVQQQTLEVSIPAGVDDGDRVRLAGKGEAGDQGMPSGDLYVEVRVKPHEIFTRNGADLHMDIPISMISAALGDEIEIPTLDGKVKIKVAEGTQSGKLLRVRGKGVTTVQGRMQGDLICRILVQTPVNLTSEQKDLLRQLQGTLSTENSSEPKKKGFFDKIKDDVKDLFD

SEQ ID NO: 2900 - protein, 462 aa, M.catarrhalis
IKEVFIMTTNDLAKTAVSRFLQNQIAIKSEKLQKQLTKAQEDGDVTTIGQLQSQIQEIEQRFKKSVWLDLAANRWTQWMTFGTHISKGIHLSARGDNVNFVFNRQLPNTLIGTHSLTDPVLDASGHAAALPLATFFDFDVADGLKIRDLILQNHAGFISSLSDDERMAANYHSAFKKALQNNTDNPSTHELNKQLLWHINADTACQLNELDYINIIPLYPSVLTHGVYLKINQLRYSDDNKKALENRFKSNALHTSYVSMPNLAIVQLGGSKPQNISQLTSRQGGRNYLLPSLPPKISQDREFSLSKFCENFFDSKTLKYHIQDDFNYVVQVVKDTRNTIDVRDKRKDAIDRLLHTIFGIAHVLQNKPAGWSKTYALPLAQKIWLDPYRADLDGEAKFADEKTKQEWQKIILQDFASWFNQQLRSTVKELKFDFADAEYNEWQREIEEMQKFYERLGKGVFL

SEQ ID NO: 2901 - protein, 76 aa, M.catarrhalis
MHLLPLHDRTGRLENSLQKYFALCCLHDRTGRLEISSWQRKSIFLLHDHTGRLEIIGRVSECTKRLHDRTGRLEIL

SEQ ID NO: 2902 - protein, 1191 aa, M.catarrhalis
KMPLFCRGHLFVRNKILQNKNFAKKSYKNSPSIRHWILCLVKSNWRRSILKAYKMIVTFISQCEKKALQRTRLVLDAFANRIGHNTWQTVITEDGLVMVKKLLARTASKNTAISCYRFHTRKHSELLWIVGNRHKFNEYGWVPVNQTRRNILHSEWQNDWYYISAIQIIATLAALLHDLGKSTLGFQHKLKHGSTQGDPYRHEWISLKILLWLIQDCQTDSQWLERFGRIDEWLKTQKLSALNDYLKPCNLDHADLSKLPPLGQWVAWLVVSHHRLPPLVNVFLKEQERISFQTNASTLKLYFERPLTKIYADFTANDHWVKNPITFETAHKANKKLVDFWQFDQCVIDSNAWQSRIKRWANKAIKDPTLQALSAQDKPIDNAILLYLSRLCLMVGDHNYSSLKDGDHRRVATKSSLNLLANTNRKTKQPKQFLDEHLLGVASFTAHFARYLPIIGEQLPTLLSHRLLSKNTNIERFVWQNYAFNIAKSVQADSDVHGFFGVNMASTGCGKTIGNARIMYGLSDEKKGARFTIALGLRVLTLQTGLSLRQDLQLSDEVLAILVGGGGIRQLFEIGEQHKNQDDSSTAWGSESAEALVDGFVDFASEYHAAHLELAKLNIDTLLADNKAKDLLFSPIVTCTIDHLIGASECKRGGGYITPMLRLLSSDLILDEPDEFDHNDLPALARLVHLAGMFGSKVLLSSATLPPDLVAGLFESYLAGRKLFNQSQNKPAPQTVCAWFDEQKHGSMVISCDKVETFRQQQQIFIKKRISFLQQQPIRRKAEILPVGMAYHQDKKAEFYSTLAQNIIDGAVRLHHCYHTVDKKTGKSASIGLVRIANIKQLTHIAFYLQHAQVNQNTHIHVVCYHARQLLILRNRLERRLDKVLKRSEHDEQLLFTHDDIVQQMTKSQAKQHIFMVLATPVAEVGRDHDYDWAIVEPSSMRSIIQLAGRVWRHRPNKQVFDSNILILNKNIRALQNHHGPVFTKPGFETKKYKLTEHDMTALMSDNHLSQIDARPRIWTDTIKDRPESLEQLEHTLMHDLFGANKTNYINAYWREAGASNRIHTHLQQVSPFRHSIQQDEAWVLIPNQIVDGQGDGFRVYAMEDINQNGLSHANLHNHYIQMMDFDYHHAQISTWLVCDVYDEIRRLQTHLMVRNLSHVAIQFSKVMLDSRQSQWYFSPFLGMMSERLDC

SEQ ID NO: 2903 - protein, 74 aa, M.catarrhalis
ALAFGIKYGCLKIRVWVSFLSKGLFDHLPSNKPLLSNHRLGHFDTNMDEIIKCYLIYTYVINKLLSRAGISKFK

SEQ ID NO: 2904 - protein, 182 aa, M.catarrhalis
DYFSPFTHPKELIMTMPNYRTLNIILSLIMVAGSVYAIGYLQNYLMLDPCPLCIFQRIGLWIMGIFALLVAIINPRQKLVRLILWVGSMVGTLWGFGVAARHTWIHYAPSAQPPACGPGLEYWVQTMPMSKVLTTVLTGNGDCGMIDWTLMGLSIPAQAMILFMIIALIQVIILKKILSNNR

SEQ ID NO: 2905 - protein, 544 aa, M.catarrhalis
SNHSKIHHNLSIITLTKADLFWSIKPIHTILLRIVMSKSIQSNLSSKHSQSTTPQHYLRIWRWHFYAGLFVIPFLVILAGTGLGMIILSNTVGKQGELISVSPQNTSMAVSHQAHIATSNIAGGQVTQYIAPKDDHHAAAFLVKNHDTQVANWVAIDPYTAQIVGTQPQKSGLYHTLDSIHGDLLMGKTGDLLLETAASLTILLIITGIYLWWQKRKSVIKMLTVQDTKTKRNLWREIHAVLGSWTAIVLLFFCITGLAWAGIWGEKIMQAWNQFPAGKWGVEPVPTSSLPVDTAHDDASYQQQNTADTPHHATDISAPTHGDALNDGTKQVPWVLEKTPMPSSTPTSNAWQMTQPDIDFIDNMAKNMGFVGRYQINYPKTPTGVWSISQDSMSYDSPNPTADRTVHIDRYSGEVLADIRYHDYSAFGKFMAVGIALHMGTAGIFSILANLLFCLSVIAICISGLVMWWQRRPATNLHKNNKSALPMGLIPPASQKNIPIWWGFGGVLLLISALFPMGLFAILVIVILDWLIISRVPLLSKLLK

SEQ ID NO: 2906 - protein, 65 aa, M.catarrhalis
LNSSRQKGKKYATNLVAHCTVSDDGFSVPAPSFHRYLFQPRVGQQNQPPSPAFSLYRLGHFASLF

SEQ ID NO: 2907 - protein, 247 aa, M.catarrhalis
YHSSRKTNAMTIINKMRLSVPSSRQSSEESTQRLPISDLMSGLMVLFLFIAISLILQVRQIAEEYQDTQEQIYKALLHEFADDLPKWGAKIDKDTLTISFLSPDILFKTGQSDLQDNYKEILSDFFPRYIKVIDRYKDSINEIRIEGHTSSEWAAGVDADIAYFENMRLSQDRTRTVLQFAYAIPEVSQYRPWIKTHLAAVGLSSAKTIKNESGLENAGASKRVTFRILTNADEQIQKISKSSYEEN

SEQ ID NO: 2908 - protein, 69 aa, M.catarrhalis
IALPQSSSFSVMVVLPASGWLMMANVLRWLISLVKWVVIACLFVDDVYIDVYGEIQKLNQSNKMKIIIP

SEQ ID NO: 2909 - protein, 88 aa, M.catarrhalis
IMSTFALLFDVITAPINMAFLLVMLGLFIIGWVAVGRDDGHKPRHFIDSIPTLLTSIGILGTFFVLYWLYLPLMIVISNLISMTSSRA

SEQ ID NO: 2910 - protein, 122 aa, M.catarrhalis
ARQTYIITYLSKFGVYMKLKAIATLGALALLLQACATPHVVQTKKITDNELTCSQIKSEIAEAEEFEKKARAERKITGKNVAAAVFFWPALLGTYSNTEEAITAAKERQALLTDLYSKKNCQ

SEQ ID NO: 2911 - protein, 887 aa, M.catarrhalis
IKFAIIDSYVKKTPIACQRVIMSNLFQNPTIARFMGKLPTIKQLIFSIFGIVLLVFLFLSLLSYDQTDSAWSHVGSHSTINNVGGLLGAWVSDILHTLFGFGAWVAVLVLAYELVRLWWSHVKLFWVLRLFAYGLLILFVSALLAYIGEMTNALLATRLGGAIGFELQKSLAGIFGGTVTALLLIGIIILISLLSFEIRWRYLMGLVFHWIGGDKSTPKVDLEPKPESANSTISTIPDESTSPVTSAVVSTPHNHEGVLESFLRHSGLRDELIAERDNEASKQAAKAEAENIYQETQQAATTDPMKYRHDKLDDATHLGELNESSNQIVINNNPSTVERFKTIQKVGPNFDENQATEVKTTKDTKPNQEQTHQTPKPKQSATPVQSRAMDTLSYRLSLTPIPELDLLDKPNLSNKPKVSDDELQQASELLEIKLQEFNIQAQVVSAMVGPVVTRFEVELAPGVKASRVTRISQDLARSMSKASLRVVEVIPGKPYIGIEVPNQKREMVHLLELLDTKDYQSPNNQIAIAVGKDISGKPVIADLAKAPHMLVAGTTGSGKSVLVNSFLLSMLLKYTPDELKLVLIDPKQLELANYGDIPHLLTPVITDMKDAVAALTWCVNEMERRYQLMSKLRVRKISEFNKKVEVAEAEGEPIYDPLWHINQSVSQDKPPKLKPLPTIVIVADEFADMIMQLGKTAEEPIVRLAQKARAAGIHLLLATQRPTVNVVTGLIKANIPARVALRVSSKVDSRTIIEEGGAEDMLGHGDMMFIGPGKNHPERVHGAYVDDDEVNRVCDAWRERGKPDYIDLSDSYSFEGEGSGDAGGSVAGDELYEAAAAFVVETKKPSISSVQRKFSIGYNRAARLLDQMEERGLVSSMDNSGKRQLLL

SEQ ID NO: 2912 - protein, 97 aa, M.catarrhalis
SVFYRNFGVDLMPTIAHSPDTQRFETTIDGHTAYLSYAIIDDNTLNYHHTFVPPQLGGRGVGTALVKYAVQYANQNNKTIIPSCSFVAHYINKQHTT

SEQ ID NO: 2913 - protein, 974 aa, M.catarrhalis
FFGYNIKFFIQFLNPMTAMTNTAYPNINSIPSLAKLSTDQVDTTRPPVILVDGSYYLFRCFHGLPPLSNSQGLPTNAIRGVLNALNKLIKKYHPTHMAVAFDTKAPTFRHNLSEAYKAHRPPMDEALRIQIPYIHEMIEKLGIALIKIDGFEADDIIGTLAYQACQQGHRVIISTGDKDMAQLVNDCVMLEDSFTGKLTDNAGVIEKFGVTSEQIADYLALMGDASDGISGIPKVGQKTAAKLLNEYQNIDGILANLANIKGAVGKSIADNQDSIPLNRILATIVTNLKLTISFDDITLDHSQETTIKRAPALYALFEELEFKKEMAQTAELLNLPHQPTDKAVSIDIHDNTLSSQTPILPIKDISYHTITTQQDFTKLLDKLNHTPYFAIDTETTDINWQHAKLVGISVSTADYEGYYIPVGHTADFDVLLDNQLPIDTVLSAFKPILENPNIGKIGQHLKYDAHIFKKYGINISPWQMDTMLASYVINAAATRHGMDALAKHYLGVQTTTFEDVAGKGAKQLSFDKVAMDAASQYACEDADITFRLFNRFNQHINQDKTAAQLLYHLEMPTAQILTQMEHDGILIDTDFLGQLSGEFDKKIMALQIEAERIADEPFNLASPKQLGEILFDKLGIAGGKKTKTGQYATSEAVLSKIEHPLIDVVLEHRSLSKLKSTYTDTLANAADEQGRVHTSYHQALTSTGRLSSSDPNLQNIPIRTDTGRLIREAFIAPKGRMILAADYSQIELRLMAHFSGDESLIRAFNHNLDIHTATAAEIMGKDISEVTPSERRAAKAVNFGLLYGMSAFGLAKQIEVDRAVAQDYIKRYFARYPAILEYMERTKTMAKQLGYVQTILGRKLYSPDIQSSNRMIKDAAERAAINAPLQGSAAEIIKLAMIAVDEVLPKDDAKLLLQVHDELVFEVDTDKAHDIGNLIKTAMQNALTDTAKKLGWAVDFAVPLVVEIGIGENWEQAH

SEQ ID NO: 2914 - protein, 287 aa, M.catarrhalis
ARVLMKKTNVFDELINNTKRMVDHLVEFKLQPRGPLDLQLDTKLATPKGVQIDSLSELATDETGVFAYHGRKVVLFIPDHGYGNSFDQVKNGDLNVGKKVHFTQCKTLDDMANNGRLNRYHINKNQNGLFEIVNNVGDTHTTKLMPCHNCLKILNYNDYLSIKTPAIFRQNFDFLAFFNGDYQTKFTKLPEYVGQNKGGYTEDWSTISRNFKKSKDYLCQVCGVNLSGYQHLADVHHIDGVKQNNSQNNLMCLCKLCHVNQPNHAHMSIGDEIKNQIQQLRWQQRLL

SEQ ID NO: 2915 - protein, 62 aa, M.catarrhalis
IIKYHQLIAVVCLILSNLLSQSLKDGVTKIKLPYKKQLSAMDFTAESTAFYAFLAVLFIIQY

SEQ ID NO: 2916 - protein, 888 aa, M.catarrhalis
ILRYLANLNKGIIMATSKKTTTKAEAALTKANARGKSLVIVESPAKAKTINKYLGKDYVVRSSVGHVRDLPVGGSATKTNKTQDVGLSREEKAQKALVRRMGVDPEHDWAAVYEILPNKTKVIRELKALAKEADKIYLATDLDREGEAIAWHLKEVIGGSDDKYSRVVFNEITKTAIQTAFEHPDQLNIDRVNAQQARRFLDRVVGFMVSPLLWAKIARGLSAGRVQSVATRLVVEREREIRAFVPVEYWKIHTNNTAAGETLNLEAVKKNGKTLKLGNKAQADEVVLALGSSDFIVSAIEEKPTQSRPSAPFITSTLQQAASTRLGFSVKKTMILAQRLYEAGHITYMRTDSTFLSQDALNLVREYITDHFGDDYLPQKPNFYGNKQNAQEAHEAIRPSHVLVKSSQLTGMERDAQRLYELIWRQFVACQMMPARYQSVNLMVAAGDIELKAKGRTLVFDGYTKVQPPAKTDDILLPAVKVGEKLPLIEILPTQHFTSPPARYSEASLVKELESLGIGRPSTYASIISTIQERGYVKLENKRLYAEKMGDIVTERLVESFPDLMDYAFTAGLEDKLDEVAVGEEDWKTVLDRFYHDFKQKLDYAKTTDGMRPNNPTNVPDIHCDLCHRPMQIRTGSTGVFLGCTGYNLPPKERCKGTKNLMPVSAFEFDADDDSAEVNALMEKKRCPKCNTAMDGYIVDGGLKLHICGNNPDCDGHVLEKGVFEIGGATSDTPTIDCDKCDGQMELKTGRFGAYFACRKCDNTRKVLKNGQAAPPRMTPIDMPKLRSQKFDDHYVLREGAAGLFLAASKFPKVRETRPPKLSELREIKDQLEPKFYYLFDAPDTDDVGNPTILLWSRKNQEQYVGSEKDGKATRFALVWRDGAWVQA

SEQ ID NO: 2917 - protein, 115 aa, M.catarrhalis
LIHLLKNMLNLCHHLAYFGVHMSSLTADQVALQLDSLPGWSLDGHSLVKTYHFKSFADAISFMVRVAFYAEILEHYPIWENNHTSILVRIGTADQHAVQSRDVQLAKRMQSAFAA

SEQ ID NO: 2918 - protein, 262 aa, M.catarrhalis
ISCQPCRTVCQATSQTLRGSIMNWNWQAIINYFPDLLAASVTTIELVVLSCALGLVFGVILGLWRLSPVLWLRAIPATYIFFFRGTPLLVQIFLIYYGLGQFTALKESFLWDPIFSQAYWCAIIAFTLNTSAYIGEIVRGAVMAVPTGELEAADAIGMSKQQKLHRVILPRAFGIMIPAYSNEVIFMLKGSALAASITVVELTHKARDIISITYLHLEMFFAAGVIYLVISWVFLFIFRQFEHRVNRHKRYIPPAVNPNPPI

SEQ ID NO: 2919 - protein, 129 aa, M.catarrhalis
AFCLLITVLNYLPHSLILNAMLICPICHLSLNFTKKTYQCANQHSFDVAKGGYVNLHLVQHKKSKHPGDTPAAVQARRAFLSAEHYQPLKSEILNMIGNIRPKTILDIGCGEGYYTQALGSICDHVIGA

SEQ ID NO: 2920 - protein, 63 aa, M.catarrhalis
SLPKYLLMVLAFAGDSTITKDLPRALALVNAASALVVVFLEVAMIMPLFKFAKYLRIYPESLG

SEQ ID NO: 2921 - protein, 751 aa, M.catarrhalis
VIIKQFMTTQIDTRSVSDFTEYAYLNYAMYVIMDRALPHIADGLKPVQRRIVYAMSELGLKHTAKPKKSARTVGDVLGKYHPHGDSACYEAMVLMAQPFSYRYPLITGQGNWGSPDDPKSFAAMRYTEANMSRYADILLGEIEQGTVDWQDNFDGSLSEPVTLPARLPNILLNGTTGIAVGMATDIPPHNLHEVVKACIRLLKNPELSTKQLVQTLPAPDLPTTAEIITPKNDMIAMYETGKGSYKMRATYHTDPKQNHLVIINALPYQVSGNKVVEQIAKLMMDKKLPWVTEIRDESDNLNPCRIVIELKKSKLNIDKIMSHLFANTDLETSYRVNMNMIGINGKPEVKNLKSILLEWLSVRKSVVIRRLQYRLDKINERLHILAGLLIAYLNIDEIIDIIRTAEDPKIELMTRFGLTQTQANAILDIKLRQLAKLEEIELTAEHDRLEAERLLISEQLNNPEMLTKLLIDELTADAKTHGDARRSPVVQRAESSSLKAVDLIASEPITAILSQAGWIRAAKGHHADPAEMNYRTGDAYLTHALGKSTERLILVDNTGRSYGLDSIHLPSARTQGDPITSLLNLPAGAKIDQLLFYNQTNGSPNVLMASSLGYGFINQLANLDTAQKSGKSSINLADGVLLPIVVMQDDDSLVAVSLSNGNLLIFASDELPKLAKGKGNKLANLKAGETITAITALSDTDALVITAGKRTLTLNPNDIANYIAHRANRGNPLPKGFGKVSNMTKLKKDTE

SEQ ID NO: 2922 - protein, 296 aa, M.catarrhalis
DRMKKDHMKITTHTDTGSVIGSLWMVVGAIGFSIMGLLVKMTGTRFEMHEYELVFWRVVFAATVLGLQAALTKKQFSTRYPQAHFWRSLAGTISLFMFFFGLVHLPLATAITFSHTSAIFLAIFSVILLKQFPSRLTWFALMLGLCGIMLILRPSILGHGLLPTLIGLTSGAMAGYAYLQVRELSLLGEPSWRIVFYFAVLATLISAIASTVVGWTPIQPQMLPYLFGIGLFAMIGQLSMTHAYKVGRKFMVSALGYLVVVLSMLYGVIFFDEVLPVMAMVGIVLVIASGILAGKK

SEQ ID NO: 2923 - protein, 70 aa, M.catarrhalis
ELRNVADSLTQLSINKRLKRCEITTLKPNTYFLPAKMPLAITSTIPTIAMTGKTSSKNMTPYSIESTTTK

SEQ ID NO: 2924 - protein, 162 aa, M.catarrhalis
LGLDIAKSAIQTAAKADGSKQITWVVATGSVLPVADKSMNVCTSFFSPLPKDEIRRVLCDGGYLMVAVAAPNHLYDMRAALFETVVAHHPNKSIQRLAPEFCLVDQAYITAPMHLDNTALKNLIAMTPYAYKAKSERRAALECCESFFVQGEFCIFLFKKLQ

SEQ ID NO: 2925 - protein, 114 aa, M.catarrhalis
AFYRQYSHIADIHRHFGNFFCIVLALLAFDDSDIKSHINDIISGMKTAFITSVTGLLLSIILKIWASIHQDKSENLDLDKWMPAIYLNLLNTILQSKPTHKKRPLLFMKSCYKH

SEQ ID NO: 2926 - protein, 275 aa, M.catarrhalis
FYCRQFLLTQGIIMIKPFATLATVACVTLAGCTKEETSTQTTAPAQPSQKSIVIATEAAYPPFNDTDASGQIIGFDVDVMNALCAEMHAHCQIIAQDWDGLIPSLLAGKYDAIIAGMSITPERQAQVDFSDSYFSNTIVWLAKSDGSFDPNNITNQTLASQRGTTGAAYITEKYDGKDGNRVQLHDTYTNAYLDTKAGRNHAVMAEKVSAIDWLKQEGNGEFGLIGEEIDNNDHLGIAVRKGDSLKAEFDAALAKIKESGKLAEIEKAHFQSDTF

SEQ ID NO: 2927 - protein, 69 aa, M.catarrhalis
KVIRTMPHNQPYKTIRQSLNTHQSVNVRVGMMIKSVIDKMTLYHQLTTLNENYVTYMSLKCSLANHIHA

SEQ ID NO: 2928 - protein, 138 aa, M.catarrhalis
NEPSSPPPDNLANINKKPSILLRFWYWLTLKVYYDKLLTKGAASYLTIISVLVFMAAFAEGFAWGHLGSTFTHDNPWLGRIGLGCFVGFALLFFDRQMITADFLEDKHKDSYYHIFTILKSLKRLLVLWVRCRVFGII

SEQ ID NO: 2929 - protein, 166 aa, M.catarrhalis
LSDGLIRLIMWHRSYHLLNIKFYPNAKPHQLSKRHRSWFGWVLAVLAWLMLLMPMTSSLWVEKPKIGYNICIKLAPIINHINQSHQTHTHLHQAHTHFSKKDNQTPHQHDCDICLSAMSFALPAGALGLSGHILQFNRQLGAFYRQLRLQFLFFLRPPSRASPDYS

SEQ ID NO: 2930 - protein, 108 aa, M.catarrhalis
VTQGYLMNKFALIIATALGLSACVAPVSDQGSAMIIGVPVGVPVLIDKSTHNHQDDTVHVCKLKAFTDTFTAENQSRGKARLAVKKKCLAANHEMFCRDNIIECTEYH

SEQ ID NO: 2931 - protein, 286 aa, M.catarrhalis
GRIILIIFFMKLYRFFLTFVLICTFLGFFMTDSRPIALDLQDIHKSYGSLEVLKGVSLTAYDGDVISILGSSGSGKSTLLRCINLLEKPTSGKIIVGQETLKLKSHKGELVAADNKQLEKLRSKIGFVFQNFNLWPHKTILQNIIEGPTQVLGISKADAIKDAERLLTKVGLLDKKDAYPDNLSGGQRQRVAIARSLAMQPQVLLFDEPTSALDPELVNEVLAVMRELADEGRTMLIVTHEMRFAREVSSKVVFLHQGRIEEIGTPKEVFDHPKSARVREFMASHR

SEQ ID NO: 2932 - protein, 268 aa, M.catarrhalis
EVIMTTVLKFTTAAFCVSLLAACSNESTTNTKTTAAPNSSTSQKELIIATESSFKPFSYLDKQGQLVGFEIDLANALCKQMQADCQIVSQDWDSLIPSLNANKSDAIMAGMSITEERLNAVDFSEPYFDNTLVLIGKKDNTATINDIAGKAVATQQATVSAEYLQKHYPDANIKTYDKQDNAYLDLTAGRVEFMLSDVVPATDWLATEAGSEFEIKGMPIDIGDKVGIAVRKDSSLKADFDAALASLKTNGKYDEIVAKYFNSQALGQ

SEQ ID NO: 2933 - protein, 78 aa, M.catarrhalis
FTLIRVLNCGYLITNLVIHEIAFLPDETVFLLGGRSVLDASGCVPPVNHFHYFWLLAVDALHNTPNPLLYYNHHKGYV

SEQ ID NO: 2934 - protein, 570 aa, M.catarrhalis
ATVIVSSLDVIYGIIIFILFDWFNFCISPYTSMYTSSTKRQAMTTHLTNEINQRRTFAIISHPDAGKTTMTEKLLLWGKAIQVAGEVRGRKADRHATSDWMSMEQERGISITTSVMQFPYKNHVVNLLDTPGHADFSEDTYRTLTAVDSALMVIDGATGVEERTIKLMEVCRMRDTPIISFVNKLDREIQNPLALLDEIESVLKIKCVPFAYPIGMGQDFVGVYSFVDNKTYFYKKGFGSQIVEIESKDGYDHADIKDRLGQILWDEFIENIELAQMAYEDWDEREFLAGRQTPVLFGTALGNFGVNMILDVLTQYAPPPKDHVAVERTVKADEPTFTGFVFKIQANMDPKHRDRVAFMRVCSGKYERGMKMNHVRLGKEVRVSDALMFLAGDRETLDEAYAGDIIGLHNHGTIQIGDSFTSGETLNFTGIPHFAPELFRRVVLKDPMKSKQLQKGLQQLSEEGATQVFMPQINNDLILGAVGVLQFEVVAHRLLEEYKVQCTFEPISIATVRWVYSDDKVAFEKFKKKAHDQLSVDGGGYLTYLAPSRVNLQLMQERYPEVEFRATREH

SEQ ID NO: 2935 - protein, 372 aa, M.catarrhalis
GRLMTLHTIILAAGKGTRMKSNRPKVLQTLAGKTLVQHVLDTCTQIQADGTILVYGFGGEMVKEALSTHTVIFAEQTQQLGTGHAVKMALPHLPKEGKSLILYGDVPLTQAETLQNLVKANTSGISMLTLTVEQPFGLGRIVRNQGKVVAIVEEKDADTQQKLITEINSGIYCVDNALLHKYLPILNNNNAQGEYYLTDIIKLAVDDGVEIVTIEPKFAFEIEGVNDRIQLANLERDFQSHQIHQLQIAGVQFADPNRVDIRGKLTCDRDVFIDINTVFVGDVHLGMGVQIDAGNVITNSHIGNQTHIKPNCVIDDSMIGQNVSIGPFAHIRPKTILSDDVKIGNFVETKKTTVGVGSKINHLSYAGDSLDD

SEQ ID NO: 2936 - protein, 201 aa, M.catarrhalis
DDMMSLSSESIAVIVVLVVAGFLVGNFMAARPNANQMRVADFRLMARHSGIFPKLITCPNWLKDRYDTLKPTKKDAYARADSMPWVAQYTVIIEDLRLPMAQYHVMADCWHLIPQQFYTPKMLTQVRRLDEQPIHLPEHIKAQVLGLSMKANHISLYWLDDKYQHSQKAYKLDKIKAQSDLNDIKTQLMAWAKLIDGGKSP

SEQ ID NO: 2937 - protein, 243 aa, M.catarrhalis
GTSVFDLQGYGPILLQGTILTIKLGLASLVFGLLFGLLGALAKLSGVWILQKIADAYTTIVRGIPELLMVFFIFFGGSIILVTIAKQMGYTGRIDVSQFWAGVTALSIMFGAYATEVFRMAIQDIPKGQWESAQSIGMTPTQTLTRIILPQMWMVALPGLGNLTLVLLKDTALVSLIGLQDLMYFAQRAAQSTQKPFTFYLAAAFIYLALTSVITLFIMWCESRANPAARYAKLLHKRSGGQS

SEQ ID NO: 2938 - protein, 345 aa, M.catarrhalis
FRQVDASNILKFIEHHLTEQTNTQKKTAVIHEELLQALTTHHEYVKQNNQQFAANLWDKLEKTAQILTKSATEEVILALNQLIKDFNHQLTEQFGENFKQLNHAVFELIQWQENYKQQLEQMQVQYQNHTNAVAATQQAIDNIHDNLSHIAHHAQSIPDSMERLAVAIELSHTQIDTLYDHLAAFADMKDKAVAALPSLSEQIDTMLQGMDDASQKLTEQFHQIHQSIKAQPSIMQSTTQELKNTLERLVGQLEIDIKNITEKHAGSIKEQMNQLSNIAAQTLEDISDSIEGQINNFNTAEAKKIESDLQQMGSALISMTSQFTKDYKELVNHMNNIIRHGRPMR

SEQ ID NO: 2939 - protein, 563 aa, M.catarrhalis
RQLLPYLHNIEKPQASSGFVGKVQGFWYYLRSLKIYLFLVCRLAIILGSLYVTAPFLTQILFKTDIEQKQFEQYEQSIESAKNEIIGKIDDEIRAKKEKINSLRVKLDTEISGGRGTGRGKGPIAQNLENEILEHKAELETLIKDRNDKEKKIEDVIIGYNDKTLDEGVLTALGIKVAKDSPLFRERAIEQLEKDSAYQKVKQAVDFFLLGLGLILILGKFFQTKSVQLYFSEILQEKWLKYERGVFDEYLNPTERSSSLLPTTTAFPAEFEAMMVRYNNNISEYESQERQKRDKEKSDHMAQQAYFLGRAKEYKDSHAEFHNRAYNQEVTDLALAEIDAQERAYLAKYGKNYYKWSHEKQALSDELQAIDKEYKSKQNGRQEYEEERLAKLEQVQRDLDILKVKVVGSEHDYTLEGTKTYEHIQKSIAYHKQQIKALEDAHLEYDENLVKLAKQMTYLTQEIEGLNLKLKPYYDKLAEFEQYREVIYQKRLDYMSDHIKHNPYDDYNTEEDLAYYAKHLQQEAKNSESGLLGARTHWHRVPSDPQVKIPSHQAEMLSHESQD

SEQ ID NO: 2940 - protein, 266 aa, M.catarrhalis
IVKFKTFGLMAAIVGTFSISACSGQNEQSTKASGDTLRIATEGTYAPFNYTNPDGSLGGFDVDIANALCNKMQTECQIIAQDWDGIIPALKTGKFDAIVAAMSVTPERSEQVDFSEPYFVNSLVFLAKKGSNFDPSSTDAINNAKIVAQRSTISSQWLTQTYPNSKPQLYDTLDNAFIDLGNERADAMISDKLPALTWLSSDLGQNFEIKGGDININDKVSIAVDKGNTALLQKFNEALAAIKADGTYKQIVIKHFGEAGMPTNIE

SEQ ID NO: 2941 - protein, 78 aa, M.catarrhalis
FMGSLSITHWLILLVVVVIIFGTSKLKNAGKDLGSAVKGFKEAVKEEEKPKITNNDGKVIIAEEVKVEKPKDNRSADL

SEQ ID NO: 2942 - protein, 463 aa, M.catarrhalis
PLTSDNDAAVYQSRQIKIQAKLYLPLVWLVGGMANDDKTTNRRQFLTKVGVGSVAVGIGTIGLAGCQQGHESKSDRQTEHTPKPNSPPNPKQAGEQNTNVKHCLADNQYDFYGKHQAGIITPAQRSIYFLVLDLHTDKLDDIKEVFKQWTQYAARLTKGDNIAPYGSNPHVPPVDTGEADSLGAYGLTLTFGVSPSFLQKLNLTDKKPPEFSDLPKFPRDQIRPEYSGGDICIQACSDDPQVSFHAVRQLVRQARSSVSMRWSQSGFLGFDSGNQTARNLFAFKDGTANSNTLDHADKHVWIQQPDWLKDGTYLVVRRIQMHLETWDRTSLNGQDETFGRHRDSGAPIGQSDEFAHLDITAKDDEGNFIIPEISHAGLAKRSGLQLLRRSYSYASGIDPKTGQFDAGLLFISFQKSPMQFTAIQSSLGRVDKMNEYITHIGSGLFACFGGVKQGEYLGQKLFE

SEQ ID NO: 2943 - protein, 558 aa, M.catarrhalis
LMPPMTAVLPSLAPLILQHQLMTEDALSKAATDAKNLQRSFVQHLVASGLIDAAKLLHIQSLSYNLPIYEPPSQLSQVVETGLDPALFIKYRMLPLSCDKHTLTLAMSDATDKDAIGAMRFHARRQIRPMLVEEDKLSALLDRLYLDTDTFEDTQKIGPNSQATTDDAPTVGFVNKLFTDAIRLKASDIHFEPYDASYRIRFRIDGVMQVIHNPPKSMAAQIASYIKVMANLDIAERRRAQDGRLKFDAQDGQSVDFRVSTLPTLHGEKVVLRLLDSAQALIGLDALGMDDAQKQLFIHALSRPQGMILVTGPTGSGKTVSLYTALMRLNQPEINILSCEDPVEINLAGINQVNINPKVQLDFADALRAFLRQDPDVIMVGEIRDTDTAQIATTAAQTGHLVLSTLHTNSASDTITRMHSMGVPSFHLASSLSLIIAQRLARRLCDECKKPITIPDEALRLAGFSDQDIAKQPTLYAPVGCHKCKNGHKGRIGIFEVLPITPPMAELILTQASAAKIDALARTQGHDNLRQAGIKKVLTGQISLTEMHRVTSESWLNH

SEQ ID NO: 2944 - protein, 274 aa, M.catarrhalis
SPSPSTACTLLAKSYCRPLIKSTQPPPMKSPNPPTDDVSLMSHFIELRGRFIRIFLAVLVVFLALVGFSRELYDLISNPLVALLPNESSLIATDVASGFLAPIRLTFFTALFITVPFILMQIWGFISPGLYHHEKRTALPLLFSSIALFYLGVTFAYFIVLVPALKFFVVFAPDNVLPMTDIDSYLNFVIKLLLVFGVMFEIPVVTLILVLMRLVSIASLTNKRRYIIVGCFAVAAVITPPDGASMLMLAIPMCLLFELGLIMAKLLVKTPKAP

SEQ ID NO: 2945 - protein, 110 aa, M.catarrhalis
HEFTRYSGVLFKKGYCLKSNPPNAIGGFLMNIQAVLNDSPHHDLGLVTGGLPDSMTPLVTITSAISVMLGSSYIVSISAFSMIERKPRAPVFRSWARLAMAVSASGSKVN

SEQ ID NO: 2946 - protein, 215 aa, M.catarrhalis
GLITAPVSGIISAKNAQVGAVVSGTPLFSIIIDGMLEWQAAVPPADAANIHVGQTASVEIAGRQVIGGVARLSPVTNDSRDITVHVRLLRDSGASAGMYQSGEFLFDAQRYNAIPLSALMGLDGYDYVWQLIPNIGDDGRTYHQVKRRQITIITQQDNQVAIDDLPQSDLIVATSASFLDDDLVIVVTINGQDVDHNQTSKAPKPALNPSHGNTR

SEQ ID NO: 2947 - protein, 365 aa, M.catarrhalis
CYATIYRSKLVTPNANKTRPVVALVLGGGGMRGFAHIGAIKSLEAHGIRPDMVVGTSAGALVGAVYASGKTPSEMIALADTVKETDLIEITPSQQGLIDGTRLRHYVNEQVNHRPIEAFPIRYAAVATQMHTNTAVTFRTGEAGLAVQASSSVPKLFIPPRIPKIGGKKYVDGSQVALLPTRIAKSLGADIIIAVDVMGEKQASPNSNALPTQGSSINIQRNHAGISATWGDKTMTAPVNLDKLNQTARGLPIDIPLGDLLGVIMQSIPTNTNISLPKQLPTKTSEFARWFGNLGANLTAEPEDIRAADVLIRPKMTGAAVFDSTDRTRLINEGRLATDAQIPAIKKAIKDAHTRKRTQIQTAQS

SEQ ID NO: 2948 - protein, 118 aa, M.catarrhalis
GNNTRFTKNPGQSLTTIGVLPIFCANATVVAMAISLVFSPRITSTNGMRCTGLKKCIPTKFSGRFRAFAKRVIEIVEVFEAKMASCFTKPSTSDNTASLIVGFSTTASITISTSPKSP

SEQ ID NO: 2949 - protein, 67 aa, M.catarrhalis
SKITMNYIISLVRRWLTNAILCHDCVEILQIFTNILQFKGIGMTYFGYKFGCELVEIGLTMMANAKK

SEQ ID NO: 2950 - protein, 1319 aa, M.catarrhalis
QRVTTMMSTIAGLEFLTDFQAQKLADQLKQKAGLNIYTLSSQQVYVFDTPLSESDHQKAIDLLNQGQTPSLKTADDTQIQVVVAPRFGTISPWASKATDIFNNCGVTIGRVERVIVYTLTGENLPKRLPAIAESILHDRMTQSLVYELSDVSVLFVDGEPAHLSVVDILGMGKDALVQANAEYGFALSDQDMTYLVENFTKLGRNPTDVELMMFAQANSEHCRHKIFNAEWTVDGEVQPKSLFKMIRNTHEQNPEGILSAYKDNAAVMEGFVAERFYPTKTTEGNAQYGFHQEQIDILMKVETHNHPTAIAPFAGAATGAGGEIRDEGATGRGGKPKAGLTGFSVSHLHLPTMPEKWETTGQVSAVSYGKPSRMASALDIMIEGPLGGAAFANEFGRPNLNGYFRTFQLDISDHQDGSQMRGYHKPIMIAGGYGNIKRDLVQKNAIQEGDLLIVLGGPAMQIGLGGGAASSVDSGKLDEGLDFASVQRDNAEMERRCQEVIDTCWAMTKDGMDANPIISIHDVGAGGLSNAMPELVDDHELGAHLNLRKVPSLEAGMSPMAIWSNEAQERYVLAIRPESEALFDSICSRERCPYAILGTATTVRQLIVDDSLLPERPVDMPMQVLLGGTPKMKRSFNRTEFALKPLDTASVNIKDSIKDVLRHPTVASKSFLISIGDRSITGMVTQDQYVGRYQVPVADCAVTSTALNAITGEAMAMGERAPVALINPAASARLAVAEAVTNIASARIDKISDITLSANWMAACGDEKEDAALFDAVHAVGEELCPALGIAIPVGKDSLSMKAVWSEDGVEKSVTSPMSLIITAFAPVQDVSGTLTAALNNTDSALYRIDLSSGKLRLGGSILAQTLNQLGCDCPDLERPEDLANFFAFIQAAAKAGVIQAYHDIGDGGLIASVAEMQFASRMAITLALSDENLLGQLFAEELGAVVQVLPDDVPAFVDLAKTHGVSEFVSLIGQAKTTPAGGAGLDVLSITTPSQTLSFTRSELQKQWTKVSHAIQSLRDNPICADQEFALIDDINHHGLIADANYDLDLAVEAPYVNSRTTQPKVAILREQGVNGHLEMGAGFVRAGFDAIDVHMSDLMSGRINLRDFEGLVACGGFSYGDVLGAGSGWANSILFHDELRMQFARFFHRPETFALGVCNGCQMMSQLKDLMVGAESFPRFIANKSARFEARTVNVRIERTKSVLLKGMQDSILPVAIAHGEGYANLDDKSMADLTYHGQIALRYVDSQGNPTEHYPLNPNGSPQGITGICSNDGRVTLMMPHPERTLRTVNHSWKPHEWTNDGAWMRLFRNARAFLR

SEQ ID NO: 2951 - protein, 271 aa, M.catarrhalis
IPMTINTHWLDTLKFNEQGLIPAIAQDRQTGQVMMVAWQNKMALEQTLKTKEAVYFSRSRGKLWHKGETSGHTQIVHDIYTDCDHDVIILSITQIGGIACHTGRRSCFFKKLDDQGNWQITNHVIKDPDQIYGNNQQTATKNNASNITATITQSSSDVLSRLDATLNERKNANKDNSYVASLYHKGLNKILEKVGEEAVESIIAAKELERAKNTNENCDKLAHDLVYEVADTWFHQMVALSKLGLSAQDVIDELAYRFGISGIEEKNSRTK

SEQ ID NO: 2952 - protein, 409 aa, M.catarrhalis
FKMTITNNQETKFPVLWVMMLGVMIAIGPLSIDMYLPAFPSMAEDFGVNVGTIAKSVPAYFLGLVFGQLFYGPFSDRIGRVRPLYLGMSIFIIASIICATTNNEYALFIARTLQALGACVTTVVTRAAIRDTLNPVQSARAFSLMVLVMGVAPILAPSLGALILKVADWHGIFWFLASFGVLNLLLTKCFLKETLKPENRNTRPMSESFGQYFGLMKDHTFMLPAVASGLLQGAFFIYLSISSELFMVNYRLTEHQFAIAFGVNAFGFIALTQVNQFLTKRFHLVNLLRTGAVIQLAAAGVLLILGLIFGGKASFYWVFVSLFICIAGLGLTQPNATAIALAFQKKRAGLASALQGALQFSVGIFGGLLIGLFELDPVTRLGITTSILVVVGTFLVFYINPKLDLSRLD

SEQ ID NO: 2953 - protein, 237 aa, M.catarrhalis
NCATCAVPSSPVVKTQTENTMSIKHNPYYDQLTDALYAPNNALVPMVIEQSGRGERSFDIFSRLLRERVIFLTGQVEDNMANLIVAQLLFLEADNPEKDIHLYINSPGGVVTAGMAIYDTMNFIKPHVSTICMGQAASMGSFLLSAGEKGKRYALANSRVMIHQPLGGFRGQASDIEIHAREIIELKAKLNRLLAEHTGQPIEKLERDTDRDHFMSAEQARDYGLVDVVLDKRPKNL

SEQ ID NO: 2954 - protein, 127 aa, M.catarrhalis
HVDACHDWADLLMGIATKNSILLVDYAIIAQDEQGLSCFDVLIDACRKRAQPIIMTTIAMGAGMLPLVIGLGGVDSTFSRPMASAVIGGLVTSTLLSLVVIPVFYALMDDLGNWLKKPFNKRHRQIT

SEQ ID NO: 2955 - protein, 205 aa, M.catarrhalis
RLYFSGDCGIYLFKRLASHFCGSHGIAIVYYSNFFIMYLFGFSLNMISLLALTLVIGVLVDDAIVEIENIVRHLNMGKSPMQAAIEAADEIGLAVVATTFTLIAVFLPTAFMSGVVGQFFSQFGWTAVIAIFISLLVARLLTPMMAAYILRPSIHTQKPAGKLMTVYLQIVLDAKASHHDSRLCIGIFYCLADVGIFFAIGIYST

SEQ ID NO: 2956 - protein, 448 aa, M.catarrhalis
LFGAFMNSVSTYQNTPALTPVHWFRNSAPYINTHRGKTFVVMFGDEAVARDNFSTLIHDFALLHSLGIKLVLVHGVRPQVEKNLQNRKLISNLHENVRVTPYESMPAILEAVGSIRLQIEARLSMGLANSPMYGSRIDATSGNFVTARPYGIRDGMDYQMTGEVRSIDVDAIRHNLDNDHIVLLGPTGFSVTGEIFNLLAEDVALTTAIALQADKLIFLGEQDGIIGQDGRLLHELIPNEVDRLLRDCDDHEEISHFLRCAASACRQGVHRTHIISYAKDGALIEELFTRDGSGTLISHDPYEEIRHATVNDVIGLLELLKPLEEQGVLVRHSQERLEQEIEFYNVIERDGTILGCAALYPLDAQSAEVASLAIHPDYRKSSRGADLLAFLEQQARSHGRHQLYALTTHTAHWFIEQGFSEVSVDELPKARQRKYDHSRNSKVLKKLL

SEQ ID NO: 2957 - protein, 251 aa, M.catarrhalis
LANLRAKIMMIKPILWQIPVPSDETIQGLDAKIKTLHARLSDIHAKHHTVKFASSLQAEDMVITDALANSHLSTEIFILQTGRLNAETLKLIDIVKACYLTINFKTYEPHPHAVADYVANHGLNAFYESGDLRKLCCFIRKVEPLNRALVDADAWLTGQRREQSVTRTELNLAETDLARGIAKYNPIFDWQETDVWAYILTKNIPFNELYHQGYPSIGCEPCTMPVKQGEDIRAGRWWWEHKDNKECGLHK

SEQ ID NO: 2958 - protein, 64 aa, M.catarrhalis
RLGYGRCDIASIIFGGCLLVVTINLIRVFDDMVGNLPVALIIEFFKKAGTTPCVTGNPTNLRDR

SEQ ID NO: 2959 - protein, 226 aa, M.catarrhalis
ILGYRNLKIMSMFDDYSLALFADCTRLTDSQIIHKWIQHWAYTMPELSEEQVKDVVRGFQIQRLPARSYWQVAGQVQDHIGVILAGLCKLEYQSDQGSVVNVHFMQEGDGIGEYHAFLGDEVCRYSLQTIEPSIIIAISLAHYEYCCQRYPIFYRYIGQNLTQVLAQNIARIDSLLITDGQTRYVRFIETNPKLAARISVSDLSSYLGMSRQMLTRIRKKLGHRRA

SEQ ID NO: 2960 - protein, 193 aa, M.catarrhalis
YERYDDMFGEIIMHPLAQSVLEFWFSKDAQPVWFAKSFEFDQKISQQFGKVLESATAGECADWRCDILGRLAEIIVLDQFSRNIHRDTPKAFENDGMALVLSQEAIVLPEFESLALDERKFMLMPYMHSESKLIHKKAMTLFEQFTDATTVAYERRHKEIIDEFGRYPHRNAILGRVSTIQEQAFLNKPNSSF

SEQ ID NO: 2961 - protein, 455 aa, M.catarrhalis
YMFHPPNDTMRSMAMGEYKKHWWGLVITLIIAFILLGWGGFEIYRTTPPIPDKFVDSSGQTLITKQDILDGQSAWQSTGGMQLGSVYGHGAYQAPDWTADWLHRELVAWLNIKAQADHGKAFDELTSIEKMGLQQQLKEEYRGSSMGSDNTVMLSDTRIAAINQVAPYYIDLYGDTPELASSRESFAMKNNTLPDLTARQNLAHFYFWTAWTSSANRPGTVATYTNNWPHEPLIDNVPTAENVMWSIASVVFLLAGIGLLIWGWAFLHKQEEDDIKVTVPKQDPLSLIELTPSQKALAKYAFLVVALFVVQIFLGGFVAHYTIEGQDFYGIPVSDFIPYSLARTWHIQSALFWIATAFLAIGLFVTPIIHGGKDPKYQKLGVDLLWVALIIVVVGSYIGQYLAIAHIMPAHLNFWFGHQGYEFIDLRAFLANPKMGWGVVLAGLDVAWCTGWLLK

SEQ ID NO: 2962 - protein, 130 aa, M.catarrhalis
KDNQMSHLNTHAPLRFITAGSVDDGKSTLIGRLLYDSKALLTDQLYNLNNTKTAGDAIDFSVLTDGLLAEREQGITIDVAYRYFSTAKRKFIIADTPGHEQYSRNMGTGASPAHAAVVLIDASQIDFGTT

SEQ ID NO: 2963 - protein, 727 aa, M.catarrhalis
KSDQNGRIFAFLTELFYNHDCVSLFMDKFMTKPVMTIHLPVTALSGVGQALAGRLAELGIHRIFDMLLHLPRDYEDRSRVIAIKDVSHGMSVLVAGVVTWVEKNRTGLSVTLEDATGEITLRFFHTYPSLLTTMMVGAKITVFGEIKVSRYGTQMSHPDYHLTGTKKFESGLLPIYPTIKGINQNKLRQLVRLALTAVQQDGIHGLSETQLKAAGVELTGDLLPALKAVHLPEIHADIFSQTALLAGLKDRTHPACRRIIIEELVAHQVSFLFRRNHIYQYKAPKCDPISPLAKQLVAGLPFELTAAQKRVIDEAVSDMATSRPMLRLIQGDVGAGKTLVAAMTACYALDSGWQVAVMAPTEILAEQHLINFQKWFEPLGIGVGWLAGKQTAKERTAALDAIRKNQVQIVVGTHALFSDTVVFAKLGLVIIDEQHRFGVEQRLRLTNKGVSGGAPHQLAMTATPIPRTLAMSMYGDMDVSIIDELPPKRTPITTVTINRDRRDEVIERIQNNCQAGKQAYWVCPLVEESSALDVQSAQLTYEDLSDRLDIRTGLIHGKMKAADKQAVMQAFKAGDIDLLIATTVIEVGVDVPNASLMVIENAERLGLSQLHQLRGRVGRGSAKSFCVLLYQLPLSPTGIERLNVLKDSTDGFVIAQKDLELRGAGELLGKRQTGDMGYYLADIVRDEALLEAAGDIACQLIKTSDKLPTALAIMNTWLPESKDYVNV

SEQ ID NO: 2964 - protein, 724 aa, M.catarrhalis
LTSQGVFMIYQGKNIQVDFFDQTQGIVQFHFNATDESVNKFDRKTTQEYQEAVTVLENRDDIQGLIVTSGKSVFIAGADITEFTEYFSRSKDEIEAWLLDINHIFNRFEDLPFPKVAAINGAALGGGCEMALVCDYRVAGISAQIGLPETKLGIFPGFGGSVRLPRLIGIDNALEAIATGKAYRPDEALKLGLVDAVVADELLEQAAADLVKKCLLGKFDWQAKRQEKQVPVKLNQLEQAMAFNSAKGVIFAKANPKHYPAVAIALETIEKHANLNRDDAIALEAKGFTKAATTPQAAALVGLFLNDQTVKKLAKKHSQNAQTIKQAAVLGAGIMGGGIAYQAAVKGLPIIMKDIQAKQLDLGMNEAGKLLSKEVLRGKSTPAKMAQTLSHIRPTLNYGDFGEVDIVIEAVVENPTIKEAVLSEVEGLVKQDAILASNTSTISITRLANALKRPENFVGMHFFNPVHRMPLVEVIRGEKTSDIAIATTVALAQKMGKTPIVVNDCPGFLVNRVLFPYFGAFDLLVKEGADFVSIDKTMEKFGWPMGPAYLLDVVGMDTGVHAAKVMAEGFPDRMKPDYKGATQLMFEHERLGQKNGVGFYQYETDKRGKPKKIADSTTYELLNLVQTGDQTFDEQEIIDRMMIAFCNETVRCLEDNIVASPAEADMAMIMGVGFPPFRGGPCRYIDQIGVANYVALCDKYAYLGKAYEAPAKLRDMAQNGETFY

SEQ ID NO: 2965 - protein, 600 aa, M.catarrhalis
ILTNQKINHQRPFNPFFMSVKHRLCFGFYMTYNLTKSPMTPSKPSQDSANYLFLVLPRFALLWVCVALIPVSILFHIWWLLFIATCLTCLGVYNISQKRHAILRNYPISGHIRFLFENFRPEVRQYFIEGDREEVPFSRMQRSIVYQRAKDVDSTTAFGSLNDLTKPGTDWFLHSGRSHTIKNHDFRVRVGNERCRQPYDLSVFNISAMSFGALSAAAIESLNKGAKEGGFAHDTGEGSISPYHQKHGGDLIWQLGTAYFGCRDDKGRFNPEAFRQRAVLSQVKMIEIKLSQGAKPGKGGVLPASKITTEIALTRDIPMGIDCISPPTHPEFSTPTELVHFWQRLRELSGGKPVGFKLCIGMPWEFMAIVKAMIKEDNYPDFIVIDGAEGGTGAAPIEFMDSVGMPLVDALIFVQNTLVGAGIRDKIKVGVSGKVISGFDIARLMSLGADWCNSARGFMFAVGCIQSRSCHTNKCPTGVATQDPARQKAIDIPDKSRRVSNFHKNTLKALAEIVGCAGLSHPTELKPHHIVRRQPDGWIKLLSEHYQFIETGSLLTGDCGRRVLDDMWKLADPNSFQAMTIADKIVGAENKRNRTIESLY

SEQ ID NO: 2966 - protein, 340 aa, M.catarrhalis
SFYKNILYSVLIIIIIHIIMIIYRLSVIDYLNHVKINYLGLIGQLVIQTFSKYALLSASILTLTLVACQKPADKPTEPVQPAQTQDGHEHYKTDDDTMVDLSAETAEYKHWVEGQMEILLEQTQKFVALLDAGQLEEAKALYPHARIPFERSEPIAEIFGDLDPRIDNHEADLEAGEVWSGFHAIEKILWTKNTIEGTKELGQQLIADIKELKDKIPTAEVTGNLMVEGAVDLLNEISTTKITGEEEIFSKTDLYDFKANIEGAQKIFEILTPKLQAKNPDLVTELTEKFQVVNDLLVTHQVGQHDYKPYNELSADETKALAEAVNKLGEPLAQMGVVLQ

SEQ ID NO: 2967 - protein, 328 aa, M.catarrhalis
FWDNHMQKTHLFNNPVRLLAPMEGLTDPLMRRVLTQIAYDLGSPYDWAVSEFIRVTHYPLPAHVFYKYVPELHTKGCTASGTPVHVQLLGNNPETMAASALVAVSLGTKAIDLNFGCPAKTVNNHKGGSVLLEEPKTLYTIIRTVRDAIPTQIPVSAKIRLGYTDTSQSAEIGHAVADARADWLTVHARTKVDGYKPPAYWEKIAPFNDLGLPIIANGEIWNAEHARRCIAQSQTHHLMLGRGAVTRPDLTAIIAGKSDLGWADLCQHQLSFINDITDNQNGLIGRYKQWLAMLTKGYTQAHQLWQAVKKLKNKSDIEQLIIQSTHHH

SEQ ID NO: 2968 - protein, 153 aa, M.catarrhalis
LFIKITSHHLLDPFGNGLYFFGVGIIVGVLIGRFMLSPNQETPSKQAAQNQNAAVMAVEAVHPTSITIKNRLSANGIVAAVETAEVSSQISGVAIERVLVEVGEFVKAGQVLATLDTRTFEQQLSSAEAELATAVAAQEKAAADLARTEPLMR

SEQ ID NO: 2969 - protein, 313 aa, M.catarrhalis
FWDNLKFGLLPQTKRHSAILKHIRCSHIIVAINKMDLLNFDENKFNTVVRAYKKLAAQLDLQDVKFVPVSALNGDNIVHKSQNTLWYQGGTLLEILESLPVGEAVLTDTAAFHLPVQYVLRADGDKKDDFRGYQGRIESGSVSVGDKVRVEPSGRISHIQEIISPNGVVSRASVGEQITITLTDDIDISRGDSIISAVSQTLPTKRLRATLCWFDERALNPARKYLLKHTTQTVFAKVDEIHHIWDVHTLSNFADQSTLNMNDIGEVSMSLQKPILATSYAQNTATGSFILIDEATYHTVAGGMILAKETQDF

SEQ ID NO: 2970 - protein, 410 aa, M.catarrhalis
YGSKWRDFLLIIAPIIQGKTMTTLSPKDVVIVDGVRTAMGKTKNGMFRHVRADDLSAKLIQALIVRNDIDPSELEDVIWGCVNQTLEQGWNIARYAALLAGVPKTVAAQTVNRLCGSSMQALHTAAAQIMTNQGDMFIIGGVEHMGHVSMMHGVDPNPKASKHYAKASNMMGLTAEMLGRLNGITREEQDTFGVHSHKKAWAATQAGRFDNEIVGVEGHDSEGNLQLCTVDEVIRPDANLEAFQALRPVFDPKNGTVTAGTASALSDGASAMLIMSAQKAKDLGLKPRARIRGMAVAGCDAAIMGYGPVPATQKSLKRAGLNLSDIQTIELNEAFAAQGLSVLKGLDLLDKQDIVNHNGGAIALGHPLGCSGARITTTLLNVMEQQDTQLGLATMCIGLGQGISTIIERI

SEQ ID NO: 2971 - protein, 143 aa, M.catarrhalis
ELNDLQITTPTGTAVRLGSLAVIEDTHADMTSLAKLDGEEVVAFSIIRSKGASETSVVAAVDDALADLQAQMTDLKIEKIVDYAASIEESYQATMRMLIEGCILAVIVVFIFLRDWRATFVAATALPLSIIPTFLSCICLVLA

SEQ ID NO: 2972 - protein, 134 aa, M.catarrhalis
ALDDVRSAVSEVQGQLPAAANPPIISKVSTAGFPVATYSVAVQGMSDTKLSWFVDDTITKQLSNIAGVGSVSRIGGVERQILIQPKMDMMTSLSMPINQLARQIYAKWQDASGGEAKIGNQIQTIRILGLGQWV

SEQ ID NO: 2973 - protein, 198 aa, M.catarrhalis
PTQDKFMKISATFSLSVMALALSACATAPTQTPPVVTETTAVVPSVSDETPSVSPSSPRTTPTVVTSEDINAIMNAFIVRRDNAQETLEPVTAQSSIKAGDLIEYQVLLTNDGNNRVRDMRVALSLPQGAEFTGVVSPSVGTQASADGSRFVFMPIRTTAADGSVQNLPFSQYQVLRWNIQDLGIGATAVVKYRAVIK

SEQ ID NO: 2974 - protein, 425 aa, M.catarrhalis
CWTLKHRTMTVAFVSGFFIASLMLASFLPSAFIPPDEMNQTQVSIELTPDATFDDTLRIAQMAVNKVKAVKGVESVLLTVGSSHSSGDPSSMRSGSVNTAKLDVKLSDRTLRASKVDIESQINQALLTVPAARFNVGMSAGGGEAGYVFSITGADAKKLDATAHEIIRQIRVLPMVASVINNNAFPRPELSVIPNELSMADKGVTTADLVNTLRVATQGDYDNALPKLSLDTRQVPIVTRLSHEDKQSLTTLSNLYVPSSKAVPVQIKDVASLKFTTGEASISRLDRERAIKITVLSTKDASLGDLIDRVKSTQIMQNLPEGIHLIDEGQAEDMAELFTGLILAMAVGIFCIFAVLMLLFHRFLQPLTILMALPLSVGGAFIGLIVTGSSMSMPAMIGLIYSWVLPPKTPFYWWIMPSLLKMNKA

SEQ ID NO: 2975 - protein, 144 aa, M.catarrhalis
IFRLILSKILWLPFFTLMMILGIYGFLQMKIQQFPDIDLPGVVTTITLAGASPDQLENDVAKKVENKLANIEGVKSIRTTLQTGAVTIFTVFELEKPNDEHLTMCVQLSAKFKGNYLLLPIRPSSQKSLQQGFLWRHIRLLCRA

SEQ ID NO: 2976 - protein, 74 aa, M.catarrhalis
RRIRTGGSSLVLWGLGGPNLMLKLIPTGTLPRLASWENCRWWVGPLLGKKGFLKNLPTASNGFDFLLKLGWWNK

SEQ ID NO: 2977 - protein, 179 aa, M.catarrhalis
LMIGNLGFFELTLFGIIALIVLGPDKLPVAARTLGRWYGMFHRASQKLQTEITNELQLLETQQMLKKELDEIRQSEARIKAQMNALERSLDRTKTQQQNTQKNQPAKELPNHDDFGIQVECDDDKNLQETHAIRAALTLPMINHWFLMSSYDRRRRLPPAPYLPNHIADPLLNQPNRRP

SEQ ID NO: 2978 - protein, 264 aa, M.catarrhalis
YEHGGIMALISLASMPNWIWYTLIALLGAGVGGYLIHLIYTLPYRMMLEWQAEMIQVINPIILDDAQDKLLTGFGSSYHQKVAPAYLYAIMMPLSALLSISTLAIQGISIIGALSVIFVWFGLGLAGIDYRVQLLPDRLVLPLGMIGLMANGFGVLTTPVDAIFGAVVGFLVLWLINALYRLARRQDGMGLGDAKLLSACGAWLGIWQLPIIVFIAAALGVVAGIIIQRHQGKASAFAFGPYLIMAAWVVLLFGEYIQAYIGIR

SEQ ID NO: 2979 - protein, 511 aa, M.catarrhalis
LSCGIISTFTHPFIHAMMYNDHQKPTPTKEQLAALDMAKTGQSFKIVAYAGAGKTTTLKLISENLRGRGLYLAFNKAIAHDAQNKFPPNIRCQTFHSLAFRHVNRDVTAKISLPRLTPSRLANELGLRAISTERVIDGIKKPVTLTPAKLANIVSEAITTFCKTSSAYPAPRHITAPNWMSDTDAKMLQQTLYPAFEQRWLQSIDPRHQAGISHDIYLKLWTLSNPIIPADFILFDEAQDADPLMMGALIRQDKQTIYVGDAHQQIYEWRGALNAMKRLPYPQTLLTQSFRFGEPIARIANVFLKALNENIPLKGNPNQSSILAKSLVHGAKDAILCRTNATAMSHLLDGLKLGHKVALQADSHRILRFCQGADSLRNGKSASGIPELAYFNHWQEVQEFSETGEGGDLKTWVKLIEEHGTTTITKAINSLTMPSHADYVVSTAHKSKGLEWNRVQISDDFLYDINSLAVKITPEELRLLYVACTRGKNLLDIHHISDLLHALQHKKLILG

SEQ ID NO: 2980 - protein, 105 aa, M.catarrhalis
AVTGSSVSWALSLRTIKAFMMALISSLVTTVGVVLGDEGETDGVSSETLGTTAVVSVTTGGVCVGAVAHADNAKAITLKEKVAEIFINLSCVGQVLCAHKHSTAD

SEQ ID NO: 2981 - protein, 66 aa, M.catarrhalis
EGIMKLKTKRGAVKRFKKTGNGFKRKQAFKRHILTKKSPKRIRQLRGCVMVHASDVASIRRMCPYI

SEQ ID NO: 2982 - protein, 250 aa, M.catarrhalis
LPIMPNKSPNKAPAYLRIKTAILDNIHAGIWASGVAIPAEITLAEDFGVSRMTVNRAIKELEAERVLERRQGSGTYVAQQKYNNAHIEVRNIAKDIRERFHHYHAQVITQKTLDFMALNQPDNHWLNTLFFHNQPAYTDKLYQVCIAHYGDDLPIQYEERWVNASVIADFINQDFNIVNTSDYLIDHVPLEYGDYQIHAKLASDTICQILQIPINEPTLLHTRQTKSQGKLVTFVNMWHPASRFSFSGTL

SEQ ID NO: 2983 - protein, 441 aa, M.catarrhalis
GAVMTTKEIPSCSFCGKKKTEVQKLIAGNDANICNECIAVCGDLLGDWSKPTKSSGRSSDQSADTSHQSDVQLSIETDSDKDEWLNKVLPKPKELRAHLDDYVIGQDVAKKALAVAVYNHYKRLKVANDKKDTDGVELSKSNILLIGPTGSGKTLLAQTLAKMLDVPFAMADATTLTEAGYVGEDVENIVQKLLQASDYDVQKAEKGIIYIDEIDKISRKSENPSITRDVSGEGVQQALLKLIEGTVANIPPQGGRKHPRQEMIQVDTSNILMIVGGAFAGLDKVIRQRTEKTGIGFHADVKAQDESSITELFREVEAEDLIKFGLIPELIGRLPVIASLEELDEAALVQILTEPKNALVKQYQYLFDMEGVQLTFEPEALTAIAKRAQERKTGARGLRSIIENALMDTMYELPSMTDIAEVIVTKGVIESGKPPVTKPKS

SEQ ID NO: 2984 - protein, 310 aa, M.catarrhalis
VIIMTATILQNEHLDWLEAESIYIIREVIAECRNPALLFSGGKDSVVLLALARKAFAIKGRDVALPFPLVHIDTGHNYPEVIEFRDAQVKTLNLRLVVGHVEDSIAKGTVVLRKETDSRNGAQAVTLLETIEAYQFDALMGGARRDEEKARAKERIFSFRDEFGQWDPKAQRPELWSLYNAKHHQGENMRVFPISNWTELDIWQYIARENLELPSIYYAHEREVVEKGGLLVPVTPLTPKADGDVSEIRSVRFRTVGDISCTCPVASLAATPKEIIQETAVVEISERSATRLDDQVSEAAMEVRKKQGYF

SEQ ID NO: 2985 - protein, 121 aa, M.catarrhalis
ENNMARVKRGVQANRRHKKVLARAKGYYGARSRVYRVAVQAVMKAGQYAYRDRRNKKRSFRRLWIARINAGARLNGLSYSRLINGLKKANVEIDRRILADIAMHDAAAFTAITEKAKAALA

SEQ ID NO: 2986 - protein, 214 aa, M.catarrhalis
GEMMFILGLTGGIGSGKSAVSDYLGKQGITVVDADIIAHRLTSDGSPLLITLKKALGDWVLDHHGRYDRAAVRARVFSDSQTLDQLNAIIHPAIHQAILDELGCSQSAYTILSVPLLFEGRHKSPNLLALCDHVLVVDASSKIQRQRVAKRDGHNPTQIQAIIDQQISREQRLDLAQKIGADILVNDKTLDELHQTLDTLHQKYLAMAAQHGLK

SEQ ID NO: 2987 - protein, 380 aa, M.catarrhalis
GFIVFVMTQPTYYDILGISLSADTEIIDAAYHALTKKYKHNPNAAHRLVQIRQAYETLSDPIKRADYDSWLQMNARFSRTTPPNFGTQTTHSPIQTTDDYRPHEPPKPKKSSLTSWLVGLLIAMIAVVILAYFLVSSAGFFGHRDEPVTPLNHDTPNSSIPKLVAIEPMIPFTPDEITPEQRASYEHAHAAYLAAVNRINAVWNNLPKTIQDELRDEQRSINSTREEVCKAQAASQYSHPMDIDTARYQCEVPRLDERTETLRIYAANVADQPTLFYDPSYPNQPTYSDHSNHLEGYTPSEAHALYDDAVAHINAVWDELSDETQSLLRDEQRAINADRERHCQVNAQNTYNNRHDQTVARYLCEVALLYERAEELALYD

SEQ ID NO: 2988 - protein, 423 aa, M.catarrhalis
IAFLMKKLNKPLANQGMTNKTLSKSPKMLMFDYHAKSYDGKTVSGQISANNMSLAKARLRKQGFYHIHLTAKQARWHFERPIANKQILLSLRTLATLLTSGVVLTDALDIAAKTTTNGRLSNKLIQIKQCIEQGENFTQAIASHPEFGSLALALIDAGEKSGTLDIMLERAAEHAEQQALRQSQLNQALRYPAAIALTSLIVSTVMLLKVVPSFAASFGNMGNELPTITLWVLSLSQWLSANFWQLLLVAITSIGLFIYFYKTNTRLRLWCANTAFGLPIFGKLIQAVGSARFAQTLSTTFSSGVPLAQSIVLAGRACHHVLFFDASEQIAKAVKTGTPLGQAMADTKLFSPMSVQMVTVGEASGRLSEMLDQIAKHHDKEVKDKIDALIGMIEPAIIIVMGVLIGGLVLAMYLPIFNMSMGA

SEQ ID NO: 2989 - protein, 433 aa, M.catarrhalis
SVKFALIGILMEITLNGYYTLILATLVLLLGRLLVKKIKFLGDFNIPEPVAGGLIAAVIVYCLNWFFGYSFIFQKELQTACMLMFFASIGLSADFGRLKAGGKPLIIFLFVVSGFILLQDAVGVGLASALGLDPLLGLVAGSVSLTGGHGTAGAWGYTFEDKYGVVGATTLGIACATYGLVAGGVIGGPVAKRLTNKLGIKPTAHAVSPSKMEQLANDQSLYNTTHNLDDDTAHKQMFERPDNIRLITASSAIETLALFAACLAFADIMTGVAKDTWFELPTFVWALFGGVVIRNILTTFFNFDMFDRAIDVFGNAALSLFLAMALLSLKLWELTGLAGPVLIILAAQTLAMIGYAYFITFRTMGKDYDAAVLAAGHCGFGLGATPTAIANMQAITDRYIPSHKAFLIVPMVGAFFVDLVNATILQAFLRVFG

SEQ ID NO: 2990 - protein, 275 aa, M.catarrhalis
QPLSERELITQRRKIGMIFQHFNLLHSRTTFENIALPLELSGTPKAVIASKVGALLELVGLSDKKDVYPANLSGGQKQRVAIARALASDPKVLLCDEATSALDPATTQSILTLLKKINEELGITMLLITHEMDVVKRICDKVAVMDKGVLIEQGTVGEIFANPQTPLAKSFIHSTFHIGLPNSYLSQLKSEPALGLSPVICFEFTGNSVDMPLFSLASKQFDVDFNILTSQMDYAGDIKFGFTIAELIGEGTSVMQAIEFLTTHRVNIEIIGYVE

SEQ ID NO: 2991 - protein, 118 aa, M.catarrhalis
TYNFILQGHFMNFGKIFGICALASGIALAGCSNQSNEPAAISDTAAQTIKVGVMASPEQAVAEVAGQVAKEKYNLTVELVEFNDYAMPNSAVSKGELDANAMQHKPYLEKDSQDKGLN

SEQ ID NO: 2992 - protein, 99 aa, M.catarrhalis
YRVYFIDQGNLRLSTHSFSPMITLLGVSKHFVIEKEGKTTSFTAVQPTDLTIQSGEIYGIIGASGAGKSTLIRCVNLLERPSEGSVVIDDVDLTAFIRA

SEQ ID NO: 2993 - protein, 95 aa, M.catarrhalis
GLAKISPTVPCSISTPLSITATLSQIRFTTSISCVINNMVMPSSSLIFLSKVKIDWVVAGSSAEVASSHKRTFGSDAKARAMATRCFCPPDRLAG

SEQ ID NO: 2994 - protein, 240 aa, M.catarrhalis
PPIGSILRLSAMWNEIVTKFVSEMHPRMWEMVAQSTWETIYMGLAATAIAVLVGLPMGFLAFLTDKGRILENRSAFVILDVIINIGRSVPFIILLIILMPVTRFLVGTTLGTTAAIVPLSVAAIPFFARLSANALLEVPTGLTEAAKSMGATHWQVVSKYYFAESLPILINAVTLTLVSLIGYSAMAGVVGGGGLGSLAINYGEHRNMVYVKWISTIIIVAIVMIFQKAGDVLAAKVDHR

SEQ ID NO: 2995 - protein, 131 aa, M.catarrhalis
RSCIQIMLHSGVLGVKTSTYELWGDVIQPITVKLSQILLRSVEGESVGTHDFPESQQCYPEQVCAREGSHLLFHGLESPSFFHQDSESSAPWTPLPKLLSGQDLHSGAYRWSLGWNSTSSTYQLCVFGPLI

SEQ ID NO: 2996 - protein, 367 aa, M.catarrhalis
IGAAPSSPVVKTNLKDKPTVILDGVSITSLADQNTEFGVNHSKTVSGITVSKEQLQQRATTLGDALAGELGVHSNHFGGGASAPIIRGQEGKRLKILQNGSEVVDMSGLSPDHAIAVDTTLAKQVEIVRGSGALLYASGNSAGVVNVVDDKIPSKLPSKLQGDATVRLSSANREKLITASAEAPLGEHVVVRVAGLSKQAADYKTPRFDRHVFNEESEYDDTQPEFIYKDTLKHLPDSHAKSNAGTLGVSWVGNQGFLGASVSLRRDKYGLPNHSHEYEECSVHGISQSALQYKPYLRLYPFLMENDDLEFDNAGLECHTHDDHDHEHDHAHDHDHDHEHDHGKPWIDLKMKRYDVQGANQCAVCWH

SEQ ID NO: 2997 - protein, 122 aa, M.catarrhalis
SVMMCKGQINAPFAGIDKIRASMGKVDYHHDEIDGGEKTSFFDNQANVWRLEASHTPIHTPMGKFSGVFGVGYLTSKNSGLVPPSYEDGNKQDTQNILHNNKTKTGSVFWFEEYKTHDKLDR

SEQ ID NO: 2998 - protein, 60 aa, M.catarrhalis
EVRAGKDEEKTVSGGEKRNRNLEREKAMKGNKRRAEKKGAASKSTYNIRRRVWDAFVRHI

SEQ ID NO: 2999 - protein, 345 aa, M.catarrhalis
GEDKIHYAMKASPATEVVKYLADLGSNFDCASIYELDRVLDCGVTADRISYGNTIKKAVHIKYAYNKGIDLYATDSKADLINIANNAPGSKVFVRILVHGADTAEWPLSRKFGCHPDMAVDLLVQAKNLGLVPYGISFHVGSQQKDVAAWDDALAKVKYMFDWMKYEEGIKLQMINLGGGFPTNYISEVNPISVYAEEIHRYLSEDFDEDEMPEIILEPGRSMVGDSGVLVSEVVLISRKSRTDLTRWVYTDVGLFQGLIETLGEAIKYPVYTPKMETTAEQGTVILAGPTCDSTDIMYEDAAYKLPQNLEIGDKLYWLTTGAYTNSYSSVEFNGFPPLKVKYIE

SEQ ID NO: 3000 - protein, 150 aa, M.catarrhalis
WMIWLIALNSDTPINMLGGANPANFPNKLAAYHAAYQQIATHGSCICKYEHFPFLRKVLDILFTSLSEIYPPHSEMWHRPLTHMCLTKASQTRLLILYVLLLAAPFFSARLLFPFIAFSLSKFLFLFSPPLTVFSSSFPALTSYDSFSFP

SEQ ID NO: 3001 - protein, 69 aa, M.catarrhalis
QVHPWRLCLVVKTIDGRELARGGFLRGALNGLIKAGTRFTIFCHIELNLKADFTHANNWGEKVIQGLAL

SEQ ID NO: 3002 - protein, 341 aa, M.catarrhalis
KETTMNAYRLSDIAQSYGKAPKDIKVIVGMSGGVDSSVSAVLLQQAGFHVEGLFMKNWEEDDGSEYCTAMTDLADAQAVADKIGIKLHTANFAMEYWDNVFEHFLAEYQAGRTPNPDILCNKEIKFKAFLDYASGPQFGLGADFIATGHYARRGFSQDGKAQLLRGLDANKDQSYFLHAVGGDKIAKTLFPIGELEKPQVRAIAQKYDLITANKKDSTGICFIGERKFKDFLQQYLPAQKGDIYTDDGIKIGTHDGLMYYTIGQRGGIGIGGVANRPEEPWFVLHKDLTNNRLIVGQGHDHAMLQSDELTAYKLDWGIAPPVQIFGKQGFRCTAQNPLSPE

SEQ ID NO: 3003 - protein, 249 aa, M.catarrhalis
WDKCKDLLILLLFFVKIISHLSKFIIPMLHQNPPKYSFNHQKIIIIALAYVGVITGAGLSSGQEIFQYFASFGKMGMIGVVILGVLHAIFGGIILALGSFYRANEHSQVLDNIAGPWVTKLLDWSLIVSGFTLGFVMIAGAGANLNQEFGAPTWLGTALCSLLVIGISMLNFEKVTAVIGIFTPIVVFIIFALTLYTFVGKSYDWDYLDRIALSEPQIFPNAWLSLINYYALGIMTGASMAFVLGGKNH

SEQ ID NO: 3004 - protein, 108 aa, M.catarrhalis
QITVSSSDRGMTTPCYNLTSLPLINWIGELPPLFRFLASKVLDAPPKTRYRQSDQDCTVFALDETGDTVKVVFGDAQRAVTQGQSVVFYDGDICLGGGVIDGTNAKIY

SEQ ID NO: 3005 - protein, 200 aa, M.catarrhalis
TVGVHGCLFLSDCGKLVPLYGGWPVIYKALSTTNQKGFMMIKIGQGIDVHSFTQGDFVMLGGVRIPHSHGIKAHSDGDVLLHALSDALLGALALGDIGQHFPDTDDAYQGADSKVLLKHVYALVQAKGYMLGNADMTVICELPKLSPHNLAMRECIAGVLGVSVDCVSIKATTNEKMGWIGRGEGIWASATVLFIKNHAY

SEQ ID NO: 3006 - protein, 66 aa, M.catarrhalis
KYHLAVALSIVFHTGKAWEPLTGKYYLRRVWFNLEPCLVWTLNPPGGNTGKDWVFTILAPEFKNFD

SEQ ID NO: 3007 - protein, 366 aa, M.catarrhalis
MNMSNMTDFTVSTDAPWYKTYQEHGLDFNFDLPDNINSLMDIFDQAFARFGNQVAFTCMDKSITYRQLDNYSRQMAAYLQSLGLVKGDKVAVMMPNILQYPIAMIAIVRAGLTLVNVNPLYTSNELEHQLNDSEAKALFIVENFAHTFEKVVNKGQVRHVIVASLGDMLGLKGFLVNAVVRHVKKMVPEWNIPGHVSFKDALNKVPIGNYNRPNLALDDIAVLQYTGGTTGVAKGAMLTHRNLASNVEQCAPFLSLVFSKDNLSGQYIAVALPLYHIFSFTACGLLGMKMGFSMLLITNPRDFPALCKDYAKYKPAFFPAGKTLFNGLVHHEGFSVTWTHSNLKISFGGGLVNCIPYWQSMGTFDR

SEQ ID NO: 3008 - protein, 69 aa, M.catarrhalis
IPRVETQGKIGYSQFWHRNLRILINEANNFSNGEAWEYFAQKANKNWSAQGIPFIKTQRVLPNKGFFHP

SEQ ID NO: 3009 - protein, 141 aa, M.catarrhalis
EMIAALFADTNIKLTIILMVIACLLPFVCAALAKYLGGYNIKDNQTPREFLANTHGAAARLNHAQTNSFESLPIFLASVLIALYTFVPVSIINILATGYLIFRICFIMSYATNLSILRSVTWMFSLSCCIMLFILAYQMGI

SEQ ID NO: 3010 - protein, 412 aa, M.catarrhalis
KDILMTLSLNKEKIRFLLLEGVHENALKVLNEAGYTNIEYISSALDEAELIEKIKDAHFIGIRSRTQLTRKVLEAAEKLICIGCYCIGTNQVDLDAALELGVPVFNAPYSNTRSVAELVLAETIMLMRGIPEKNAVVHRGGWNKSAKDSYEVRGKTMGIVGYGSIGSQLSVLAESLGMKVIYHDAMTKLPLGNATQVGSLEELLSKADVVTLHVPDSSSTRNIMTAKAFEQMKDGSFFINASRGSCVDIDALAAALESKKILGAAIDVFPKEPKSADEEFESPLRAFDNVILTPHVGGSTQEAQANIGLEVAEKFVRYSDQGDTTSAVNFPNVSIPFTDGTHRLLHIHRNVPGVLSQINASFADAGINIIAQSLMTKGDVGYLVMDVDDNDSDRALKRLRAVPETIRVRVLF

SEQ ID NO: 3011 - protein, 1220 aa, M.catarrhalis
NTTLFYHLSWFFMRLKSLKLAGFKSFANPTTFTFRHDITAIVGPNGCGKSNVIDAIRWVLGETSAKQLRGGAMSDVIFAGVEGRAAKSLASVELIFEHTQDETHGIRHELNLYQELSLRRQVTKEGKSDYFINGQRVRRRDVVDVFLGTGLGARSYAVIEQGMIGRIVESSPMQLREFIEEGAGVSRYQARRAETEKKLGETQDNLKRLSDLQGELKKQHKTLIRQAQSAKQYQALNDELKTLQKEELIRRLFEAWHHHEQKKIEQGKSGEVLAKLDAKANQVRRELDLLSARVAEAQWLKDDAKDNYHNAQMAEQTAQHNFYTVNSQITQNDEKIARLQAQHQEALTKINQAQDELLQINQSLDVITPKVEAMTHEITHAKQAQSEVQLTWQSHRDELSSLMQEKNNLENLKKLAQSQRQRLEIGLNKWQVRYDELITAKNLFSDTIEVQNQLSADTLKAVALRQKLEHLNDDEMLKSLVDELTQAVQTSQIHVQSQEKRHASLMGEYEILHKLVHTKIPSHKITTPPDADTSIALNALPSLKESLVLTEMGLDYADVLDQFLGFWLNARLSDELPTAVLGHVMDDNDYMILKSGKTSDTDMTALAVSANERISQLPTSIQQQLVRFDRLFSMPTLELFGRCYLYVGDEPLTDLDTNVPFGMIIMTKAGWLVGSFGMLHLSKLGDTSSQFLSDRKKHLERLEVLEDELNTLEDSLEKDQKQLKQVLTRLQSSKIELEEITAQKNVVTQQLHQLEQGLTILTAKLDSEKARRESIDSQLKRLDDENSSIKNELQELNMQIETCDFGLRELEPKVEQANQAMAVQTVRIDEAVAKLKTQNDTYQALQIKLGTLTQAKTHAERLLEMAKHSASQTQADIETTKSTQQELSQKLPVLEEAFKAAKAVSHELKIASDEYELAAKAQQIAQSQLQETLTEAHTKFATAQATLAQISADTAVGESRVQDIGGELMRLDESFNLASKLADFRTNPNQNFTDNSARQNQIKSKIAELGAVNLAAAAELAELEARVSPMDEQINDITQSMKKLQDAIRAIDEKTKTLFLTALEAVNKELNALFSKVFGGGQASLTLMADDDLPKSDKWRAGLVLMAQPKGKKNSRLAVLSGGEKTLTALSLIFAIFKQHPAPFCVLDEVDAPLDDANVARFTGLIRELADDVQFIFISHNKLAMQIADELKGITMPTAGISSLVTVDLQEAQKYLEVND

SEQ ID NO: 3012 - protein, 303 aa, M.catarrhalis
IFVQLKLKVIDMTQVSAKLVKELRDRTGLGMMECKKALEEAGGDIELAIDNLRKSGQAKAAKKAGNIAADGAIIIAQGEGKALLLEVNCQTDFVAKDENFTAFANKVAKLALENNTTDVAAIAQLPYGDGSTVEEARVALVQKIGENIQVRRAEVIEGANLAAYRHGLRIGVVVSIEGGSEEVGKAVAMQVAAFNPLAVNEADVPVDILAREKDIIEAKAKESGKPEAVIEKMITGGLQKYLNEVTLVNQPYVMDNDKKVGDVLKSENATVVSFKRLEVGEGIEKKQEDFAAEVAAAQAAAKA

SEQ ID NO: 3013 - protein, 278 aa, M.catarrhalis
PKLLGFFMSDKNPTQILMRDLLEAGAHFGHQTRFWNPKMSQYIFGARNRIHIINLEHTVKQFNEALTFVNKQAAARNKILFVGTKRAAGAVIREQAQRAGMPYVDHRWLGGMLTNWKTLRQSITRLKELEKQAEDGTFAKLTKREALERTRQMEKLERALGGIKEMGGLPDALFVVDVDHEAIAIKEAKNLGIPVIGIVDTNSNPDNVDYVIAANDDAIRAISLYVTAMADAIIAGKEYAKTQGHADAADADKQANRENATAPVEDKVDQAGQVVNNY

SEQ ID NO: 3014 - protein, 253 aa, M.catarrhalis
KFFKSIFLNRKNNQRQNEMVLWLDLGNTRLKYWLINNGQIILSDAKEHLKAPNELLLGLLGVFTQFEPNFVGISSVLGEKINHAITKTLKELGVPFEFAKVNHRHPMLCSRYEPSQLGVDRWLQMLGAVNGHKQCVVGCGTALTIDMIDEGEHLGGYILPNVYMQRHALYAGTQQIDVKQGRFDGLSLGTTTDDAVNHGVLFGVVGAVASVQANYPNFEMILTGGGAQMLRPHLKHIQVDEELLLKGLQRYFC

SEQ ID NO: 3015 - protein, 374 aa, M.catarrhalis
YAHKYYVWSYLNVLEDFVAKGIIMADIAGQSLDGSDIELLSNPEIGGIILFARNVKSPAQVRTLTDSIRQINPQLLIGVDQEGGRVARFKEGFSSLPAMGKLGQLYDKSPKDALSLAYDCGYLMACEVLAVGVDFSFAPVLDIDGKSLVIGDRAFHANPDAIITLSRQFMDGMKNAGMATTGKHFPGHGSIAPDSHIADAIDERSFDEIMDYDTQTFIKTLDKLDALMPAHVVFSQVDDKPAGFSKIWIQDIVRNQLGFDGVIFSDDLCMQAAHIVGGIDARVVAAIEAGCDMALVCNHRQNALLAIETAKKLKDTPQHRLIKMAGNIPTWQGSLEATCHQFPLWQAAKHRIQAAFFQENHETLAKDPTVYSVC

SEQ ID NO: 3016 - protein, 180 aa, M.catarrhalis
QGINAGYLLYIKSLIMIDADGFRPNVGIILVNAHGQLLWAKRIGHDSWQFPQGGISHGETPLDAMYRELYEEVGLHPEHVKVLAVTRDWLRYRLPKRYLRTGQEPLCIGQKQKWFLLYLDEANTKYIRFDVGVPEFDDWQWVSYWFPLTGVVPFKRNVYQRALLELIDAVPRRKSLVANM

SEQ ID NO: 3017 - protein, 987 aa, M.catarrhalis
PPTLKVVEKLFESMFFSQERYDLSNVGGMKFTRRLGREFIDTDDMDVQREQGVLSNQDIVDVLKELIEISNGRGEVDDIDHLGNRRIRYVGEMTENQFRIGLARVERAVKERLTTADSDNLSPQDLINSKPVAASIKEFFGSSQLSQFMDQNNPLSEITHKRRVSALGPGGLTRERAGFEVRDVHTTHYGRVCPIETPEGPNIGLINSLATFAKTNNFGFLETPYRRVVDGRVTDEIEYVSAIEEVGMVIAQADSPMNDKGELTEEMVSVRHDGEFVRMSADKVTHMDVSPRQVVSVAAGLIPFLEHDDANRALMGSNMQRQAVPTLRSDKPLVGTGMERHVARDSGVCVVAKRGGVIEEVDASRIIVRVNEDEMTAGEAGIDIYNLIKYTRSNQNTCINQRVIVNEGDEIERGDILADGPSTDLGELALGQNMRVAFMPWNGYNFEDSILLSERVGQEDRFTTIHIQELTCVARDTKLGPEEITGDIPNVGEAALANLDEAGIVYIGAEVDAGDILVGKVTPKGESQLTPEEKLLRAIFGEKAADVKDTSLRVPSSTKGTVIDVQVFTRDGLEKDSRAKSIEKAMLDDYRKDLKEELVIFEAAAKGRILSLLDGKKVSGGAGFKAGAILSTKDIENLPLESLLDIQPAEEEVSERLGQIAEFLSDKQKDIDNKFTEKKRKLTQGDDLAHGVQKIVKVYLAVKRRIQPGDKMAGRHGNKGVVSRIMPVEDMPYDENGNPVDIVLNPLGVPSRMNIGQVLETHLGMAAKGLGDKINAMLRSQVAVSELREFLDKIYNQVGGEQVDLDSLSDEDLLALCQNLKDGVPMGTAVFDGAKETQIKELLSLADLSTTGQQTLYDGRTGKKFDRPVTVGYMYMLKLNHLVDDKMHARSTGSYSLVTQQPLGGKAQFGGQRFGEMEVWALEAYGATYTLQEMLTVKSDDVEGRTRMYKNIVDGEQYMNPGMPESFNVLTKEIRSLGINIDLKEKK

SEQ ID NO: 3018 - protein, 141 aa, M.catarrhalis
KEFDMAQLDAELIWEDGVHFIGTSPSGHTIHLDGNKTAGASPMELILLGLGGCASYDVVTIMKKSRQDITDVRCQMHAHRADTIPAVFTDIHLHFVVTGSDIKESQLAKAIELSAEKYCSASRMLSSGGVNITHDYEIIEK

SEQ ID NO: 3019 - protein, 66 aa, M.catarrhalis
YGGERQDRTADTRIFNPLLYRLSYHAELMRIKTKFHQLVKKNISKIAFCIKLSGLCTDTNKRLHNI

SEQ ID NO: 3020 - protein, 469 aa, M.catarrhalis
LFDCLHMIKMRKTMTKHYDYLAIGGGSGGIASINRAAQYGKKCAIIEANLIGGTCVNVGCVPKKVMWYAAQIADAIHKYAPDYGFKGNIDEFNFGQLIQSRQAYIERIHRSYRMVFERNGVELIQGFARFIDKNTVEVAYDDGTTEQISADHIVIATGGQTVRPDIIGQELGIDSDGFFALDEMPKRVAIIGAGYVAVEVAGVMNSLGAQTHLMIRGNQPLRSFDDDIVEVLVNVMQNDGIQIHTGVNTQQIIQNEDKTLTVEFNDGQNLTVDCVIWAVGRKPATDQLNLDAVGIKTNTKGQIITDKFQNTNIEGIYAVGDIVANGVELTPVAVASGRRLSERLFNNKPDEHLELNLVPTVIFSHPPIGTVGLSEASAIAQYGADNIKVYTSNFTPMYSAVTSHREPCRMKLVCLGEEQKIIGLHGIGFGMDEMIQGFAVAMKMGATKQDFDDTIAIHPTAAEEFVTMR

SEQ ID NO: 3021 - protein, 1422 aa, M.catarrhalis
RLRRIQRRNLLKDLLDIMKGPADNGVKEFDSIQISLASPEAIKSWSHGEVKKPETINYRTFKPERDGLFCAKIFGPVKDFECLCGKYKRRKFQGIICERCGVEVTAAKVRRERMGHIELASPVAHIWFLKSLPSRIGLLLDITLRDIERVLYFESYIVTDPGMTSLEKYQLLDDEEYFNALEQYGDEFIAKMGAEAVQDLLRDIDVDGEIDELRTAIPQTGSETKLKKMSKRLQLLESFRDSNNKPEWMVMTVLPVLPPDLRPLVPLEGGRFATSDLNDLYRRVINRNNRLKRLLELNAPDIIVRNEKRMLQEAVDALLDNGRRGRAITGSNKRPLKSLADMIKGKQGRFRQNLLGKRVDYSGRSVIVVGPTLRLHQCGLPKKMALELFKPFTYAKLLQNGIASTIKAAKKMVEREEPAVWDMLAMVIREHPVLLNRAPTLHRLGLQAFEPVLIEGKAIQLHPLVCAAFNADFDGDQMAVHVPLTLEAQLEARALMMSTNNILSPANGEPIIVPSQDVVLGLYYISRGGVNAKGEGMVFSTVNEALRAIGSDDLSVNAKIKVRVAETILDEKTGEKISHTSIQDTVAGRLLIWNIMPEGMAFSECNTEMTKKNISKLLNSCYRKLGVKESVMFADHLMYLGFAQATLSGISIGMEDMVIPPTKKQIVDTADAEVRDIEQQFEQGFVTAGERYNKVVDIWARTSDKIANAMMDNLSKDDVINADGETETQKSFNSIYMMADSGARGSATQIRQLAGMRGLMAKPDGSIIETPIKANFREGLTVLQYFISTHGARKGLADTALKTANSGYLTRRLVDVAQDLVITQDDCGTDAGQRMTPVIVGGEIVERLGDRVLGRVAAKDVVNADGDVVVPSGALIDERLVEKLDANAIDEVYVRSVITCEATQGVCAKCYGRDLARGHLVNIGESVGVMAAQSIGEPGTQLTMRTFHVGGAASAASVDNSVSVGNAGSVRFHNMKTVQHADGHLVVVSRSAEIGVADDQGRERERYKVPYGSSVLVRDADAVEAGQVIAKWDPHTHPIITEFSGTARFSDITDGMTATVKVDEMTGVRSFEILTSKDRPSIAKDLRPAIILDTDEGKEVVYFLPNETIIRVSEGEHVTAGSVLGRVPQATSGTKDITGGLPRVADLFEARRPKDHAIMAEMSGVVSFGKETKGKNRFIITNEDGDVHEELIPKWRQINVFEGETVERGEVVSDGPQNPHDILRLKGETALANYIVNEVQEVYRLQGVKINDKHIEVIVRQMLRKVEVVDGGDSSYFKGDQAEYSKIRTLNAELIANNKFPVQYERQLLGITKASLATESFISAASFQETTRVLTAAAVMGKVDDLSGLKENVVVGRLIPAGTGLAYHQSRQRKAQNAGNQTAQVDELLSVITAEPPTTSEDNLSIEDNFAKAFADELGSQE

SEQ ID NO: 3022 - protein, 309 aa, M.catarrhalis
RTFIIFVVNCHLMNVNQSNFDQLWQTIQNHHEHHASILSTNTELKNTVIRGEKSHSLLHLMTADHQSLGRGQHGRSWVSSQGAVFLSLYVPMQSQTQDFGINQLSGLISLLVGFYLIKMPIITQMNQIRQTMNLPKIGVKWANDLGVFDEDSQRFWKLAGVLIEPIFVAKNDHRSLVGLVFGVGMNVQHAPIIQSGTYQATSLNMLWYPSLGALPSAQDLYQPICQAICRAIFHHHQLMTSQKTATGFINQFNQMHLLTDRQVEIFTQNDDTGNRLSGKCLGVDERGALLVQNEQGIQTIFAGTAKMMT

SEQ ID NO: 3023 - protein, 727 aa, M.catarrhalis
DTDMSKQQYLLSGVASAMAFALFASSVASFAQASDRTAFIQKPEQRVTARQVAILLDRAHYNDQRLDESMSQVILQQYFDKLDPNRTLLLQSDVDEFISKYGKTYAAYLIRGDLTPGIEIFERFRTRSFEYFKAAKAHLATDIDLYTNKSIILDREKAPRFRSKKEQLEYWKNQTTLSLITIMINQDSDKAKDQVYLQNPELARGQDLVKAESRTPKEILLNRIKRQEEQLERLKNDEVMESILDAAAIAYDPHSNYYAPIQAQDIQIQNSLQLEGIGVSIRPDRKNPDYTRIISLVDGGPAAKSGQILANDLIIGIAQSDGEMVDTIGYSTREIVALIRGTRGTEVTVKVKQPNTPDSQARTVTLVRDIIRQEESGVQYRVIDMPYDGSIKKVGVIEIPSFYLNFKARREGIDASQYRSVSHDTQKALQALTDQGIDGLVVDLRNNPGGSLDEVAKMLAMFIKEGPLVQIRDNRGNVQVFEDTDGGHQFYDGKLSVLINLGSASASEIFAAAIQDYGLGLVVGSTTTGKGTAQTQRDDLALGSMTLTQRKFYRVNGGSTQTKGVVPDVELVNIYEGIEFGEREYKNPLPWDTINSTNYHAEGKYSPSLLSSLNKQSKARQASDPQFRYLSELNAIRTLDDDKKPTEINLQKRRARLDMIEKRTLAAENARRQATGEAPFVDWSTYQANLEALAEERSAMKENERPKLPESEVYVFEAARLMFDAER

SEQ ID NO: 3024 - protein, 83 aa, M.catarrhalis
LLRIQENTVFFHPNWLIQIYWTHASHYQENPMFRWAIIFAIIAIIASFLGFGNIAGLSKEFAYIFLIIAVVLFVIGFVGGRRR

SEQ ID NO: 3025 - protein, 267 aa, M.catarrhalis
MSMIYIWFAAAGIIAGLCAGLFGVGGGMVIVPALIWILAAYGMPTDIVPHVAVGTALATIILTSISSMTAHHKRGGVRWEIFKNMSKGLVLGSLFGAWVATLISGAALQAILGAGAILVAIKMLFFPNQERLDIPPPPAYKQGFAGVVIGILSAIFGIGGGSLTVPYLSQNGVPMRQAVGTSAACGLPIALAGAFGFIWFGHQVGTANIDGLIGFVHIGAFITISILSFIMAKVGAKLAHALPAQTLKRAFGVLLMIVGVRLIIGGL

SEQ ID NO: 3026 - protein, 915 aa, M.catarrhalis
LSCPINLTHKYKISAAFSQGFYMKTMQSNEVRQAFIDFFVSKQHTHVPSSSLIPHNDPTLLFTNAGMNQFKDTFLGLEKRDYVRAVSSQKCVRAGGKHNDLDNVGYTARHHTFFEMLGNFSFGDYFKKDAIAFAWEFLTDEKWLALPKDRLYVTVYHTDDEAFDIWHKDIGLPQERIIAIGDNKGGAYQSDNFWMMGDTGPCGPCTEIFYDHGEHIWGGLPGTPDEDGDRYIEIWNCVFMQFNRQKDGTMQPLPKPSVDTGMGLERISAIMQGVHGNYETDIFTKLMTKAVNIIGLPTDTDIQNEPSLKVLADHIRSVAFLIADGVIPSNEGRGYVLRRIIRRAVRHGNKLGATDAFFYQLVHPLADIMGDAYPQLRHEQHKIEQAILKEEEQFAKTLSQGLKLLSQELDSLQQGDALAGETVFKLYDTYGFPADLTADIVREKGITIDEAGFELSMAEQRTRAREAGKFAMDYHALIQVDSATEFLGYERLDNDSTVIHLYQDGKAVDTLAEGDEGVLILDKTPFYAESGGQVGELGEISTESGVFDVLDTQKSGQAIIHHGVVKMGHINNNQSATAQVASQVRASSAKNHSATHLLHAALRTILGDGVSQKGSMVSSDLLRFDFSYDKPLTEQNISQIEIMVNQQILANTPAHVEILDIDSAKNKGAMMLFGEKYGDTVRVLSMGTTDKDGKPFSIELCGGLHVTRTGDIGLFKIISEQGISAGVRRIEAVTGMGAVNYVQQGDKQLNQLANQFKAKRHEIAQRVAQLSDKNRHLEKQIERLNQKFASLHANSLMDNLKNIHGQKVLIATVNGMDNKALRTLSDDMKSKLADGIVILASIYTADGEDKIAMTASVGKHLTGKIKAGNIIKHLSENLGGKGGGKPDFAQGGATDVANLPKLMTGLTDWIGEKLG

SEQ ID NO: 3027 - protein, 488 aa, M.catarrhalis
SQTAHIEQHSQPNIKQPQNKLRKFKTMPLSALTALSPLDGRYASKCDALRPYLSEFGLIHARVTVEIRWLQALANHPQVIEIQPFSAKTNQRLDEIVQNFSEENALRIKEIERTTNHDVKAVEYFLKEQIADIDELKNAGEFIHFACTSEDINNLSHALMLKASRDVLASSMQQLIDAIATLAQTHANQPMLSRTHGQTASPTTLGKEMANVAYRLHRQLTQFNHVELLGKINGAVGNYNAHLSAYPNIDWADHAQKFVTSLGLTFNPYTTQIEPHDYMAELFDALRRFNTILIDFNRDVWGYISLGYFKQKLKDGEVGSSTMPHKVNPIDFENSEGNLGLANAVLAHLGEKLPISRWQRDLTDSTVLRNMGVGFAQSLIAFDACLKGIGKLEINANRLNEDLHNAQEVLAEPIQTVMRRYNIEKPYEKLKTLTRGQAMTCEMMLDFIHGDELNAVPASEKKRLADLTPATYIGNADIQAKNIKDYFK

SEQ ID NO: 3028 - protein, 73 aa, M.catarrhalis
SVINFKKYSLANLIKSQPKKITASLLSGDFYIRDYHELFKIIFNIFCLNISIANIGGGGQVRQAFFLTCWHGV

SEQ ID NO: 3029 - protein, 155 aa, M.catarrhalis
FGSNWQIKGLNPSSMTKFALGMLLAAAGFGLMIVAANHVVNQPGTLVSPMWLVGSLLLLTLGELALSPVGLSSMTKLAPERMQGQIMGLFFASIAVGNLVAAFFGGYVTADTINDLPNLFATMAIFLVVSAVMLLILSHPIEKMLKDSETLKRAE

SEQ ID NO: 3030 - protein, 452 aa, M.catarrhalis
FTNRLFDEIMLFLDKFNLNKDIHSMTQNINHLEGDTPIKPHKDSGFMGHPKPLQPLFFTEMWERFSYYSIRPLLVLFMVATIQSGGFGFDDVTASAIYGIFAGAMYLMAVPGGWLADNWLGQERALWWGSLIIALGHLCIALSAMVGASVFFLGLMFIVIGSGLFKTCISVMVGALYPDGDGRRDAGFTLFYMGINIGALFASLIVGIFKEQGMWHVGFGVGGFGMLVALLLYRFYAHASLKKYAQENNITPVWEYPSGQVANVGRWVFAVVAVLTVVVGLIMMGIMPFNPQVVAEYMTYLIAGTIVLYFLYRFISPSLSKNEKVRLLICFLLIIGSTLFWSSFEQQPTSFNLFADRYTDLNVMGFNIPSLWFQSLNPFFILLLAPIVSVIWVKLANKGLEPKQYDKICFGHVIGSSRVWLDDCGGQPCGEPTRYIGITHVAGGQFAPIDTG

SEQ ID NO: 3031 - protein, 285 aa, M.catarrhalis
IKISDDRYLIYKVSFMALIVQKYGGTSMGNITRIKNVAQRVKRWYDNGHQVVVVVSAMSGETNRLIGLAREISSDPDPREYDQMVCTGEQVSISLLAMALQSLGVDAKSMTGDQVAIHTDDTHTKARIQSIDTDSILSELNAGRVIVVAGFQGIDEHGDVTTLGRGGSDTTGVALAAALKADECQIYTDVDGVYTTDPRVTPKAKKLSKITFEEMLEMASLGSKVLQIRSVEFAGKYQVPLRVLSSFDEGDDGIFDDKFKQTVGTLITADEGDDMERAVISGIAS

SEQ ID NO: 3032 - protein, 106 aa, M.catarrhalis
GTCRVKRFGNEVHNHVQAIHLGFNEIHKTGLLTNNTIIATQQTLEENRADFRTQLGTQLRNERIGQVMRKILAYNFCFVSNKQLGNPPFQFELLISSFQLRAGCKK

SEQ ID NO: 3033 - protein, 95 aa, M.catarrhalis
AMPIDEFIINRLKNARGDIETVIDRLFGRFNMQKLRARDLWHLSHRFMRKILAYNFCFVINTQLGNPHFSLSCLFQVESGVIEGNSLFKERFKIL

SEQ ID NO: 3034 - protein, 61 aa, M.catarrhalis
NGEVMPATLGQLSSDIETIDILKLTVEAHKALAELKGLAMKYITMFKPYTLDLMKYTKLDF

SEQ ID NO: 3035 - protein, 82 aa, M.catarrhalis
IGYSTKTMGFYMNIPLFSAIFSIAFTVIIGVLMIVAFVTGFDKGMHIIGAVVIGAVISLPVALFVTKRLAQLTSGSNKAPKA

SEQ ID NO: 3036 - protein, 132 aa, M.catarrhalis
ILDSDLNQRIMRGKRFTKGWEPLVSLSNCDQYFLKRQSVFILAGQSVFQGNNNKAFKWKLMGLVLEAFILTLQGFKNLVSIWFPTIDYIGMLLLVGVLLAWIKTHKKIKPERINRRHIYALMQKKLDDSQSF

SEQ ID NO: 3037 - protein, 61 aa, M.catarrhalis
NGRLTGFDAVKQHLIGITSYDSLVTINGEYGFLVISKSMIAGVLIFITGILIKIILNAIMI

SEQ ID NO: 3038 - protein, 416 aa, M.catarrhalis
YQRLNTQKIKREITMADLSKITEIEDLRRIAERKVPRMFYDYVDSGSWTQTTYRNNETDFDRIKLRQRVLVDMDNRSLATQMIGQDVSMPVAIAPTGFTGMMWADGEIHAARAAEKFGIPFSLSTMSICSIEDVAENTTKPFWFQLYVMRDKEFMENLIKRAKAANCSALILTADLQVLGQRHKDIKNGLSAPPKPTLKNILNLMTKPEWCYNMLGTKRHTFRNIAGHAKNVSDLSSLSAWTAEQFDPGLSWDDVARIKDMWGGPLILKGIMEPEDAIMAARFGADAMVISNHGGRQLDGAPSSIASLTDCVQASQAENSNCEVWLDSGIRSGQDVLKAIALGAKGTMIGRSFLYGLGAYGEDGVRRALEIIYKECDVTMAFCGHTNISTVNSDILVKGTYEHLKANQPHITPIRW

SEQ ID NO: 3039 - protein, 176 aa, M.catarrhalis
ASLSPPLAFLFKFVMARVTASKSAKASSVLMVSISDNGLTCPSTWITLSSSKQRTTWAMASVSRILAKNWLPIPSPLEAPATRPAISTNSILVGMVRSGLTIAASAFKRGSGTGTMPVFGSLVQNGKFSAAIPALVSALNKVDLPTFGKPTIPQLKPIINSRMLCEILSLYQNLSN

SEQ ID NO: 3040 - protein, 434 aa, M.catarrhalis
QGFFVPKHSATNFNTEHQMDTKHIQQNWLLPDGVADVLFTDAQKQESLRDALLFVLTAHGYRLVSPPLIEYTESLLNNADEDLKRQTFKFIDQLNGRLMGLRADITPQILRIDSKYGQGISRYCYVGQVVKTLPTGLFGLRTPLQLGAEIFGIDDICAELELIDLLVALADEVGLDRQMLHVDIGHVAIFDRLCQLHGVSNKDADELIGIYHKKAMPELTKWCQNMGNSLNSPSDATDFLVLVKHTLSSDRTPNAEALLNKLSDKARQDNQIIQAANELATLAAHIRAVGMSVSIDVTELSGYHYHTGVVFNAYLGNRTTQTQALVRGGRFNGTSTQSVARGATGFSMDINRLLEFVELEEDTVILVDYHDLQNADADTKADLATQIKTLQSEGCIVIKPLTVDDKPDQIDGILHWDTDQDKPIWAVRLVGDEY

SEQ ID NO: 3041 - protein, 286 aa, M.catarrhalis
ITSPNTKDDDKLMTTNTPSILQKIIATKHQEIAVAKAIKTTNELLKSAAHHMPRGFANALRAVDTTTDIGVIAEVKKASPSKGIICQDFNPVTTAQAYEKAGATCLSVLTDRDYFQGHDDYLIKARKAVRLPVLRKDFMVDEYQIIESAAMGADCILLIMACLDADTALHLHQTATDLGLDVLIEIHTDDELTQALNLPKSAHNIYGINNRNLNTFQVDLENSIRLSQRLFANLGQDALVVSESGIHHATDIHRMQQNHIHHFLIGEQFMKTDNAGGALSQLLKTI

SEQ ID NO: 3042 - protein, 198 aa, M.catarrhalis
MLTPKLDKLIKELQVLPSVGQKSAQRMALQLLTKKRTQGLSLAAALETAMHDIKECLQCHSFSDDEICPICLDHRRDDGLLCVVENASDVMAIEQSGAYRGKYFVLGGHLSPIDGINANDLHIDQLIHRIRHEAIHEVILATGATVEGQTTAFFIHDAICTHVPKITRLAQGIPMGGELGYVDSITLHQALQNRSNIS

SEQ ID NO: 3043 - protein, 154 aa, M.catarrhalis
IWALFWQLLRIKYHQRVNLIHICIFFLDAGGGNILAFFELPTKPAMGRDENTPIWTQHLALKVDSEETLSATKQKLIDAGLEVLGPVNHTLFKSIYFFDPNGHRVELACDITTDQMNRALDKVKWDMLNEWAQTKKHPNTHNGYMMAQSRLMCD

SEQ ID NO: 3044 - protein, 223 aa, M.catarrhalis
DSFTQLILTMKQEILLIDAPAGVLEVDAIWQSGERQTKDGLAILCHPNPVQGGTMNNKVVSTMYRFCRDGGMDVLRFNFRGVGRSTGQTGTGDGELEDALTVLRYALKHTKARKLWLGGFSFGGYTATRLASLMTDNEEFFDVNLHNLALIAPSVMRVGMASLRWQADHTFMIYGDQDELVSPEHLAQFAEEREIPTTVLSTGHFFHGKLVELGQSLQKHTKI

SEQ ID NO: 3045 - protein, 60 aa, M.catarrhalis
MSITQGVHHVAYRCKDAKETVAWYQKHLNMGFVLAIAEDKVPSTGEPDPYMHIFFGCRRW

SEQ ID NO: 3046 - protein, 286 aa, M.catarrhalis
IMITISNNPAPSKTADVRIFDTPVLNLPEDLYIPPQAFAIWLEQFAGPLDFLLYLVKKNNFDLTETAILPITEQYLSYISELDEAYFELAGDYLLMASTLIAIKSELLLPQSKVDDDEISPKARLIRRLEEYAQIKEAARRIDGLLRLERDVFLAFTSMPSPEAMQKQLPKYSPELLVESLIHMKIRPEAITHTVQADSVPLSQRIASITRLISEKGVSTFAELIDKSQGKIGIVVSFVAVLELMKRGLIGFDEANSGKLNPTKNDTYHDNQNGQDLTKQSLHWLH

SEQ ID NO: 3047 - protein, 451 aa, M.catarrhalis
QEDTMIKKLLIANRGEIALRIVRACKQLGIATVGVYSTADKDLMHLRFVDEAVCIGNAPSAHSYLDINALLAAAEITAADAIHPGYGFLSENAEFAERVEEAGLTFVGPHPEHIRLMGNKVSAINAMKEAGVPTVPGSIGAITLGNAEEQAREIGFPLIVKAAAGGGGRGMRVVERFEELLIQVQAAKTEAQNAFGDDTVYMERFLKNPRHVEVQVLGDGNGNALHLFDRDCSLQRRHQKVLEEAPAPDIPDEVRTPILEACVHACKKIGYRGAGTFEFLYENGEFFFIEMNTRVQVEHPVTEMITGIDIVVEQLKIAAGYGLSYHQDEITIRGHAIECRINAEDPKTFMPSPGQIQRLFTPSGSGIRFDSHLYQGYTIPSYYDSLIGKLICHAQTRRQAIAKTLHALDELVIEGIKTNIPLHRDVILQDEAFCEEAQNIHYLEGHMLKTQ

SEQ ID NO: 3048 - protein, 238 aa, M.catarrhalis
TMTTKPKLTTTKTANTPPSRSMNANKRLVFFQKLAKHIKEPVTELHYTSEFELLIAVMLSAQATDKSVNIATDKLFKVANTPKAILDLGLDNLKSYISSIGLYNSKAANVIKTCQDLITKHNGQVPRTRDELEALAGVGRKTANVVLNTAFGEPVMAVDTHIFRVGNRTGLATGKTVLAVEKALMKRIPAKFLVDAHHYLILHGRYTCTARQPKCGACVVFDECMFKDKEQWALKDLS

SEQ ID NO: 3049 - protein, 139 aa, M.catarrhalis
SIMTIPTLEVPKFTIIHAACDGLPTIWVQNDDDLYALIDEIDASDVVALDTEFIKRTTYYPILALIQINTGNAIYLIDAPKLDLTEFWQALAEVPTMVWYACGEDLGIFYLLAKCPPLTNIFDVQIGVAYLSGKLQAWL

SEQ ID NO: 3050 - protein, 519 aa, M.catarrhalis
MKPASYDVIIVGSGLAAITTALSLPKDCQVLLMCKGEIADTSSRFAQGGIAAVIAPTDSVQEHVTDTLIAGAGLCDPNTTEQIIHQGADAIAWLSSLAVPFSTTKEGLHLTKEGGHNRRRICHVADHTGQSVMACLWANMQTRPNIHVLERCFVTDILTELDVKTKKVHCKGVVCLINQQSKKYDADKVVLATGGLGQIYQYTTAPEVCTGDGIAMAYRAGCRIVNAEFVQFHPTGFDDAMAQTALISEAVRGEGGRLINAQGERFMSNYDERLELAPRDVVARSIIKEAQRTAQGVFLDISHQSDEFIKQHFPKIYQSCLAKGVDITKQPIPVTPVQHYFCGGVLTDVSGRSDVVGLYCLGEMAYTGLHGANRLASNSLLECLVMGQNAAKSLQEPLAKWSNRDVLPNWSVQTHQKDINLASSIPLDVAQIKQLMQQHLGVMRRQEDVAKTVELLAGGLADLSTQNLTTQSQIQKLNLTMCAYLVAKASLDRPHSIGCHYWVENEPNLIAPNRLPKVV

SEQ ID NO: 3051 - protein, 308 aa, M.catarrhalis
ITPARISSSPVVKTNELLSDPEMKEMALDEIEVARANIETLEERLNVMMLPKDPNDKATAFLEIRAGTGGDEAAIFSGDLFRMYQKYTQSQGWQVEVLSANEGEHGGYKEIIARVSGIGVYGRLKFESGAHRVQRVPATESQGRVHTSACTVAVMPEVEIDDTVEINPSDLRIDTYRSSGAGGQHVNTTDSAVRITHIPTGVVAECQQERSQHANKEKAMKMLVARIQQAKVQAQIDATSDMRRNLVGSGDRSERIRTYNFPQGRMTDHRINLTLYKLDAIMEGDLTELLDSLLREHHADLMASVGAE

SEQ ID NO: 3052 - protein, 95 aa, M.catarrhalis
IAMAKKRRLGVKYGLDTLLSGTKVSRQVVDVIDDAKMVMADDNQPNDKPQAVSSTAESDTTHQSADDKAVSVLDNLPKYQQKQIALFWQFGLAEP

SEQ ID NO: 3053 - protein, 120 aa, M.catarrhalis
LIIYILGRLPMNIQALMQQAQAMQKQVEKNVEAAKASLATKEVQGEAGNGLVKVTMTGRHVVKRLAIDPSLMDDEPDMIEDLVAAAINDAVRQADELYEEVMAGATTGMGLPPSMKGLFG

SEQ ID NO: 3054 - protein, 202 aa, M.catarrhalis
LFLYTHFLNNHESVMTQHTTSDFLQAHKQAETFSRYIEVLLHASETPLTDKDLKKHLMIGSNELQDALAILQERLSYGVLTLNKTASGYRLQIKDSYSSLIQQVFPERLENLSQALLETLSIIAYQQPVTRSDIEQVRGVAVSSNILRQLFDKGWIVENGHKDTLGRPALLHTTQAFLDAFGLDSLDRLPPLPDLDHLKIRQ

SEQ ID NO: 3055 - protein, 205 aa, M.catarrhalis
IQRYEFLIKIKDKIMTNEILNIIHQRRSIGNLSLPMPNDAELKSVLEAAMVAPDHKQLKPWRFWVLTGETLIEFGQVLLSAAEHEAASCGEILDEVAIKKILNMPLRAPMIIVIATEYQYHKKVPPFEQLLSAGAVAQNMLLALESLGYRSVWRTGPLCNTPEVKDYFGVTKQNTICGLIYTGSSSVQMPDRETVDLSDYVEYRQ

SEQ ID NO: 3056 - protein, 832 aa, M.catarrhalis
IQHHFKNIRNTKMTTPNTTYDNANNHHNLQQLPLIAVRDVIIFPQTQVALFIGREQSIKAIELAQKSHEGKLIAVAQKDSLSEQIDIEDLHRYGTLCRIVSTMPHDSDDKCLKVLIEGLERVEIGRIQNANDDTDDSFIAEFTAANVDLNLSQEEADAQKSVLLELFSDYAESTLRNSRELIRVASGFDNLLELIYFVVTRTQLPLDKKQALLESGDAAEYFKVLSEYFTNTKTEHSIESQLQDTVRKQMENNQREYFLNEKMKAIKSELSDLNDGADDDDVELENRLKEADLPDDVRKKAESEFKKLKQMPASSSEASVVRGYVEWILDTPWNKASKVSINLDKAKQTLDKDHYGLDDVKDRILEYLAVQSRVKQLKGPILCLVGPPGVGKTSLGESIARATGRKFVRMALGGVRDEAEIRGHRRTYIGAMPGKIVQSLAKVEVKNPLFLLDEIDKMAQDFRGDPASALLEVLDPSQNKSFNDHYLDLDLDLSQVMFICTANSMNIPPALLDRMEVIRLPGYTEDEKMAIANNYLTPKALEQNGLKPNELDITDDALTSIIRHYTKEAGVRNLEREINKISRKAVRSQIEKYGVKPKKGVNIDSLTITDDNISDYLGVKPYDYGLAEKDPEIGRITGLAWTSVGGELLTIESATMQGKGELVFTGSLGDVMKESIRAAMSVVRANGERFGITYEKFKNTDLHIHMPEGATPKDGPSAGIALTTAIVSAMTGIAIRADIAMTGEVTLRGKVLRIGGLKEKLLAAHRGGIKHVLIPKSNERDLIEIPDNVKEGLVIQSVETIDEVLAVALVEPIRPLPPQAVTHKTSSDTVRS

SEQ ID NO: 3057 - protein, 329 aa, M.catarrhalis
VMNQSKPKNNSAINEQNATNKPAGEKLQKLLARLGLGSRRGLEEIIKSGRISINGKVATLGDRVILTDEIRIDGRQVRLKAEREKRRRVIAYYKPEGEICSASDPQGRPTVFDRLPKLTNDRWVMVGRLDINSSGLLLFTNDGELAHRLMHPSSGIIREYAVRVLGEVTPQIASQLTAGVELEDGVAKFDDIKEGGGIGVNKWYHVTIKEGRKREVRRMFESQTLKVSRLIRTRYGTVILPKELRTGRFIELDASDIGKLVDSVGLRQRQGTGLNHATKEKQARIHKKPLKSREIRRQKHEAHERREERKKHTPKHRTPNLSRTKFTKI

SEQ ID NO: 3058 - protein, 197 aa, M.catarrhalis
PNSQLPMKKKPNYKGLSMPNEIKLGFDDDLTNTVQSLYFDIDLNKIVETTLSIMTQKLHHGIDFVYFPDAIQIWHMPKSVSIYVVNHAQGRAVNLAARGKDYATNVLSYPSELPTEMTTLLGEIELGELVLCHEVVLNEADEQNKSFESHLTHLIIHGLLHLLGFDHEISDADADQMEGFEIEILAQLGIDNPYLEP

SEQ ID NO: 3059 - protein, 87 aa, M.catarrhalis
SIRQPLSNKFMQFYGTLFYLSNFNHFARLLELKTYLLGCYHQIPKELIQLLAVDLVLSDLAHFLPNNDSQCYAGDLSLLLRPNKRTW

SEQ ID NO: 3060 - protein, 190 aa, M.catarrhalis
YMTQLTFAERLKEDTRNIHDSVDETVMSVRPFDSVENYIKFLNLQSVFHKIVDPIYKDPALNQSIENLASMTRYDAVLNDLKDLEQQPNTFKAKLPAPMGAKAIGWLYCAEGSNIGAAFLFKDAKEKLGFDENFGASHLDAHPDGRGKHWKAFRESLNQLNLSKDEQDTAIQGATEAFEFYKVALKQIFG

SEQ ID NO: 3061 - protein, 492 aa, M.catarrhalis
ISFKIQMCKTFVLFYKEVWTVLHIVRTDFLEKVMSLKFGYKALSLAVFSTLTATAAQAAGLDRSGQDVTAFLQDGTYAETVYTYIDANVTGKDTAGKDTGDIAEAYDFFRYGVKADINDTFSIGVLYDEPFGAAVQYDGNSNFVADKNATATIFAQAINQATKAQLNDSLAYKSIKPVLDSVKSPQRALAVASIVETNSAQAKPIADRLRAAAAHAEATDGQKTNVEIRTNNLTMLVGAKLGANKNFQIYGGPVAQRVKGEVHLRGPAYQVMTGYDAKIATDTQLGWAAGLAFYKPEIALKAALTYRSEIEHDSEIAETIPVTGYAGKKDFKVTLPDSWNLDFQTGVNPTTLLTAKVRYVPWSDFDIRPTQYTETTKLRYPQGLPIISYDKDQWSAEVGLGKRVSDRLAVSGAVGWDSGAGNPASSLGPIKGYYSLGLGARYNVTPEWSLSLGGKYFKFGDAQAQLPTKDKVGNFDSNDGYALGVKLAYHAK

SEQ ID NO: 3062 - protein, 344 aa, M.catarrhalis
LICFDKNKGVFMKLATLKQGGPDGSLVVVSRDLSQYRKVEDIAPTLQAALDDWEVVSPKLQAVYQDLNDNRNGLPFDQTQCHSPLPRAYQWADGSAYLNHVELVRKARNSEVPESFYDDPLMYQGGSDGFIGPRDDIVASEAWGIDMEAEVAVITGKVSLGSTSKQAAEQIRLVMLVNDVSLRNLIPSELAKGFGFFQSKPASAFSPVAVTPDEITAWDNQAAKLYLPIQVHLNGELFGRPNAGEDMTFGFGQLIARAAKTRHLAVGTIIGSGTVSNKQDSLWGSSVEHGGVGYCCLAELRMYEAIEGKQQTPFMQDGDVVRIEMFDETGESIFGTIENTVKAI

SEQ ID NO: 3063 - protein, 267 aa, M.catarrhalis
DKHKNTPIQFLRIAMQKIHLIIPARYQSTRLPGKPLLLLHDQPMILWTAKKALKASFVDTVCVATDDDRVYQTCADVGIHVVMTDSTHPSGTDRLAQVATDLGFDDDDIIVNMQGDEPLVPTVLLEQVTQLLIDNPDCAMATLCEPIYHQEEFFRPSVVKVVMNQAKHALYFSRAPIPYDRDGLLDMPNHAFRHLGLYAYRVRMLKQFTNWTQGVLEKLESLEQLRVLENGERIAIDVAKVALPAGVDTQEDLDRLNAMPMDEFLKF

SEQ ID NO: 3064 - protein, 259 aa, M.catarrhalis
DKDKFMKTPLFALPDALLIPTVQAALLEDLGRRGDVTSAAVIAKNSTANLAIVSRDTGILAGMDLARLAFECIDKTINFSPNASDGDTIKSGQVLAYVSGNTQALLQAERTALNFLTHLSGIASMTAKAVAQISHTQAKITCTRKTTPLLRNLQKYAVRAGGGCNHRMGLDDAILIKDNHLIYSGTLKQAIANAKAAAGHLIPIEVEVDTIAQLEEALKAGADFVLLDNMDNDTLKPRRITLPRAEQKQRHQVALPLND

SEQ ID NO: 3065 - protein, 383 aa, M.catarrhalis
QIDNLNSRQAVLHWKNKPNIMTKIITTDDIAIMTDDDILAILTKALSHLLKNIELTHDEMRQVMLIIMQGRCPDALMGAILIALRQKGESIDEITTCAKTMIELADTIDICNPNAVDIVGTGGDGSNLFNVSTASAFVAAAAGVTIAKHGNRGVSTSSGSSDVLSLAGVRLDINKTQTVKAINTLGIGFLFAPNHHPAMRHAVGVRRLLKVRTIFNILGPLTNPAKVSRAVVGVFSPELCEPLAYVFAKLGLTHVMVVHSQDGLDEFSLATGTHVAELKDGKVHTYLCQPEDVGIVSRTLYGLTVNDSKQSLEIIKNALGGTANDDISLKARAMIAINAGAAIYVAGHAKTHAEGVAIAKQIMTSRQALDKLNAFANFTQHCE

SEQ ID NO: 3066 - protein, 219 aa, M.catarrhalis
SSQNLRFFGDFMTQHNTQTDHTPNPNDLTHPAKSATISDLNPIIHQDELFDESDMIKVTNDPEHTPESAETFHDTQDSYIYGDADATDEDTIETMTVYDPDADRLEDIEQSGDNETVICYAYSRKTGAPIEPLAIEDVSRTLTNNNQFIWLGLYDPSLETVQEVQDAFDLHELALEDAFADHQRPKVESYGNDTIFVVVRTAKLEDNQIRYGATAIFMG

SEQ ID NO: 3067 - protein, 61 aa, M.catarrhalis
TLKNSIADNVSEGSDHVDVGGKTTHILSYLQDFFSRQIVLAPLLKHYQAVKKHAFYWPNYC

SEQ ID NO: 3068 - protein, 77 aa, M.catarrhalis
KFTNFFDVHQYYLDKNKNVNITPVKRLSTPLASKTYHRLSKQPRWFKNYLYIVYIRFILLQVFFCHILVQFGKLMSV

SEQ ID NO: 3069 - protein, 63 aa, M.catarrhalis
KCKKIQTQQLMIKGYYAINIKLAQLGKQIGRYFDILKLARTTCTAIVQVALGIISTITRIMII

SEQ ID NO: 3070 - protein, 314 aa, M.catarrhalis
LLKEYFIMSVRHFRNLLDMTPAELEAIISRASKLRQMQQCGEIYRPFVGRTLGMIFEKSSTRTRISFEAGMGQFGGHAIFLSPKDTQLGRGEPIEDSAKVISSMVDIIMIRTFEHDKLDLFCKHSSVPVINALTDDFHPCQLLADMQTFHEHRGSIKGKTVTWVGDGNNMCASYILAAHQFGFQLRVTAPYGFEPNPKLIEEYSHCVTYVEDPQEAAKGAHLITTDVWASMGQESEQMTRARRFAPYQVSPAMLDKADPDVLFMHCLPAHRGEEISFDLLNDPRSVVWDEAENRLHAQKALMEFLLKDKINLSS

SEQ ID NO: 3071 - protein, 376 aa, M.catarrhalis
CKKEHVMHKNTQQAFDYEAPLSNMPTTSCRIKQAWAKIPPELPKDALTQYQRNIKDLLIQKDAVIIAHYYVDPDIQDLALATGGCVGDSLEMAKFGAAHDAKTLLVAGVRFMGESAKILSPHKTVLMPDLQAECSLDLGCPIEEFSAFCDAHPDRTVVVYANTSAAVKARADWVVTSSVALEIVSHLHAKGEKIIWGPDRHLGEYIRQKTGADMILWQGSCIVHNEFKSIELEQLKSKHPEAITLVHPESPASVVAQGDVVGSTSKLLQAAIHRPEKTFIVATDLGILHEMKKHAPQKTFIAAPTAGNSATCKSCAFCPWMAMNGVQGVYQALKYGTGEIQLTESLMNDARHALDKMIEFSKTLPKKPAVHGLGVA

SEQ ID NO: 3072 - protein, 144 aa, M.catarrhalis
HQLLSTLMIIINLENTTMIRTLLGGKIHRATVTEANLNYVGSITIDVDLLDAAGILVNEKVSIVNNNNGERFETYTIAGERGSGVVCLNGAAARKVQPGDVVIIMNYVMMQDIDAQNHKPNVVLVDANNHITQIMHYEPANTIW

SEQ ID NO: 3073 - protein, 248 aa, M.catarrhalis
RDFCLMNKRLMLLMMSATYLKLYEVVRTELAARGILNCVLEDSNHYARELHTIQNQPDEMLYLDLLAPIYNRRQLGVLQQLTIWREALARATNEPRSFIISKQALREIVQDMPDSIKLLARTTINRAVLRRYGNEIVRIICQVKNMPDGNLPALPPPTYHSKSKPFKNDLNDIINAYSQSHYIPPNLLLKNRWMNDLLVLVAYDGLIEELPLELLGYRQSLITNNILPALRPYKEHILEVLNTPEYNH

SEQ ID NO: 3074 - protein, 74 aa, M.catarrhalis
NRVWCRIAWANPNFDFRHTGRFMQHSHRRVLATALARLRAKIKYRPVIFELMADEFTLFQLQKSVEALIRSRTA

SEQ ID NO: 3075 - protein, 356 aa, M.catarrhalis
LINCRLEIFMIKKRGLGMNRGLDVLLGNISAEKKIIAGAQSLVASAASEQTETKPTASTKTTKINKAKADKKAGNNNNPALEAGMGEKVALVQIATNRLQSGKYQPRRDMNEAALNELSLSIKQHGVMQPIVIRPLLSDESKSSDTVTHEIIAGERRWRAAKLVGLETIPAIERVLSDEVAIALALIENIQREDLNVLEQAAALQQFHTEFGMSHAMIASVVGKARTTVSNLMRLNHLHDQVKQYMIDGVMDMGHARTLLSLSQEQQPIIAKKIVDGGMTVRDAERLVKSILDPNPKLIVQPNHEVLALSQQISDALGAKVKLKQGKDGKGSVEIFFYDHDEFGELVNRLCQISDY

SEQ ID NO: 3076 - protein, 124 aa, M.catarrhalis
SLCCSKMASTSISGSGSGSGNGSGNGSGSGMGSGGSITSGVATSGSTTGSGVTTGSPGGSGDSRSLSAMGSGTGSLINSISKGGVTGGGVIGFIVIFANPKPTNPCKTAAIEIANTLIFLELST

SEQ ID NO: 3077 - protein, 343 aa, M.catarrhalis
SMSCHHQHKQTPKHAISIKHMPSLTDTHKQSSQAEPKSFEWAFLHPKYWGVWLAFALILPLRWQFWIGKRLGILVHYLAKSRVQDTLTNLQLTFPNQPKSKHKATARQVFINQGIGIFESLCAWFRPNVFKRTFSISGLQHLIDAQKQNKAVILLGGHRTTLDLGGRLCTQFFAADCVYRPQNNPLLEWFIYNARRCIFDEQISNRDMKKLITRLKQGRIIWYSPDQDFGLEHGVMATFFGVPAATITAQRRLIKLGDKANPPVIIMMDMLRQTPDYIAKGHRPHYHISLSAALKNYPSDDETADAERINRLIEQNIQKDLTQWMWFHRRFKTQADDTNYYQH

SEQ ID NO: 3078 - protein, 157 aa, M.catarrhalis
PFDWRNINILIFIKVILMDIKKIRELLDLMEEKDLLNLEYGYDDKYISLTRNTAVQTVATTQVVSAAPSATTPAVVKPSGQLETSPMVGVFYSAPSPNDPPFVKVGQKVEAGDTLGIIEAMKIMNPLEATQSGIIEEILVKNAEVVEFGQPVIRYKA

SEQ ID NO: 3079 - protein, 447 aa, M.catarrhalis
KDACRMKLRKPNVKNQKVQKIVDAASVGIDDAVSAIKESGLPNKPLISSIAELTGLKKKKSAQLVESMQATEQIASDIHQMSFAFLGGGSFGTAMANLAAKNGCDATLWVRDKRTVKSLHKTRINKKYLPNHKLDERLKFSHDLKTAVAGVDVIFVAVPSSAFREMLTNIKPFITHQAVVSLTKGMEKETFAMMSDIIQEVLPEVNFGVMSGPNLAVEIMDNMPTATVIASASEPLRKAVQTALHSAFFRVFASSDIKGVELGGALKNIYAIAMGMAAAYDVGENTKAMLLTRALAEMSRFGVAVGADPLTFLGLSGVGDLYATCSSVLSRNYRIGYMLGQGISLEHAIKKLGQTAEGVNTILQVHSRAKALGIYMPITHALHAVLYENKSALGVALNLMETGFRSDVEFVLPHDESNVRLSHEFSEVLKTSANAKPKDEIQSSDMP

SEQ ID NO: 3080 - protein, 233 aa, M.catarrhalis
PCRCWWKNYAHFKLFARFFFTPNRARPPVKALSGGEKARVLLAKLLLKPANVLVLDEPTNDLDMATLELLEDFVVNFKGTVLLISHDRAFMDNVVTQTWVFDTDKYGDGIVLEYVGGYEDYVQQHERWLAHHATDNKPKATKPAEPIQIKPPQSGVAQKRKLSYKEQRELEDLPNEIAALEQEQAQLAKKIEDGSWFNTDLAAATKAGERLVEIDELLMMKLERWDELENMTQ

SEQ ID NO: 3081 - protein, 80 aa, M.catarrhalis
VDIFMPDVLFTKDFTLIDLQTRISFLEDTCDELSKIIARQDRDLRDLQDQLKLMYQHIQAKQDDVGIATFDLLADRPPHY

SEQ ID NO: 3082 - protein, 115 aa, M.catarrhalis
RRKSRVFWRAWGMSEASLDRVIRAGYELFNLQTYFTQGVKKVRAWTVPVGATAPEAVGVIHTDFERGFIRAEVIGYDDFIEYGGEKGAAAAGKSRLEGKTYIVQDGDVMHFRFNV

SEQ ID NO: 3083 - protein, 76 aa, M.catarrhalis
WQMSLHYFSFKKASKPLSGQELHKQNFRRQVQQQNLIEAIEGRFAHERGRPAQLYRFKDTVLLERLLSNTRLPVSK

SEQ ID NO: 3084 - protein, 616 aa, M.catarrhalis
ILIGLPFFLDRRLSHFWHTAAVGLKLCKQGVSMLTFLAIVPIIIVFLLLVVMRLPAKYAMSLAYLATAALSYFVWQTSGNQVAAATIHGVLTAVNVLFIVFSAILILNTLKYSGAINAIRQGFMDISADRRVQMIIVAWLFGCLIEGSTGWGTPSAVAAPLLLALGFPAMACVMAVLIIQSTPVSYGAVGTPLLIGVNSGLENKDDLAQALANIGMDLPAYIFNISGNVGMIHGMVGFLIPLILCGFLTLFFGQKRSFTEGLKVAPFAIFAGLAFTIPYALTAKFIGPELPSIVGAVVGLSLVIPAAKRGFLTPKQTFDFGPRESWEKEWVSEFTITDSTSDVAPKFSVIRAFSPYLLIITILIITRTIAPLKAWLTSDAVSIVFANILGTNITNKTQLLYSPGGVLLLVSILCIFIFGMKGNMVKKSWSESGKTMLAAAPALLFSVPMVQVFINSGTSPDAAVQILAMPKVLATSAAQAFEGMWPLVSPWIGSLGAFIAGSNTVSNMMFSHFQWGTATQIGLGVMDAAKVVSLQAVGGAAGNMISVHNVVAACAVVGLVNREGYVIRKTLIAMSYYVIQAGLIGMAIIFNPTYWVGAVIWPILFLFIMSKVGNKA

SEQ ID NO: 3085 - protein, 330 aa, M.catarrhalis
NPHGRYAMNEQEQLPYFAPLLPWQRQAWQQLTGQFIEQRMPHGLLAAGQKGIGKREFVWRFVAYLLCLEKNQYGACGHCQSCQWLRAGTHPDLLVLPQGDSIKIDDIRLLQEYSQTKGHGVKVIVLDGADTLTLGAANAFLKTLEEPRDGVFLILITDHPSRLLPTIKSRVQTMPLSYIDKVEAIDYLSEFMSPELSKLLLDISDGAVLQAKSLSSAKWFDQRTLWLKTYTALQLSKRTASAASSYWQKTLTLAEFITLSRVMLMDLWRVFLGIPSLHQDIDVVALLAQVQLDSSKLESLLSCIDDTQTAYAQNVQETLGFDRILIEMAK

SEQ ID NO: 3086 - protein, 347 aa, M.catarrhalis
GMNGLIEKGVPVRERLRISPACSFIMPYHTALDQAREIKRGSGKIGTTGRGIGPAYEDKVSRRALKVADLFRADLPEKLENLLEYHNFALTEYYKVDAIDFDTTLKLCQEWASDLKDLVIDVTDALEIRRQNGENLMFEGAQGTLLDIDHGTYPFVTSSNTTAGGVSTGTGLGPLYLDYVLGITKAYTTRVGSGPFPTELFDDVGAHLAKVGHEFGATTGRARRCGWFDAVSLRRAVVLNSMSGICLTKLDVLDGLDEINICTSYEVPEGECAGAYDAEYYEKVVPKYETLPGWSESTIGVTNFDSLPANAQVYIKRIEALVGCPVDIISTGPDRDETIVLRDPYDA

SEQ ID NO: 3087 - protein, 80 aa, M.catarrhalis
VLVGSVGWVECCHDTQERQDGLSRGSIMWGFTSLLWSEEQVLLRYELLYETGFGAESPGQTQILIFVILVVLCSIAIAEY

SEQ ID NO: 3088 - protein, 185 aa, M.catarrhalis
GEFMDFGFYWSHTDAVSKTLFFVLLALSMISWVVGIMRVINSRRRTANIVDELTAQINIQNLGDLPFDQRKMATEQKLLQQIARHRYELEKGLPVLGTTASIAPFIGLFGTVWGIFHALHSIGATGQAGLAQVAGPVGEALIMTGLGLAVAIPAVIFYNIATRINKQAIHLATDTAHQILSKIVQ

SEQ ID NO: 3089 - protein, 370 aa, M.catarrhalis
QGFIMSNQTPLERYQAALATGDFSEDAVQLAAVTYMDNLYHEIIKSQDSSGGGWFSSLFKSKPVMPKGLYMWGGVGRGKTWMMDMFYESLPIKRKMRMHFHHFMQRVQRELVALQGQADPLKKVADIIHQEAVVICFDEFFVSNVSDAMILGDLFSMLFDRGITLVATSNIEPSSLYKNGIHRDRFLPAIAQVEKHTTVMNIDAGIDYRLRLLKQAKLYSSPLTDDTKDWLSERFDTLAGGQTISTSPIVIGGRNIDIIKRTETMLLADFRALCMQPRSAADFIEIANDFDTVMVDNVPALNDTLMDPTRRFIYLVDEFYDRRVKLLIRAEQSILTLYQGEKLAFEIERTRSRLLEMQSEEYLAEEHRLD

SEQ ID NO: 3090 - protein, 264 aa, M.catarrhalis
GFIMEIIAIANQKGGVGKTTTTVNLAAALAIIAKKRVLLIDLDSQGNATTSVGLDKNALEYTMADVLLDGVSLQDAILSTDIGLDVIGANRDLAGIDVSLAGVADAPFLLKQAMADAKMAGKLEYDYIVMDCAPSLSMITVNAFSATDGVIIPMQCEYYALEGVADLIATIDKLKSINESLHIRGVVRTLFDYRNTLAQDVSGELERHFGDLVYQTSIPRNVRLAEAPSFGQSIFTYEKSSKGAIAYHKLMNEVIAQTKAKSNG

SEQ ID NO: 3091 - protein, 65 aa, M.catarrhalis
GYIMGKNVVVLGSQWGDEGKGKIVDLLTEKATAVARFQGGHNAGHTLVGGGEKTRSASYSIRYFA

SEQ ID NO: 3092 - protein, 216 aa, M.catarrhalis
PLIIHMNYQDKFARIVVYCGSNFGDTPAYYHAAQSLGKTLAEHDITLVYGGGNVGLMGTIADSIIAHGGKSIGIIPRFLKDKEVAHHGLSELITTEDMASRPLKMISLADAFIALPGGIGTYEELFEVMSLAQLRQHAKPIGVLNVDGFFNPFLKLLEQTAKAGFMPVSNINLICVADNIPTLLTKMATYRFTESQKWVKPSWMDETSAYTVPKFT

SEQ ID NO: 3093 - protein, 253 aa, M.catarrhalis
YTVIHSTFKFITGRTMSIARTTNREQKKRQTRQAFFNAVLDLCMSGQGYSSVSLRQVTREVGVVPTAFYRHFDDMESLGKALVEDELGGALATLREHMQLGRKRSFDRQIAKSVQLFFKAVDAQPRYWQFIASERFGGSEAVRRAINEQINTFAKIMSADLVLQPAFEHINSYDRYLLAETGVNLSFSWIIEWLDLTHMPIFLDEEERLSTCELDTKKQQMLHRCTRQMQMVLYGAYNWKSSEETLLDEPANI

SEQ ID NO: 3094 - protein, 160 aa, M.catarrhalis
RITMNQKLLLASVVAALTLTACSKPADESSQANPSAEQVANPATPDSTAEHATMQDEHTHAHEHHDDHAGHMHIHTDGDAYQCGDQTVHIVVHNHEGEIEAHLNHDGIEYDFNQDPSNKNQYTSNHGFADNQKTILTIDGNKAVVTGDTNQVLLDCVKAS

SEQ ID NO: 3095 - protein, 146 aa, M.catarrhalis
GKTMAIERTLSIIKPDAVGKNHIGDIIARFEKAGLKPVAMKYKHLSQADAEGFYAEHKERGFFGDLVSFMTSGPVVVSVLEGENAVLAHREILGATNPQEAAQGTIRADFAVSIDENAAHGSDSVASAEREIAYFFGDDEVYPRTR

SEQ ID NO: 3096 - protein, 219 aa, M.catarrhalis
NQNIYLNQGFIKMILMIDNYCSFTYNIVQYFGELQQEMTVWRNDETTLDQIIKLAPRAIVLGPGPCSPNEAGVTLEILDKLSGKIPILGICLGHQAIGQAFGGQVVRAGEAMHGRLSSVHHTNQGVFADIPNSFNATRYHSLVIDKASLPDCLEVTAWTAHADGRMQEIMGVRHKSLDVEGVQFHPESILSEYGYQLLNNFLKRCGLAKLENSHLPKVV

SEQ ID NO: 3097 - protein, 415 aa, M.catarrhalis
FYCITFHLMALIHLKNIHLAFGTAPILDGVHFTLKPNERVCLIGRNGEGKSTLFKLIMRQIHADDGEVLIKDGTKIAMLAQDVPNESASVLDVVMEGDDKVAQALKNYHQASAKCAMGDNEACDVMSGLQQTLDALNGWDLERGARALIDSMGLDADACLSTLSGGRKRRVLLAQALVTNPDVLLLDEPTNHLDIESITWLEKFLLNERLTVLFISHDRKFIDTLATYIIELDRGQLSGYDVTQGVGGYARYQELKALELASEEKSFAEFDKKLAQEEVWIRQGIKARRTRNEGRVRALKAMREERKARRDVLGTVQISQNNSEKSGKIVCEVNHLTLEYDNKTLVKDFSTLLVRGDKVGIIGKNGVGKTTLIKSILGLDDSAIQSGSVKLGTNLNIAFFDQLKDDLDPEKFYRR

SEQ ID NO: 3098 - protein, 130 aa, M.catarrhalis
IMSIHSSTNTPQQTDGLVDLVTVLAAVTDHKARILTVSGGDKLPSGQLTPIHHSLQAGVKDWVRTQTAQPMGYVEQLYTFVDGERKNAQGMPVLYVSYLGLVKEATAHSLNPDATWQDWNDYFPWEDRAY

SEQ ID NO: 3099 - protein, 358 aa, M.catarrhalis
NKSIIMNTTKKRILTGITTTGIPHLGNYVGSIRPAIAEAHRAFENHDGDAFFFLADYHGIIKCFDPDEIHRSTRAIAATWLACGLDPEKVIFYRQSDIPEIPELAWILNCSCAKGLMNRAHAYKAAVDMNLSKEDTDPDYGISMGLFGYPVLMAADILMFNATHVPVGKDQIQHIEMARDIAGSFNFKYKPLFVEPFAVVDENTPLLTGLDGRKMSKSYGNTIPLFGDGNPHIDPEKALKKAVMQIVTNSQPPEEPKDPEHCTIFEIYKAFGTPEEIEALATHYRRGIGWGEAKEILFNKINHEIAPYRERYLHLMNNPKELEEILQMGATKARRVAQKQLDKTRRAIGIKPLAKLKS

SEQ ID NO: 3100 - protein, 350 aa, M.catarrhalis
VGILSLLILILSTTMTQKVRNTPKSILNNSQTRSQINPKEDTLGTILPKQAATLTTKSMQKTPKSQVVAVKPNDIVPSKSIYQTANQVLRVVSINVNGLRAAEKKGFFEWLAVSNADVVCIQESRITHEQWTDKFRPKGWHTHLFAAQKAGYAGVAIYSRLPFVSVVDGLGFDLADSQGRFICAQFDLSAQGIDHPVYIASLYLPSGSSGEEAQARKDLFLEKYRHILKQWRDENKSLIVCGDYNIVHKRIDIKNWSGNQKASGCLPHERAWLDHIYDELGYVDTFRVVRKDADIYSWWSNRGQARAKNVGWRIDYHACSPDWKKRTLNAWVYKDSWFSDHAPVIIDYQL

SEQ ID NO: 3101 - protein, 222 aa, M.catarrhalis
NFIISVRRGASISTPPVREHCHRRPEKLRLGPIFVLHAILDFIVDNYLPITDRLGNYLREQERNIFSHEFSKSTLKSLYELKSQLVHMRAVILPVQDVCNFFINHKKNELVSAFPVAAKPYFRDVNDHLLRSIDAVNGLNEMLSVAMDTYMAMVTMGQNDVVRKLAAWAGIAAVPTAVAGIYGMNFDYMPELHIRYAYFVVVGAVMLVCLFLYTKFRKAGWL

SEQ ID NO: 3102 - protein, 356 aa, M.catarrhalis
SSDIKISRAMVMKKLELALTQAWQKNAAWLKLLTPLSGLYGMVMHARKSLYHSGKCPIYRAAVPVLVIGNITVGGSGKTPFIIALTKILRKQGISVAVISRGYGGDSTQMPKLVTPTSTPNEVGDEPCLIAQSLYSDGFFLPMAVAPNRGQAIDLLLKNFPETTLIISDDGLQHYALHRDEEWIVVDVARGFGNGKLLPQGFLREPIDRLQDALVLYHDKDMTKYPKKAMAMSLKVGQIEPLMGNHKSPVPSVGTYVHAVSGIGHPKRFFDTLSDQGFLVIPHPFGDHHDFRLEDLVDLINHPIIVTSKDAVKLRHLATQTTHDIFNHIWVLPVEMVLSDGIIEQINHLIVKYKLN

SEQ ID NO: 3103 - protein, 216 aa, M.catarrhalis
KICIMKALFDYIPLIIFFVLYKTTEPTDSTHPILQLIGSAGTDNNHILVATFGLIAATVIIYGYLFISQRFHLEKQQWFVLLMTVVFGGITLALSDAFYIMLKAVLINGAFALGLLISPLFSKDKSPIIKRLFEPVFHLTHQGWQYLNLAWVSMFTVMAGLHTFFAFIFAEGKYWGEFTAFGDMIVMFIFLGVMFFCLRKNIKKDITENSKKSLNK

SEQ ID NO: 3104 - protein, 216 aa, M.catarrhalis
  UNSURE (203): Identity of amino acid sequences at the above locations are unknown.
SLSITRTIQTNLNTHELRTLLGEYNKHIKYIQERLEVQITQRQDQFIITGELDLVERTEIIINKLVELAGEQHNISGEELHLIIQSSLSRDYDYANTQGKHHDHSGNSKDKSDTNVALRTRKGKIIPRGYNQQEYTKKILISDVSFGVGPAGTGKTYLAVACAVDMLERGEIERILLVRPAVEAGEKLGFLPGDLTQKIDPYXRPLYDALYEMLGL

SEQ ID NO: 3105 - protein, 465 aa, M.catarrhalis
FIIIFLKNFMNFFGYNTEFNFDRYDLGVMMNAVLLAVIVMVGLSLVRVHVVLSLVVGALVGGLMAGMSVADTLTSFQDGIKNGAQIALSYAMLGAFAMAIAHSGLPQILADKLIARLQYADGTGGLKFLLFFILIIMAIMSQNIVPIHIAFIPLIVPPLLSVMNRLHLDRRAITCILTFGLVNTYMFIPYGFGDIFLNQIILKNINEAGMITNNISMMQTMMIPALGMLIGLLIAIFVTYRKPRHYQEKVVAVSYASIQVGTLNIVVAMAAIVAAFVAQLMTDSLLIGSLVGFAIFMATGIVKWRDANEVFNDGIKMMAMIGFIMICAQGFAEVMKATGQINALVDGAVVLFGDNKMLAAVSMLLVGLVVTLGIGSSFSTVPIIATIYVPLCMAMGFSVPATVALIATAGVLGDAGSPASDSTLGPTMGLNADGQHDHIHDSVIPTFIHYNIPLIIFGWIAAMVL

SEQ ID NO: 3106 - protein, 141 aa, M.catarrhalis
DCTIKEGLMAFELGDHDNNGMNEMNLIPLIDIMLVLMIIFLVTATVLNPSVPLDLPKTSASVNDAPPEVLQISIDEAGGIYWDREALTLDELSQRFTEQVNAGKNPQINLRADKEGKYDTVAQVLAEASKAGLGKIAFVSE

SEQ ID NO: 3107 - protein, 828 aa, M.catarrhalis
SAKIPFLTNPLRFLGISFIFYYFAQRIADEADFDFMKDNAYHRLKNNYRLQACDLKRYTDPNHLPKSSRLHLPKPDIAFGQSRAIKALNTALDIHANGYHVFAVGENGLGKRTLVTRLLAERAKHMPTPNDWVYVHHFEDIRRPIAIDFPAGMAIIFQQKVHKLWQNAKKKLVAKLLGDTHQNHIELIKSAIPLQQNKRFDAINADAKQHNLVLKTTGDGRVHFVAIDDSKPIDTKKLAQLQKQLLEAQIELSELEDSTHEALDELHQSTAKKVLEPMFNAVMANFENHPKAIRHLMAIQDDMVKNITHIINEDDDNFIATSLSQVPSRYVVNILVSHQPSAGAPIVFEDLPTHLNLLGHIEYTTELGTVLTDVSMIRAGALHKANGGYLLLEAQSLLEHPYAWQGLKRALQSKQIKISSLEQMLTLTGSLSLEPDSVALDVKVILLGEADLYYELLEFEPEFNSVFKVRADFHDDIQRDDCSEYGMVLKMVDMIKSHQLPNFDNTAFAVIIDELSKLSDDKNKLDLHADRLSGLLVESARIATLENNKIVTAKHVQTALDDITERKGYLKDLYWQEILNGQQIICTKGWAVGQINALTIISYADSEFGLPARLTALIQPNFGQGEILDIERDVELGGSLHAKGMLIMSSFLRALFSEFHELNFSASLAFEQSYGQIDGDSATLAEACALLSALANIPIAQNLAITGSMNQLGQAQAVGGVNAKIAGFFDACRDKGLDGNQGVILPRANIAQLMLRDDIVQAVKDEQFHIYAIDHITDALALLSGMLIDDKNKHGEYKRNTLFGKIVKRLESWVQDDKDDKDNRTAKN

SEQ ID NO: 3108 - protein, 382 aa, M.catarrhalis
FMGIYLTATGLYKPAYQISNDELVAAFNTYVDNYNAEHAKAIAAGDKVALQHSSSEFIEKASGIKSRYVIDKKGILDPKIMAPIFPARKLGEELSVMAEMGLAALKDALDRAKLTADDLDGIICASSNFQRCYPAIAIEIQHAIGMQHGFAYDMNVACSAATFGIAQAVGSIKAGLGKKIAVLNVEITSAHLNWRNRDSHFIFGDVAAATIVEELSTPKGYEILDSKLYTQFSANIKNEYGFMDRSEFLAADTQMYADIKEPVTDKLFLQEGRKVFREVCPKVSEIITIHLTENNLSADQIKRMWLHQANINMIDLILRTVVGKDADKSIAPVVIAEYGNTSSASPVVAFHETQDGVESEDLCVMCSFGAGYSIGSVLLKKV

SEQ ID NO: 3109 - protein, 620 aa, M.catarrhalis
GITMAEAGMASELIKVVTLLGAAVIAVPLFRKIGLGSVLGYLAGGLIIGPFGLGIFTDPQTIIHTAELGVVMFLFIIGLEMHPSHLWSLRRQIFGLGSLQVLGATALMMLVLKIFGVSWQVAFVGASGFVLTSTAIVMQTLGENNGLSTAKGQSMVSILLFEDLLIVPLLAIVAFLSPVVHTSETPAWQAIAVALGSLLALLIVGRVLINPLFTILAKTGVREIMTAAALLVVLGSALLMELGGLSMAMGAFVAGVLLSESSFRHQLEADIEPFRGLLLGLFFLGVGMALDLSIVTKNWQLISLGIIALMLTKGLWIYFVARMTKAGHAIAIERAVMMAQGGEFAFVLFSATGTHSVISADTHANLTAIVVMSMVLTPLFLVIHQKYTAKNTSPASVRDSDAIDEENPIIILGHGRYGQVVNGMMTACGYQTTLIDSDADHVDGLSNLGIQTYYGNATRFDLLDMAGIAKAKLVLIAIDHPKEALSIVRHLRHTYNDLPIVARAYDRIHAYQLHKAGASAVIRETFDSAVRSARTGLELLGMDSEIAERIAHLYHHRDRDGVAAAAETYDPNISRYKNTHMISMLNHHRAHTKMMIEKILRGEEVKWQPKRGTYLGQENQ

SEQ ID NO: 3110 - protein, 769 aa, M.catarrhalis
SKTVFKTFGAIMTHIDTIKVTKRDGRLEPINLDKIHRVIAWAAEDLNNVSVSQVELKSHIQFYEGIRTRDIHETIIKAAADLISVETPDYQYLAARLAIFHLRKIAYGKFEPPHLYAHVKHLTEQGKYDQHILADYSIDEFNELNDYVDHNRDMNLAYAAVEQMMGKYLVQDRVTKRVYESPQFLYVLVGMCLFAGYDKAQRLDYIKRFYDATSNFYISLPTPIMSGVRTPTRQFSSCVLVECGDNLDSINATTSAIVRYVSQRAGIGVNAGAIRALGSPIRGGEAQHTGCIPFFKMFQAAVKSCSQGGVRGGAATLFYPIWHLEVESLLVLKNNRGVEDNRVRHMDYGVQINKTMYARLIKGTDITLFSPSDVPGLYEAFFADQETFERLYTQYEADENIRKRKVPARDLFSLMLQERASTGRIYIQNVDHCNTHSPFDPTVAPIRQSNLCMEIALPTAPLDNINDEKGEIALCTLSAINLGKIEKLSDIEEPAELIVRALDALLDYQDYPVIAAKKGSTNRRTLGVGVINYAYYLAKNGTRYSDAAALGLTHRTFEALQYYLLKASNKLAKEQSACPWFDQTKYSQGILPIDTYKKDLDSICTEPLHLDWESLRTNIKAYGLRNSTLSALMPSETSSQIANATNGIEPPRGLVSIKASKDGILKQVVPEIERLASQYELLWNIPDNNGYLRLVGIMQKFIDQSISANTNYDPTKFEGGKVPMKVLIQDLLTAYKFGVKTLYYHNTRDGADDAQGDLDDGCAGGACKL

SEQ ID NO: 3111 - protein, 81 aa, M.catarrhalis
DRCLYFMATGLSPAFSKRAMISPIWFLPTASGLMIDKVRSIAIVFPYARLSDSKIVIDYNNFSNNLHLFKSVYGEIFTAGL

SEQ ID NO: 3112 - protein, 361 aa, M.catarrhalis
RIFFLGFIMTLIKPLSLVMISLLSIGIAHANTDGDIISGEVIVPTQTDDTVINSIEQGGKRTTIHNLDEYARRVNESLWTQDMKVNTAMTVKMQVLLDWNHASPGPIDGGWGMNSKKALMNFQKIKGLEPTGKMNQATWDALNQNIATNQPVLVSYTITEADAKGPYKTLPNDAESRSKLKALGYESIQEMLGERFHMDVAYLKKLNPNKRFVAGESITVINTGKPFEGVVTRVVADRKDKILYAYHEDQLVATYPTTVGGEASTTPGGKYKIINKVKMPTYKATVNRDDEDNKVYYLPPGPNSPVGVVWMGLNKPSYGIHGSPIPEGISRQSSLGCIRLTNWDVLELVAVIENGATVEIR

SEQ ID NO: 3113 - protein, 201 aa, M.catarrhalis
VFKVLGVAMTIVYFIRHAEPNYANRDEFSRDLTPKGIAQSERLLDVFRGIDIDVFFSSPYKPAVDTIYPLANSRKKNIHLKEKLCERRIGTWVDNFDEFSQKQWQDFGFHLKNGESLHRVQQRNIAMLHEILINYPNQTIVIGTHGTALSTIIKYYQADFGYQDFNANKHKFPWIMAFEFDGIMLKRYHEISHEIHMDDTP

SEQ ID NO: 3114 - protein, 165 aa, M.catarrhalis
MMKVIFVRHGQAAPYCEDDAGRDLTDFGRLQVQQTAQYLAKHYQLDLIIASPYNRADQTAKILLSWAMTLGQNPSFMSLNSITPDDNPMIAIDDLEDIVRTKFGEDLDDKCVAVVCHMPIVASMVARLENLSPASFELAEARILQMPVLAQGLATTQDVFIPNQS

SEQ ID NO: 3115 - protein, 86 aa, M.catarrhalis
VSLLSDYLLSNYLLSDFLEFSVMSFLIFFLRQKNITPKNINMTIISPKAVNSPQYFPSAKMNAKNVCKPAITVNILTQAKLRYCQP

SEQ ID NO: 3116 - protein, 234 aa, M.catarrhalis
LVKLIKNDDMTPKFSKISHKFQRFATAIDEAAQSLGLTITDVQNMQILRYLDGLLLWGKAYNLTAITDPDEALVKHIFDCMAIIPMLPFVTQPNKSLLDIGTGAGLPSVILAILKPDWHIDALDSNQKKIRFIRQISSEIGLKNIMPIASRIEHHHAQKAGAYDVITSRAFASLTDFVSLATPCLADTGVLYAMKGKNPTAEEMADLQAWHIDIEPICVPKLDDDRCVVYLTKQ

SEQ ID NO: 3117 - protein, 279 aa, M.catarrhalis
FDKFWYNDKISHNIREFIMGFNCGIVGLPNVGKSTLFNALTKAGIAAENFPFCTKDPNTGIVPVPDPRLKALAAIVNPERTIPTSMEFVDIAGLVAGASKGEGMGNQFLANIRETDAIAHVVRCFDDDNVIHVDGQVNPLSDIETINTELALADLEAVTRAITNLNKKAKGGDKDAQAALGVFQKIEPLLADGKPARLADLDADEKKLIKSYGLITLKPVMYIANVAEDGFDNNPHLDAVREFANNEDAIVVALCNQIEAEIAQLDEEEKAEFFGGHGA

SEQ ID NO: 3118 - protein, 171 aa, M.catarrhalis
  UNSURE (7): Identity of amino acid sequences at the above locations are unknown.
PKKLTLXCVLCMMHCMRCLGFEKVGKLLERQVIEVAPLAYMRGRTLNNSFVILDEAQNTTPEQMKMFLTRLGFGSRAVITGDMTQVDLPRGHKSGLAQALQILSKIDEIHITRFDSNDVVRHHLVQKIVQAYDQFDEVQQAAAAERRALHLTKQSIANEEKTELQGAVDAQ

SEQ ID NO: 3119 - protein, 128 aa, M.catarrhalis
LNELIYNWGFMMKKLLAVAVLGGLLSACTSTSTTAPVITRTDGIHETTGLGVTKTKAQESALAAAKKQCGIQSPIVVSDKMTYNGILNEHTGRMIEQGVSVAGAIFGQSAPKLSRDDDFEYAIKFRCQ

SEQ ID NO: 3120 - protein, 322 aa, M.catarrhalis
VDNSKKIKVLAISIAAVLHGLVGFGLANMTIKPITPPPVTPPLEIEFIKEPVPEPIALNDLESPEPPGEPVVTPEPVVEPEVATPEVIEPPEPIPEPEPLPEPLPEPEPEPEIDVEAILEQQRLQEAWVAQQQQLAKIQEQERLEQERLENERREQERLEQERLENARREQERLDNERRAREQAQKEAQVAAARRAAAQAAANAAKKAGNHGGGQPGQNQTVEGGINISNASWKTKPRVNNFCSARSDIDTTLQVSFRVDAEGKISNVNLNGSTGDAKLDRQIIRQIGRGRLHPFREGNITRVGTAIYPITLKLQKDESCTN

SEQ ID NO: 3121 - protein, 376 aa, M.catarrhalis
SSMSILGQPMLISLSMPSWIRLPKMCVSQRCKLINKNTDCSFYPLSFVHQPIMSEFSLIHTHFKHLTAPHQHTVLGIGDDCAISNIPPNSQLVSCVDTLVAGRHFVHETSPHAIAYKSVAVNLSDLASMGATPYAILVGLSLPKFMANDNFCQAFAEGLAAACTPFGIELIGGDTTSSPILTISVTALGFVPHGQAITRQGACVGDVVCVSGTVGLASLALHGILDDLHGDGHANRPPKSLPEKLRQAMQYPAPQVALGRQLIGFANSMIDISDGLGQDLGHILTASNVGAVIDLDAIPSDALLDALPHAQKWQHQINGGDDYQLCLTMTKANFKQFNQSYPNSIFAIGEIVAQEGLTLIFNHQKVDLTVQGWEHF

SEQ ID NO: 3122 - protein, 270 aa, M.catarrhalis
PFLPLFIDCLRKIMLAKRLIPCLDIENGRVVKGVNFIDIKDAGDPVEVAKRYNDQGADEITFLDITASSDGRDTTYEMVEKIARTIFIPLTVGGGVRKLEDIRNLLNAGADKVGINSAAITNPDFVNDAASRFGNQCIVVSIDAKRVGDIDGQPRWEIFTHGGRKATGIDAVQWAVEMAKRGAGELLVTSMDGDGTRQGYDLLLTRTISDLVNIPVIASGGVGNLQHLADGILTGKADAVLAASIFHFGDYTIKQAKEFMANQGITIRPI

SEQ ID NO: 3123 - protein, 165 aa, M.catarrhalis
IMTTYTEQKNAVTHIDGALHENANLRIGIAVGRFNGFLVESLVEGALDALLRHGVLGENITVVRVPGAFELPLTTKRMAVTGNYDAIVVLGAIIRGATPHFDIVASESAKGLSHVALHHDIPVINGILTTENIEQTIERAGTKAGNKGYEAAMTAIEMVSVLKAL

SEQ ID NO: 3124 - protein, 284 aa, M.catarrhalis
KMNFSIFDVFMLVYLKELENNTDLLENLGKVVFHLDEANSDKQAKSIIKDFMLRNPIVSTDCNLEIHQETQIFKYPSMKFIHIRQVYLQDELTEPLKKLIKSKKSNSVYTNPDIFIELSNGKETEFFSVELKSTKKNEIPGSSVQQINPYEWVIFIKQGKPIEITTGFYLNSITEKVQFPDRSPRPQVSFNTLKNWNKKNFISENNSLIFKITQSEWDNKNQLIRNWKITLVEQWLKVVLDKNLTLTSRSPWFNETLIMYTDKLLAHYEQLSKIDKEKLRDKVF

SEQ ID NO: 3125 - protein, 317 aa, M.catarrhalis
HHGQKSRLDETLGKLSLGKGEIIMCQLLGMNANTPTDIGFSFTGFRKRGGLTDYHEDGFGIVFFERTALGDIGLRQFHDDKPSHLSPVADLVNHYPIEAMNVIAHIRKATTGGHGLANIHPFVREVWGEQWAFAHNGQMSDGFIRRTQRLMTNGNAEHYAPVGTTDSELAFCYLLNRLKATFKTRPTYKMWFAFLRAQCIFWQANGLFNSLIQNGNGQWAYAGSLLFYLTRKAPFGEATLSDGEMTVNFSDVTTDKDKVTILVTIPLTDNEQWQQLAVDECIVFHDGEMVFKDTPSKKTYLSIEEGIKLACSVGASV

SEQ ID NO: 3126 - protein, 201 aa, M.catarrhalis
DNDKIGKAMTSHKPDIRQANPCPPCPATATAWEKAIYWLGVGLGTGLPKKAPGTWGTVGGLMIALPMLLLGFWGFLAVVAVGCLVGSYVCGKTSKLMGVHDDPHIVFDEWVGMWISLLPSVWSLAQTQNAAKTGLEYCHPSTALLFIVPFVLFRFFDIMKPPPIKWVDKNVSGGFGILIDDVLAGVMAVIFIFMLSWFMFY

SEQ ID NO: 3127 - protein, 196 aa, M.catarrhalis
TVSKRRCKMTDAAKAQDDKQQIKSKKRVADFGEVFTAEREVNAMLNLLPETIWHNITATFLEPSCGNGNFLAEILSRKLNAVLELLSTKKIKKKHQAFNYGFYAIGAVSSIYGIEILPDNCHECRERLLNLFTEHYQTHFKETDPNIIKIVKYLLGQNIVGGDALTLKDLNGNPIVFSEWKFISETLIQRRDYMVI

SEQ ID NO: 3128 - protein, 653 aa, M.catarrhalis
SMTKQRKNPKTGSATTAASLHRPKASAKTFGILTKKRIKKSGANLAGGKQDAWRYLIIGGLMLCIFMAIFARAFYLQIVNPQFFIDKGDELITGKRIEPAYRGVITDREGAPLAANAPLYTVFFDPYAYAEEYYRLDNEIKTTKSETAKQKALKKLKEMDLVRLAAAANYPLEKLEAAVGIDHTLDTSNSQKVKEALPKGASSRRLVLLNRVSPEVAKSVTDLGLFAIGREQYFQRYYLQAEPNAQLLGYMAQSSDETQGGYIGRAGIEAKYNERLAGKDGKVQILRGTGRQPIQEIEQIEPLIEGENIRLTIDSRLQYVLYKELEQVGRLQSARSSSGMVVDVKTGEVLAMGSWPSFNSNNLSERDGANERNRPVLDVFEPGSVMKPFTVAAALESGKYTTNSVIDTSPGSMSVGGYTIRDSGNYGVITLDKLIQKSSNVASTKIALNLPTDAIANMQLKFGFGRKTALDFPAEASGRVSIPKERELARRATLSYGYGQQVTLAQLAQAYAALGNRGLMQPLKLVKDQKTPEPTQVIHAGHAEAIVRMMELVTGPGGTGQAAAINGYRVAGKTGTSRRTNPQGGYYTDQHRAIFVGLAPASDPRFVVSILVEDPRRQSYAGQVSAPVFHQVMKEALRLYNVPYDKPLRVLAP

SEQ ID NO: 3129 - protein, 501 aa, M.catarrhalis
KVIKGNRMTNSSAYFWNQDNLKQATQGQWHHSDKAEIDARRIVTDTRQIQAGDVFLAIKGERFDAHDFIQNAYQQGASAAIVERVVDCDMPQLLVADTKLALGNLGKFRRDAHPDLTVIALTGSSGKTTTKEMIGAILSQIAPTLITRGNLNNDLGVPMMLLELTDEHRFLVIELGANHLGEIAYTASMVRPDVALILNIGTAHLGEFGGRANIACAKSEIYSALTSQGVAILPFSDDFYPELLKQASQFTKLHLSFGERAVPIEQAGLEATDQAMLKAEGISSVLMMGDLFADDIETFATHSTFTLNTNIDIDQIDSLPVHLPFIGEHNVANALAAASATFALGVPLEQIAKGLLRAMPPKGRLMRLSMDGYHIIDDTYNANPTSMLAAAKVLEAELDTKILVLGDIFELGDAADDEHTKLGHQLALLEIDHVFTLGNHMAHTAAAINEQKPIARHYTDKPSLLKDLCQLLSHGSATVLFKGSRGMAMESLIADLTACNH

SEQ ID NO: 3130 - protein, 225 aa, M.catarrhalis
IMANFHTHLTAGVIGSTIIAAFGFYFELYGLTTAVLCLAVGTLGSLLPDIDLDHSKPASQGFLIASLVVSTLITILYANRYHADRLLIDSLILWMGAFLLLRLGLFGTFSRLTVHRGMVHSVPYMAMFGLLLVCGAFYGLKLTAFVSWLFGAALFMGALIHLILDEIYGVNIYGLRLKKSAGTAFKFFEIKKPFGYIFLYVIILVLIYVAPSSADFIRALGRFGT

SEQ ID NO: 3131 - protein, 299 aa, M.catarrhalis
RMKDIKGIAQAELDFWPSFQQINQAMPHLMPYADIHRAFGETYQGGHLSVWINDYFQLSNIYPCLQVANTPLQFTAQDDLPHGTAYEMYIHQTAKIPTRDNLHDWFGACVWSVFPKTKSMLNAKHIAHFAHQNTSNGRNRVRDTITVFDENGAIFVVSEDTIGTQIGDALVTFDWQNCLVNTRQYWYHLLQPDTHAKVFVFGHALLEQLISPYKSLCAHTLIVHVPKAFFELSQPEQLKRIDEILCNQLNDFLVEGVTPKHLHPLPILGVPHFWDNADPSFYQDAFVFRAGRQKQAKTT

SEQ ID NO: 3132 - protein, 65 aa, M.catarrhalis
QVRLMRYWLPAFFTLVIIPLNKPKNLWQTKALPFAQFSPLVYSHLPKLLLINVNFIASYQSNKLS

SEQ ID NO: 3133 - protein, 201 aa, M.catarrhalis
SFIGITTMNVQRCVIGNWKLNPATKSAAHELAQGLSGIACDAVRVGCTPSFTHVSTVAGVLAGTPIWVGAQDICAYTQSTGAYTGDVSAEQLSDLGVGFVIIGHSERRNYYREDHSLLVEKMKHAFAADLSVVFCIGETKEQYPDNQTLSVLDDQLSVLPTFRVPTGKLIIAYEPNLGDWHKSYHPALKKSSQPMRILSQS

SEQ ID NO: 3134 - protein, 341 aa, M.catarrhalis
FYFMLGLPMSVYTHLSDDEFFAFCGLFGVAFKKAAPITQGIKNSNWFIQTDSDEDGEFSHVFTLYEERVPDDIIKMATIMHTLKDRLPIAAPLIKMTAKGNHIGEDCVMRYENKAILIVPKLSGSHPVLTDVAMCHEMGKALATLHDALTTLQPSEDYGVPLYDWTRVKERETAYMPTDEARLMNDIWTAYANLPDDLPKGLCHLDMFADNTLWDFTGDTPKLTGLLDFTEVSVEHYLMDIAITINDFCTTWGNANDGESVNFNTNKMTAFIDGYASVRPLTDNEKTALPVMLAYSATIFWLLRLNVIHHNREQGRTGDNIMVKNPDLMKRLASYHWAKVK

SEQ ID NO: 3135 - protein, 183 aa, M.catarrhalis
CSIILRPNMTTPNPQNDQFDINETGYKTSHTAVRKARRFAVQGLYEWLMTDYRFAKQRRDLLGGNEPHTIAARTRADNAMHTVHLGYYHELMRNIPAQIDELESLIVSQLDRELSKLDIIEHAILLIGTYELKHSLHIPYKVVLDEAMKLNVHFGATDAHKLINAVMDKIAKNVRQPEVQADK

SEQ ID NO: 3136 - protein, 502 aa, M.catarrhalis
RFVIIAQTIRFPKLEKIMTRPVRTRIAPSPTGFPHVGTAYIALFNLVFAKSMGGEFILRIEDTDQVRSTKQSEQMILDALKWAGLSWAEGPDVGGPHAPYRQSERADIYKKYAEQLLDDGHAFRCFCTPEELDAMREAQMAAGLPVKYDGRYANLSREESDALVAQGKPFVIRMRVPSNGVCTIKDMLRGEVVIPWEQVDMQVLLKTDGLPTYHLANVVDDHLMQITHVLRGEEWLPSAPKHQLLYEYFGWQMPELCHMPLLRNPDKSKLSKRKNPTSITYYRDAGILPEALMNYLGRMGYSLPNEQEKFTLDEMIQSFDIQRISLGGPVFDIEKLYWLNGEYLRTLSVDDLKNKILAWASDDTKLTAIARAIQPRINLLSDAINWAGFYFQNLPAITAEDFAYKSLDNEQILEILYLATWQLENLPIWSEENIYQTLKGLAAHFDIKLKDFMQPFFVAIAGSTSSTPVMNSMHIIGTDMTLARFRHACKILVELAKKNSKN

SEQ ID NO: 3137 - protein, 120 aa, M.catarrhalis
VAIFMSNTPLMTTLNSSMTWVLRLVLAVLVVMIFATALGIVTQTQERHEAYIELQKRSRELNELRIEEQRLMIEQQTFSATPQVAQRAVSELGMFFPTNENRRVITPSAKPDSEPSQNSE

SEQ ID NO: 3138 - protein, 368 aa, M.catarrhalis
GCFMLYWLLQQTDIAIGSLTLRALLAVITSLLIVIIGGKPVIHYLRTLKYGQAVRDDGPKTHLAKQGTPTMGGVLILVAIGIATLAWADLGNPYVWILMVVMVIFGAVGWADDWLKIKHKNPQGLIARKKYFWLSVGSLFAGCSMYYIATQQDTNTMIAMQDMLIPLFKDIVIPFSAIPLGLGFIIATYFVLAGSSNAVNLTDGLDGLVILPVVLVAAGLGVFAYISGSPHFADYMHVPYIAYNAEVTIVCAAMIGAGLGFLWYNAAPADVFMGDVGALSLGGMLGTIAVMTRQELAFAIMGGIFVAEAVSVILQVGSYRLRKQRIFLMAPLHHHFEELGLKETKVVARFYIVCIILVVLGLMTLKLR

SEQ ID NO: 3139 - protein, 523 aa, M.catarrhalis
GCMMMPISFREVIQKAVATPHTVAAELGLMTLESVFAPILACQFDQFCLDSRKIGTDDGFVLLKSSRQDAQTNLNNANRYLMSVKDSAAFVISEFDLVGLDLDGIQIPIVSVPNIRTYLGDLIAARLQLHHAVALPKIIAVTGTNGKTTVSQLIAQLCQASGISSAVMGTAGNGRLGQLIQSANTTGDVLLTHTFIHQMAQEGVQMIALEASSHGLDQYRLQGVPIIGAIYTNLSRDHLDYHADMASYRDAKAKLFDQSLFPTLRFGVVNLDDEPALFDYETADFQIIGYSQQKPNADFYAKAVRLSLDCVEIEVQTPQGEMTAISPLLGLFNVDNLLASMAAFTALNPARAADLPNLITQLQGARGRMQRASSQTGAFIIDYAHTPDALKQVLSSLRRHCTGRLIAVFGCGGDRDRGKRPQMTQAGLAYADQVILTADNPRSESPSAILADMQKGLSCEDHYKIIIEPDRKNAIELAVKTAGKTDIVVIAGKGHETYQEIQGVRYDFDDLAVLGEFLQKYQK

SEQ ID NO: 3140 - protein, 336 aa, M.catarrhalis
ITTVSTMSNTISTSDEFSHTTVLLPETVAMVLGVKQLNDVTSKVSGVYVDATFGRGGHSQLLLEYLAPEATLAVFDKDPEAIAVAKSLAAQDERIKVVHDSFAHLTKNLQALGIDKIDGLMADLGVSSPQLDDGTRGFSFMRDGVVDMRMDTTRGEPVSEWLQRVSADELADVLYEYGEERHSRKIARAIKSMPNYTSTRQLAEVIKQAHPAWQKGKHPATQSFQAMRIFINNELGDVEAFLAQSIGVLKAGGMLAVISFHSLEDRLIKQFLQRHSRGQYEEDARLPIIPKRPKYFGKPKRIGPCDQEVKANPRARSAWLRGAVRSDVALVAQDED

SEQ ID NO: 3141 - protein, 73 aa, M.catarrhalis
ISTLYDGYTINHSYPWLTLKPLVYETFGEKINQFGIIDPSLRVSQVDAAHRRTQGKTYINILPKPMMSIAPII

SEQ ID NO: 3142 - protein, 179 aa, M.catarrhalis
YNLLLTAACHQAVLFGEYIMMRIILLGPPGAGKGTQAQLISKEFGIPQISTGDMLRAAIKAGTELGKQAKSVMDAGQLVSDELIINLVKERLKQPDCDNGCIFDGFPRTIPQAKALADAGIAIDYVIEISAPDDEIVSRMSGRRAHLASGRTYHVIYNPPKTDGIDDVTGQALVQRDYE

SEQ ID NO: 3143 - protein, 386 aa, M.catarrhalis
AFSPIKGFKMAEKMVVGLVGWRGMVGSVLMSRMVEEGDFQHITPVFFSTSNAGGQAPSFDGVDGGTLKDATDILELSRCDAIITCQGGDYTKQVHSALRDSGWHGYWIDAASSLRMQEDAIIILDPINRDVIDKALADGKKDFIGGNCTVSLMLMAIGELFRRGWVEWVSAMTYQAASGAGANNMRELIKGMGVLRDSVSDQLDDPASAILEIDRTIADTQRSDDFPKQHFGAVLAGSLIPYIDSQLDNGQSREEWKAQAETNKILGKSADETINIDGICVRIGAMRCHSQALTIKLTKDIPLAEITTALRESNNPWLDVVENDKAASMERLTPVAVTGTLNVAVGRLRKLNMGGEYLTAFTVGDQLLWGAAEPLRRMLAILQGSI

SEQ ID NO: 3144 - protein, 452 aa, M.catarrhalis
TPFNFLNPKIDTMFSSLWQALSEHPEFIAMLTIPPVTAFVTWAHVWMALEMLFYPIKFWGIRIFGLPFSLKGVGWQGIVPAKAGKISGIIVDQTLSKLGSLDEFFQAMEPEEMAEFITATVDKNLESLIDEIMLERSYTLWTHTPYAIRRRIYAHAHSHLAAIMKSLVMDLTYNVESLVDMREMIVTKMENDRKLMVDMFLRVGKKEINFIWKISALIGFGFGVLQMAIFYFVPQHWTVPFFAMIWGALTNWIAIWMVFNPVEPKTVPFVRLFRYEMVDHQKRIVWMHPHWHKYSWQGGFMKRQDEVSTVFAEIVVNELVTLENIMNEMMYGRRADKTRELVKSHLYEMLEDPIVATSLKVGMDKRSLDTFKDTIIDKSIDATMVPIRDPKLNVSRANKIFGLFESRIRALTPKEFQNLLRPAFQEDEITLIILGGITGFLAGWLHLVIVFF

SEQ ID NO: 3145 - protein, 338 aa, M.catarrhalis
HSPKYSLIIMTPTQSPICLIYAGGTFGSHGTPLSALPAEIFLPILSNLYGTTDHHIKILNNQIIKDSSLMTPSDFVGFYELILTAYHDGYRKFVLITGTDTLSFLAAFLAHAFDEFTDLSLVITGSMQPLLLPQCADLSINYDSDAWNNLSQSLDLAAAQCGTFVHFHHQSFNAKHTQKINSQAPNAFMGADAIFNKSSPPSINTAIYLNQLPSLIKRAKSVKIRSVYALPNDPNALADELLVAADACAVILIGYGAGNLPKSQAIIDALAKLTDRGVAIICTTMCAYGGTNTDYAAGAWQYEHGVWASGSLTIPSIYGQILWLSITQKLTAWHWKFS

SEQ ID NO: 3146 - protein, 303 aa, M.catarrhalis
TWCLGIWFINHSVYLWSNTLAIHHPKAHRLALEILMKTHTLAVGIEFIGTRYRGWQRQEEVIGVQAVIEKALSTIANESIELIAAGRTDAGVHAGNMIAHFVTHAERSAHSWLRGTNSLLPDDIALRWVQPMPDDFHARFSAIARRYRYITLNQPYRPAILRHQVTHEYTKLDIDAMIIASQFIVGTHDFSSFRAAACQSNQPVRTVTHANLFQHGSYLILDIQADGFLHHMVRNIMGALFAVGRGEISPETFYELMLAKNRTLAPPTASADGLYFINAYYHKRFESLLPQMPLTPLWLNLPD

SEQ ID NO: 3147 - protein, 203 aa, M.catarrhalis
NHQRSIIMAKPNKRLMLFIIPLIIFMILVVMFFMRLGKPTEINTRRLVGNPLPNLSLPLLSDTTRTITKADFPDTPFILNVWGSWCLTCHAEHPFLLKLHEQGVPIIGVNYKDELSEALAYLNKNQDPFVYSVQDVTGDFALDLGLMGAPESYVVGTNGIVYQHIIGEIGEKNWAGIQHCLTAVADDGLSDAKKIKACHKDDS

SEQ ID NO: 3148 - protein, 70 aa, M.catarrhalis
PKAIFVAKSALPLILYSLILYNATFDKITANTMKTCYNTMCYHIMILINKLHLTFLIPRLTLCFHPFGKL

SEQ ID NO: 3149 - protein, 423 aa, M.catarrhalis
GIDMTPSLILFFSLCAVLTVLLSLVVILPWRKVGVSSDNQLMAINVQIFGERIAELDADKATGVIDEASYQTQITELKRQLIDAQTTTEAQTPVGIKGRAIIMIWIPILAVIAYMMTADRTAVFTLWQAQDKVGQVADDLLTGKIDVPPEWAAKESTALISAMQTNVHRNADDANRWMRLSELFMMLEAQPQALEALARANRLQPDNEEIALTYAQTNFFINEGRMDATTHKILTQILTQTPNHEGAMMMMAMGEVRAGNYPNAKAWIARLRSSLMARSGDHSEALASLDKLVENIDNQQAAVAQGVTITINLAPALVDKLRPDDVLFVSISGQSGGAPYAVKKLPASELMSQQAVSVTLSDMDAMMPTRILSSARQAGEALVVNARISHLGDAMPKAGDLAANPIILDKQTEVSLMISQIVP

SEQ ID NO: 3150 - protein, 692 aa, M.catarrhalis
QFNIKKPRKILPANECFTMLITELGYFSLLLALVLAMLQAILPAIGVIKHQVQWQRLAPSLAMAQFLAMAVSFLALIAGFLYNDFSLVYVAKHSNSLMPWYYKLSATWGGHEGSLLLWMTILATWCMLVAVFSRGLPLQMRARVLSILGGVQVMMLAMMIFTSSPFDRVLPSLPVDGADLNPLLQDPGLIFHPPMLYMGYVGLAVPFAFCMAALWAGRLDAVWTRWSRPWTLVAWTFLTLGIALGSWWAYYELGWGGWWFWDPVENASLMPWLAATALMHSLAVTEKRGVFKAWTMMLAIFAFALSLLGTFLVRSGVITSVHSFAADPTRGLAVLAILTIVIGFGLLMFALRGWRLTVESSYRLKSRETMLVVNNLVLLVATLVVLLGTLYPIIADFFKLGQVSVGPPYFNALFVPLTWLLLGFMGVGVVMRYKHDSRPFLATLMACAIGAFVLGSALAYMVSQLAEEPLFDYGIYVSGILSLWVLIFIILDIKDKLKHHKGGIFSGLAKLSPSYWGMQIAHIGVIVCMMGVAATSSMSIEKDVAMTVGDSVHVQGYDFYLQEFEMIQGVNYDATQATIIVRQHGRQIAVLYPQKRDYVVSMMPMTEVGIRPSLLNEMYVALGEPISTQNGQVDMNTWAVRVYVKPMVRWIWLGAIIMAVGAFIAILDKRYRMYQTKSGKYSSKFNKTMTNQ

SEQ ID NO: 3151 - protein, 77 aa, M.catarrhalis
LLKIMAKKDDIIEFEGEVIDTLPNTLFKVRLDNGHEIIAHISGKMRKHYIRILTGDKVKVEMTPYDLTKGRITYRGK

SEQ ID NO: 3152 - protein, 172 aa, M.catarrhalis
FMNLRTLMMVLVIGVSTTAAASFDLYEFDSPQQEAQYRVLIEELRCPKCQNQNLAGSDAPIAQDLKQKTYEMVKDGRSDAEIRNYMFERYGDFISYKPPVRPSTWILWFFPPMLLLLLLLGWIYKAQKGRSWSKQVPTSHAPLSAGEEAKLKKILAHHQNKSLDGSDSKPTK

SEQ ID NO: 3153 - protein, 206 aa, M.catarrhalis
TIIVMKKPTQKSTKAVNQVRIIGGQHKRRLLSFVDAQGLRPTPDRLKETLFNWLTGYLTDAKILDTCAGSGALGFEAVSRGAKTATLIEPNLAQAQMLKQNAKLLKLSDRLTIVSTDAISALNTMHDRHDAFDIIFIDPPYALNLWQPILENLLDNALIHADSRIYLEADKPLHSILDDDTSAKFTLIKSTKVGQAMAYLLTPTPN

SEQ ID NO: 3154 - protein, 283 aa, M.catarrhalis
KRRLTVAQELPTTESLFDFLYLDSIKIRSFYVQLTGFGSLASIKANNALNSSLASEGAFGVNAMAKIDAKVNYATGENQSSEKTYDATPTLPREMIDKLDELGFISRELGENSAGNLVLLNGVLSITDIETLQNLLEPTMYFATEEEYKQLYGDRKRQAVKKKLEENKPVVQLIKAIPYALEARLKVGEDMVWMTLNRGEMVGNPHDINLKHGKVLFGEYYVLGVLDAIPNDDMNIDMTTGSFGDVILELSQSLKETMGRNTSSYGITPIAIFRVIRTNQQAK

SEQ ID NO: 3155 - protein, 76 aa, M.catarrhalis
IYLTNNLRISQMPKIVANPKTRAQIQKDSDARRRVKPIGFKVPIEFAELLDELAKQSGKTKNIIIMEAVELWAKQL

SEQ ID NO: 3156 - protein, 391 aa, M.catarrhalis
QPKTMTDKTDDVKPDTDGNHPKKQKPHTQAKSKPRPLALFLLLALIGSVLLVIIFGLIQSYGTPQNLPTANAIGSTNEPPKGVIAHLRQKIAGPATFSIQGRVEGETVNISTKLPSRVAAIYVKEGQAVRAGEPLVQLVSPEIDAKKQQAAAMLQSALAFQSSTDRGTRQENVDTLYANWQSAKAQATLAEESHRRGEYLYQEGVISRQRRDEMRAAKQSSAQIAQAAQQQYLKAQRGRTDELKSSADAQVQIARAAVAEADALDAETMLYAPIDGTVSKIYIQSSELVMPAVPVMSLLDNHPTITISVQENQYSHVHALPKLTGFIPALNKTADFKIVHTDDEGEFATIKNTRQTGGYDIHSFKTKLEPITPIEGLKVGMSVIFDITVLP

SEQ ID NO: 3157 - protein, 105 aa, M.catarrhalis
NKTAFIGNQLICGGWCIVFRVGFKLLTCCPNFVRCNCFNHKGREFMHYPVTLTPDTDGFCVTFRDIPEAISQGDTTDEALDMAQDALMVAMEFYFEDNRAVPMPS

SEQ ID NO: 3158 - protein, 77 aa, M.catarrhalis
HHFYKNQGFFMADKASPQARKKATANYFDKSLARIGLVISHTEPHVLDALNQIMAHKDCSKAMAIKIALVEYARTLD

SEQ ID NO: 3159 - protein, 657 aa, M.catarrhalis
IALYNLKNQPSFMGGFLLGEFMSNTYRLDIQVNADSANTALGNLKEHFDKIEQSSGKASVGINGFSDKADKASKSSKKAGDEAKKAGDGAKKFGDDAKKAGNDIDDLKHKADGLKTAFGTLKGVMFTAFAVAGVGGIIATADDMQTLTSQIKIATTSTKDYAHAMSEIERIAMGNMVSLDSVGQLYASNERSLKQLGKSQDEVIKFTENITTAMRVSGGSAESQAAALTQLGQAMASGVLRGDEFNSVAEQAPVIMELMADSLGVTTGKLRDMAKEGKLTSKVVYDALAGASASDKLAEKSKKMSTTISGAMQNIQTQWRLGVHAIMNGEGGLSSVLADGINSIALGASSFVDSLPAINQAITDTIAKAKEMGTAFLESDFGQSAIQTAKDAFEQLKSAMQGVVDIAGDVKAFFEKNPELAIALASGVGAVAGAFLLFKGVLIVWAGVATLATVAGGALAAVMAVLTSPITLVIAAFAALVAAGVYVYRNWDTIKQKANDAWNSIKETWQGVGEWFGELWDKVKQTFFDWLSQMPKPVQDMVANIGEIFSTIVDVAGAVWDGIANIAKSVWHAITKFVSYAIDKIKPVIKSVLEFFKNAWDGLVSIAKTVWQAVVSVVSHVFDKISGIISTQFEVMKAIFMAGVTIFASIFMQALRW

SEQ ID NO: 3160 - protein, 69 aa, M.catarrhalis
YCYHQGDGCMQDNAKKSDATHHSAQLLRDMFSCLNQAMSRETEKFHQEQKKVKEEINRGARITNHRISL

SEQ ID NO: 3161 - protein, 401 aa, M.catarrhalis
IFIQISLISMIVRFIRAFCQAFLRELNRLSCNRFDLAMAMIAPLVIIVLFGAMFYHGKAHHLPVALVDEDNSELSHLIYQHIHHNETIKTVLILDNVQDAHHAINRLDVGGYIHIPKDAQNHLVRGENTGIHIAYNQSFFSIGSAISSALSKSTKGGIAKFIQTKHLTGVLPHLSGNMPHVKISVLFNPNLSYEFFLEPFLVAAVLHLLLCCLVAHAIGQEFHEHSVHEWLCHSPFGALFGKISVYVLIISLWHGLWQAWLIGVRGWFVAGSLFVLIIGQLLFYLAYALFGAMVVLKTQNINKSYGILAVYGGSSMSFAGVTLPLNNAPSFTQFWSQIIPFTPFARLQVEQWVIGSPFIITLAHLNSLLIFVLIFGIGSLLLLRRIKKTLIAIPNTPKDDS

SEQ ID NO: 3162 - protein, 220 aa, M.catarrhalis
MTLQSIDKVPKLYLLTNDDELTTLLDKLERVFDTGAVSLLQVRRKSTLKLYDLATVYREAEMIVSLANDYDIKVVMNDSLELASHFGTGLHLGQRDGSVRVAREILGDHVVIGRTCHTDLALFKEAKREGATYGAMGTAFASITKPRAKIISKDILKKACELDFPLCVIGGITLENIHQLRDKLNGAAIDYIAVTADIMGHSVDTIADKCLAWQQKLNTW

SEQ ID NO: 3163 - protein, 165 aa, M.catarrhalis
QIWQKRTPHQLYRAYYFIEHIMVTSNRFARRQRPLNSDMNVVPYIDVMLVLLVIFIVTAPMLATGIEVSLPKEQTKPITQADKLPVIVSIQADGNLYVSHKNAIDVPITPDKLDTLLRQMHQDNTDLQVMVNADADNAYSRIMQIMALIQNVGITQVSLLSESVQ

SEQ ID NO: 3164 - protein, 419 aa, M.catarrhalis
LSFKNMHSTDNLPVLAKDRHYLNKLKQKMNSTTGDLKTKCKIRYDAIYERSAEQVANRMDSIPKNLSEKLNHDLPVTAEADTLIQAIRDHQVVIIAGETGSGKTTQLPKLAMMAGRGITGQIGHTQPRRLAARSVAMRIAEELGEPLGQTVSFKIRFTEEGGKHSIVKLMTDGILLAELGSDKFLANYDTIIIDEAHERSLNIDFIMGYLKRLLPKRPDLKVIITSATLDTQRFSDYFAANGKPAPVYIVEGRSYPVEVRYHPLTDAIVSSQDDDAFDDIEDNLPRALTAAVNECFEDARTKGHPDQADILIFAATEAEIRELQEVLMLYAPAHTEILPLFARQSYGEQQKIFAPSGKGRRIIIATNVAETALTVPNIRYVIDLGFARISRYNYRSRIQRLPIEAISQARRQSKKRAVR

SEQ ID NO: 3165 - protein, 1195 aa, M.catarrhalis
RGNKNLTLGNTMIDTFKPKLDLPTKANFKTTLPLLGGADLSFWLALAAKSEERLIVMIANHQNELNQLDTELSFFGIDAHVFPDWEILAYDQLSVHQDIISERIALLTRMPTTGVLLVSTQTLMQRIAPPSWLIGQHFDLAVGDKFDIHEQRLRLTKAGYVQTENVFEPGEFAVRGSIVDIFAVGQSLPFRLDLFDDNIETIKFFDPDSQRTLSDNDLAQLKKDAQAGMNTHHAQKLPSSAKITEFRLLPAREFPLEEGKEMFRQNFASLFPNASARKIEFYNDVMAAIAPQGIEFYAPLFFELDAWMKTGNLFSYLPDDTLVVSHDNLSACHDEYYQQIQARHHSRAHDKSLPIMPPDYLFLANNEFHQVLKAYPRVVINTNHDTAKIGAMESLPPPILPINHQAAKPLSELLSFIKSGQVPILLVAESAGRREIILELLKDKVAVKVVDNYQEFINNLDDFNTDCIALSVAPIERGLWLRDETGGLCIISETQIFGRQVLQTRRRRQSSVSQAFLIKSVTELTEGALVVHLEHGIGRYQGLVVLDVGEGEQEFIHLKYADDASIYVPITNLALIGRYSGSDLQTVSLSKIGSGKWEKAKLKALEQIHDVAAELLNVQARRNAKSGISFDIDMSQYELFASQFAFEETIDQAEAIHAVMHDMKQNKPMDRLICGDVGFGKTEVAMRAAFIAVQAGYQVAVLVPTTLLAGQHEDSFLNRFADWPIKIESLSRFGNKKHQDAILAGLADGTVDIVIGTHKLIQDDVKFKQLGLMIIDEEHRFGVRHKERIKALQTNIDSLSMTATPIPRTLNMALSGMQDISIIATPPARRLAIKTFLLPKSDETIKEAILREILRGGQVYYLHNDVASIEAAADTLRELVGEARVAVAHGQMNERELSVVMNDFYHKKFNVLVASTIIETGIDVPNANTIIIHRADKFGIAQLHQLRGRVGRSHHQAYCYLMVPSLKGLSSDAKKRLNAITRANTLGAGFMLASEDLEIRGAGEILGKEQSGNMQTIGFGLYMDMLERATNAIKQGKTPSLATPLDLVSDIDIHASALIPDEYLGDVHERLVFYKRISSLDDVNQLIDIRTEMIDRFGTLPTQTQNLFAVHRIRIRAKALGIAKIDATQTTISIEFRADTPIDGLAIIKLIQSNDGYRMNGATAIRYTSQELMDTQARIDKVNELLLYFESTKTA

SEQ ID NO: 3166 - protein, 114 aa, M.catarrhalis
NWQKMKTFTWDISADSSETTALNTTITAFGDGYEQAVSFGINNSRKSWQCSKTDTKAVIDEILSFLLNTKGVEPFTFAPIKGEPAIKVRLDGEISRQKTGGDVWQIGFTLKQVF

SEQ ID NO: 3167 - protein, 151 aa, M.catarrhalis
QQYERTMFQLHPTLAKDTFLVGDFPLSTVRLMNDCQFPWLILVPRVSGIKEIYELSAADQVQFLRESSWVSSQMAKIFGADKMNVAALGNQVSQLHFHHIVRYQNDAAWPNPVWGHEAMPYTQEVLSHMQQTLMMALRGHHQMPFDWKMDV

SEQ ID NO: 3168 - protein, 264 aa, M.catarrhalis
TMRLTKTIKEAIHAHAKSAYPNECCGLIIDGQYYPCDNVAVNPTEHFEIDPIDMFEMEEKGQIQAIVHSHPDGNAEPSEVDRVQMGIHGIDWVICAFGYHAGGKEYFDVKCHKPKAYQAPLLGREYHHGVQDCYSLVRDYYHRELDIDLPDFHRSDAWWEDENHEPLYEKNFAKAGFIKMQDKNDLQKHDVILCRVGRTHHVNHALIYVGDGKLKSETTPDCVGNALILHHPHGSLSVREIYGDNWQRRTAMVVRHQASNQTNL

SEQ ID NO: 3169 - protein, 62 aa, M.catarrhalis
TASRCQNQAKKQIGFWLDCLLSTYLLLRIIYIMLNNISKPNNNSLLIFHFVIFKFNNFIIKY

SEQ ID NO: 3170 - protein, 94 aa, M.catarrhalis
MKKLLIDEIDLADLPRAIAYTHSLMIKPDAKEQGEFQITCHQATNQAMNYLHGLHAEIKRLGGVAPSLDIDEDEIARAIITRMVQGKRFMVNLD

SEQ ID NO: 3171 - protein, 673 aa, M.catarrhalis
SHESDFYGRCYHFCQYFYAGFEMVKTIFSTAFKVITAVLTGDMQGVKDAIKDGFQKAVDILKKLVGNIVDALKKLGKDLLQVGRDAMQGFINGISEKIDAAVSKAKQMASSVKNAITGFFDIHSPSRVMKQVGGWISEGLAIGIAYKAPIAAKEAKNLAKSVKNDLESELQKTAEEIFLTKQHIAGNPYAQLTKDIAFGKYGKQDTSRLQKLAQEQILQSNILTLTQQLHEAQQNLANVGLTSIEIMQRQYDETDKSVRASLDLFEQVKKTSQELIDATNRHEATQEFESTLKDIAKQMAIMGSQEPLAEFLYDLQNAEKYAYYTTEQLATLKDEMIKLQNAKDAKQASDGIEESLKDINKQLALLGSNHPLDDFFYELEQTDKYAHATTDEINELIDAIFKLQNAKDALNAKQAFDTLMKDTALANETPAQRLQREYDEKMAVIDRYEQMHSDKLENATSLRQQITERYEQAEKDAKVKNYQEHLTAFAGFLKNTAGEQSKAYRVMFAASKAYALADVGVKMGKAVADAWADPSAVTIWQKLANVAKVSLEQGHVLSMINAISPKGFATGGYTGNMGINQVAGVVHGQEYVLNAKATKRIGVGNLERLNRGDGIGGHVNHINVHVTVNSDGSNVQADTQMGKTMGEAMAKIARQVVIQESKQNGHLDRLYRR

SEQ ID NO: 3172 - protein, 368 aa, M.catarrhalis
QLMRRFIKQYLTIWLDIIKDRSIFLTMVLSVVFYGFFYPFAYQAQRPADLPIVIVDEEQSPLTQAIIHTTSHTPNIHVLAVVSDFRQAQMLVQSAKADGILLLPDNLSQSIHHGQTGGVGLYLSSAYFLRTQNIGAGLVSSLQATIIQELGQVTQTRHKPMPELIHQSALFNPLSGYGSYIFPAVAPIIVYQTIVLGLAMLVAGYRQRLWRASACDFLAIYAVALTIGCLSCFYLFGFVFWWHDYPRGGNFWGMMLGVPIFVSCAIGVALLIASWVADGAKVGVLLIFSSVPLFMLTGLAYPLMAMPKFLQPLAHALPTTQGVQMFIQLNQMGVSIQDVWQKMAYLASVAVLCLGVAFWRLRLVNRSV

SEQ ID NO: 3173 - protein, 76 aa, M.catarrhalis
AQDGEHLVSLPPSVWVKVLLLNEMIAQNVSQAELAKRMGIVPQSLTRLVDLSHTTKIDTLANAFAKLGKQLQVGLV

SEQ ID NO: 3174 - protein, 156 aa, M.catarrhalis
SGLGANTGVQLHLVNPLGFELNDTRLKRAGLIIHEYAILSVHDNWQETNWALKSLGVERIVAMTTKFTRPFYEYQFKLDNDQHKVALVFGSETDGLPEEVRADIGANHWLRLPMLPDSRSLNLANSVGICLYEVWRQLGFVGDIGQSVGYHKPTSR

SEQ ID NO: 3175 - protein, 77 aa, M.catarrhalis
FLQGFFMTDSTTSPARQKATNTYRQKALANIALVISHTEPHVLDALNQIMAHKDCSKAMAIKVALVEYANTLSQTSR

SEQ ID NO: 3176 - protein, 108 aa, M.catarrhalis
PPLGIADCHLSWDTHWHYFDQIGSRTVPDVGMVRMALLDSERIISWFLLPWLDVYIIRVPDGEKLADTSVPNTLKLCWIRPLVLAMMICPPDKYTSFDPSGLKRGLVA

SEQ ID NO: 3177 - protein, 232 aa, M.catarrhalis
LSIMNESISLISLVIEASVVVKLVMAILLLLSTISWVLIFHLGTKIGGIAKFDKRFERWFWTDDIDHQLSVVQAESERAGLELIFYTGFYDQNHQDQDSSLSDDKKVQIVERRLRMALGSEQVHLEKGLSTLATIGSVSPYIGLFGTVWGIMNAFIGLGQAESVGLATVAPSIAEALIATALGLFAAIPATMAYNHFATKSNTLYENRSLFCEGLISALVTNLAKKNTASTL

SEQ ID NO: 3178 - protein, 514 aa, M.catarrhalis
NAYIIYPKNQSLNLIHMSIKCQLVAIDNIIKPCYDKILNFVYFSTMKMPYFLLLGLLLAQQADADYSLLDAQKQLMSSSSAIQASHALYQADVLQAESLQKLHYPRISLNAHAFVLQQNSSIPLDHIKEQTAQHINTHFDHRFGSAPDGLLDALHDSTQTALDRLPDHQDVKLRHDGITPNITATMPIYTGGLISSSKNIANLQAQRGKFGLQERISLAKLNLIRHYFNVQLQKQLTDTQQNMLSAMQLHVDNAYKLEQQGFISRGQRMQFEVARNRVQRLYQSTQNQHQNSIYELAVLLGLPHIEPLSTPLFINTQHRPNWQALLKDSQNTPLNQKLKTDILLADENIALRQSTKKPKIAAVARYTLDDKPDWFAGVAVSYNLFLGIDRDKQIEAAHLQKQAAQLGHEQVNEHITTTMHTAYGEMVLAQKTHALLQQNRQAAKENLRIQTLSFQEGFGTVAGVVDAQSALSQIDSETALNAYRYLLALATLLHHTGTIDDFDDYLSLDDAHKL

SEQ ID NO: 3179 - protein, 102 aa, M.catarrhalis
VQDIHKMALECLDVHFSGLVADGEEIPLSTNCDAHTQNSQFDGMMWAWVAVDLSKYDVKSHKINITLPNHLIAKIDEKVAAHKSLYKSRSNYLAQLAMADLA

SEQ ID NO: 3180 - protein, 276 aa, M.catarrhalis
CMIIHKANQSMRLSDNHPTVNFDKSALILPILASVLLHTVIIIAVAAPLITPPTKPNTTIQTALVGQEAFNRVKTALSNHHADQNKPTATNTSSTITANDNDNAFIQAQNQHRYHPQVSTSATTTQAYHPPPNSAPFESNSPNIQNQPTNAHAKLAEYSNHVSDLEQSNHTESTPSRAQINAAITSVKHRIEAIWQRYPKQPNQTITFQVNMNQQGDVTSIQFGGGHPDLRESVEAAVYAAAPFYELGGMRDSIRLQFTTEQLIMDNNQTTNEPNH

SEQ ID NO: 3181 - protein, 439 aa, M.catarrhalis
LWIITKQPMSLITNRHGVFMKSPITKVCLALTISFSAALTHTYADDELIVISEQVAPSQYPVAVMPFSEAHQMSHYLSLAGLGTTHQNLPQHTQTNSDILNNLTAWRNRGFEYIILAQSHQILGNKLAINYEIIDTANGLVSVKHTQISDNHPASIQAAYRQISDTIYQIITGQPSDLMGKIAYVEESGSPQNKISSLKLIDPSGQLIRTLDTVNGSIITPTFSPDGLSIAYSVQTKNNLPIIYIVSVSGGTPKLVTPFWGHNLAPSFSPDGGSILFSGSHENNNPNIYRLNLHTNHLDTLTTFNGAENAPNYLADASGFIYTADKGTRHQSLYRYDFGTTHSTQIASYATNPRLSPDGSKLVYLSGGQIIIANTKGRIQQSFRVLGTDVSASFSPSGTRIIYTSNQGNKNQLMIRSLSSNAIRTIPTSGTVRDPIWSK

SEQ ID NO: 3182 - protein, 227 aa, M.catarrhalis
SNEIAMSFNTDIQQTTVQGFITLYELDARKLGGEIYRFHGHNDGVIRWQGQDFHPIAIKADGLEMRSDGRASTPKLSIGDKINGIQGAVSALCRLYDDFARAKLTVTHTLQAYLDSHDAQNYRQQEWYIEQKVSENPSLGIVEFELSNPVDFEGQKIPVRQITTYCNEAVCGRYRGEVCGYTGTARFTHDGKPTDDPTLDRCSGLLAHCKLRDNEGSFCGFPAAGLV

SEQ ID NO: 3183 - protein, 79 aa, M.catarrhalis
GNRIVHKFSAFVVKAITPDEIRAAGEQFKSHPENNAPATADKLIANKSGFVLSERSLKNLQMIIAPLPKQWHRQAVSWA

SEQ ID NO: 3184 - protein, 139 aa, M.catarrhalis
IKGFFRSKTMSETTLTELSRTEATVLQSFIAQVDFWKNQHGDKAATIEVIYYPEDDGFEVSNNEPNNGVLKRNRTTAFRADLLAWASNQLRQLQGWDNSQTVTAFILSFKDNRYGVRAALASEATDKADDGAEQAEQDK

SEQ ID NO: 3185 - protein, 1014 aa, M.catarrhalis
LIWVLPEFLAITIDHASKDCPSRQSVKPAANQRKGRCGRVAPGVCIRLYSEEDFNSRPEFTEPEILRTNLASVILQMERLQLGDVNAFDFITPPDLRLVNDGRKLLIELGALDDKSFTKTRAKKGRTQLSSLTKIGQQMAKMPIDPRLARMLVAGDAFDCLADILIIVSALAVQDVRERPINKHAQADQKHALFRKEDSDFLFYLELFAALFDRHSTNDNQALSSNARRNFAKKHYLSYARIREWQKTHRQLSEMMAEMGFEINKQKNHQNDVKIDTKKGVRLSLKSGTSHQKSIKQALVGAKALKNDIDNKTSIHYANIHRALLSALLSFVAHKTDTVGEYLMARSQKARIFPASTLHKKGAQWVMAFEVVETSQVYMRTLAKIEPEWIIKAAPNLLKYHYFEPHWSKKAGRVRAYAQISLFGLIVIAKELVNFEQIDLVQAREIFIRDALVANQYGMQMKFLADNANKIKDIERIEDKLRRRDLLVDEESLYQFYDAKIPNHIASRKSFEEFYHDAENKTPNFLHFSDEDVLNEAVDDSREFPESWHLGGVRLPLSYVFDPAADNDGVTVHVPIKALAQVDPVALLWGISGWRYELVLQLLKTLPKEIRRQIVPIPDTCQKIFHQLDASSKMGLLDQLVAALKTLGVQAHAQDFAPDKVEDYLRPLICVVDDKNRVIEKSRDLPKLQARHRKASVQSIAIEQGVHHHFPNHFNFVKNKHTSGIVMQEFSALKADAAQSAVFIATFTEMNAALAEHKKGVLTLIKGHLGAKQKQLTGQIDKAFKLAFAPLGDLEKLKNIVVHATLEACLYDYGPDFDHKPVSQHVDHARAAIAGLITQNNQWLISHLPLDEREFDDCQDLILKNFLLVGQEILRNLKEIYTAWQTARGKLLMLDQEIFGENIEDIEDQLDDLQLANFVYQTDYRHWRQYPRYLQALNIRLDRLQHNLEADLDAVYLLDTHMERLARCVKNPKFAEYRWLVEEYRINLFAQPMKTVQPVSAKRLETLWANLTTQ

SEQ ID NO: 3186 - protein, 334 aa, M.catarrhalis
IHGNTAELQSDNLTFTTPQTGKTVYSIDGLKFTNDNNSIVTVGTTRITRDKIGFTGASGELDENLPYLDKEQLQVGKVIITKDSGIKAGDQEITEVKSAIADAANGQVDQSFINRLETANNSKSKYAATIKDLHGLSQVQLTFAGDTGTTAKKLGEILTIKGGADTRELTDKNIGVVKDNGNGGGLQVKLAKNLSGLDAVNTKTLTATGKIQVNNNGNTAELQSDNLTFTTPQTGKTVYSIDGLKFTNDNNSIVTVGTTRITRDKIGFTGASGELDENLPYLDKEQLQVGKVIITKDSGIKASDQEITEVKSAIADAANGQVDQSFINRLRNCL

SEQ ID NO: 3187 - protein, 206 aa, M.catarrhalis
PRGEDDILDTKERDISLIVLDLMLPDMDGMEVCQKVRGSKNTMINKVPIVMLTAKGDTTDRVLGLEMGADDYIAKPFEPRELLARIRAVLRRHETPNQADTNSGSLTFGRLTVYPDSHEVTIDEKTVRLTTHQFQLLHYFATHAGKVLNREQLWQAMPNDDSSENIDRAIDVHISRLRALIEDNPRQPKRIITVRGVGYQFATDQV

SEQ ID NO: 3188 - protein, 230 aa, M.catarrhalis
  UNSURE (178): Identity of amino acid sequences at the above locations are unknown.
TSCCGNRDLTGLNDLVESILLVSRLDAGHALQATEQVDLYELIRSEVQHYPEATLIGESVSMMAQPKLLTHLVRNLLNNAMIHGIPPVQVYLYHATNIQEATSIPQYLLDSFCNIGDGDILHSKSDEANALDNKTPTDFVKRLTRPKDKEQKADQPNFAVLAFIDQSLRIPKDKRKDXFSPFVRLIQEKKGVGLELSLVSKNVEAHHGTIITNTWLGHTPFLVILPMTGK

SEQ ID NO: 3189 - protein, 300 aa, M.catarrhalis
STVGRLMNLVHYGKFGFRSISARLFISVFLALLTFTIAFVLLSQFAHNNSDYTRNRAIASQIMNQIEPFLAEAHTLSAKNNLLQARFSLVVIKKSFDIFDESLNAKIGLYDSQGRLMLQTENTDLPETLVPNPPWISQIFAPSPTHIVVNSTLGYSLWYENRILSPERPLMAWFNLFSGTVLLFTIMSAVLWWISHSITWRINQLSQQMSRLGEGDFSVRVIEKGNDEIAVLAHGFNQSAQKIEQLIDAHSLLLAHASHEFRTPITRIRLQIEMMDMLTSQLDETTKAKFDKRAAAGIVI

SEQ ID NO: 3190 - protein, 152 aa, M.catarrhalis
QAVPINQQVKLWLLLMHPQGYTGVIYTGVAPLVDNDETVKALASTLPSLVYFDFDSDEIKPQAAAILDEQAQFLTTNQTARVLVAGHTDERGSREYNMSLGERRAVAVRNYLLGKGINQASVEIISFGEERPIAFGTNEEAWSQNRRAELSY

SEQ ID NO: 3191 - protein, 85 aa, M.catarrhalis
PLHTNLAGFILIGGVGIKRPKIKQKAEPHLRGGGGNLINGFNSMDGLNAHIKECLLIKNIYLKAGNLILMLYPHAKVKPTGGASV

SEQ ID NO: 3192 - protein, 276 aa, M.catarrhalis
TKITPKSSMNKSTNQFNHLKVLSIKTYDKLQSGFVLLVVLVVLLFISGLTALMMSQNSVDVRSVLYHQNQYKLFIAADKAVMNLWQLSPKHLVHMAQTDTWLASLLSDKNDLTKIYTAQSCNDWQTFSISTLDDPPIQCHQTAPIVSWQATYIEPIGANHYLNTLLQNTLSKKSAHDIQNPDQQAVNDDTAHYEIFHLRLYAIAAQNSQDIIQCQEPLYQTRITTCLNDHGIIHKISVAEWLIWRQKIQKTDSSAEAANAIRIMPLRTYDIRSMRE

SEQ ID NO: 3193 - protein, 867 aa, M.catarrhalis
MIMTDTVQKDTAQSPKKVYLKDYTPPVYAVDKVDLDIRLFDDHAVVGAKLKMTRAHAGDLRLFGRDLKLKSIHLNGQELESQAYHLDKEGLTILDAPDVAVIETLVEISPQTNTTLEGLYQAGTGDDKMFVTQCEPEGFRKITFFPDRPDVLTEYTTRLEAPKHFKTLLANGNLVESGDVDENRHYTIWHDPTKKPSYLFAAVIANLEVLQDHYTTIEGREVLLEVYADAQDIDKCHVGMQALKDAMKWDEDNYGRAYDLDRYMIVATGQFNMGAMENKGLNIFNTSCVLSSPETTTDERSFLVKSVIAHEYFHNWTGNRITCRDWFQLCLKEGFTVFRDQSFSGDFRSKAVQRIEDVAVLRAAQFAEDAGSLAHPVRPESFVEINNFYTMTIYEKGAEIVRMIANFLGKEKFRQGSDEYFARYDGQAVTVEDFLSAMSVADARVMDFLAWYRQPGTPVVSGGYRVLGDKVIINLSQKTRHVPNYDAPVALPIPVDTAIFDSLTGEMLASRMLLLTTDNAQFEFDHIQLSDGAHPVVSVLRNFSAPIKIDFDYTDEDLASLVAFESEGFNRWQALQILMNRWLSGSVEDATLIISVIQKAVDELIEDDPMLAARLFDIPSQKELAMAYDENYDPISVKARRDELIGKIADGLLENAKLWYQKLPLQAYEDTPQARGRRLLRNVLLNLRLTAGDEMAHQDAYHQYDNASCMSERLGALMAMIEHNLDKKDSYLDDFYAKFSHEDLVIDAWFVAQATPDSTSVSQIASLMERTDYDWNTPNRVRTTLSALAAKPVQLWTAEGLDLYLSSVVRLDGSNPQLAARLLSALARWNTLTADKKAMAQEKLAAVTSQVSSKNVLEFLQNMQTVA

SEQ ID NO: 3194 - protein, 199 aa, M.catarrhalis
AFYFLIIMLKIHSAIFLQPAPQVIIAFAKMVQTSRQRLKQKKAQSACVRSLLQITMHRFDIVGEFHDHAHPYYINSNKIRYFVSFSHSDNQVALIISLTPCAIDIEVNDIKYSVVERYFHPNEIYLLTQFSSTDRQQLINILWRLKECRIKLIQDQLYTGMGADMSCYLTDIRPNSINLIKNNDDYFYNHPKLKLTALF

SEQ ID NO: 3195 - protein, 384 aa, M.catarrhalis
NGYAIYKIYVTINEIFKFLFYHNQHIMERFMTLARNKFAQVMPKFAAIAIAALAVGCSQPTQTISQAPADTSNTSTEKIPKTIAITAIVEHPSLDDIRLGVVDGLASLGYKDGENLTVNFQSAQGNMATVGQIAKQFVADTPDAIVAITTPSAQSLAAATTSIPLIYTAVSDPVAAKLLNNNHQATQPNITGLSSQLPIEPQVELFQKIKPEAKRIGFVFSPGEANSVAVKNKLIEILPKYGMTLVEVPANRSSDVGDATRSLVGKVDLLYTSLDNGVASAMEAMVLAANELQIPVITSDEFSVRRGATAALGVNDYDFGLTTAKLVAQVLDGKSPNEIKPEVMNTLTLFISPKHAANQGVTVDLTTLGESINVDTTPARQPNK

SEQ ID NO: 3196 - protein, 338 aa, M.catarrhalis
LQPASVNSAAVGKLKYWMVDFFIKMLITQKLIYKIYRRKARCAIILDWRKCPYYNTIHQQITHTNLYIWLLYFIYQLTMTITNDRNFDTISEHFAKKVYGGLKGRIRLAVLQQDLSEAMDQLMLNRPLRILDVGAGLAQISLSLASDHHVTVNDISTNMLDMAKDHAKSLGVYDQVRFITCPYQALSNHLAGEQFDIILCHALLEWLGEPEKIMTFFDQYLADGGMLSLCFYNPASKIYRNLIMGNFYQLNTPRPADDKSLTPNHPVAPDTVEAWLIAHYYKISIRSGIRVFSDYAPLKRGGLNNPDDVVAMELEYSRQLPFRAMGRYLHIIAFKNPA

SEQ ID NO: 3197 - protein, 109 aa, M.catarrhalis
LSCHAFGGRIFKEGSGSQPDDNPDILDYYGYGDVRFLYQLENKSNISGTVRYNPRSGKGALQLDYVYPLGKGISGYFQIFQGYGQSLIDYNHEATSFGVGLMLNDWMGL

SEQ ID NO: 3198 - protein, 637 aa, M.catarrhalis
PIMQCIFIDILSLINLNEYIVPMIIFKDNYMNFEKYTRTLQEVIRGAQQSSLGHHHTAIAPVHLLSAVADNHTALSIIEASGANLARLQDEIKTLLSYQAVINQPTGQVNLSPETIKVLQATENYAAKAGDEFVPIEWLILALFENKSLNKAFVSSGVTAQNLQTIMKNIRGDEAVTNQNSEQNRQALDKYTINLTERAMAGKLDPVIGRDDEIRRTVQVLSRRTKNNPVLIGEAGVGKTAIVEGLAQRIVNGEVPESLRNKSVLSLDMGSLIAGAKYHGEFEERLKAVLNELAKQDGNIILFIDELHTMVGAGKTSGAMDAGNMLKPALARGELRCVGATTLDEYRQYIEKDPALERRFQKVLVDEPTVEDTIAILRGLKERYELHHGVKIMDSAIIAAAKMSHRYITDRQLPDKAIDLIDEAASRIKMELDSKPESLDKLDRRIIQLKMQLEAVKNEEDAGAKSQVKSLEQQIDDAQKQYSELEEVWKAEKVGVEKSKQLQAKLDTARITLEKALREGDYARASQLQYGEIIALEKQLAEEQTDEPEHAPKLLRNKVTDNEIAEVVSHATGIPVAKMLQGERNKLLAMEDVLHERVIGQNEAVAAVANAVRRSRSGLSDPNKPSGSFLFLGRGRG

SEQ ID NO: 3199 - protein, 349 aa, M.catarrhalis
AWVKYQLIRLCHHGWSMKPILTNQQGMTLMELVVALGLGSFIVLMAVNFYALSAKNSAYTHSIAQFIDRETLGITAMTEQLRLAGIGIIDMPAVLVHKEQLLGISSSQSINLNHQLSQTGGLPSHYPKSSDQLTIHYIAPADMWDCEGSVVLGPRPARLKNGKMAMVDGQVVIERYFVQTETDGSLSLRCDAGRYITDEIMRDGTRNRHGISAPYITAVIDAQVNKRFGTDKPNHIRGLGKGDVILSDIEGFWVRLIVADGSTRHSMTIENYQTHWYGYPIIGVQLAILSRSSPAPHASQTHNFLIFDESISPPNDGLPRRLHTMNVNFVNASLNQTKMNQNNAKIIHE

SEQ ID NO: 3200 - protein, 90 aa, M.catarrhalis
CCILTPKLSQRVGQVFEDPQKPKDNQLPNTGVDLYLERLLSSIFIQSSNYGTRVSNLLCLQNHHLTWQEKQQQGKHMGQIFSWSGHLQYK

SEQ ID NO: 3201 - protein, 282 aa, M.catarrhalis
CCQKLKPSYHQKNTKECTMLQATDLRLTFNLGTPIENPALRGLSLSIADGEFVTVIGTNGAGKSTFLNAISGAVRVDSGSIKINGQDVTRLKTHQRAKQVARVFQDPMAGTCEALTIEENMALAYKRGGMRGLASALNHKNRELFREKLSILKLGLENRLTDRMGLLSGGQRQAVSLLMASLQPSKILLLDEHTAALDPKTAAFVLDLTDKIVSEGRLTTMMVTHSMQQALTHGTRTVMLHQGQVMLDVSGDKRQGMNVQDLLNMFEKTRGEKVEDDRLILG

SEQ ID NO: 3202 - protein, 346 aa, M.catarrhalis
PFMKVSLSTLTLSILSCFAILAIQQAKAVPNPVAFVDEVRSENDLGQDNELPIDVQSATQSASTDTANPLDEHEPELYTTALENKTMLINCSALNQDIMRLACYDTLVHGETPAVIKTKRSIRLDETIWQTIKGKPQVIYQETTDPIFLMGNEKGMLTKKDAKQLEYAAKQFTPLSLSFDLDRNNTPLWSSRPHNPMYVLPIFMHGKPNRSPNTPSHEAKQFTPNEFRAPELKFQVSVKVKAAEDLWGTDSDLWFGYTQQSHWQIFNGKNSRPFRVHDYQPEIFLTQPVYSDLPWDGKVRMIGMGAVHHSNGESAKLSRSWNRAYLMAGMEWKNLTVMPRIWGAYL

SEQ ID NO: 3203 - protein, 224 aa, M.catarrhalis
VSQKASVSRLVGAPPGYVGYEEGGVLTEAVRRKPYSVVLFDEVEKAHPDVFNILLQVLDDGRLTDSQGRVVNFKNTVIIMTSNLGSHAIHEMTDSPYEDIKTAVMASVTGHFRPEFINRIDEIVVFHGLGADQMTGIAEIQLDRLRTRLKERELGLSVSDEAMNHLVSVGYDPVFGARPLKRAIQQEIENPLAQLLLSGEFTTGDTIFVEWLNDQFTFNKLRYS

SEQ ID NO: 3204 - protein, 250 aa, M.catarrhalis
TNIDDYLNHISSLMNIILLNDNDFITADSAVIHNQSTIVHLKTVLNVHHGDFIKLGKLGGNMGHGRIVHMDENQVILSEITLTKSPPCKLNLVVVLALPRPKVLRRLVMDMTAAGVRHMVFINSYRTDKSYWSSPLLSRLDEFVIEGLQQGIDTITPQITLAKRFKPFVQDDLPSLIGDGGAIVAHPYAEEHFGKLTQNQLPQVLVVGAEGGFIPYEIQLLDSVGVQAASLGKRILRTEAAVNALLGRWL

SEQ ID NO: 3205 - protein, 342 aa, M.catarrhalis
IKRLGMTGVAMNNFLKTTLWASLVALTLAACGGDKPTAQADLAASQAKTVAITAIVEHPALDAARQGALDQLTKEGFKEGENLTVNFQSAQGNMATAGQIARQFTSDNPDLIYAIATPSAQAIAAATQDIPVVFSAVTDPIEARLVANLENSGNNITGASDALPYEPQIALIQELVPTVKNVGYVFSPGEVNSTVVLKTLKEKLAPLGINVIEAPAQKSSDITQAANSLVGRVDVIYTSTDNNVINAYEALYQVAKTAKIPLISADTSTVERGAVAALGVNYTDLGKEAGKIIARILKGEKPADIPVHISENLDLYISKKHAAEQGIILPQAVIDRATKVVE

SEQ ID NO: 3206 - protein, 304 aa, M.catarrhalis
LFGRIWLMNLIAFFGALESGLIYALMALGVLISFRILDFPDLTADGSFPLGGAVAGICIVAGINPWLACVFGMMAGMVAGMMTAWLHVKLGILHLLAGILMMTALYSINLRIMNAPNLPLLGQPTVFTPLIDGGNGFWVRVAVIAGVVLVVKLALDWFFITEMGLSMRATGSNLRMAQAQGINTPWIIILGMAISNGLIALSGALFVQTQGFADVSMGIGTIVIGLAAVIIGEAVLSAKRIFWMTLAVVIGAILYRLFIQIALSSELLRGIGFKSQDLNLVTAFLVIIVLMLPKIKAKLSPKKH

SEQ ID NO: 3207 - protein, 285 aa, M.catarrhalis
RLDGSITQRQINMEHGLINLLKNHKHKRAFNQGVLAKPVFDQPYWVHHQAAIWLFRLHRRCVLCQLHHLDYQMGRMNFICADCQANIATQVSYFNIHLNIGKDFPTNKDRLTAQQTPKRQHIRAYPVSYYQYPVNQLIKKFKDHENSQSLLALYALIAHLPKPDYCHAGNTVILPIPTTQERMRQRGFDPVAILAKFLAWHWQLPLWQGVARHDGKRHQRGLTRHERLVNTQTDFYLCQQIPNRQIIIFDDVITTGATVAAVAKFINTASSRYSTDCNLYGTWFC

SEQ ID NO: 3208 - protein, 413 aa, M.catarrhalis
YLLGKFMKQFFALSVLAMSMSTSANYLTNYQDPNTDQLIQALNNNRIHIVQLGDSHTAGDSMTEALRSQLQSRYGNGGMGWAMPMYFSGQRMARYGYDNYQWTPISSRRNQNEDYTLGGLIAKPNFSGSTLTIKAKNQEPMQSMTVSIRQSATDGLFKISDADGNHLILEAPIKNDTWQTTTFDAKLPFTLTAEGSMTNTAIGGWWGRSKHELGAIVSSLGINGAELSHWSRWNQNAWQQELATIAPELIILAYGTNEAYNNLSAERIATVLDERIEQIRQASPHSAIMIVSSPEVLKNTAGSCGVRPPTLHAIQEVQRQTAQNKHTLFWDWQSAMGGSCSMKQWMKSGKATKDGVHFTHLGYQQLGRQMADDIISLSALNSSSHLTPPPQMISPSPISIAPSLSTTRTFYQK

SEQ ID NO: 3209 - protein, 154 aa, M.catarrhalis
AGDMLIVEDNGVIITLNGQVKDPLFWWSMILLLLGVLVAIICLIAPVFYAIGALALFAVVVFVFNIQRQKAKTCHMFSQGRLKITPKRFEIHNKSLTLSASATISAKDNKMTIVDRGIEYHFTGFADDREINIAKQVLLGKSIKTNAVAVTLAK

SEQ ID NO: 3210 - protein, 246 aa, M.catarrhalis
  UNSURE (44): Identity of amino acid sequences at the above locations are unknown.
QNCIVRKIMRSNNRQNNEFRPIHFIRQYTKHAEGSVLVCFGDTXVLCTASIEAGVPRWLKGQGKGWLTAEYGMLPRATGTRTQREAARGKQSGRTQEIQRLIGRSLRAMLDLSKLGENTIYIDCDVIQADGGTRTASISGAAVALIDALEHLQRRKKLTQDPLLGLVAAVSVGVNQGRVLLDLDYAEDSTCDTDLNVVMTQAGGFIEIQGTAEEKPFTRAEANAMLDLAELGIGQIIEAQKQVLGW

SEQ ID NO: 3211 - protein, 329 aa, M.catarrhalis
VMSIFMKKSTIQYLSLPTAALLTLAGCSHDNHRDDEMAVAEPVIQQIDDICQAPAMQANLQNSIKQSILDATISQMTDADPNQRLAIQNTIGQKLNTLQITTQNATNFADSCMADVHVTVNPQDLANAEFAFARSGVTLLQRASQDQVEFYNGTIVAKQITYQMVNGNVVMYGNNHNAIRLIADILAASTSSLPQVSIQPDVTARPQAIERLPETPIAMPSNPQEDSSVTTHIEQKPAPNAQVSSRPRSEKPSNNSAQTPTQNSVGQSSATGSTPRVDRDSQAKANTERTTERSTSKTPQDLAHPQPPTANASSDGKTSISIVESNETY

SEQ ID NO: 3212 - protein, 67 aa, M.catarrhalis
TVTIIDKPKSGILMMLHIQIAAAAAALSVLTFMTGCANKSTSQVMVAPNAPTGLHWGYLYWCCTFGR

SEQ ID NO: 3213 - protein, 440 aa, M.catarrhalis
NHLIAMSDTHAVRPPLYYRLATVMLAPIYRQMVIKKSKNKPTLKRELNERFAKHYQPPPVGRLGVIWCHAVSLGELNTVYPLLLKLLNHGYGLWVTSTTQTGFERAAKLFDNEIRLGRVAHSFVPVDTPSVIDTFLTHVKPIAALFIETELWANTLYACRKHGIKTLMINARLTQKSYLGYAKIAKVSQTMMANLDGIIAQDASSAKRFGQLGRVYIVQSDSLKWASVSTLSDAQLAAVNILTRQLNQACKTYIWVMASSHDGEECIALKAHQQFLQKFPNALLILVPRHPERFEVVHQMCLQGGFLTARRSMGETISSKTQIYLADTMGELLSWYQVAQIAVVGGSFVPIGGHNPIEPASLATPVIMGAYDDNCKDLVEALKQVGALVQLPDEPNISEQLFKSLLQASLSQWTGKSGAVLVQQKQRALQEQFLFVLRMI

SEQ ID NO: 3214 - protein, 255 aa, M.catarrhalis
EKVMKAIKLSVVSAAVLLSTSAMANVVTNTGATVVDGTRTIFSTLVKPAAVSAEVGTLGYGANIGWAVNDTVELQAGWAGGNIAKSINDNFNANGVNYQLETDFSNPYLGAQVRPAANWFTVGTGIIVPKNDIKVRSNNTTDGVFRVDGKDYKQSDVGRLTGKLEHRNKLAPYLTLGFRPNLHSNWGVFGEVGAAYLGKVDATVDAQNPTKSVTATDSKTQETVIKIAKQAERDIEDKKYANWFPIAKVGVTYRF

SEQ ID NO: 3215 - protein, 202 aa, M.catarrhalis
LQFVWHMVLLISVLILMTDNNPSPALIPTNESGFGLIEVLISLLLLSVVALGLITVQGRLLVQTKHADLRLQAVQLMANDYHAVRSFTPEQKQIYIQTLQRIAQTAQSRSESDMNSYRIAAYATTIRCRPECHLNEQAQSLAIQSAQAAARANIILSVTDCQLGHCWVAGWGMQAFELIKTCSNDELGLNISSLDCAIMDGL

SEQ ID NO: 3216 - protein, 379 aa, M.catarrhalis
LLLFLRRQAFQDLFMQTSNQPISKVAQTKQYPEPKHIRLKLRPKPYFHGKSYSYLLIVLCLFATLGAWIMQNSINAYYLQTYHKSSPLSLLDRYPAWKMGGDIGNKLYAWHGDLTSAINQKNQQIVDYFNDNLAYTPKYQAMMAKSLESTPAVQMDNVGVSEAKPDNPYVLHSGDEIFFAGDSMMQGVAPHIQQYLQKNYNIKSVNLAKQSTGLAYPSLFNWPKTIKETLSINANIKILVVFLGPNDPWDMPDLVNGGQLKFQTPEWEMGYRQRMMDILDSAKNHNTQVIWITPPNMKKQKLNKQMIYLNQIMQDELKRHHVLIIDSRKLLGTSDDIYNDYLIQDGKSVKMRTADGIHFSVKGQKLIAQAVQDQITIIP

SEQ ID NO: 3217 - protein, 499 aa, M.catarrhalis
AMFSFLSLEFTLMFIGFLAIYWLFRQTPKFQNFLIILFSYTVIYLMAGTLATEILFGYTIFVFFITKMMNGSKIKKFWLILGIAITLIQLSIFKYYDFFREGIKYSLDAMQLDSSGVMANIIFPLGISYYSFQAISYMVSRYYDEYDVPQLSFMALLHHLSFFGTISAGPIARTKSVSGLTDIEGNPCGMSEQIISQNPRRILFPTIALCLILLALIKKWWLAGWLADHWVNPIFANPMQYHSLEVLVAIYGYTLQLFLDFSGYSEMMVAFGLLIGFRLPVNFKAPLIAHNIRVFWDRWHISLSTWIRDYIYIPLGGSRQGFFRTQINLLIAMALSGIWHGSSVNFLLWGVLHGLAIIWLNCTDKLYQNIYAVDAKHARNALYRHSWLGKVIGIFVTIHFVAFCFVFFRATSWSEAIQIFEALAYNHTNIAWSGNPLFILALFMIAWFIYPIYTRQTLNIIRLGSLLPKPILISLLFVCLMIVVIFAPSGIPGFIYANF

SEQ ID NO: 3218 - protein, 330 aa, M.catarrhalis
MLTLTVDKPFGLGRIVRNQGKVVAIVREKDADTQQKLITEINSGIYCVDNALLHKYLPILNNNNAQGEYYLTDIIKLAVDDGVEIVTIEPKFAFEIEGVNDRIQLANLERDFQSHQIHQLQIAGVQFADPNRVDIRGKLTCDRDVFIDINTVFVGDVHLGMGVQIDAGNVITNSHIGNQTHIKPNCVIDDSMIGQNVSIGPFAHIRPKTILSDDVKIGNFVETKKTTVGVGSKINHLSYAGDSIIGQNVNIGAGVITCNYDGINKFTTTIGDRAFIGSNSSLVAPVTVGMGATIGAGSVITKDAKDNALTLARAKQATIIGWSRPKKNQV

SEQ ID NO: 3219 - protein, 616 aa, M.catarrhalis
VFMADDIKHLRNIAIIAHVDHGKTTLVDKLLQGSSAMGERSGEIERVMDSNALESERGITILAKNTAIRWTDKRTNTEYRINIVDTPGHADFGGEVERVMSMVDCVLLLVDSQEGPMPQTRFVTQKAFARGLKPIVVINKIDKPAARADWVIDQVFDLFDSLDATDEQLDFPIVYASGINGIAGLEPDNLADDMTPLFETIVDIVEPPKVDVDGPFQMQISSLDYNSFVGVIGVGRIQRGSVKTNTPVAIIDKDGNKRNGRILKIMGYHGLERVDVESAQAGDIICITGIDSLNISDTICDPQHVEALPALSVDEPTVSMTFQVNDSPFAGKEGKFVTSRNIRERLDRELIHNVALRVEDTDSPEKFKVSGRGELHLSVLIENMRREGFELGVSRPQVIMKEIDGVMCEPYENVTFDVEEQHQGAVMQEMGNRKGELTNMEVDGKGRIRIEATVPSRGLIGFRSAFLTMTSGTGIMTSSFSHYGPAKDGTVAKRQNGVLVSMVTGTCLAYALFSLQERGRLFAKPQLEVYEGMIIGINSRSDDMVVNPTKAKQLTNIRASGSDDAIILTPALDYTLEQALEFIEDDELVEVTPKSIRIRKRYLTENERKRFGRKKD

SEQ ID NO: 3220 - protein, 78 aa, M.catarrhalis
WLWRVKMFKKGTFLPKTGNFSQTKTNNLGTGSSGQDGHFPILPKKGKSLILIWQWNFNSGPKPYKTFVKGNTHRYLKC

SEQ ID NO: 3221 - protein, 133 aa, M.catarrhalis
VEELRQELRVFFDYDKSFIKPQYREEVAKVAAQMRELQCASATIECHASRDSIRSSARYNQRLSEARANAVKSMLSNEFGIAPNRLNAVGYGFDRPIAPNTTAEGKAMNRRVEAVITGSKTTTVDQTKDMIVQ

SEQ ID NO: 3222 - protein, 92 aa, M.catarrhalis
PPMSNANWSGFLEYRHTFKQDKLANFERPTPAHNLVNLGLNYQHKPSHQAGSVQVFFNANNLLNDKVFAHETFFPDMPQMGRNFMLGANFKF

SEQ ID NO: 3223 - protein, 123 aa, M.catarrhalis
TIGAIMSDFHTSHQHNEILGRLIEMQKLNDDIQALTQQLKNALKQIQKLQDKHAKLDEFYQKECQSLCTAYQNGSISEQDLDYVNKKAQTKGYSILSEDGIWNVLIDAEQTQVALIKQLVRSL

SEQ ID NO: 3224 - protein, 250 aa, M.catarrhalis
KTKQNQSHTLMSTIDMKTDTPVAIAKACDYPTLTPIDRPILTPPNGHKKVLLHSCCAPCSGEVMEAMIASGIEFTIYFYNPNIHPKKEYEIRKNENIAFAQKHGIPFIDADYDMDNWFARAKGMEQDPERGRRCTMCFDMRFERTALYAHEHGFPVITSSLGISRWKNMAQINDCGHRAAAPYDDLEYWDFNWRKGGGSNRMIEISKREHFYQQEYCGCAYSLRDTNNFRRSQGREPIKIGVKYYGDDEE

SEQ ID NO: 3225 - protein, 60 aa, M.catarrhalis
ALTGRLPRQTLLILEQWWEKPLVSKILSGGPPEQNPLFTLKSGPPKKGGGIFFGKKGGPY

SEQ ID NO: 3226 - protein, 134 aa, M.catarrhalis
TNKQANSTIKTATQAENETSAQPSQASLCVANINEGFLSLLNWCNRYTGAKHPPKFVIRQQFSQHAVDIGLLTQLSGLIDAGKLPKSVLYDKAREFNLISGELSNDEIDGLIEQPSMTYEAFNQFRKVQGSSGK

SEQ ID NO: 3227 - protein, 239 aa, M.catarrhalis
LMKHLINLERFKVHLANKFKTTLNEIDEFLQLVVFRHEISELNYKEFELLIGESKQKLLGFLAGYALELTQDWQELYDYSYTLETKMIDDDKPDTLNMNEPQFDADSPIKLSAQVGVTLNQILAKLGDEQSTEISNAISYAYANGLPNPELVRIIRGTRKKPLPRMDFTNYNTPCKEHCYTSTALGVKSAKQAFFMKTKNLLKAFKFLEPWDYPTNAIWEGLRRGVLPFGQGRFPPLKF

SEQ ID NO: 3228 - protein, 77 aa, M.catarrhalis
GFFCCSLTYSQLISGRQSSAFTLPPVACSIAKHLPLGGLFLSHLLNAQGVMPSERAKADQFPNMAITLSNAVINNPT

SEQ ID NO: 3229 - protein, 190 aa, M.catarrhalis
VEKLRRMAVQDFSIRLNQAMSAKNLSLRDLSEKTGINYEMIRRYSKGQAKPRNDKMKLLAQCLGVPITWLDYGEGEMTKNNDKLAPITEWDNGAPLDDDEAEIPFYKDIAFACGHGAVNGDAPLEGRKLRMGRRTLSNLGVMPINAFAVTACDDSMTPYVQDGDTIYIDKRRKEVKDGRLHLKGERNRAS

SEQ ID NO: 3230 - protein, 122 aa, M.catarrhalis
MNEFIIPNSNSVSNDFNYSRTDLDAQEQQIAEFIKKGGKVINLDNSEQPKKKSAKKRDFNNQRINSKMHLVLCYLKRSGKRMTGTQIQEKFGISAQTLGVQMSLINEQASKQYNQNSNPSRK

SEQ ID NO: 3231 - protein, 109 aa, M.catarrhalis
LFGLNYLAILHTIISIICMYYQSNSDEVALMAKTYLLTASIMSMAISGCQVIHANQGKVNTNSAVITGADAHTPEHATGLTEQQQVIVSDFMVASANPLVTQAGYDILK

SEQ ID NO: 3232 - protein, 146 aa, M.catarrhalis
SIKSLNASIKLNLTIRESIMAYSDKVIDHYENPRNVGNLDKAAKNVGTGMVGAPACGDVMRLQIQVSDDGIIEDAKFKTYGCGSAIASSSLVTEWLKGKTLDQAAAIKNKDIANELALPPVKVHCSVLAEDAIKAAIEDYQTKAQA

SEQ ID NO: 3233 - protein, 111 aa, M.catarrhalis
RLAFADRDVYLGDPDFVPVPIRQLISKDYLKHRSQLLKQSDKALPSVSVGDFIHEWVSSQAIELPSTSHISIVDKAGNVLSMTTSIENAFGSTLMANGYWLNFDGKWLPAE

SEQ ID NO: 3234 - protein, 110 aa, M.catarrhalis
GGSAADAMVAVQTTLSLVEPQSSGLGGGAFVLYWDNTAKTLTTFDGRETAPMRATPELFLDKDGQPLKFMEALVGGRSVGTPAIPKLMEVIHSDTVYCLGENYLIRRSTW

SEQ ID NO: 3235 - protein, 91 aa, M.catarrhalis
RRLYMKGTPQFPQCGFSARAVEVLTQIGRPFAFVNILENPEIRSTLPLIANWPTFPQLWVNGELIGGSDIILQMYQSGELKPLIEEHSSDA

SEQ ID NO: 3236 - protein, 420 aa, M.catarrhalis
FTNHNHHFNWESSMSQTSLIYLDYAATTPVAKEVADKMVNYLTFEGIFGNPASRSHGFGWQAEEAVENARLQIAETVGADPREIVFTSGATESDNLAIKGVAHFYEGRGRHIITSKIEHKAVLDTCRQLEQEGFEITYLEPEAGTGLIYPEQVENALRDDTILVSLMAVNNELGTITDIAAIGEITRAKGVLFHVDAAQAVGKIKINLGELKVDLMSFSGHKIYGPKGIGALYVGRKPRVRIKAEQHGGGHERGMRSGTLATHQIVGMGEAFALSVQRFDEDHTHIKALRDKLWHGLQDIEEVYLNGSMEHGIPNIINVSFNFVEGESLMMSLKDLAVSSGSACTSATLEPSYVLRAIGRPDELAHSSIRFSIGRYTTEQDIDLVLSQIHEAVDKLRELSPLWDMFKEGIDLNTVEWQEH

SEQ ID NO: 3237 - protein, 186 aa, M.catarrhalis
IIYRLIANLDKEFMMNKANFFGLFGLPIAFDIDKNALKSALLSLQKQHHPDRDANKASTNQASLINHAYQVLSHADSRAAYLLELSGQAVDLSQSINDWDFLDEMMDLRIRLDTTDDKMVLDQISNQVHALSQEQSTRFMQNYQNHTWAEAIDATRKLQFLSKLLVDIDAKVTKLLSQGHDDDLYV

SEQ ID NO: 3238 - protein, 72 aa, M.catarrhalis
VVERPPVCVTYRIYEVCGMSAPSSGGIAVGQILGILNEFSPNQVGYDAEGLRLRIVMYIWATLILYLYPFAS

SEQ ID NO: 3239 - protein, 178 aa, M.catarrhalis
NQNRQDGSISMRLTTRGRYAVTALLDLAVQESRHQGAVSLSDIAKRQSISISYLEQLFSKLRKKGLVNSTRGALGGYHLAKPLEDIDIMSIITAVDESINATQCGGKGNCQDGAMCLTHDLWHNLSHHIESYLKKVTLAQLLETKNTQTIADRQVNRLHQFEKDNSQITTITLIGNPA

SEQ ID NO: 3240 - protein, 112 aa, M.catarrhalis
VNKGVAMINLTTQAAQHIKDFLENRGSGVGIRVGVRTAGCSGLAYVLEFVDDPNNSDERFESHGVSVFIDPKSLVYLNGLQMDYVTEGLNSGFKFTNPNQTGECGCGESFTV

SEQ ID NO: 3241 - protein, 120 aa, M.catarrhalis
TDGGNTQRYGVLPWGKLFDTPIHLVKQGFEVSPRLAISVEQNWQHLARYPKTAAYFLPNDVPLQAGSLLKNLEFADSVQALAVQGAKALHTGKYAQNIVSVVQNAKDNPGQLSLQDLSDY

SEQ ID NO: 3242 - protein, 622 aa, M.catarrhalis
ESIMSLLQISEPNQSKNPHQHRYALGIDLGTTHSLVAVVRSGRSEVLAFGQSPLLPSVVYYGKKSSRPIVGNDALNYADDHKNTIISAKRFMGRAKSDIKFSHPYDLSGNHQTMPAFLTAQGEKSPVETSAHILRHLKNHAAAALPPDSIQGAVITVPAYFDDAQRAATKDAATAAGLNVLRLLNEPTAAAIAYGIDKNTAQGNYLVYDLGGGTFDVSLLRLSEGVFEVLATGGNSALGGDDIDRLIAHWLIQSSHLTPADIDETEKSRLAKLAKTYKQALSSQDSVVIEVEIGGILVTQTLNNDMLSEIIQPVIRRTIQSCEQVMRDAKIDKSNLNDIILVGGSTRMPVIQNAVTAYFERTPLCNINPDEVVAIGAGIAADQLINQSNETLLLLDVTPLSLGIETMGGLVEVIIPRNTPIPVTRRQVFTTHQDGQTGMIIQVVQGERDTVANCRGLARFELHGIPPMKAGLARIEVTYAIDANGQLTVSARETTTDIISQIQVSPSYGLSEEQQEQLLQAGFIHAAEDKAARMLIETKVEAQRELLALQSALDEFTDLLSDEEQTNLRHHMQVTADSLNTDDKAAIDEAIKALKVHSDHFASVIMDKNVKDALTGTRTSDW

SEQ ID NO: 3243 - protein, 115 aa, M.catarrhalis
ENIMTVVTILPHHEICPEGATIEVAEGENLCQAMLERGIKVEHACDMSKACTTCHVVVRQGFDSLEEMDDIEGDLLDRAWGLEPDSRLSCQCIIADEDLVIEIPKYTLNHAKENH

SEQ ID NO: 3244 - protein, 119 aa, M.catarrhalis
GEIVSNQTKIQAIKQASEQILAICETPNTALQAIHLILRHGGAGELSWQVVYQRVMADEDVIGAGYLIDFAQTAENLPFDVLPLISLVLNKGDETLKTTMLNKLPDNAKENLRIMGYIC

SEQ ID NO: 3245 - protein, 161 aa, M.catarrhalis
WQMVTGSTLMANGYLLNNELTDFSFEPIKQGKQVANRVEPGKRPRSSMAPTIVFKAGKPYMAIGSPGGGRIIGYVAKTIVAHRDWNMDIQDAISAPNLLNRFGSYELEMDTTAVQWQHALNDLGYKTDVRKLNSGVQAIIIEPSRLVGSADPRREGRVMGD

SEQ ID NO: 3246 - protein, 200 aa, M.catarrhalis
ALLPLPKSSVNVDDNIKVTAINGQAIHHGLLQPLQQNFTLEPGRHVITARYDRLFKLGRDDHDYLKSGDITITANLADHQTYRLIMPNQPKDYHAAKDYIKTPSLAITQHGAIITQEDTTQTKRSGLFGGITSTINNLFGRTNSATTANQEAIAAISTYNTAKPTDNHAVRADDNLDGFMQIWLNASDEEREKIRQWIEK

SEQ ID NO: 3247 - protein, 371 aa, M.catarrhalis
VFMYPAKIDPFFRRLFILAALCLFLYALFLMKTVITPFVAAFILAYFLNPLVSRLALIMPRILAVSVVYISCFVVMGALIIWLVPMVWAQMQILWESLPHIITWYNDTGRAWIARYTDSELLPLDIDLISNTALDYFQNNYQVNDVQGLIKQVFSSGISAANNIGLIVMVPILTFYFLLGWDQRLYTWKLSIPKPYTNKVVRIARDCDTALMNFAKGQFLVMLLLGAIYAIQLQLIGLQLGLIIGITAGIASFVPYLGFGIGIIAALIAGLFQFGLDWIYLGLIFGAFMIGQVVEGYILQPLLLGDKIGLSPLWVIFSVLAGASLFGFVGMLIALPVSAVINVLFHYAYDAYLRSDWHEGQRQLPLWKEDD

SEQ ID NO: 3248 - protein, 97 aa, M.catarrhalis
GIAHGILTGDIFMAHKKAAGSTRNGRDSNPKMLGVKVFGGQDVVAGNIIVRQRGTEFHAGEGVGMGRDHTLFALTEGVVKFETKGQFNRRYVSVLAK

SEQ ID NO: 3249 - protein, 261 aa, M.catarrhalis
TPIKAVIMTQAIQDSLNLDIRPEASLEDFQSSSYRPILDAIDKLVQGSLRELFIVGDSGFGKTHLASAIYEHYTSMTSKMVISLNLTELIEQDPHATALVGLEMFDLIIVDDLQMVRHSYEWQEGLFHLINRLREHQKQILYLADDPARELQIGLLDLHTRLSLAPMLTLPDNDDINDRRILIEVILKKKNWKLPEEIFDYLLEEGPRNAGDINTILDHIRPLLTRLSRVQIPKKTIAEAKQIILHETFMLEIGDNADSNF

SEQ ID NO: 3250 - protein, 182 aa, M.catarrhalis
QGSNMTDQTPLSYKDAGVDIDAGEALVSRIKSVAKATSRPEVMGGLGGFGALCRIPTGYKSPLLVSGTDGVGTKLKLALQLNRHETIGQDLVAMCVNDLLVCGAEPLFFLDYYATGKLDVDTAATVIAGIGEGCQLANCALIGGETAEMPGMYQDEDYDLAGFCVGVVEESEVITGENVQKR

SEQ ID NO: 3251 - protein, 131 aa, M.catarrhalis
LGPDALMAPTRIYVKSVNALQKSLGNANIHAMAHITGGGLTENLPRVLPKNLAAQIDTSSWALPEVFQWLQHGGNIDTLEMYRTFNCGVGFILVVPADQAKQAMNKLTAEGEQVWQIGQIIERTDDAVVYA

SEQ ID NO: 3252 - protein, 228 aa, M.catarrhalis
CGGVCLMSQKPLKVAVLVSGSGSNLQVMIDAMKSGSLAIDIVGVISNREDAYAITRAKDAGIQVSVLSHVPNGKRMSINTFEKYALQQIQDWSPDLVVLAGFMRVLSAQFINNMPCAMINLHPSLLPHYKGLDTHQRVLQSGDKYHGCSIHVVTPKLDAGQVLTQAWLAVDVLDTPKSLAKRVQTLEHRLVPYTLDMMIKKVIDIDNIMAGRMNGMIPLPLKFWMDDE

SEQ ID NO: 3253 - protein, 309 aa, M.catarrhalis
FMKSIKTFTACLTMCLALVGCGQQTKEDINAQDTHSPKKLSVVTTFTVIADIAQNVAGEAADVQSITKAGAEIHEYEPTPQDVVKAQKADLILWNGLNLELWFEKFYHDTSNVPAVVVTQGITPINITEGAYKDMPNPHAWMSPSNALIYVENIKNALIKQDPANQEVYTKNAEQYSAKIKAMDAPLRAKLSQIPENQRWLVTSEGAFSYLANDYGLKEAYLWPINAEQQGSPQQVKSLIDTVRSNNIPVVFSESTISDKPAKQVAKETGAKYGGVLYVDSLSEAGGPVPTYLDLLQTTVSTIASGFEK

SEQ ID NO: 3254 - protein, 558 aa, M.catarrhalis
PVLFIDNGFESMQKILRILIIIAMLITAYLLILAWRDDYARKPVVTQPVATQTTHADVPTTQVVGDIPSLTAGSVADLADTDLITVSTDRYEIKINPVGGDIVYAALKQHNATKDSTEPFVLLETDLRTYVAQSGLIGRDGIDTAEGRAVYHSPRSSYVLNPSAGSLQVPLTYHKDGLTITKTYTFNAGKYPINLSYNINNNSNQPWQGQMYAQLKRDSSKDPGLEDKGMLGMSTYLGGAWGVPSDPYNKLKFSNFDDNINISSKDGWVAIVQHYFVSAWTPSNSFEADFFARTTGKDFYIGYNSPVINVASGKQITLNSTLYAGPKVQSEMASVAEGLNQTVDYGLLWPISKVLFAILDNINKVIGNWGWSIIVLTLIIKVALFWLSNKSYMSMAKMRAIAPKLQALKDKHGDDRMAMSQEMMQLYRDEKVNPMAGCLPILIQMPIFLGLYWMLVESVELRHAPWIGWITDLSAMDPWFILPIFMGITMFVQQMLNPQPTDPMQAKMMKILPMIFVVFMLWFPAGLVLYWTVNNLFSMTHQHLVNKRVERQMKAKQA

SEQ ID NO: 3255 - protein, 95 aa, M.catarrhalis
VIITNKEMAMFSMIWALIVGFVVGLLARALKPGVDGMGWILTMILGIAGAYVGAFIADFVGVNAQSGFSYLIFSVIGAIILLFIYEILAGKRHLK

SEQ ID NO: 3256 - protein, 479 aa, M.catarrhalis
DIKTVGVFMQYISTRGKTQPMQFSDVLLMGLAPDGGLMLPETYPSIDEATLQKWRNLSYSELAFEIMSLFVTDIPADDLKNIINKTYTKAAFGSEDITPVTRLYDRLALLELSNGPTLAFKDIAMQFLGNAFEYVLKQKNERLTVIGATSGDTGSAAEYALRGKDNIEVFMMSPEGKMSAFQRAQMYSLDDANIHNIAVEGMFDDCQDIVKALQEDAKFKAKYSLGTVNSINWGRILAQIVYYFKGYFGATTDNAQKISFCVPSGNFGNICAGHIARQMGLPIDRLIVATNENDVLNEFFNTGKYTPRTSVETYVTSSPSMDISKASNFERFVFLLLDKDSMQVAKLFGDVKSGKGFDLSDNLKLVSEKFGFIAGKSTHQDRLATIKKVYDDTQRLIDPHTADGVKVAIELQKADEMILVAETALPAKFQETIVEAVGEMTLPRPEHTQGLEDKPQYVTVVPNDTKAVAALIEQYITAC

SEQ ID NO: 3257 - protein, 266 aa, M.catarrhalis
MKKTIFNIAKMDCPSEEQLIRMRLKDVSDIYELQFDIAGRCLTVYHDNQDTTILQVLEPLNFDSHIISTEVIVDKIVFNKPDERLEKRLLYQVLMINFVFFIIECSVGIFANSMGLIADSLDMLADSFVYILALSAIGMTLAYKKRVAFLAGITQIILALFGVIEVIRRFIGTEQLPNYQLMIGTAFLALIANWLCLYLLSKNQNKEAHIKASMIFTSNDIIINIGVIAAGALTLLTHSSYPDLIIGMIVFVIVLFGARNILKLAK

SEQ ID NO: 3258 - protein, 281 aa, M.catarrhalis
VMIALLLEPFAYEYMLKAIFLSSLVGGVCAFLSAYLMLKGWSLIGDALSHAVVPGVAIAYALGAPYALGAFFSGILAALSILWIKSVTKLREDAVIGFIFTTFFALGLFIISLNPTAINVQEIIFGNILGIANTDMYQVTVVMVITLLILLIFWKDLLLVFFDEIQAKAVGLSSKYYKLLFFSLLSACVVSALQTVGAILVIAMVITPGATAYQLTDKFRTLILIAGAIGVITGGFGVYLSYFLDGATGGIIVCLQTALFIIAFLFSPKYGKLKQPKFQSP

SEQ ID NO: 3259 - protein, 165 aa, M.catarrhalis
LCHAIFNLGHPFMYRIEQLRPLSRKHQLGLSLSRQAMQCPKDSTTDDIFRHWQALVAYVHDDRIAHFAIEERYLVAPLLANHGNHPKVMALGKQLLAEHEQLRTLSQLTESASHPTIDDLHALAQALYDHIRFEEREVFPVIQELLTTKQLDTAYQQTLQHNPTK

SEQ ID NO: 3260 - protein, 213 aa, M.catarrhalis
MPFYPSTHEYTMHQINPELLTKSKQWRHDIQFSQEVLGKPFNFTSTWGIFSPEKLDDGSLMLLDYIDFQTQDNSIDLGCGYGVLGMTAARECPKGHHLLIDKDFVAIEYAKLNCKNNGLGNAEVMLSNGFYHVDKSRQFSLVMSNLPAKASKEQHYLYLLDAYNAMTSGGRFYVVTINGLRDFMKRSFTEVFGNADKIKQGKTYTVTMAIKES

SEQ ID NO: 3261 - protein, 345 aa, M.catarrhalis
EMNFMNHLTQSKMRIIFAGTPEFAAVSLKHLIDLQDVLNIQIVAVYTQPDRKSGRGQKLTASAIKQVAQVYNIPVEQPISFSLKYQPEQGVSGAVSRETLANYQPDIMIVAAYGLILPLGVLKIPKFGCLNIHASLLPRWRGAAPIQRAIMAGDQETGITIMQMATGLDTGDMLYRVSCPILDTDTTQTLHDKLAVIGAHAITTVLQNLLHFQSLAKVQDDSLANYAEKIHTQEGLIDWNQDALTIQRQIRALNAHTYHKSERIKVLSALPIKFDQTTSIPAGQIVSVGKNAILVSCGADTNGIQHLINITSIQWPGGKPLTAEQICQTNKLCDSDYFEIKTHEK

SEQ ID NO: 3262 - protein, 415 aa, M.catarrhalis
LMSYSSLTPEQSMLALWYITNTSLISYYKLVNHCGDAASALSQNQSIWKLLGIHAAHIKRWQDVNDVLAFLDKVRHDVELKMYGIVYVSDEDYPETLKSIYDPPPVLFYRGNLIRLKDRQIAIVGSRSPTEIAQKITFDLAQYLVQSGYTVTSGLAQGVDKQAHLGALSQLSVLSGRTVGVMGTGINVCYPRNHNALFAQIIKDGGCLISELLPATPASKHTFPRRNRLVAGLSLATVVTEAALQSGSLITARLSAEQGKQVFAIPSHIHNPNAEGCLHLIREGATLIYHPDQILEDLSQHDQEFFNALPKSFSQGMSIFSEESSKLNTHPSQAPDTNTLVSPNPKTAAHHLQPASRSTCVPEHLADLYALMNEPCDLDQLVFSSQKDTGSLLAELMELEILGLIEQVGGRYGRL

SEQ ID NO: 3263 - protein, 602 aa, M.catarrhalis
HIFKIRFFIMTTPKPTVSPHVNIDLSLLIFYQPPIEKLTNHLLTQPAMYAQLLAKKQVQEQQKQSNNETKDGDDGITLTEEDIENLIEQGFSEETIESVSKAVNEQLSKNANDDAKQDDNTDDNLPKGDDANQTHSKINPITKKISPNDFAHTSRPNQSKVHKLAQNPSHPAKTDDTKSHVAQALAQSADASAAKIAESLDNDIHAAVEKQLKEQQEQQEQQYEAFKQYLAKKNSETAIDYRQIRIDIESGALPTRHFYLMNGLSAVIAGFGLLANSPAVVIGAMLIAMLIGPISGIALAIIDARLALLKKSLLTLLSGGALIYAIGVLLGFLYPDQAASQEIIARTAPNTMDVFVALAGGVAGAYALISRNLSVAVVGVAVATALVPPLTASGILLATGHYQLALGALILTLTNILAIQFTNALVLWAVGFRRLDIDESEDETVKDSRWQQNWLFIRRNMVTLILLIGLSVYLTLDFQQRIRQKSYEKAVIEVVQQQIQYQPSYVVSSDFGVVEKGQNNKASADSYMIRVLLQGLIAPSHQDIWQMEQKIQTITTKRYPKRSPIKLQVRFVPEQVIETTPVSKADVKLDDASISQLEENKN

SEQ ID NO: 3264 - protein, 65 aa, M.catarrhalis
CSCLLLRSFNVNISYFYLFLTILNNIRFKEYSLFDNRHNTGKIIFFEHLNPTHWQKWGLISPFTP

SEQ ID NO: 3265 - protein, 83 aa, M.catarrhalis
YMLNFQQKQELFFNCLNEKNNSYSDDIRKEILFYFDFLENDLGFLNRFSSEIEIKNFTNMLVSKIIMNEYQDGVHNIIENYCC

SEQ ID NO: 3266 - protein, 66 aa, M.catarrhalis
KFIKIFPSRDEPFDLITPDGQILNAKVCQENSKALMTNPNSALADWLLRQLLNLKKASWQPAKDCS

SEQ ID NO: 3267 - protein, 430 aa, M.catarrhalis
NSIKPIQIQQTQPNKDAFMKPLAERMRPTTLDAVIGQTHLLSEGAPIFNIVRQGFLPSLILHGSAGIGKTTLAMLLADAVGRPFRPLSAVSSGVKELREVLRSDDGLFHEPPVVFVDEIHRFNKAQQDALLQAVETGEITLIGATTENPSFSVNNALLSRCQVYKLEPLSDDEIYALIVRAIRQDTLLKTKDIQINNLAALIDLSQGDGRRALNLLELVAAAPEPIIIDNASVVAVAGQPLVRYDKSGDGHYDLISAMIKSVRGSDADAAIYWMARILAAGEDPAFVARRLVILASEDIGLANPNALLLADAGLRSVQSIGMPEARIILGQVIIYLANSPKSNSSYNAINRALKLAETDQSPVPLHLRNGVTKLMQAEGYGMGYIYPHDYPNHYHPQQYLPDALIGTRFYEFADNQKEQANFAFINWLKT

SEQ ID NO: 3268 - protein, 165 aa, M.catarrhalis
LIIKNLGVVMHCPFCNKADTKVTDSRLAAEGAQVRRRRQCLACGERFTTFEICEILMPRIIKTNSRIEPYDQSKLRRSISLPLQKRPISVDEIEACISRIEHELRKTGEREVSSKILGEIVMNELKILDDVAYVRFASVYRDFQDIGQFQAELDKINLPKRGESS

SEQ ID NO: 3269 - protein, 311 aa, M.catarrhalis
HMTNKPTVALIGAPTDVGAGVRGVNLGPDALRIADIDKAIEQYGFTVIDRGNLQGPANPNQPPVNGYRHFDEVVAWNKMAHDAVYDELKNGNFPILMGGDHCLGLASLTAVARHCREQGKKLRILWLDAHADFNTSEMTPSGNIHGMPVACACGFGPDELTTIGGVRGAISPKDVYQIGIRSVDAKEKYFINEKGVTVFDMRYIDENGMRHTMEQALKGLDNDTHLHISFDVDFLDPSIAPAVGTTVMGGPTYREASLCMEMIADTGLMASLDIMELNPTLDERNRTAVIMVDFIESLFGKSTLVRPDTTQ

SEQ ID NO: 3270 - protein, 62 aa, M.catarrhalis
NRKNKQMKALKIIAPVLALGLSFTAIANALDAHRAIQLTNKVRQVTCIVAPQVVSPQATRFK

SEQ ID NO: 3271 - protein, 474 aa, M.catarrhalis
LSRKPYQFMTTSIQQLPTIAAIASPIGQGGVGIIRLSGKDAYRIGCLMTRRSNLIPRMAYFGGFYGQEGVIDEGVIIYFKAPHSFTGEDVVELQGHGGMVLQNMLLARVFELGARQAAAGEFSYRAFENDKIDLVQAEAISDAISATSVAQATSAIRSLTGEFSQKINELLDKLVHLRLYVEASIDFPEEEDVDFLSDGIIENKLTEILSGIDRILATAKQGQLLRDGVHVVLAGKPNAGKSSLLNRLSGTERAIVTEIAGTTRDTLEETLILNGLTVHLTDTAGLRKTDDHVEKIGIKRAFDAIRQADVLIMVYDVTTETDPLALADQLFCEGVTEDVGDIIRQKLILVANKSDLLISKPVLQVSCETKSAPKLVYVSCETGEGLDELIEILTQKVGFHPPENSLIARTRHLDALNRAKGYAIEAYEQLTIYHAGELVAESLRQSQQALGEITGQMSADELLGKIFSSFCIGK

SEQ ID NO: 3272 - protein, 352 aa, M.catarrhalis
IFMNDKRLIQQDIYYMQLAIAEAKKGIYTTRPNPAVGCVLVKDSLVIGQGYHPKAGQPHAEIFALADAKAQGFDTKGATAYVTLEPCSHTGRTPPCADALIAANLRRVVVASLDPNPKVAGNGIKKLQNAGIEVLVGVCDQQAAALNLGFLKAMRMGLPYVRLKTASSLDGRTAMASGESKWITGIEAREDVQRLRAQSAAIITGSGTIIADNPALTVRSKQLGVDLHMLPKPKVVIVDRRNRLSDSDNYQVLNRDDTLIWRNDLMSLLKTLVSQYACYDVLIEAGSELSGAFITEGLVDELIVYQAPCILGQDARPMFACQLDQLVQQYRFGLHSADIIGNDIRLIYRSLT

SEQ ID NO: 3273 - protein, 450 aa, M.catarrhalis
KLMKNNIKKLHNHQLSSRAKVILVIEEILNGKSLSELLDPLLESTEMSSRGFVHELLLGTLRQWWALSRISESLIENPVTDQGVQAAINIGLYQLIYMNIPEYAAINDTVEALKQLGKEYGTGLVNAILRKTQKSKTKFTKKVNKNHSLPNWLAKQLKQDWGEYYDELGRTLRFAAPIFLRVNTKFSDNVSYCQILDEHHIQHSLVSLGYNQAQAVRLDGGVRIGELPYFDEGWVSVQDAHAQLAGFLLAPTLQAQGSHQAVLDMCCAPGGKTTHLLEMFHMKHLTAVDSESARLKRMHENISRLKLDTKDISVVHADGTSWRSDRCFDVILLDAPCTATGVLRRHPDIGLLRQEQDIATTVNLQRSILDNLWSRLKVGGVLLYVTCSILKAENERQIIDFLRANDDANAIPFDLSLPHQIKQQVGYQCLPLDTKGGDGFYYALLTKTAK

SEQ ID NO: 3274 - protein, 303 aa, M.catarrhalis
KVMDKITISLDDISVRYNNGHTALYDVSLHLQGGTTCALVGINGSGKSTLFKVLMGLIKPQTGYVKLCDLTIAQALKKNLVAYVPQSEEVDWQFPVSVLDVVMMGRYGHMNFLRRPKPKDYQKIDEAMSRVQINHLANRQISELSGGQKKRVFLARALAQESKILLLDEPFTGVDVKTEKAIMNLLDELRQEGHLILISTHNLGTVPEFCDQVIMINRTILAMGSTKSTFTQANLEKVFGGVLRQLHLVGEDLHDDDDKRTLTILADDEIPAVFYGHHQNRSSYHRKNVKSSENPQAEQEDKS

SEQ ID NO: 3275 - protein, 60 aa, M.catarrhalis
AYLLSGGGGSFLFSRVLSPHGETPPLFVCGGGRNARLYYIIVLRVTKTGGHARGGGCVHI

SEQ ID NO: 3276 - protein, 103 aa, M.catarrhalis
NILLILIEIYRRWISPMMTPRCRYYPTCSAYSRQAIIWHGAIKGLRLSIWRIGRCHPWGGCGIDFVPLPLARYHYQPSHLYFSYGFKDTLSYAARLNHLIKTT

SEQ ID NO: 3277 - protein, 417 aa, M.catarrhalis
CKCWQIMTISADFLEEIFGENLADLTIMDEAPYFIGMMSGTSLDGMDAVLCRFFETDDETCSVEIIASHSVPFTEDLRQALLSLTTPNGVATFIQTCEFDFQSELDVYGWASVYYATFAAQVALELLDKANISHDLVCAIGCHGQTVRHRPNWSFSLQLLDPNILAEYTGIAVVSDFRRRDMAVGGQGAPLVPAFHQAIFGHDKQVKGVLNLGGIANITVLNHDKSTPIGFDTGVANLLMDAWNFRHTNTCYDQDGTWAASGQVIQPLLDILLGHPFFSQSPPKSTGREDFNLSWLDAMIDQLNSSHPNLCHTPADIQATLCELTAVSAAKQIRHFIKSGTVLVCGGGAKNTHLMARLQAHLPNLSIKPTNDWGIEVTWIESVAFAWLARQNILGRHGNVPAVTGANKTVVLGQVCF

SEQ ID NO: 3278 - protein, 211 aa, M.catarrhalis
LSRWGDAMAGSKQIFGADELDLVANYLQAGGVLAYPSESVWGLGCDAFNTDAINQIINLKHRDIGKGLIVLTDAAERLKSLIDVSHETSLLDYMQNFSDEFTHEYSRALTWLIPIQSSALPSVLIGSYDTLAVRITIHPVLKDLCHALISPTNPYGFLVSTSCNPSKSTPAKNLTQAMGYFGDQIAYLDTDGLGFVQPSCIKDLLAGHILR

SEQ ID NO: 3279 - protein, 106 aa, M.catarrhalis
GSPSDLYSCPTGSFPTGDTVQVNYGFSDQALPTYAEANFGGKTRFLPINLVESIGELMIFGDDNDWQIFGLYLQLDNDHHSYVHIIDPDAEASYRCDVVGTKRIKD

SEQ ID NO: 3280 - protein, 165 aa, M.catarrhalis
WSFMKMSCPYCYSAKSRPLSFGERQMAISVFGDALKLDDIRLKTAWWVIQGYAVSPNGHVYFHPKDFCEDFSSQHLMKRAWLIHELVHVWQVQQGIRVFWRAILSRRYRYRWIQGKAFLRYGIEQQARMVEDFYIRRECGKNCDKWYECVPFLSREIKSTQCFKN

SEQ ID NO: 3281 - protein, 225 aa, M.catarrhalis
ENIMFTGIIETTGRLKSINQIGGDVQLVIHAPDMDFNDVHLGDSIASNGICLTVVDIGDKTYAVDVSRETLSKTALKNWRTGDTVNLEKAMRPTTRFGGHIVAGHVDGVGVIRHISKDARSIYIEIEIPSELMRYAADKGSITVDGISLTTNAIKPEQNIVCLNIIPHTAKCTNIDRHWSVGGLVNIEVDLISRYLERLLFASNQVQKPTSSISEELLNQAGFYL

SEQ ID NO: 3282 - protein, 367 aa, M.catarrhalis
ENIMALNTIPEIIEDIKAGKMVILMDDEDRENEGDLIMAANHITPEAINFMITHARGLVCLTLTEARCQQLDLPLMSDKNGAKFSTNFTLSIEAAEGVTTGISASDRARTVQAAIAANAKPIDIVQPGHIFPIMAKKGGVLHRAGHTEAGCDLARLAGLEPASVIVEIIKPDGEMARRDDLEVFAKEHGLKIGTIADLIQYRMATEQTVSEVEHFAIQTEHGDFTAYRFSEFGSDDTHLAFVKGKPTGGVSTVRVHSFSPMKDLFGIHTSGSRWNIQNALAKIATAEHGVLVWIGHDDTLNLGDGFEALKDKQSVTSVNRRAPYQTIGVGAQILKHLGVKDMRLLSSPIKFNALSGFDLNVVETIDK

SEQ ID NO: 3283 - protein, 435 aa, M.catarrhalis
HNPIIQTIHGHIFFKDFTMNTTNQPSNSQAYIDREEQYGAHNYHPLPVVLSRGEGVHVWDVEGKQYYDFLSAYSAVNQGHCHPKIITTLTEQAKTLTLTSRAFHSDKLGEFEAFACDYFGYDKLLPMNTGAEAVETAIKICRKWAYEKKGIDENQAKIIVCENNFHGRTTTIISFSNDENARKNFGPYTQGFIKVEYDNLQALEQVLTDNKDVAGFLVEPIQGEAGVYVPSEGYLAKAKALCDKHNVLFLGDEIQTGIARTGKLLALDHENVRPDILILGKAVSGGVYPVSVVMADDDIMNVIRPGQHGSTYGGNPLGAAVAKTALEVVRDDNLADNADKLGHIFREEMQKLVDKHELLTLVRGKGLLNAVVINDTEDSSTAWDLCLALKENGLLAKPTHGNIIRFAPPLVMTETQLRECVDIIAKTVAKFEADR

SEQ ID NO: 3284 - protein, 411 aa, M.catarrhalis
IKAMTMSDFLPIKDQLTLIMRGVQEIYSKEDLIKKLEKNRPLRIKLGMDPTAADLHLGHTVVLNKLRHFQDLGHEVLFLIGDYTARIGDPSGRNATRPPLTEAEVKANAQTYAKQVFKILDKDKTKIVFNSDWFGKMSAGDMIQLASQITVSRMLERDDFSKRYNSQTPIAIHEFLYPLVQGYDSIALDADVELGGTDQTFNLLMGRTLQGRYDKEPQVCITMPILEGLDGVQKMSKSLGNYIGINDPAGVMYQKILSMPDTLIARYFELLSFKPMSEVNTLLDDMKNGRNPQEIKRILALELIERFHDKESADNAHKSAGNRLADGELPVDLPEVSLSLNGQDKLFITQVLNQAGLAKNSAQAKDMLSRGAVKVDGQVVDGSFALEQGQTVVIQAGKKAYARVWIQSAQI

SEQ ID NO: 3285 - protein, 265 aa, M.catarrhalis
KYEILTLNDLSNKHEHYELLNLLGYGLAKFNNDFIKQFNCRTKEQFYQYFVDFGIAKTKSVVKNRQDLFDPYFDNGRLGWWQKKEVYEHRKLLIDGLFGTENVVNYANIVKLILKDNYKTSDFIVEKISIEPITQSKFKKMQETGLEAELYFMNNYQNIELFGNGVLQDARLFGDGYDFQIATNSNNYLAEVKGIRQNKGKIRLTENEYIKACEYKHDYILTLVLNLNEVPRFLVIENPVNELNFKEVIFQSKPVKEYHLERDIC

SEQ ID NO: 3286 - protein, 71 aa, M.catarrhalis
RQDVVITQLAQLIAAKRLFGMELSKDLGSVFGESAAVTLGAAVVLILFHCLWLAITINQAIFIFLMDSKTH

SEQ ID NO: 3287 - protein, 292 aa, M.catarrhalis
VLGVPNLFSLLLMSNSILYWFTEPFSHTFMQHALISAVAVAVICALLSCYIVLKGWSLMGDAISHAIFPGVVVAFWLGIPMTFGAFIAGVCCAGAVGYLQTHTRLKEDTLMGVVFSGMFALGLVIFHKIDSGQHLTHLLFGNLLGISRTLMYQTLGVSAIIFLILILKRRDLLLYCFDSHHAQVAGLSIQKLHYGLLIILSATIVVAMQAVGVILVIAMLISPGMTAFILCKRFDTMLLTAIISSCFTSVFGVIISYHLDSATGATIVLMQALVFLGAMIYDKICLWLLNFY

SEQ ID NO: 3288 - protein, 60 aa, M.catarrhalis
IGVFRGHFWWDIEVIGRLFVRGTEGLNYVWGGERIGKLLSLLTKWGGGVLPIFPRIESTW

SEQ ID NO: 3289 - protein, 128 aa, M.catarrhalis
AKSFIVASKGVFMQIPIHAIYIQLADASRMPEMAFVRCEFGNKHCKTIIAHVLITDGQVQETGDFERDGVTFPTTEVWIDFINPVNSDGDMFPTGKLIDILTVPNVDEFEVTLINAGMPTIFICASDL

SEQ ID NO: 3290 - protein, 375 aa, M.catarrhalis
MLLLCLMKCTRNIYKEKTMKHRDFYVYQVAETVLNTSIRTVGFLFAWLMLTVFKNPQHLGVFIGTSWACQVLALLLFSWVCSQPKFTIHSKKILLCFCVICLLSFLPLLFIHNYFIFGIIFVISSIFTILLNPLGTSLTNDLYGGNNKSNGFKVRGFVNSINTILSPAISGFIIHYFGAHQIICACIILSFISGILFYGIKNIKLQENLEKQSKNTFKILLKNPIERLMVLVSLLANFIITPMIAYIIPYNIANKFKLPAFYIGISEGCFGIGMILGSVYFLKLFNKKIGSHKSVVCSIVLVAIGILLSLLDGFYLFCMALIMMGVGVVMFNINSTHIRCTATPKDIRASFEFIFLACCIVFIPIGVFFDDLGVK

SEQ ID NO: 3291 - protein, 271 aa, M.catarrhalis
AVKTMRQIFMHRLLPPTLMASFLLLSACSSGNSHAKDTSNASQPTTQTSSQSDTTLVKTLQDNLTQAGVDITVTNALPTTMPDIYWVSFENAPAMFTDKSGEYLIQGQIVKLSGDYPTDITADIQSSLAKETLAKANTDDMIIYPATSQHKASIYVFSDPTCHYCRMLHKDIKQLNAGGIEVRYLAWPRSEQDIPLTEAIWCSQDRKAALTAAKLGQTVHAKHCKNPVQEHLALGRSLGVSGTPAVFAESGRQIGGYMPAKDLIHTAIEQR

SEQ ID NO: 3292 - protein, 204 aa, M.catarrhalis
LWETLQSFHTPKDIAMKLLKITLFASILGSATFSHSLSAIANTRFETIDITTLTNQAARGDYHAQFFLAKRLQKGEGVTKDASKAVYWYTRAAEKNIAPAQLNLGIMYLRGEGVRADIATGRAWLEKAANLGDNRASYALAMIDEQQQRLVDAYKWYDLSAREGMLDDNVRNRAKVKVSQLALNLSSSEIESAKRSANAWFLNQ

SEQ ID NO: 3293 - protein, 89 aa, M.catarrhalis
DSYFQDAKDGVEKLVPEGIEGRVPYKGPVAGIIGQLAGGLRSSMGYTGCQTIEQMRKNTSFVKVTSAGMKESHVHDVQITKEAPNYRQN

SEQ ID NO: 3294 - protein, 61 aa, M.catarrhalis
FRKAIVISGGLAAYKLGITKEEIQEILIQNAIFSGFTRAMNAAVVLDEVYKKYLQGKDNEA

SEQ ID NO: 3295 - protein, 167 aa, M.catarrhalis
WMIYVFGVDFKDSQEMVYSGSDFDKLGCIFFNEEIFVDKDDLFILDKIIHESAHQILLSVMIHDEVVLNSDDERYPSPLRTGLRTMNGIYHAAFVLYRIARFFNQIIKKQNTQYSYDDLISHINKNKEQFLACYDVISKNGKLTNLGSAIIENCYKELKDMPNEINR

SEQ ID NO: 3296 - protein, 297 aa, M.catarrhalis
KIMYDNPISCLAKSGFVDGLHCVVTTVSTPLWDILIWMLIGIGLFFTLFSGVAQFRLFGRSIKSMLGSRNQHDDAGISGFQAFVTGLASRVGVGNVAGVAIAIGIGGAGAVFWMWLIALIGMCSALAESSLAQLFKVRDATTGQFRGGPAYYIEQGLGQKWLGCLFALALIVCFGLVYQSIQSNTITLAIQSALGCVVEDAICQNQWQSYKHMIGALLVILTAPIIFGGIRRVAKIAEMVVPIMALIYILGALAIILMNITAIPSIIALIFEKAFVFETTSGGLFGSMVFVAMMQGN

SEQ ID NO: 3297 - protein, 61 aa, M.catarrhalis
HLNHPIPKVIDLTKIDNLKKLYQKMAIATKIFQDICLNDSVNFYCGLFWFYRIGLLFILHL

SEQ ID NO: 3298 - protein, 177 aa, M.catarrhalis
MNFNDIYNPNQSLAIVLRGANNEKIVDSFYYLLDVCDEILDKDFKKNIAKNIEFAESHSILGDILFHFINHLVKSITKNNIYEINDVFISFNKFISFYDREKIIFSGVGDVGNLYLNQFNKINDDAYEFSCKPINVNLIDEYKLKINNLMNFIKDIDFETYMEIDNIVDDICIWCRL

SEQ ID NO: 3299 - protein, 1105 aa, M.catarrhalis
PIFLYFYEPVMTDQITDYKNTLNLADTTFAMRGDLAKREPLWLEQWEKDDVYGQIRQARQGRKTYILHDGPPYANGQIHLGHVVNKVLKDIIIKYKTLDGYDAPYVPGWDCHGLPIEQKVEQKIGKVGQKVNATKFREACREYAKSQVQLQMADFKRLGVLGDWDNPYLTMNYQQEANIVRALGKIYDNGHIVRGMKPVNWCLDCGSALAEAEVEYQDKTSDAIYVGFDIVNRENLPIIANISGTLQAVIWTTTPWTLPANQAISVHGDFDYVVIKGKKTPIFALPSQIDSKNFTLRTLTKADKQALQACASDPAIWQFMPTKRHLPEVFEPFFEQAVKDKAYAIIDKRTGNIIGTTRFCHDNAKDDTIGIGFTFITPEFWGKGVNDEIKHTLLNHAFKYRNAVCFQIHEGNDRSKKAVEKLGAVYQKDVKNDFGKMWVYTITNPSTINHTTHFIVANDLVADFSKNVALDDVETITTIKGADLTVLNAQHPLISERQVPIITGEHVTADSGTGLVHTAPAHGVDDYIVGNKYNLPVENPVSDAGVYLDNAKVFVGEHIYKAQPKIIETLGSSGHLLDHKKIRHSYPHCWRHKTPIIFRATPQWFISMEQNGLRQKALNDIKNITWTPAWGQNRIEAMIDGRPDWCISRQRTWGVPITFFIHKETDQLHPRTSELIEKAAQIIEKGGIEAWFDADISDFLGDESGEYYKVTDTLDVWFDSGATNFAVLNHRKELSNPADLYLEGSDQHRGWFQSSLLVSESIYGRPPYKQVLTHGFTVDAKGHKLSKSKGNTKGFEPSDIANKMGVDILRLWVGSSDYRYEMAVSKEGFDRTTDMYRRIRNTIRFLLANTDDFDPKTDMISTDKLISLDKYILYRTKHIQQEIIQAYHSMDFHQVCQTVMGFCSQDLGGFYLDIIKDRTYTTKADGLPRRSAQTTLYHIAHALLRWIAPVLSFTAQEAWQVLKDTQGYIFTAEWYQLPDFQMNDISHEDWDKVALIKDTVNKSIEQARSDKIVSSNLTAKVTITAPQDITDILNKFGDELRFVFITSDATVKSGDTLSTTITPADGTKCVRCWHVRTDVGTHAEHPEICGRCVQNLDDGEMRLYA

SEQ ID NO: 3300 - protein, 777 aa, M.catarrhalis
ARDNLTKTNLISSLIIGVIMNKFQLLPLTLAVSAAFTTTAFAAVSQPKVVLAGDTVVSDRQGAKIKTNVVTLREKDESTATDLRGLLQDEPAIGFGGGNGTSQFISIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTLDIKKDDKTLTETELQAELDNKYAGKGYKLGSKTPDGKKYNVVDANGKLVADLDRNNPTQRETYQKLTNLEWTGKNLGFANEVTANVYKLEHGRNSSSDQGNTYITKDVPKEIIDNVDTPSNMHVVATGANINFDKEFNHSPLKGFGVDNTLLKYGINYRHQKAVPPRSLKPGVVHQEKTDAGIYLEAVNQINDFTINTGVRVDRFDFKAMDGKKVGKTDINPSFGVIYDVNPNLSVSGNLIYATRSPRFADAILSRGYRGGVISIDDNAKAEKARNTEIGFNYNNGPYTAFGSYFWQRVDNARATADITRHGTTDANGKSIKVPTLGNQGHQTNQGYELGVGYTEGAWRARAGVAHSKPTMHNVKFSGNPEYAVRTGRTWTADVAYRLPNPSVELGVRHTLVEGVDAKDTSIISGEVSKLNREGYNVSDIYANWKPYGNDKVNVNFAVNNVFNKNYRPHTQRASIDTLPGAGRDFRVGVNFTY

SEQ ID NO: 3301 - protein, 87 aa, M.catarrhalis
YLINKTKRHQILTQCLFDWHYFLSLTPIVIIVLQFDWFLSPTALLRSNCFNIIPYINEKDKHHNLKYLISLWFFDSKLKKQDVKNFL

SEQ ID NO: 3302 - protein, 228 aa, M.catarrhalis
RLTDMNSQEILKQIHQTKFLLSAPTFKLCPEDTGFEVAFAGRSNAGKSSAINTITHQKQLARSSKTPGRTQMINFFMVGDEQARIVDLPGYGYAAVPESMKIKWQKELENYLVSRQSLAGLVLMTDIRHPLKYFDEQMLHWAKDGKLPVHVLLTKSDKLKRGAQKSALLATKKQLEVLDLPFSIQLFSALKKKGMDELALVLGDWLHLTPSDKHHLSPSNTDIFGENE

SEQ ID NO: 3303 - protein, 87 aa, M.catarrhalis
RICLMKLTDKLSKETIELMQRFNDDAVRRLNDDLYPIAPDLVEMLIDSIYGNIYQRGVLSIKERHIATLSALIAMGSSERQLSFQGG

SEQ ID NO: 3304 - protein, 185 aa, M.catarrhalis
NNYEKLPSIPKSNSPIEYHLMNTPILPSEEVRITHKSTVSLHFEVSLMNGEVIDSTFHRQEPVTLTIGDESLLAGFEKVLINLKAGDTRTATLSADDAFGQWNPENVQTFTRTQFALSEPNPVVGMMMEFADKGQNSLVGVISLVTDDEVLVDFNHPLAGQDVLFKVQIFKVTPPNQVGFQLRSS

SEQ ID NO: 3305 - protein, 117 aa, M.catarrhalis
PCKEKVGIMDDQLPICFSLRLTQQNYLSFKVMALKITTDCINCDICEPECPNDAISYDQKGQKTYVINPDLCTECLGFYDEPTCDKVCPIDCIIKDDSRPETPDELMAKYKQIWGKS

SEQ ID NO: 3306 - protein, 401 aa, M.catarrhalis
PMLRIAYDALTFDDVLLLPAYSEVLPKQTSLTTRLTKDITINLPIISAAMDTVTESKMAIAMAQLGGMGIIHKNMDIAHQARRVRHVKKFEAGTVADPITVTADATVGDLLALTREHKISGVPVVKAGTNKVVGMVTHRDLRFETNLSQPVANVMTPKDKLVTVKEGETQERIKELLHRHRIEKVVVIDDDYQLKGLITVNDFSKAENNPNAAKDSKGHLLVGAAVGTGADTQARVEALIDAQADVIIVDTAHGHSKGVIDRVAWIKKNYPNIQVIGGNIATGDAALALLDVGADAVKVGIGPGSICTTRIVAGIGVPQISAIDSVASALKDRIPLIADGGIRFSGDIAKAIAAGASCIMVGSLLAGTEEAPGEVELFQGRYYKAYRGMGSLGATSRETAA

SEQ ID NO: 3307 - protein, 443 aa, M.catarrhalis
FGVRMSWFPKWQPYTGDINTQPVATNEYLPVGQSIMLGLQHVLAMFGATVLAPLLMGFDANLAIMMSGICTILFFVMTGGRVPSYLGSSFAFIGVVAAATAHATGSGANSNLSVALGGIIACGFLYAVIGFIVMATGTQWIEKLMPPVVTGTVVMIIGLNLAPITVSGVQGKPFDLWMALMTVLCMGMIAVFAHGFLQRLLLLIGLVMAYAIYAIATNILGLGEPINFALITDADWFGLPNFSSPTFDTNALPIIAPVAFILVAENLGHIKAVGAMTGENLTPYLGRAFVADGVATALSASVGGTGMTTYGENIGVMAVTRVYSTLIFVLAGIFAMILGFSPKFGAMIQTIPSPILTGASIVVFGLIAIAGAKIWIDNKVNFANNKNLMVAAITIILGTGDFGLMVGNFNLGGIGTATFAAIILHWFLSLREFNSSRVQFFES

SEQ ID NO: 3308 - protein, 177 aa, M.catarrhalis
MMGRCVCMPNHLLLNTKQVMGYYLIAIVVLVSDQMTKFYFKNTFQLGESVEVISPILNWTLAHNYGAAFSFLADQNGWQKWFFAILGLIVSGFIIIYLKKAPKTANILNLGLSLVLGGAIGNVIDRILHNHVVDFIHVHYADVWHYPIFNIADIGICVGMAMIIYDMLFLEKKRRSV

SEQ ID NO: 3309 - protein, 252 aa, M.catarrhalis
NPSIFIACEDTRLSSKLLKHFNIPTPTIAYHEHNADKQTVHLIEKLNSGQSVALISDAGTPLVSDPGYRLVKASHEHGINTVPIVGACAAIAALSVAGLPSDRFTFAGFLPAKSHGRLKALQHWQACTQTLIFYEAPHRIVDSLTDMMTVFGATREATLCRELTKTFETIKKLPLGELVQFVQNDSNQQKGEIVVVVAGCDDTVHQSTDYDAWLLAITKELPPKKAASIVADVLGLKKTTVYDRLLALQNHI

SEQ ID NO: 3310 - protein, 392 aa, M.catarrhalis
ETVVSDYEQTAPYLDPSSVGIVQPQTLIFDEPLTLECQQILPAFELVIETYGTLNTDKSNAILICHALSGSHHAAGYHSADDTKAGWWDNLIGNGKAIDTSKFFVVCLNNIGSCHGSTGPTTINPKTGKIYGADFPLITIKDWVKTQVMLSDRLEIKKWHAIVGGSMGGMQALQWSVDYPDRLSRCVIIASTPKLSAQNIAFNEVARQSILSDPEFHDGWYLEHGTYPRRGLILARMVGHITYITEDAMKAKFGRDLKSGRFMYGYDVEFQVESYLRYQGERFSQNFDANTYLLMTKALDYFDPTRDYAPDGLSDEDALKLTLSRTRCQFLVISFTTDWRFSPERSVELVDALMANTKPVSFVNVDAPHGHDSFLFDIPRYRDALKGFLQAK

SEQ ID NO: 3311 - protein, 152 aa, M.catarrhalis
RKTVMTLKDSLTQTIKSSMKAREMEVVKILRNVQAAIKKVEIDTQTTLDDNAVLELLQKQIKQRQESLDIYEANGRDDLAAKEKFEIEVIGQFLPAQLNEAALNDIIAATITELEANSMKDMGRVMNAVKEKTVGQADPAIISGLVKKALTA

SEQ ID NO: 3312 - protein, 98 aa, M.catarrhalis
CLILTVPIFAVQQPQRIFVPVLNLSFWRVVLCLFPLVFFLTTWVLNNGFLIYFYGVIICFLLMLSVMIDKNLDVVHIYKVDNDKLEGYYKTYYPKIYQ

SEQ ID NO: 3313 - protein, 458 aa, M.catarrhalis
TLFSEFGGLFIAKCIKINIPIAEYFVNNTINLAVLGLGTVGTGVLNLIKDNVNELARRSGHQLVITHAGTRRHRHDIDPSINQTADLMSIAEAKDVDIVIEVIGGTDIAYEVITHAIRHKKHVVTANKALLAKHGNEIFRLAEEHGVQVRYEAAVAGGIPIIKIVREALAANKIDWLTGIINGTGNFIMTEMQQKNRKFDEVLVEAQALGYAEADPTFDVEGIDAAHKLSLLASIAFGIPVQFDKVYCEGITKIGLQDVIYAKELGYTIKHLGFAIRRDHGIELRVHPTLIPSQALLANVNGVKNAVMIDAHPLGQSLDYGDGAGAGATASAVMADVMDLIYVINADTPSDVPHSGFIPEELSDIGILPADEMTSGYYLRLTVKDEGGVLADTTRILSDNGINIDAILQRDAHKSGLVPVIILTLPVLEKQMNAAIRQIEALGAVVEPVVRIRLESLE

SEQ ID NO: 3314 - protein, 215 aa, M.catarrhalis
QKFSSNPYRYFMRIDHQLVEQWIEPNSRVLDLGCGDGTLLEHLQKHLGVTGYGLEIDEYKINQAIAKGLNIIEQNLNDGLARFADNSFDTVVMARALQAVKAPDQLLIDMLRVAKEGIVTFPNFAYWQNRMYLGIKGMMPISDTLPHEWYNTPNIHLCTFKDFEQLCDKNNIRILDTVAISDKPNPKLPPVLLNHMVKRIPNLLADVAVYHIAKY

SEQ ID NO: 3315 - protein, 124 aa, M.catarrhalis
FYSSIRRKKLFQNKKLLFLGDWANGERFFDQDKDLNKELKSQSEQAISDKVALSECREMVGRDAKYPDSVDFKLLNTSVQKSKTHGNVIVTTKFTAKNDFGAELPYTAKCLFTPDGKVEFEYIK

SEQ ID NO: 3316 - protein, 65 aa, M.catarrhalis
MVGLILKCSNQMLKYLFLLNHCYFLNMLYNNVLYLIMLYHNRGYHDKKTTCLCDIGHLCDASGSR

SEQ ID NO: 3317 - protein, 131 aa, M.catarrhalis
IRMPAVKSNRPINLPLSQVIAVNSKSPIAMASILHRVSGIVLFLLVPVMLCILQTSLSSADSFAAVFNNIALRFVAWIFVAATAYHFVMGIKHLLADAGMNEELKSGRTAAVISFVIAAVLIVASFVWVMF

SEQ ID NO: 3318 - protein, 229 aa, M.catarrhalis
QGLYPESPNVKGLYAIGECACVSVHGANRLGTNSLLDLVVFGRAAGQHIIDEFNQTGRNYKPLNPRVLDFTQSRLDKLQNSTEGYNAQEVADEIRNTMQSHAGVFRTQALMDEGVQKIMALAPKVEQIHLADKSAVFNTARIEALEVANLYEVAKATMISASLRHECRGAHMVVDYEHPADYEPAPLGRNDSEWMKHTLWYSEGNKVVYKPVRKQPLTVDYCVPRVRTF

SEQ ID NO: 3319 - protein, 763 aa, M.catarrhalis
VEDLTLAFHGLAESDLDTTFPTNDLAIGKSEAKLREIIEILERVYCQSIGYEYMHVFQAAEKRWIENYIESNHGHIKFDKDKKLEILERLTAAEGLEKYLARKYTGVKRFGLEGGESFIPAVHEMVQRAGTHGSKEVVIGMAHRGRLNLLVNILGKKPSDLFDEFDGKVQPVNGSGDVKYHNGFSSNVMTPGGEMHLALAFNPSHLEIVSPVLQGSVRARQARRSEKYGLQIDNSTVLPLVVHGDAALAGQGVNQETFQMSQTRAYKTGGTVHIVINNQVGFTTSRIEDARSTEYCTDVAKMVHAPILHVNGDDPEAVVFASQLAVDYRREFGKDVMLDIFCYRRNGHNESDEPSATQPLMYAVIKKLPTTRAQYVEQLVQEGIITHEQGAKLEDDYRELLDRGEFVAGGLVSEPNTELFVDWKPYLGHDLQDDWETGVDIEKLKSYGRAMAKIPEGFTLQRQVAKVVEQRLAMQTGEEPLNWGAAETLAYASLAAEGSLVRITGEDVGRGTFSHRHSELYNMNDGSMYIPLQHITKDQARFATYNSLLSEEAVLAFEYGYATTVPNALIIWEAQFGDFVNGAQVVIDQFISSGETKWQRVCGLTMLLPHGFEGQGPEHSSARLERFLQLCAEDNMQVITPTTPAQIFHALRRQVVRPIRKPLIVMSPKSLLRHPLATSNLEELASGKFETVLPEIDSINHEQVTRLVLCGGKVYYDLLDQRRKLGQEHIAIVRIEQLYPLPEERILAEIDKYPNLEEIMWAQ

SEQ ID NO: 3320 - protein, 80 aa, M.catarrhalis
TNLHSPTNFCFCASEWSESDFKFDGLILLVHRTLFQIPFISRDNLNVFDQKGRFFDKIGQMGMVNKIGNGKRRYYKKLDF

SEQ ID NO: 3321 - protein, 381 aa, M.catarrhalis
PKLQHTNTKCNMQSLGINMATNQDNTINNIPTLNFDAVIVGGGGSGMRASLQLVNGGMKVAVITKVFPTRSHTVAAQGGIGASLGNMSPDNWHFHFYDTVKGSDWLGDQDAIEYMCREAPKVVYELEHMGMPFDRNADGTIYQRPFGGHSSNYGEKPVPRACAAADRTGHALLHTLYQKNLEKGTQFFVEWIALDLIKDDEGNINGVIALDQETGNISVFQANTTVLATGGAGRIFKASTNAYINTGDGLGMAVRAGIPLQDMEFWQFHPTGVAGAGVLLTEGCRGEGAILRNKHGEAFMERYAPTLKDLAPRDFVSRSMDQEIKEGRGCGPNGDYIVMDMTHLGAATLMKRLPSVFEISKNLVMWILPKNLCLLCRLSII

SEQ ID NO: 3322 - protein, 62 aa, M.catarrhalis
YIIKKIYSLTLFLHTYNQILFFYCPKLIWSNVCEFVNNGQCFSSLWQIVNKGKYDLICIGRW

SEQ ID NO: 3323 - protein, 183 aa, M.catarrhalis
RWLNQCIQKSMSVRCVMKKFLKRLGIIFAVFFGIMVVLATIIETPEQETKKEVEQTDEQKTEQTPQQATNQKTKQETGPKAEAKANNGPKAKPCVSKPISEHAFTEYDKENYPKIYQKWGNDWIERLEAPQRAAADKIANSDNACDSISFIALSDAKSYSKTRNCCFWGIGLMVKDFLIKIKI

SEQ ID NO: 3324 - protein, 68 aa, M.catarrhalis
EPLNQGAWYYLAPELFAWVVPAPTKAKIITPSARPAAAAPATGSPKLHTEQQKALIAEALGVTVEALK

SEQ ID NO: 3325 - protein, 375 aa, M.catarrhalis
  UNSURE (22): Identity of amino acid sequences at the above locations are unknown.
RHINNMPPLMLVVPYGILRQAXRGGGEGAHITRGMGSPMELYYQGGHLATSSFEHGNKNLVKEKSDNYELGFMHTADKVSYKASTYYSNFDNYIFNETIAKEGNLYIRRYNQTTAKFYGVEGSLTYQPNANHSVMFFGDMGQGKIGALSDIKGKLVYAGRKWVYFDDDIKDMTVDDNGDYDADGGLTCALKTPEQWGQINDNNDCSTTINVYKNGTTTSGEEDYDRLARNPTYAPRVPPSRLGIRWQGYFGDHWSANAEFNHVFAQNKVATSTVAIKPQFKQPEGCQRHESNCRISDYGSDNNPLMMQPRYITENKTAGYNLLNVGLNYNNAYRNVDYTLSIRANNLLNEQIFIHQLIFAFVPQNGRNLTLSLTG

SEQ ID NO: 3326 - protein, 123 aa, M.catarrhalis
NGEKRMTNSSKDTVAFANTELAADSAAYVEALYEQYMADSQSVSKEWQDYFATYRQDDDAPHNAIKEQFLLLARNQSGLTAKSSDSSVEHHPKQMAVQALISAYRRRGHRKANLDPLGLHPRP

SEQ ID NO: 3327 - protein, 488 aa, M.catarrhalis
RKKENMMKNSYDLVVIGGGPGGYEAAIRGAQLGFSVACIEKRVHKGEPALGGTCLNVGCIPSKALLDSSHRFEATKHELTDHGITTGDVNIDIAKMLERKDSIVKGLTQGVAGLLKGNGVDWLQGWGTLVDGKGAEKQVKFTPLEGDESTITAKYVILAAGSVPIEIPVAKTDGEYIVDSTGALEFAEVPKRLGVIGAGVIGLELGSVWRRLGAEVVVYEAMPEFLAVADKDISKEAAKLLKKQGLDIRVDTKVTGAEVKDGQVIVTTDVKGETQTDTFDKLIVCVGRRAYSEKLLAENCGIELTERGLVAVDDQCKTNLDGVYAIGDLVRGPMLAHKAMEEGMMAVERIHGEKAQVNYDTIISVIYTHPEIAWVGLSEQAATEQGYEVKTGSFSLSANGRALAQGEGVGLIKVVADAKTDRLLGMHAVSVGAGDIVHQGMIAMEFVSSIEDLQLMTFAHPTVSEAVHEAALSADGRAIHAIQRKKRK

SEQ ID NO: 3328 - protein, 192 aa, M.catarrhalis
SREDETLTFRRSCREGICGSDGMNINGKNGLACLINMNTLPNKITIRPLPGLPVIKDLVVDMNQFYEQYEKVHPYLINNQPAPPKERLQSPEEREKMNGLYECILCACCSTACPSFWWNPDKFLGPSALLNGYRFIIDSRDTDTQARLARLDDPFSLFRCRGIMNCVSVCPKGLNPTKAIGHIRNMLLDQAG

SEQ ID NO: 3329 - protein, 135 aa, M.catarrhalis
FCNRGCTDCRIVCMGDVLMRNNSGIKSATGLTGSGSRDWILQRISAVVLAVYSVVMVGFFLFNDVNFESWQGFMLSLPMKLFSLVAILSLVFHAWVGMWTVLTDYVKSSGLRLVIQSLVIIAVLVYLFWGVMIFW

SEQ ID NO: 3330 - protein, 599 aa, M.catarrhalis
LCYIITEGIMIKKPLVCAISATFAMPAVADNTKLGEEPTTTLKGVLVSSQTNQNTGFVSNDSKQSSDLTLSKDKLKYRSATLGNALSGELGIHSNPFGGGSSAPVVRGQEGVRLKILQNGTDVIDVSSISPDHVVATDTLLASKVELVRGADTLLYGLASPAGVINVVDDRIPNRMPSGAIHDKIEGETMLRYNTNNHEKLATAGVSFGVGDRIAVRVEGLKREADDYQVPHFQADRMLDYVPGSANNSTVGMIGVSYIHDNGHIGASYSHRKDRYGIPGHIHCDSQREHFIKWHNITKSNYYLPIYPHLMEDSDIDDNPHTHCRHNHEDHIGEHNPTGVPINHEHHSPWIDMKTDRYDIRGEVYRPIQGLDKIKLSLTYADYYHDEKDAGNEQDPNNHKPSERDTTVDKGHASSIFTKKGVNGRLELYHTPTKRLSGVLGIGYQTQKSAAGEAYLPSYFQSEAEWQKAQSQNINQYRPYLLVPNTNKSLGIFGLEQLKLNQMTFKVAMRHERQKTPIEYDQHLLDHALQYFLSKAQLKAPDHPDLTTYKQHATSYAGSALWDITPGSSRGRRGSSHNERHGIADGAVLSRRTFGDQLF

SEQ ID NO: 3331 - protein, 420 aa, M.catarrhalis
FINLKEFIMAEIKAPVFPESVQDGTIVEWHVAEGEAVSRDQLLAEVETDKVVLEIVAPDNGVITSIVKNVDDTVLSAEVVAIFEAGASAPAGEAPSKDGELSKDEADKGTTIDPASVAAPVQPKDESATSEAEYKDHSPAVRKAAKETGVNPADVQGSGRGGRVTKSDMINPTLKADNGQVIATAVGQRIEKREPMTRLRKRIAERLLSATQETAMLTTFNEVNMKPLMDLRAKYKDRFEKRHGVKLGFMSLFVKAATEALKRFPAVNASIDGSDIIYHGYYDVGVAVSSDRGLVVPVLRDTDRMSMADVEAGIRDYATKARDGKLSIEEMTGGTFTITNGGVFGSLLSTPIINPPQTAILGMHAINERPMAVDGEVVILPMMYLALSYDHRLIDGKEAVQFLVTIKELIEDPSMLLLDL

SEQ ID NO: 3332 - protein, 141 aa, M.catarrhalis
SLYSASDVADSSFGCTGAATDAGSMVVPLSASSFDSSPSFDGASPAGADAPASKIATTSADNTVSSTFLTILVITPLSGATISKTTLSVSTSAKSWSRLTASPSATCHSTIVPSCTDSGNTGALISAIINSFKFINQNMLF

SEQ ID NO: 3333 - protein, 147 aa, M.catarrhalis
PMTPAQAMITPLKPTQPTPKNLIHQSALMRAVYFVLGLVCLILGLIGIVVPGMPTTVFILLAGYFWARSSRRFYAWLLAHRLFGQMIINWQTHRAIPRFAKYLAWSMMSLSTIILFFKLPSSWQWVAWLLAAISLGVGIWMARLPNA

SEQ ID NO: 3334 - protein, 78 aa, M.catarrhalis
KSLPMQAWFCVYEILADEAVWMVSATAGVGWASNSKRPPMLWLKTAISWILILIAVQIIIRFVMDMGEVFNNSYLTIK

SEQ ID NO: 3335 - protein, 67 aa, M.catarrhalis
LVKLMHLGYYRTLPSNFKGQKHNFQTNRYAKKDNHHLKTLNIIQNPSDTVSTQLTVPILACLYGCIS

SEQ ID NO: 3336 - protein, 269 aa, M.catarrhalis
VNFTKNTNVMNDFFSQIKTHADPNFVDKTAVYLPPEHRFSTLSHALSEYHGVDILSLTQNNDLIAGVDRQQLNQAYEQLLINKPQPHACVLVAITDEIGPRLLLTRRASNLSSHAGEVSLVGGKRDKTDRSSYEVATREAFEEVGLLRQDSTLIGFLPMQISKKGLLVRPVVVSMTPAIADSLIASEDEIQRLFWADLTYLKTTPPIDYHFERPKLGRAYLHTPAWLIDDRQIGKPEVVWGLTGRIIANFLHIGYEVCYQWYYHLQAHR

SEQ ID NO: 3337 - protein, 173 aa, M.catarrhalis
TNETNEFAFMTTLPNLHQMQGSYFISGIDTNIGKTIATGHIACQLLKNGRTVITQKLIQTGNIKLSEDIVKHRQMMGVGMLPDDETHLTMPLILSYPASPHLASKMDGVSVDVSHLLACTKQLAEAYEIVLIERAGGLMVPMMDDVKGGLMIDYIASQNYPVILVSSGQAWQH

SEQ ID NO: 3338 - protein, 63 aa, M.catarrhalis
KSRTLGKFRINIGAMSSNSECEQFTKNNYSIPFGQMLVLFHQNSTDLVYDIQPYRHAKMGTVS

SEQ ID NO: 3339 - protein, 287 aa, M.catarrhalis
EQMTKSALSSNPNKIAQRFCRAHQSYRAHATVQAKMARRLIISLKMVKAKMVKACNTKNTGMQPYRVIQDEHISRLLEIGVGSGLLTDALFENFSVDTLYLNDLYDNIQTNALPKDIDANYLIGDIGMIDLPKTLDGVISSSALQWIYPPDVLFKRVFQTLTAGGFFAASTFVEGNLSEIQALTGRGLRYDTPKQLMVRLNQAGFMIDEFKVDEQVLYFDSPMAVLRHLKATGVTAVGTEQACWSKQSLAKFCQNYQQFHTDAGYTLTYRPLLFVAHKPMKPMSSPL

SEQ ID NO: 3340 - protein, 326 aa, M.catarrhalis
FGVAMQWSGLWLILALMVVILGVFFVIRSLRRNNLVLESEALGVKTKYGLPIIPRDERELPSRIESSNKKVEPEDALSSMAAAVVAAPVMSQTSQAQMVYEPLTENNKENQADTQAKIDENSQNQDSVRVNNPSGGLSHAQDWQAHDDENQDADYVVDMTFDKRSAVLDEHLDERRIFDQNNDPLLNATETVSIAIMPRNSFAGLPGCTVLEIVRTYGMKYGVMNLFHRYENEDGTGDLWFSMMGVGYEGVCAFDLNSLPESHFMGLTLFLALPHPHALRGFDSMVSVAHMIAQDLSADMLDEQGNLFDDTYFAKLRSVVAEHNAN

SEQ ID NO: 3341 - protein, 80 aa, M.catarrhalis
PAAAGAAAGYVASKVAGNRAATAQASQTAQTPTTTQQPAQNNQQATNSNRQSLAQATQDNRAGTTRQGFGATGGATGSAS

SEQ ID NO: 3342 - protein, 310 aa, M.catarrhalis
SMIYETTTMTKDFIHQTTTLSDCVGNTPLVKLNTLAKDSQATLLAKLEGNNPAGSVKDRPAFNMIYQAEQRGQIKPGDTLIEATSGNTGIALAMVAAMRGYQMTLLMPANSTQERKDAMTAYGATLIEVADGMEAARDMALQMQADGQGIVLDQFNNTDNKHAHYLTTGPELWQQTEGKITHFVSSMGTTGTIMGVSQYLKEQNPAIQIIGLQPDEQSSIAGIRRWPAEYLPGIFDASLVDTIMDVNQTNAERYMRKLAREEGIFCGVSSGGAAWAAHQIAKNTPDAVIAFIVCDRGDRYLSTGLFGVTD

SEQ ID NO: 3343 - protein, 533 aa, M.catarrhalis
SIDYILIKYNKTLISSFIVSKSIMLKNPSNDRQAFHMTQTHSLIQNPSKKGKPTARARKRLADTPPLEFHITNLAHDGRGVAVYETDNTTHNPDKAGKKVFISFALPGEAVLVKMTNSKKNFEEGDALQVVNHPHSQRQTPPCPHFGVCGGCSLQHWQADAQIDFKQSVLKELLIHQAGIEPDIWLKPLVGDRLGYRTKARMGVRYVAKKDSALVGFRERASNFLAELNECHILDKRIGFELENLKALITDLNARDSIPQLEIAMGQTLPHVPDSIKSVAVIVRHMQELDDEDLAKLRQFFAARNWQLFLQPKGADSVHRIDTEDARPTSLTVPPTGGLFYHLPNFELTYEFSPLDFTQVNLSVNQKMMDLASSLLNLQKGERVLDLFCGLGNFSLVLARQVGESGFVVGVEGSEQMTERAKMNACANGIAHTEFYAKDLTQDLSDQPWATGNNRFDALLIDPPRSGAWEVMAYLPKFNAKRIVYVSCNPVTLARDTKALIEAGYRLTHAGVMDMFSHTGHVESIARFERIDA

SEQ ID NO: 3344 - protein, 290 aa, M.catarrhalis
NKKYLKKYLNRSTMNPFTLIQNLIPQQALSEFAGNLAASQNPYVKKSLIHSFAKAYHINLDEYARSQFSDYSSFNDFFTRELKSDARPIDETPNQLICPADGTISQIGDIKQGMILQAKGRTYEIGQLLADYDDGQYFMNGSFATIYLAPSNYHRVHMPFDGQLTATRYVPGTLFSVNHTTAKHVPDLFARNERLICLFDTNFGRAAVVMVGAMIVAGIESVATGKINRTPHIQYRTHELTLSKGDELGRFYLGSTAIIILPKSAHNDWLAHITHGKKVMMGQAIGNMPV

SEQ ID NO: 3345 - protein, 444 aa, M.catarrhalis
KKAYKSSSQRQGRLIDHMREGRVDLSKLDMLILDEADRMLDMGFADDIKEILQNTPQTRQTVMSSATWDGAVGKIAESFTVNPEKVSIKVESAHIDESVYYCDDFNHKNNILLQVLNNPKIKQAVIFAATKMSTEKLAAQLVEAGFKARYLHGDLPQGKRNRIVSDMKSGKCDVLVATDVAARGIDISAISHVINYDLPRQVEDYVHRIGRCGRAGRTGVAVNLCSIDDNRQLEHINRYLKRQMSVSTIEGLEPRRNFGIQSQERRRGRSKSQNRTRQDGRQNFERTDHKFGSRNRHEHRHERSFEGKRERFEDRERSVNRRENDENHERRNSRFEARSDRRFDKNRQGYYQADGTARQDKKAYTRNFDRRDNDRNDTRFDKPTKKFGTQTDFDRPRRNKAFGDKVKPNTGFDKFGGKSRPKAVEEIFFAKRQDKKAKRRFGEF

SEQ ID NO: 3346 - protein, 284 aa, M.catarrhalis
LISQKRVTQIEIITRSNREPNRDWLMASLGYIHTARAKSKLRQWFNKQDRDKNIETGKALLLKEFDRLSISPNQISLSEYFTDLNVKHEDDLYVALVIGDITVTQISNLVAQKLNLTTQVPDKAKIEIKQPIRPNKYKIELEDLDNVEIHLARCCNPVHGEPIAGFITLSSGVSIHNDGCPEYLRLIEREPDRSVIAHWQESFGRYQPVVIHVEAKNTNGLLRDLVHVIDREKVNIHRAETVFNDGAISHMKFYVEVAGIAHLSRLLNKIEQQPSVLHARRATA

SEQ ID NO: 3347 - protein, 421 aa, M.catarrhalis
PTSHQQQSPKPRSSHPRQPSWHHSPRFWCDRRCDRFGLMKRITVAPRPDWQSEMARIGFNYHSIDGNYWQEDACYVFTESQIDLLEDATNTLHHMYVQAVAHVVKTGDYARLGIDDIAAKQIEDSFGRQAPSLYGRFDLCFDGINPPKLYEYNADTPTALFEASVAQWYWLQAQGGILRGADQFNSIHERLLVEFESLKPMLGHDTLYLTAASDSIEDLTTTQYLQDVAIQAGLQTDYIDIGNIGYCMSDGQFTDLNDNIIHHLFKLYPWEWLLAEEFGQHIASSNIHLIEPAYKLLMSNKALLTVLWEMFPNHPNLLAASLNPNDISTNVVKKPFFSREGANISLTHANQTLSTHGQYGQEGYVYQESKPLPKFSNNQGQDVFAVIGSWIIGHSAAGIGIREDSTLITKDTSLFVPHAFI

SEQ ID NO: 3348 - protein, 612 aa, M.catarrhalis
LSMQINKAFGIKSAYGQLILLVFLPIVVLAFLGSYLVMSEVRRAILSEQDTMANAALVRYDAIVRPLLTDLQHRQNRLDERVAQMNEDEILIAITPHDTNLPNRAMARHAQDIPFFNTNWFVQLQQSRNQHVLRVAIMDGIGQVLFSTGMQTDLSWGDVDLQAKEIYRIPTAVGTAYGKSFIFDNERYWLLVDMDNTPLTITSYRVALALTAIGLTTILLLLLILNIYSKRWITPLYEMRLYLQRLNTDNLSRVPQLKTSGEFALLRDDFTRAVRRLHASFTELKNHADETEHDLQQAFDEMEMQNISIRNARDAAISTSQAKSAFLANISHELRTPLNSIDGFINLLARKGELTGEQNLYVQTIKKSSAHLLALVNDVLDFSKIEAGKLILDSHDFDLYDAVYDVVDMLSPAALEKRLRLAVLFYDDVPTRIIGDSLRVKQILTNLVGNAIKFTDMGSVVVRVSLAEKTGYLCIEVEDTGKGISESDKEQLFQSFGQGDLSVTRRYGGTGLGLVISKQLTQLMGGSIGFIDNRSENIANAGATFWFEMPMGVDEGSIDDALPKLAELLHTPMQLLVWINHAPALRVLKSSLVGTKVQLTIAIGLADLLEKL

SEQ ID NO: 3349 - protein, 258 aa, M.catarrhalis
SIWQMGFVINTWISCTVLLFKLAFLSHNDYNIKNLKNSIMIRLYLGGSFDPIHRAHLQMVLSAYDTIHQKTTDTVTVHLLPTAGNPFKNAPTSHAHRIVMLKLAITPLIKKGMNISIDERELSLIPPIYTIDTIRQLKSTYPDDRLIFIIGGDSLANLHQWKAYDELIYQVKLWAFDRVDTTPADETVATKCTTNLDEFLANDHTIYLDHTPIMNISSSQIRTLIADGRTKLAAPLMDECVLAYICKEGLYQNLKNML

SEQ ID NO: 3350 - protein, 441 aa, M.catarrhalis
AMINEFDTAHLWHPYTSMTSPLPALPVACAKGCQIHLQDGTVLIDGMSSWWCAIHGYNHPVLNAAITEQLTKMSHIMFGGLTHEPAIKLGQLLLSIVPKPLQHIFYADSGSVAVEVALKMAVQYQHALGKTTKNNIMTTRSGYHGDTWNAMSVCDPITGMHQIFGDALPSRIFVDAPTIKIDDPWDDAAMDDIRLAFKRHHKNLAAFIIEPIVQGAGGMRFYHTNYLRQLRKLCDEYGVLLIFDEIATGFGRTGRLFACEHAKVVPDIMCLGKALTGGYMTLSAVLTTTKVAHTISHGKVGAFMHGPTFMANPLACAVALASVQLLLQSPWQYHVRRIARTCRMTLTHLKQLPHVADVRILGAIAVVEMTDPVDMAIIQQECVARGIWIRPFGRLVYLMPPFIISDDELATLLHEFTDLICTTLSPNFKKQSMNPIINEDE

SEQ ID NO: 3351 - protein, 208 aa, M.catarrhalis
KTSKGNFMSVNKVILVGNLGNDPEVRNFDNGGMIATVSIATSERWTDRNTGERKEHTEWHRVVFNNRLAEVASQYLRKGSQIYVEGSLRTRKWQDTQTGQERYTTEIRADNMQMLGNRASGDNGGYANSQGGYANPNQQYQNQGNQGGQYPNTAYQQANQFGGQNSSGYTQPQPNQAYPNSGYPQERASQPQSSSMAQNHAFGQPTHI

SEQ ID NO: 3352 - protein, 61 aa, M.catarrhalis
ELLNTSPISITNRMMICTAINIKIQEMAVFSHSMGGRFEFDAQPTPAVADTIQTASSASIS

SEQ ID NO: 3353 - protein, 400 aa, M.catarrhalis
MMNDQLLNFYAEQLSALKASHNHRQLQRLKHQGQRIGVNDSKPLLNLASNDYLGIASQTSLYEEFLELLHEQRWPFSASSSRLLTGNFENFERLETKMASLFGRPCLLFNSGYHANIGILPAICDDKTVILADKLVHASIIDGMQLAAKHGTKTIRYQHQNLPQLEGLIQKYQSDNGICRIIVVTESIFSMDGDITNLSHLSHLKAQYPKVMLYVDEAHAIGVRGGRGLGCVEEYGVINQVDFIVGAFGKALASVGGYCICHPILRDYLINKMRPLIFSTALPPINIAWSCFILEQIPLMNQRRKHLMKLSDDLSKVVHLAKLPCPSASQIIPIILGDNARTLNAAADLGRQGYHVLAVRPPTVPKGQSRLRICLNSTINDDTMTKFTQVLTQIVSSESK

SEQ ID NO: 3354 - protein, 532 aa, M.catarrhalis
YNLEIIETICFLDLQGFTVVQIRDSLPLLGGNSSSMDSATLAASLVAKQLHPDFKAQLANHKLISAVDHSSSTTNPCDINVSDIDIETWICHVAARIGKEDLPILRQACQFVQIHANKPHVTRSGAYITGIGMADILAYLFQNENALAAAMLYRTARRELVSIQTIRVNFGEDIAHLVMDALAMGRLSESIESNQRLEDYFESNQREQLSNIYSMLISTTNDVRAVLIKLAERTFAMRELSFAPPDRQKRVAREVMTIYAPLAHRLSIAQLKWELEDLAFRYLAPDEYKKIASLLAEKRSEREAYIQLVKSKLSEELERAGIQGEVSGRVKHIYSIWRKMKSKNLSFDQLYDIRALRVMVNTNAECYYTLGIVHGLWRHIPEQFDDYITNPKPNGYKSLHTAVIAEQRTLEVQIRTFDMHFEAELGKASHVNYKEGLKAKKDDYLTQKISSLRQLLGNEKADGEEDIELDIDNAERIYVFSRDGDITELPKGATVLDFAYYVHTEVGNRAQGARVNGRYVPLTHQPKTGDPN

SEQ ID NO: 3355 - protein, 211 aa, M.catarrhalis
YNFWVVFINQPVYYRPMPYCMQCGHTATYTIPKGDSRQRLVCSACGFIHYDNPKMICGALVRHENKILLCRRAIEPRYGYWTLPAGFMEIGETMMEGALRETIEEAAAIATDAKLYCLFDMPYLGQIHAMYLTNLSCDGRFGVGVESLECALIDEQDIPWQDLAFRTIHLTLEQYLADKAAIIAQGKNIDDFANYPIHQITLDEIVVDELQ

SEQ ID NO: 3356 - protein, 411 aa, M.catarrhalis
PCTSIAGTKEQFGWHKSSINDSHWSCRFIRKTLIKMRWVYDWVIVDNFGQDAAKDDVGAVLRQIRLRYDGKLASFGYQVGINEQLLLRYQTQALYEPMDKRQLYAMLLNQQNLSAIQSPRQAKFVGRRILAVDDHLPNLLVLDALLAELGVEVVTANSGFEAIERMTQSITGSTPPIDMIFMDVQMPRMSGLETSIEIRKIEQAHLSKPVPIIALTAHGLSDEKDQLVSSGLNDYVSKPIGEVQLVQTLQKWLGHDVAADKLNVLDMVESLPILDVPKNAGDAPEKLPVVHWGHALERSANKPKLAYRLLEMLIDGADSERQSLERAWADRDRVSLADISHRMVGAARYAGVPRLRAVSEIFESACRNDITAVTPSHFIALRPAYRALIDALDTLQAVELDKVAMDADLAD

SEQ ID NO: 3357 - protein, 78 aa, M.catarrhalis
ALARLGSINHTLLSLNALKTYGIYLYALAYNQADDGDDEMIATDTKQYLQEYLKAHHSDALWWEIPKLNSADFGLNSF

SEQ ID NO: 3358 - protein, 152 aa, M.catarrhalis
VRLGIYLQRRLIPKPQKYAIIKSYPSNYQSIMTTLNLDQTLALVTKTLDDLKAKNITTLEIEHLTEIAERIVICEATSKRHVKALADKLGAATKEAGLMPLGREGDKDSDWTLVDLGAVVVHIMTPQARAFYDLEGLWSSPDALKALVAQKD

SEQ ID NO: 3359 - protein, 261 aa, M.catarrhalis
LRLGMICTPILVFDIETIPDIQTGKRLYPELADLGDDDALTALIALRHAESGTEFMRLPLHKIACLSFLWFDGTTFHLKSLTLQTMSEKEILVNFLRAFDKKPVLVSWNGLAFDLPVLMHRSMHHQLSAPALFGSAQKFGYSYRYGEMHIDLMDKTALHNNKLHQKLDTVASLCGFAGKGNLDGSQVLPMVQNSQWDALSCYCESDVLNTWLIYLRWLTLTGKSSTDECQALIDKTNQFVQSLTNSAGKLRHQSFLDAWVR

SEQ ID NO: 3360 - protein, 990 aa, M.catarrhalis
NPCIYYKTHLPNALKYLENPHFLIKFFYKKGVFMAQDKIAIRGARTHNLKNIDVDIPRDKFVVITGLSGSGKSSLAFDTLYAEGQRRYVESLSAYARQFLSQMQKPEVDSIDGLSPAIAIEQKSTNHNPRSTVGTITEVYDYLRLLFARVGVPYCPEHDEPMVAQTVSEMVDGIMSLPTETKLMILAPVVRERKGEHIALLEQLPSQGFTRVRIDGVIYETDELPSLEKNKKHSIEVVVDRFKVRDDLGNRVAESLEVALKLGNDIAILYHMDGNPVGDDEQILSAKHSCPVCDRAVSELEPRLFSFNNPAGACPACDGLGKRQYFAAERIVTHPEKSLNQGAIHGWDKRHAYYFGLLSTVCRHFGIDMDMPWQDLSNKHQAIILNGSGRQKIEFNFTDERGRKTTKNTPFEGILPYLERRYTTTTSNLVRDELAQYLSDTQCNVCHGVRLNDIARHVRVEDKAIGDIIHLPIGEAWQYYQNLKITGAKGEVADKIFKEIKERLGFLTKVGLEYLTLARSAETLSGGEAQRIRLASQIGAGLMGVMYVLDEPSIGLHQRDNDRLLSTLIQLRDLGNTVVVVEHDEDAIRQADYIIDIGVGAGVHGGRVVASGSAEQVANTTGSLTGEYLSGKRRIEVPTTRQLPKTIEIIKGKKTIQEPLWIHLEGATGNNLKNVHLSIPIGVMTCITGVSGSGKSTLINRTLMPLAATTLNNATTLAPEKYEKISGLEHLDKMVDIDQSPIGRTPRSNPATYTGVFTLIRDLFTQTPEARARGYKAGRFSFNVKGGRCEVCQGDGLIKVEMHFLPDMYVPCDVCHGKRYNRETLEVKYKGKSISDVLDMTVEEAMGFFEPIPAIHRRLEALHEVGLDYIRLGQSATTLSGGEAQRVKLAKELAKRDTGKTLYILDEPTTGLHFHDIAKLLHILHTLRDRGNTVVVIEHNLDVIKTADWIVDLGPEGGSGGGEIVATGTPETVAKNSRSHTGRFLKPMLK

SEQ ID NO: 3361 - protein, 69 aa, M.catarrhalis
PRGIVMQANLHQVDRIIRIVIGIALIVLPLFAVIGWWGYVVGAILLATGLINFCPIYRLLGINTCKYKR

SEQ ID NO: 3362 - protein, 305 aa, M.catarrhalis
PIIMPELPEVETTKLSLEPLIGQTVTCVQVRHPRLRYDIAKDLDSLVGFVLTKLQRRAKYLLLDFYHAHDSRQKTLLIHLGMSGSLQQHINEPPRKHDHVLIDFADSHGKIITLHYHDPRRFGMILWVVNDDYIDQPNTYARFLAHLGPEPLSEDFDANYLIRYIMRPKSHQKPLNKPIKSLIMDQSVVVGVGNIYAAESLFLSGIHPLTPAYLVHEDKLVRLTHHIKQILARAITQGGSTLRDFTVGSGKTGYFQQTLLVYGRQGESCATCGSLLENIKISGRASVYCPNCQPYHDHNNPSSQN

SEQ ID NO: 3363 - protein, 154 aa, M.catarrhalis
KRQIMKALIQRVHQARVEVCGEVVGEIDGGILAYIGIGKSDDVKQAKRLVDKILSYRIFENTTDADKLGKMDKSVADVGGGLLLVSQFTLMALTDKGRRPDFGPAMPPNQAAQLFDELVCYAKQYHTPVATGQFGAHMQVIAHNDGPINFILEV

SEQ ID NO: 3364 - protein, 169 aa, M.catarrhalis
INTFALAHQRGISVEIIMTESTTQTTDSTTENFVPQFSDLGLNKPILKALTKSGYTTPTPIQAKAIPHALNGRDLLLSAQTGSGKTAAFVLPVLDKMSRKPTIEKHVQALILTPTRELALQVQDSVRRYGDGMRNMFSVPLVGGAPYGGQLRALKKGVQVIIATPGPLD

SEQ ID NO: 3365 - protein, 177 aa, M.catarrhalis
QVVAMSLANQRREDANSKIIGRLKLDASFSPFIIVAYEVENARGEQRTDLDKLIIELETNGTIDPEEAIRKAATILQQQIAIFVDLEAEEAPEPIKEKEEIDPVLLRPVDDLELTVRSAKCLKAENIYYIGDLVQRSETELLKTPNLGKKSLTEIKDVLASKNLELGMRLENWPPSE

SEQ ID NO: 3366 - protein, 239 aa, M.catarrhalis
RQQASTIQHAKYIQTLWQQFHQRPIAKLQIILEKISPPPWQNFYHRWQLIQNNTKDEAQDEQILTDWLIHLFDLLFNHMYFDQIPTVLVRGESEPEYFPSEHNAPARIEFAHGFFQSALHEISHWCIAGQARRKLNDFGYWYESDGRNEQTQRLFEQVEIKPQAIEALLTLACGRYFYVSQDNLNANFDISNSTFAQDVFNQAKFYLSNPSTLPTDAQLLLWVILTLSHSNYYTTIKMR

SEQ ID NO: 3367 - protein, 165 aa, M.catarrhalis
SELNRGDTMTNATEFLTPSAINVDTVNETTAKVTLEPLERGFGHTLGNALRRILLSSLSGAAVVEAEIEGVDHEYSTLEGLQEDVLDLLLNLKSLAIILHDQNEAYLTLDKRGAGVVTAADLELPHNVEIANPDLVLGTLSERGHLKMRLHVVTGRGYEPGQSAS

SEQ ID NO: 3368 - protein, 83 aa, M.catarrhalis
LCPKAKELRRVAEPLITLAKEDSVANRRLAFSRMRNKDMVGKLFSELGPRYQTRPGGYLRIIKCGFRDGDNAPMAYVELVDRP

SEQ ID NO: 3369 - protein, 217 aa, M.catarrhalis
GDRLMARYIGPKLKLSRREGTDLQLKSGVKPYDVKTKKAGRVPGQHGNSQNKTSEYASQLREKQKVKRMYGVLERQFSNYYKEAARERGATGENLLVTLERRLDNVVYRMGFGATRAEARQLVSHRAIMLKKAGRDEFVRVNIPSIQVQDGDVIAVHEKSKDQLRIKNAVELATQRGIPAWLEVDHSKLQGAFKSAPERSELPAEINENLIVELYSK

SEQ ID NO: 3370 - protein, 191 aa, M.catarrhalis
GKQMQKFYIHPDNPQKRVLIQAANLLKNDQLIIYPDPSGYRLAVSLDAKQSLAQALRFGQYEPKFCLMCRHISEISTFAKISDFAHRNLKNTLNKNTHFLLNPTKSAPKKFVNSSDKNICASLAHTPIVLSLIEALNAPFISMPIYLNGEKVTYDSTYELEAMMENLVDGFLDAGELQDQPSPVVSLIDAS

SEQ ID NO: 3371 - protein, 94 aa, M.catarrhalis
ISHVLEHSLSMASGATQLDSAFFDVAWSSILLISGSDKKNDSSSRYSLGGQFSKRIPSSRFLDASTSLISVNDFLPRFGVFNSSVSERCTKSPM

SEQ ID NO: 3372 - protein, 62 aa, M.catarrhalis
SFGSLPDCPFEQAVINEANTATKATPTSGRKQNIFIIIPYIDNQAHDAPAISPMRLTPMSKN

SEQ ID NO: 3373 - protein, 72 aa, M.catarrhalis
LGSPPPSLIRGTVNQMGHPPNQIYRLYDNTTTQLDAIANGYQTDYQVGKWRYPPSWTVVMFSRNKFYCIASL

SEQ ID NO: 3374 - protein, 373 aa, M.catarrhalis
IIKLLILKNKLIERFMTAQFAPLKNDRLLRALKFLPVDTTPVWMMRQAGRYLPEYKQVRAQAGDFLSLCKDIDKATEVTLQPLRRFELDAAILFSDILTIPDAFDLGLYFAEGEGPKLTKTVRTESQIMALPKIDMTSSLDYVMKAVTSIRKALNGQVPLFGFSGSPWTLATYMVEGGSSREFRHTKHMMYATPELLHALLAKITDAVVDYLDAQIVAGAQIVQIFDSWGGVLGHRQFTEFSHAYNRKIVARLKAIHPDVPVILFTKGGGLWLDVQADSQADALGLDWTMPLDKARHLLHALNAKKAIQGNLDPATIFGSPKMIQMEVHRMLDDAYVLDKSGYVANFGHGITQWSNPDHAKAFIDAVHDYQIS

SEQ ID NO: 3375 - protein, 591 aa, M.catarrhalis
RQVTEELIDQTITIAGWVHRRRDHGGVIFLDMRDREGLLQVVIDPDTPEAFATADAARSEYLLKITGRVRRRYEGTENPNMVSGQVELLGKEIELLAKSDTPPFPLNDDNITVSEELRLKYRFLDMRRPEMQERMKFRAKATSTIRRYLDDHGFLDVETPVLTRATPEGARDYLVPSRTRQGNFFALPQSPQLFKQLLMVAGFDRYYQIAKCFRDEDLRADRQPEFTQVDIETSFLSDEEIMDITEGLTKNLFKTMLDVEFDTFPRMTYADAMRDYASDKPDLRIPLKLIDVADIMQHVEFKVFSGPAQDPKGRVVALRIPNGGNMSRKQIDEYTKFVGIYGARGLAYIKVNDASNINNGVEKESGLQSPIIKNMTDEVLIELIERTDAQTGDIIFFGADKAKIVNDAMGALRVKIGTDLNLFTCEWAPLWVVDFPMFEETDDGKWTSVHHPFTRPKGSVEELKQSPETALSIAYDMVLNGTEIGGGSLRINTVDMQEAVFDALGISKEEAELKFKFLMDALRFGAPPHGGLAFGLDRLIMLMVGASSIRDVIAFPKTKTADCPLTEAPAEVDNRQLRELGIRIREKQKAE

SEQ ID NO: 3376 - protein, 207 aa, M.catarrhalis
PITAQGIRDEITCYPIPELNLPSDIPERGWKKLTTFKPDLYGLKGTALFLDIDIVIIDNIDAFFTHKAQHDDSVMIIRDWKKPWRMVGNSSVYRFNVGYHTYPHLLEYFEQNFEKIRKEVRHEQAFLSNYLREHHHLEYWDSSWCVSFKYHCLQKIPMAYFVPPKKPINAKIVIFHGEINPPDAIAGGGGKWYRHVLPSKWIKDAWQ

SEQ ID NO: 3377 - protein, 125 aa, M.catarrhalis
SNEATKKVMALKKQAIDTNSKQILGFVCGKTDTNTFKRLYQQLNTHNIQLFFSDYWKSYRQVILKPKHITSKAQTFTIEGYNSLIRHFIARFTRKSKCYSKSEKMIENTLNLLFAKRNGSLRYVF

SEQ ID NO: 3378 - protein, 442 aa, M.catarrhalis
RPHLSSRKTQEIQAVELLVALNTLASRQVSVTFLGERMTLDVVALIALHDKYGVALADTLAFAKALVDHGLENTSLDIVQAIKAQKSANEFDSGSQIKATDVVLYGFGRIGRILARLLMSRPAAESGLQLKAIVVRPAGEGDLAKRASLLERDSVHGWFNGSVQVDTTNNGIIVNGRFIKVIYASDPSEVDYTAHDINDAIVIDNTGKWKDEAGLGKHLASKGVKKVLLTAPAKGEIKNIVYGVNHDTIGSDTIVSAASCTTNAITPTLKVLHDEYGIVHGHMETIHAFTNDQNLVDNHHKADRRGRAAPLNMVMTSTGAASAVSKAIPELKGKLSGNAIRVPTPNVSLAILNLNFEKSVGDTKAINAFIQSKAQSEQWQAQIDYSDSPEAVSTDFVGSEKVAIFDAKATIATDNRATLYVWYDNEMGYSTQVIRVAEEMAK

SEQ ID NO: 3379 - protein, 60 aa, M.catarrhalis
TLGYPDESPLWRINPAQNFGFRHALANIGIGGFEAHTVPGFLFQGQAPKYQWHYWSNAYS

SEQ ID NO: 3380 - protein, 252 aa, M.catarrhalis
LNNLSLMHPKLEFKNISHAFTTNAKTPLFDGLNLKVAQGSVVSIVGASGVGKSTLFNIAAGLIYPSHGQVMIDGKNVTGTSGYVGYMLQKDLLLPYKTVYDNIALPLMLSHKTKQEIAAQIQPNLTIFGLDGLTKKYPNQLSGGQRQRVALLRTYLSNRELMLLDEPFSALDFVTKADMHEWFGQFRQANQLTCLIITHDIDEAIYLSDEVYVLKGMPAMFTHHFWVPKQRDFYQSTEYLTLKQQILTAIRY

SEQ ID NO: 3381 - protein, 348 aa, M.catarrhalis
  UNSURE (312): Identity of amino acid sequences at the above locations are unknown.
AFFKDNHMTRFANFCAGPASMPTAVLERAQAEMLDWQGLGTSVMEISHRSTDYIEMAQKAEANLRKLMGISDEYAVLFLQGGATLQFSAIPLNLMNGGVADYLETGTWSNKAYKEAKRYEALGLGQVNLVAAGSQTQFSDIPDPSTWQLTKGASYFHYCPNETIHGVQMFDVPKVDTPIVADMSSCILSEPISVDKFGLIYAGAQKNIGPAGLTLVIIRKDLLEQASEYCPMVMNYKNQHTNDSMLNTPSTYAWYLSGLVFEWLLEQGGVEAIAKVNHAKAKTLYAAIDGSDFYHNTVNPNHRSIMNVPFHXADDSLDKRFFGRNPKKQVLLNLKGHRAVRWYACQHL

SEQ ID NO: 3382 - protein, 65 aa, M.catarrhalis
DWSKLVRCRWIIWWCWWQLPLEIKPKFNCCVKKYGLYKQTIFLSKKIILTFIKYYKPKLSNNKRC

SEQ ID NO: 3383 - protein, 255 aa, M.catarrhalis
FGDKLMKNFNQYFITTLISSMLVACSAPIPTNPQVSPIKTPSVLITKDKIGDHHTHEHDESVSHVGLQAHFETWLQMHHATKQEVVRYQAYLQSRLGNYLPPMSQLLTTARSWQACGHEPYQLPPEHLWGQIVPTLHLYQDLKSRGILPTNTQIRSVYRNPELNQCAGGAAMSKHLTNSAIDIWVPDLEIKSQALYELQNRLCQYWLEHGENQNFGLGLYATGAIHLDTQGFRKWGTQFSETNSICRHVLPKNKL

SEQ ID NO: 3384 - protein, 409 aa, M.catarrhalis
NLSKIMRFIDEAVISVKAGDGGNGIVSFRREKFVPKGGPDGGDGGKGGDVYAIADDNTNTLVDYRYTRKFEAHRGENGGSKNRSGKGADDIYLAVPIGTTIIDTDLDVVIGDLTEKGQKILIAKGGDGGFGNTRFKSSTNQAPRKATPGFAGETRNIKLELKVVADVGLIGLPNAGKSTFIRQVSAARPKVADYPFTTLVPNLGVVDVGSHQSFVMADIPGLIEGASDGAGLGIRFLKHVARTRRLLHIVDVQPIDESDPVANAQIILNELNKFSQELSQLPQILVLNKIDQIPNEQRDAVCQDIITRLGWTGEVFYTSTLTGEGVEAVKHHLMQVIEDERERELEDPMFAEAQAARFARLEEEVRHNTEIQKEAYRAMRKAQREGGDGDDDDNWNDDDYDVAVEYAPY

SEQ ID NO: 3385 - protein, 174 aa, M.catarrhalis
YIVKITNFIAILWIIHMSHVAKQTDLDTTDQKILRILTDDARLSIAEISEQIHLSPTPTIRRIKRLEDIGVITGYHAATNPTALGYALSVYVAVSMDKHTAERFYEFESQIQNFDEVVSCSVVTGRSEDYLLKVLVKDMRHYEEFLLHRLSKIEGVSQLHTSFVLREVFHRSAI

SEQ ID NO: 3386 - protein, 443 aa, M.catarrhalis
DSKKHNFKVCMQTNIRFHHQSGISVLLIVSWLLLAVFALIIGYLVMNPSIITKEQLEQPSAISVSNEGEWQPIIADDSTKIHPDTPAPIASYYEAVNRAAQSVVNIYTTQNAHHQLYSNDPVLQQFLERYYGGAPHQGVNLGSGVVVSSEGYIVTNAHVINGADEITVALNDGRKARATVIGSDADSDLAVIKVELDNLVPMAFRAEPIRVGDVSLAIGNPFGVGQTVTQGIISATGRTGIGVSSFEDFIQTDAAINPGNSGGALVDANGALIGINTAIYSRSGGSMGIGFAIPNQIVQQVMTSLITTGKVSRGWMGIEMVRMTDDPTNIESRSNVIIRRVWQNSPAEHAGLKSGDKIVRIDGVHITSINELVGVVARKAPDSQLTVEIMRDQRPMTVQVILAERPSSETLSQPVQNSLSQSRQSTQLEQLLQELEFLHGTPQ

SEQ ID NO: 3387 - protein, 304 aa, M.catarrhalis
NLSDFMPTIQATKSHPMINLADEMPSILFDTHPSRLNYAQQQRITRLCIRCALLLMQYGAESVVVVDLTKRLGAALGIDGVECGLSFNAVTLTTLYQGRCITTVRNTVHQGINVSILVQIQQIILSAENHQANQSHCLNTQSHDACISSVEQGFDAIYQTVYSNHLVSFFVGVSCASFAYLNGATLVIALITFIASFVAMRLRMYLLKQHFNPFVVAMITAFTATLLAALAYFLNLGTNADIAVAASVLLLVPSFPIINALSDILKGYMNMGVGRWMFATMLTLSACVGIVMTLIFLRIPHWGL

SEQ ID NO: 3388 - protein, 264 aa, M.catarrhalis
EMSDCRIQAVLAFEDNYIWLIENQMTTIIIDPGSSQEVLAYLQKNQLTPSAILVTHHHDDHTGGVRDLLIQYKNCALYAHANHGFDDIPKVNLVDEGDHFAVGDICFQVWRTAGHTDSHLSYVTEIDQKTRVFCGDTLFSAGCGRVFTGTISQLFASMKRFNDMDEQTVFYPAHEYTVSNLKFAKSVALDEHQDAIKHATHIAITQRQNNQMTLPVSLAHERQINVFLHACDDNKAKQLANQHGLNDNSALAVFRWLREQKNHF

SEQ ID NO: 3389 - protein, 72 aa, M.catarrhalis
FKLLTINLLIIKALEIFMKQSEQTTFNMRVDKHLVEQFKQAARDNNRTASQLLRDCMIDYVKKNRQADMFKR

SEQ ID NO: 3390 - protein, 250 aa, M.catarrhalis
AVYRMLPTRLIQNRHILTKLGITIWASKYADVTTLPSAHQPPPQKGVPKALAQQIPTQQNPNAQTQLASTPVTHRPKQVIDTPPKTQQTKTSHLTLPPHHEVLEINQSSFAAKSIEYHLKVMIYRNWIMMADVDALDAAGHELWLSLHRSLTRQAKQQQLTLVSRQFDYPLFEDDLTGDSVFLANISLRGFIFGCMRESGQIKYLAPLTALPDYLDLQSIQNLTLISDYHIDQMLLDGTTKKAFWQALHR

SEQ ID NO: 3391 - protein, 507 aa, M.catarrhalis
IINSNNKEDIVSDSNLVTDDNHSLNKSYRELHRPSSSFEKREDYLKHELQIMQPHRWRINLPFRDYRFELEDTIPAMAGTIGKIVMVGAMAAAFAAPLGLGEAFVLENVRYEMIIAAFFVLIFSSFILPTSNLPGTHGPLLPLIPIVVAAGGHPLAFGVLIGVFGLILALVKGGSLMTRLTSNGVAGGLLLYLGFVGLIGQVKKLITWADAIGLPHIAFIIILSTIIMYALLEHWQKRWLAVPIGCMLAGFLAFILGAPFEFKTEPGLPPLSPMYWWGESTGWTLGLPDLKAFIVVFPFAVLAVAMWTPDFLGHQVFQKISYPKHSERTHMSIDDTTITCSLRQMVGSVLGGANFTSSWGTYIVPASIAKRPIPAGAALTAIFCIVVAVWGYPMDLAVWQPVLSTALIVAVYVPLLEAGMEMTRKGKTTQSASIVVFSSALVNPVFGWSLTMMLDNLGLIGDKERSRQLGLSGRVIIPVIGFVVLCLAMASVGMFPGVPALIPQFRV

SEQ ID NO: 3392 - protein, 356 aa, M.catarrhalis
SVLGFLRYVPLSVLHGLAACASYISYHCRLSIYRSIQANLILVHPKMPDAQRQKLAKQILKNQLISAVDSLKTWAMPPKWSIAQIKTVHHEDILIKALANPSGMLAIVPHIGTWEMMNAWLNTFGSPTIMYKPIKNAAVDRFVLQGRERLNASLVPTDASGVKAIFKTLKAGGFSIILPDHVPDPSGGEIAPFFGIKTLTSTLASKLAAKTGCALVGLSCIRREDGDGFEIFCYELNDEQLYSKNTKIATTALNGAMEQMIYPHFLHYMWSYRRFKHTPLLNNPYLLNENELKKIAIKLQSHVKRIVMSDTNYIICKKWGTKYGAEYVNRLYNMGKRNLTLPFTMVCLTDNSTGHS

SEQ ID NO: 3393 - protein, 221 aa, M.catarrhalis
FVPICTFLCTYFGQYVEIFSIIVRVCNTKGVTMKTVSKSLLGLASITLTASLSMNAQAGNSPANIDNVLQQLTTQHNNASSLVKSARQPASLALNSPMIAQSTKSKKTDEDIPVLDRLTAVASSTVNKFKQNGIASWYGRQFHGRKTASGETFDMNALTAAHNSLPMNCHVRVTNRDNGKSVVVKINDRPKTNRVLDLSYGAAQAIGMTGNVGNVTIERID

SEQ ID NO: 3394 - protein, 82 aa, M.catarrhalis
MMRMSLINQVMLLTLVMALHSGQILTMLRHLLMQCMIIRFHNKLDRPLSDILRGFINSDICSKLVTQSSIKCIAIKSSDTKR

SEQ ID NO: 3395 - protein, 176 aa, M.catarrhalis
GIIMPKISLIVPTLAHQSQILSLAKAFEDNGLVLHGMSLSLFDSYEDWLNFSRAPAGTPAPNHAFVKVADDTFFGVDELGLVLGVINVRYQLNEFLKVQGGHIGYSTHPNYWGQGIASQMLKLALTHCQQNGLNQVLITCDDSNLASAKVIENHGGILENKLNTNGKTIRRYWIHI

SEQ ID NO: 3396 - protein, 85 aa, M.catarrhalis
GYAMNSHIIPTYVRQPISFVRGEGSYLYTKDGTAYLALIGRKRRRLCCVKPLAWCKYFFANSGAKANECVLKLAISSASLNLEFK

SEQ ID NO: 3397 - protein, 63 aa, M.catarrhalis
MNQITHPCPLCQAVTTWSDNPNRPFCSKRCKLIDLGAWASDEYLIAGDELAIALNIMKLQTIN

SEQ ID NO: 3398 - protein, 589 aa, M.catarrhalis
TIKIVTIQYLKVNELFGAFMPHITPKNPAFDFNKYQPFAFAPKLENRTWPDKTITKAPIWASVDLRDGNQALIDPMTIEQKLKFFKLLVEIGFKEIEIGFPSAAQVEFDFTRRLIEEGLVPDDVTLQVLVQAREHLIDRTFEALKGARRAIVHVYNSTSKVQRDKVYQMDKAQIKQIAIDGATMLRDKAKHYPDTQWVFEYSPESFSQTETDYAVEVCDAVCEIWRPDTGQAVILNLPATVEASTPNIYADQVEYFCRHLKARPHVTISLHTHNDRGCAVAASELGLMAGADRIEGTLLGNGERTGNMDILVMAMNLYTQGIDPELDFSQVSDIVQIVSECNNLPVHPRHPYVGELVFTAFSGSHQDAIKKSLDYNEKHPETQQHWDVAYLPIDPIHIGRGYQDVVRINSQSGKGGAAYILQRHFGFNLPRWTQIDFARVVQAYAESMARELKTDELLEIFTQAYLKQDKFRLSDYTISNKGDAVSFQGQVATPKAVFEVIGQGNGALSAFIDGLVKSTGRQIHVTNYAEHAIDSKTHQKTDTDNQTDAAAAAYIQLSVEGQIYSGIATCHSTVSAMLKGALSALAQAW

SEQ ID NO: 3399 - protein, 243 aa, M.catarrhalis
EKLMEFKQAVEYRRAVRDYDSNRPLDPTLVIDCLKLAQLSPSSSNMQLYEFYHITNPDMLKKLTKACLSQQAAASASQMVVFVTRQDLYRQRAKSALLFERHNIKTYSPPKRQGARIQRMQKYYGVLMPTIYRTTFGVPSLRSAAFLAIQKFKPTYDRVSVADVRIMVHKSCALAAQTFMLAMSAAGADTCPMEGFDSKLVKNLLNLPKEAEVNMIISCGYRTEKGVWGERFRVPFDEVYRQI

SEQ ID NO: 3400 - protein, 330 aa, M.catarrhalis
GIMMKIFCFRPLVGVALVAVLASLMTACSNGQSGNEPKLQELIIALDWVPNTNHTGLYVALDQGYFKEAGFDAKIVQPSEDSTSTLVANKRADFGVYFQPNMVKRLNKGEPITAVAAITQHSSAGLLSLAKLGADKPQDLQGKRYSTWEDPVDDAVVEQIVGTPLKKIPGESTDATTALRMNQFDYIMAYYSWDGIHADIKGVDTNFFYLKDADPIFDYYAPLLIANNDELKNHPEKYKKALAAIKQGYLYAAHHPNESAEILVKYAPEINVELAKQSQAYISPQYLDEQGDWGRFDYDRWDRFFNWVYRKGLMNEFTPKSGVTNDYLTQ

SEQ ID NO: 3401 - protein, 878 aa, M.catarrhalis
ETKMNKIYKVKKNAAGHLVACSEFAKGHTKKAVLGSLLIVGILGMATTASAQSKKGQGAYIAADQNGNKAPGEYSFVGGGSGNEAKGNYSTASGGDYNTAEGNYSTASGGSGNEAKGNYSTASGGITNEAKGDYSTVAGGANNKAIGKHSTVGGGNGNKAEGIDSTVAGGKNNQATGEGSFAAGIDNKANAKNAVAVGKKNIIKDENSVAIGSNNTVEQGQKNVFILGSGTTGVTSNSVLLGNETAGKQATTVKNAEVDGLNLTGFAGVSNAGNGTVSVGSQGKERQIVNVGAGDISATSTDAVNGSQLYALAKVVADNYNDILNNLDDIYNLDDGIKDLDDEVGLLGEEINSLEGEIFNNQDAIAKNQADIKTLESNVEEGLLDLSGRLLDQKADIDNNINNIYELAQQQDQHSSDIKTLKNNVEEGLLDLSGRLIDQKADLTKDIKTLENNVEEGLLDLSGRLIDQKADLTKDIKTLENNVEEGLLDLSGRLIDQKADIAKNQADIAQNQTDIQDLAAYNELQDAYAKQQTDAIDALNKASSANTDRIATAELGIAENKKDAQIAKAQANENKDGIAKNQADIQLHDKKITNLGILHSMVARAVGNNTQGVATNKADIAKNQADIANNIKNIYELAQQQDQHSSDIKTLAKVSAANTDRIAKNKAEADASFETLTKNQNTLIEQGEALVEQNKAINQELEGFAAHADVQDKQILQNQADITTNKTAIEQNINRTVANGFEIEKNKAGIATNKQELILQNDRLNRINETNNRQDQKIDQLGYALKEQGQHFNNRISAVERQTAGGIANAIAIATLPSPSRAGEHHVLFGSGYHNGQAAVSLGAAGLSDTGKSTYKIGLSWSDAGGLSGGVGGSYRWK

SEQ ID NO: 3402 - protein, 261 aa, M.catarrhalis
NSLLSDFYSRFMHHLITLIRQYSLVLIILVIWQFVVAVGILPDYLLPSPWQILHALIDDAKLLAHHAKYTLATAFIGTVIGLALSFVLSILMDLSRNFRQSVYPLILLNQTIPTIAIAPLLVIWLGYGILPKVVLVVLSVFFPMTIALLDGYRSVSTDELNLFYSMKANIYQTYRHLKIPSAMGYFFTGLKVALSYALISAVVAEWLGGYYGLGVYMTRVRKSYELDNMFAVIFLISFLTLALIALVKWLERHVLDYQYKE

SEQ ID NO: 3403 - protein, 160 aa, M.catarrhalis
NSTLGAMMGIIEIIQTIVLSCIITVGWCLMFTLPKQYIMHCMMVTALGFGLKQVMVIFGVHLVVATFFGAMAGSFLGVHFAQRHGLPPKALIVPSLICMMPGIAAYKAMVSMVQIGYFGFDMDLFIVMMRHFFEAIFIISALVLGLSIPGILFDRRKPIV

SEQ ID NO: 3404 - protein, 61 aa, M.catarrhalis
AKKLISVSLGVIPDTRSVRVSNKLCIGIHHDIDVLTIIVVQDTCQGCSRASGTKYEHHVWF

SEQ ID NO: 3405 - protein, 297 aa, M.catarrhalis
TLKSLYSKSISSGFLSTQTPDKLKIKGYFMLTYKAPLRDIKFLINEMLDYQAHYKTLDNGAAADPESVDMILEGFADFAENILAPLYQPADAEGCTFKDGEVTTPTGFKEAYQQFVEGGWQAISYPEKFGGMNLPMSLNLIKSEMMGTANWPWAMYPGLTTGSINTILQYGDDEQKSVYLPKLISGEWSGTMCLTEAQCGTDLNQMKTRAVPNADGSYAITGSKIFISAGEHDLTENIVHIVLARLPDAPAGTKGISLFIVPKFLPNADGEADKRNAVACGSIEHKMSSLWCTTARQ

SEQ ID NO: 3406 - protein, 251 aa, M.catarrhalis
  UNSURE (246),(248),(249),(250): Identity of amino acid sequences at the above locations are unknown.
MAMAKFYQYFNRTLVASDDRMDDRAFAFGDGFFSTIGVRQGQILFAQLHHIRITHGLTIFKLNLDVDEMMTCLSKLAHQMTEGIIKIIITRPRQSMRGYGFLSVQPAQVLIKVMPLAIYQGVSFIKGVPIQPTIPRQMVCLTHKLSHRPPHLAGIKLIGATEQIFAHAELLYHQSMDDGILDGLVGNVHGEWICATMGNVFYRLGQNWYTPLVDKSGVLGVMRCAVIQSGLVFTTGLEGSDGGARXSXXXH

SEQ ID NO: 3407 - protein, 188 aa, M.catarrhalis
NFIDGNIMTSDQSTNNANIFFKKIRKTWLIWAIILAVFVILFLTFRPMTKDDALVKDDGEVKVYQPVVYDTATWQKATKTSNEIESLKAQLGSTATTEEALDFYGRRATRYRFSTPYEPPFYLIESENFLEVVWYYAASIDDEATKAQSLDFAKRAYRMMSMLTKIQAHMSCIKYFKVSLWDLSVLVC

SEQ ID NO: 3408 - protein, 64 aa, M.catarrhalis
GNQSTVFRFCQACLSYDEHADKNTGTHVVHQILQGIAMGSQRVGMLNLEQADCQDYRCQIILHK

SEQ ID NO: 3409 - protein, 275 aa, M.catarrhalis
PLTVLVDQKIQMMQHFIVIGNPIDHSKSPQIHTAFARSVGLPVSYQKQYCPNDADSFTAVVSAFFAGGGVGANITLPFKEMAFEMIKSNGRLSTHALAAGAVNTILQDQQGLYGDNTDGRGLVADLYAQAIELDNKKIALIGAGGAARGVILPLLEAGAHISIFNRTFLKATNLVNEFQSDKLSAHSLDELKTGGKFDVIINATSATTIGQILDLGDCSANFAYDMMYGKPSEFLTHFKQQGADISDGFGMLIQQAKLSFEQWTGKTIDLSQVQF

SEQ ID NO: 3410 - protein, 162 aa, M.catarrhalis
NIVPPVPSSPVVKTDDMDQVLGLEMGADDYVAKPVQPRVLLARIRALLRRSDTVPSDTSPQRLEFGDLVIDNGGRSVTLNDELVDFTSAEYDLLWLLASNAGRILSREDIFERLRGIEYDGQDRSIDVRISRIRPKIGDDSENPKRIKTVRSKGYLFVKEGN

SEQ ID NO: 3411 - protein, 179 aa, M.catarrhalis
VFFAVISILPEMFSAIKDYGIVGRAVKNGQVNIQVINPRNFTTDNYKRIDERPFGGGPGMVMMAEPLEKAILYAKELAGRAGCDIQNGRCPVVYLSPQGKTLSEPLVATMPNLDGMILLCGRYEGIDERLITCYVDQEISIGDYVLTGGELPAMVLMDSVIRRLHHGAGRSSEWCERVI

SEQ ID NO: 3412 - protein, 191 aa, M.catarrhalis
VLINLYMTKPNLCKTNLVPDASEMIKIATLKKPYGIKGWLWVFSQTDERASIFQMQPWWMKTATGFKPLTVKDWRIQGQGLVACFNEVPDRNVAETMNGTSIWVCKDHLPKLADDEYYWSDLIGLTVMNEQAENLGVIKEMFETGAHEIISLKPTAQSIDNEPRLIPWHSDVVLSVDLSAGTMLVAWQSDY

SEQ ID NO: 3413 - protein, 502 aa, M.catarrhalis
IFIKICLKSSVQAVLKYAWANHRQLVMNKNTNKKFRIFLAKLNYKLYSNTLQTLLMVCFIVFVSVALSISLFWRSLYLPELRNHASYLSTEIKLLTSVGDKWHDNPEFMQWLTDNTHIEIITNPQDFPSITDKPVVVYLTQIMAEEISQSLGREVEVYFKFKPTPKLWIHDSAHPDIWIREPMMYYSQYSTGVIYGFLFGLPLLTIMTILVLVRGLNRPLKKLERAANNYILHGHATTLPTQTGPNEIRKANTAFNRLFTTLNQAQKERTIMLAGISHDLRTPLTRMRLTAEMLPDEFFREGLVYDIEDMDAILEQFISFMKDGSDEPVKPTNLDAIFKEILVQFDGIQFIYNSTITQPVPVRTLSIKRLIVNLVNNAIRYGEQPIHLIAKIIPPAQNTQNDHIFDHYPTLVLCVKDEGEGVAEDQLERIMHPFERGESARTTQGSGLGLAIVSRIAHLHQGVVEAINHPNGGLQVCIKIPLMTQINDTPNDDFDTTSTNLA

SEQ ID NO: 3414 - protein, 86 aa, M.catarrhalis
KRVIMVVIRLARGGSKKRPFYQVVVADKRASRDGRFIEKIGFFNPMARGQEVETRIDLEAYNAWIAKGAQPTERVASLVKALNKAA

SEQ ID NO: 3415 - protein, 598 aa, M.catarrhalis
RRQLIHGILFRQSDACEASYCWLSFYQALFDMTLVSFTERSIFFRIYAGLLLVCLSVAFFAYLLVDTINQERAQSYRETVATGVFYLIGQGAIHQETNAQKNYWLNDISALFGSNFEIIPIDAIEFKAREMRRIEEAKTVVRYDPYTNQSTFYHRLEGTDEILTVKLAQVGERQVRAMTIFLLDDLSYFHGYEQKQARLEYLSEKFSYPIYQQSINNLHLDHDQIARLKRDELVISYQDGIRGQNSTMSFIVASEVEDMVIVVGPVTLFNWFPLNLLASVALICVLLIALGVYALIFPLERRLQLLQLGVNRVAQGNLDTKVQVVGQDDIARLSMTFNAMTEHIKRLIESQRELTRAVSHELRTPVARIRFAVDMLADTDDEDSRQLQRQFIDEDIESLNELIDEILTYAKLEEGSPKLDWEMVNLCDLTEQIERETNALGKPIQLICKLPPAKAVAMADRRYLHRVVQNLVGNALRYAQSTIMLSAGVVKGEAFISVEDDGHGISEENREKVFIPFARLDDSRTRASGGYGLGLSIVSRIAFWFNAKLSVDESPTLHGARFIMKWPAKQVGVVVAADELTQDRVEKTIHQKGSIKPD

SEQ ID NO: 3416 - protein, 393 aa, M.catarrhalis
TYASFIMGIRSVIMTKNYALLSVSDKTQIVEFAQGLVESGFGILSTGGTFKLLKEHGIDAIEVSAHTGFAEMMDGRVKTLHPKIHGGILGRRGIDDAIMNEHGIDRIDIVVVNLYPFANTVAKDGVVMSDAIENIDIGGPAMVRSAAKNHAHVGIITSPNDYSRILDELKNQGHLSHNTRFDLAVKAFEHTAAYDGMIASWLGARLPVDKETAPSDDATATTQFSRTFNHQFTKAQELRYGENPHQSAAFYVDDHATEASVATAQQLQGKALSYNNIADTDAALECVKSFTTPACVIVKHANPCGVATSENGILDAYHLAYATDPESAFGGIIAFNRELDSDTARTIVERQFVEVIIAPSIAEGVLEITSSKKNVRILVCGELSQPTQRAASI

SEQ ID NO: 3417 - protein, 65 aa, M.catarrhalis
TCKSKPDRTVVLILPSSYTLLIFLACKMVAMLILIHILKFVQAEFLTPLTQDKLSSKNLIKMMPL

SEQ ID NO: 3418 - protein, 128 aa, M.catarrhalis
KLVPSVCPSKAELDDLLFAWKVAKYVKSNAIVYAKNHQTIGVGAGQMSRVNSARIAAIKAEHAGLVVEGAVMASDAFFPFRDGIDNAAAAGIKCIIQPGGSMRDAEVIAAANEHGIAMVFTGMRHFRH

SEQ ID NO: 3419 - protein, 183 aa, M.catarrhalis
AVPFRPMVLKPIHEIDFAGVLFEILSIARRHRMSIPPQLMLLLKTLVHVEGLGRELYPELDIWSLAKPILTAWVKSQLDPIKNIQELQARLPEVLLSTTDLPKLLNQSLQSLATLGAHQDALLHEIQSLRADGLNERRHDWIALAGFILMLGMAWWSALAIHLYLAPIFFILAIGVILWRVLL

SEQ ID NO: 3420 - protein, 255 aa, M.catarrhalis
LVALTHQYLGNMLRGVEQALSGLSVGQISQPVQTGFGYHIFKGTKVSNDTPNIASMRDQLMDRAAKLKRDQAFADLSAKINTMATDGMGVADIAKEAGVQVKQIIAYPQTNNTTALPQPAVIAAAFDDFTIQDQGVSPNISLGEKNVWVQPTNYEAERPLTFDEAKAQIKQTLAKQKAIELAMADAKKVADEAKNSGVTALMTTSANIGMTTRMNPLLSPLELASLFLNRSAEGYDVWAVQTEEGCKCDRWRCCQ

SEQ ID NO: 3421 - protein, 75 aa, M.catarrhalis
KNDTIAEMAGFFKSNYDTKLAKWLNFITIATQMCTNLVPICYVYRYAQKPPSKPFSVRMNLWYNLNMTRSKGVFA

SEQ ID NO: 3422 - protein, 584 aa, M.catarrhalis
IMSTQPTEKNDFIRTIIRDDLASGKHDSILTRFPPEPNGYLHIGHVKSICLNFGVANEFGGACNLRFDDTNPTAEKQDFVDGIKEDVRWLGFEWAGDVRYASSYFDELYGWAVQLIKQGDAYVDLQSIDEIRANRGSFTEVGVPSPQRDASIEENLARFEDMRQGKFADGEAVLRAKIDMTHPNLNMRDPVIYRVMHAHHHQTGDQWCIYPMYDFAHPLSDAYEGITHSLCTLEFEDHRPFYDWVVQKVGFDVPPRQYEFSRLNIDHTLTSKRKLKRLVDMGVVSGWDDPRMPTVAGMRRRGYTPEGLRDFCERIGITKSEGLVDHRMLEFSVRKSLEETTARGMAVLRPLKVTITNFDDAVSKFNELKNEKTLAEFDGEALWLTQPKHPHLNMGERQIPFTKTIYIDATDYEIEPPAGYKRLSPNNPEIRLRNSYILKVNEHKTDDAGNVIELIATIDEHTLGNNPEGRKVKGVIHWVSATHGVTAFVRLYDHLLLEEDEIDASLAQNALGADADAFWINRHLNPNSLTVYQAVVEPDLAKAAAGERFQFERESYFIADSVEHTQSSPVFNQIVSLKDSFKPE

SEQ ID NO: 3423 - protein, 85 aa, M.catarrhalis
YRLTISVMPNTAQSNKSNAFIQYVMSKCIKCKYKCIKFNRQSFNITQKIHQPKKVKEQNKRKNQNAAPMIKQSIIIPCHQVIPKP

SEQ ID NO: 3424 - protein, 79 aa, M.catarrhalis
STIAAFCSLNCWIPPFYLAQDSINKVCDDDQSLSNHQNKSDSLDIKVGFDIKAILSICDAIYLYLLCNLSIIAQFTLLI

SEQ ID NO: 3425 - protein, 326 aa, M.catarrhalis
LSQAMSNFTNNHPKRPPFHRIGVMGRAGKASIVETLNELIRLLKMRQLSIVIDAQTATIEGILIDGEHTDDSIIITPRHTMGEQCDLVIVVGGDGSMLQAASVMAGTGVPVLGINRGRLGFLADINPDELTEKVGQVLDGQYWLVERFLLKLQIIQNTTNDNALTQVLHEDIALNDIVLHAGKSVHTIDFKLKINNKDVYRQHADGLIVATPTGSTAYALSAGGPIIHPTLDAICLVPMHPHTLSDRPLVVAGSSQIMINIHKDNRTQPMVGADGKTSVPLENDQTLIIAKHDKTLLLLHPNSYSFYEACRTKLHWNLYSEEFSLD

SEQ ID NO: 3426 - protein, 696 aa, M.catarrhalis
CQPYRQDTHEAMLKRQNHQMLIRLGIAALGAMQAMMFSIGMYFGAYSGILVEHRDFLRYVSLFVSIPVFFYSGVPFFMSAYHALRTRQINMDVPVSIALILTFFASLYATIIGAGETYFDSVSMFIFFLLAGRYIEHNARLKASNMASDLVVIEPILVTKLDEASDLVQALATDQAQAAIETWLATKGDMDKRISQMGQDDNAKILAQSVKVGDVIWIESGCQIVADGVLLSKTATVSQSLLTGESDLIVKTRGERLAGGSQNDSQPLLMLVTDDVDNSQIALIDRLMNRAMSEKPQIAQDADKMARWFVARVLLLSLLVFVVWYFIDKTQALWATVAVLVATCPCALSLATPIALTVATNRLASFGFLPTRGHTVQTLAKVSHVAFDKPGPLTLGQANLLAVVSDYPDDDILALAAALEIGSRHPVAQAILTAAHGLHLPAVQEMSHHIAGGVEAVSQGVRYRIGHASFVTDQASSQPDFDYGRYQENLEDYQANMSVLLSAWQDGSWRLIARFYFNDPIRTDAHQMIEQIKSSGMIPLMLTGDPNPNALKVAKTLGIDQAYYGLTPEDKVSYIKQLQQDNHIVLMVGDGINDAPVLAAANVSTAIAGAADLAQVSSDSVLLGGRLHSIPKAIHLSIKTQAIIRQNLKWALVYNALVLLPAAFGYVPPWLAAIGMSLSSLVVVSNAMRIKKLSKF

SEQ ID NO: 3427 - protein, 216 aa, M.catarrhalis
TIHYYTMSSSDTQTMNQSDHKPNPDLATFGDDELGEYSLILPPAGCCFHCGEVLPKEPFFTMIFDKPRPMCCLGCQLAAQSIVEAGLSQYYLDRREISPTASLPEAINFDAYNHADIKEQFVYAENGGSTAELSVTNLKCSACTWLIETRLRSLDGVRACQVNLTQQRMRVNWDDGILSIGEILKTVHSVGYDANLIAKIRMKRCSNDKITKCSYG

SEQ ID NO: 3428 - protein, 168 aa, M.catarrhalis
IVSQILGVYSQYPLVLDAAFVPTRTGWYLWMSTIVLVLLICLAVGLSWWQWVSLGVCTGVLIGFYAYHQRSGIRQMSSRQIDGVWLLSFPIRSKQAATTQDDPKDTHVIHQAYLHDIRLVDLGLSLVVVINFYAISPRRQPLSVIIFADQTDSHNFSKLSALARLYQK

SEQ ID NO: 3429 - protein, 122 aa, M.catarrhalis
KACLVGLFAKSSIHLFLSSYGVVRCGRLAILQVVVVVLQLRLSASISNSKIRHTKQRSMRKHNYLSCLISTAQSRRFTATEDKKGLMVSALFEFLVYLLASQKRPWYWQHITKQIQAKTSNR

SEQ ID NO: 3430 - protein, 210 aa, M.catarrhalis
VNSQFKKKIQKENKHMNDKIKIQHPKPSAKAKKALIWIDLEMTGLDTQQDDIIEIATIVTDDELNILAEGPVLAIKVSDVVLNRMDDWNKNQHGQSGLIDRVRRSTITLADAEAQTIEFLSKWVDAGISPMCGNSICQDRRFLARQMPKLERYFHYRNLDVSSIKELCYRWRPDIATGYQKTGTHLALDDIRDSIRELRHYQAHFFKLLN

SEQ ID NO: 3431 - protein, 227 aa, M.catarrhalis
FALQPTSMPKNKLKAWLPTPEKLRKNRLIAVFAPFLADPRLWQINRSSLGRAVYVGVLAAFFPLPGQMPLALLGALFTRANIPMAIALTWITNPLTAIPIFWLAYSLGAMLLGEPIIGLRAIGIILTDFTLWVTADGINPFTAHRHIFSWQAMAIGLFLSAITTSIVLGLAFRAFWNYRTIKDWQARHGYNANAPKFKHQKGHKQREQDLKTRYNHPKDDKSDHFSI

SEQ ID NO: 3432 - protein, 229 aa, M.catarrhalis
INLQLSLSKGQKLIIDVFDGYNLSLYQINTLEIVQDSRNRWYACITVKEYPKTQCGTGSVGIDLGLKDSATTSKGGKLTIKQTLKYAKELAIAQRAGKKKRVRAIYAKIKNTRQDLIHKFTTQLVKDNALIVVGDVKSRSFTNKKTKLAQSTYDAGWFELKRQLEYKCKHAGCRFEIVNEKYTTQTCSCCRQIDSNSPKGRAGLRIREWTCAKCGTRHDSDLTPVGTFL

SEQ ID NO: 3433 - protein, 78 aa, M.catarrhalis
IAVQRGMMFGQCKPKKGASVIVGGVVNDSSESQLSATDRLRAVAVIRDNVCADQLEDYVHYLRESSELVINQDALKAQ

SEQ ID NO: 3434 - protein, 295 aa, M.catarrhalis
THLKNNLSRHMTTNHQNDQFTNPNILPTGTPQGQSEQQRPQGEKPADDETTHFGYQTVHKSEKQAKVAEVFTSVARKYDVMNDLMSFGIHRLWKRYAISLTGVRSGQRVLDIAGGTGDLAKVFSREVGRSGRVVLSDINEAMLEVGRTRLINAGCHNVDFVLANAETLEPFEDNSFDLVTISFGLRNVTDKDKALSAMHRVLKPGGRLLVLEFSKPVFEPLSKAYDLYSFTALPIMGKIVAGDAESYQYLAESIRMHPDQQTLKQMMQNAGFVNCDYHNLTGGIVAVHRGFKARS

SEQ ID NO: 3435 - protein, 182 aa, M.catarrhalis
ILINHQIFKEFIIMNMKSSLVLVMLAGLSLSACNKKEETIVQPNEPVTATADAAVVDATATTGTHQPEVAVVDGVGVVLPQSTYTGTLPCADCSGVQTDLTLNSDGTFVMKQDYLGKPNGQVTTQGTYDINGVDNQYVLLHPNDHADTPPYLIYMDKDSVQFRDLENGETPTPSHTLLLVNP

SEQ ID NO: 3436 - protein, 384 aa, M.catarrhalis
LKTKPPTDMLITHRKRLLSLYRIAAKYRLDTHFADVPEFAPIARLLRVHPASFGRSHQPLGVKLALEEMGTLFLKLGQLLSTRSDLLPPQIIAQLSLLQDKVAPFDAKTAIATIEHAKYGLGQPIGDIFARFDEIPLAAASVAQVHTAALHDGREVVVKVVRPNIKQGIIADFELLRQMAAWASARLEAARAIHLIDVVEDYRQIMLNELDLTLEAANSTKMRHNFTGSRLIYVPEVYMSAKQVMVSERIFGVPISQTDLFDALGYDRAALAKKGLTIFFTQVFRDNFFHADMHPGNIFVETMPDGRADAEPRYIGLDCAIMGELSKEDQLIVARMLLSVMNANYTALVDIIWQAGWIPPSADKYALMRDMSRTVSANGTKADS

SEQ ID NO: 3437 - protein, 97 aa, M.catarrhalis
PMNKQEILNSLTPEIIDKFRTAIEIGRWENGERLTDTQRQTCMQAVMVWEHEHLPITERTGYIHRPIKEDGTVIGEACDVEHDHHYPNAEHVVKFKS

SEQ ID NO: 3438 - protein, 201 aa, M.catarrhalis
LINNHMEYVMKRLSLIALLAVAGFANAATYELDPYHTNARFSIDHFGTSTNVAGFYELSGLMQFDRAAGKGSIDISIPVSSLTASSSLFTQHLKGADLFNIEQHPTMRFVSTKFYFKGTGKNRQLQSVSGNLTLLGKTHPVTLTATKFNCYQSPMLNTEVCGGDFTTKIDRTKWGMNYLVDMGMPKDVRIDIQVEAGKKAH

SEQ ID NO: 3439 - protein, 500 aa, M.catarrhalis
MMIKKSVLVLLSFLAFANTSPSYAIDELVIAQLTNPSAATDDNKPANNADDTPIASQATPIDDAQIYDRIYGIFSEVDGLSSVKVTVNQGVVKLSGETANEKKATQAVKLANRISGVVTVEDDISRTLDIQDNVTPVVNDLVNQSKAGLKALPLLLVALLAFALVAWLGGWLSRREKLWQRITPNPFIAELLAQTVKVIFIVLGLILALSLMGAEAIIGTLLGGAGVLGIAVGFAVKDTIENYIASLMLSIRQPFRAKDHVVINDEEGIVVRLTSRATILMTLDGNHLRLPNSEVFKATILNYTKNPERRFTFELGVDANNDPLAAIKVGLDAIYTLDFVLKEPKAVAVINEVGDSNIILEFRVWVDQSKTDFSKARSIAIRETKHALENQGFSLPEPIYMLNFDQALEDAVINLATHLVPTAPSPKTTPNISIDDTAPIGDTERQKQIAKVRAEKILNENCMNDILDTAPDPEIWHRVEAEIRNRSGEKDLLSNNSPQE

SEQ ID NO: 3440 - protein, 93 aa, M.catarrhalis
AVSNLPTHKRYAMSHKPKPTPLYQQVEQTAKRYFETLGDAHTHDVYATFLAEFEKPLLIAALNHTHGNQSKTAQILGINRGTLRTKMKTHHLL

SEQ ID NO: 3441 - protein, 224 aa, M.catarrhalis
YMSKLTSVVVEHNPSAQPITHTVIWLHGLGASGHDFEPIVPNLGLAKDTAVRFIFPHAPKIPVTINNGYVMPAWYDILEMSLNRKVDVAQIISSSAMIDELIDDEIAKGIDSQNIIIAGFSQGGAVAYHNVLTNSRKLGGLLALSTYFATFEHIQSIAVNHHIAVKIDHGEFDDIVPKTLGIQAMHHLKSLGLTPIYATYPMAHQVCLPQITSIGDWLNALIKS

SEQ ID NO: 3442 - protein, 241 aa, M.catarrhalis
IYLNLSHDGFIVIVDDDFMICPIILTFITHKRRKIAMAFTLPELGYSYDALEPHFDKETMEIHHSRHHQAYVNNANGLLEGTQWADKSAEEVIANLDQIPADKRTGVRNNAGGHANHSLFWTILKTGTTLGGSLKDAIVRDFGSVEAFQEQFEKAAASRFGSGWAWLVLDEGSLKVVSTANQDSPLMGEAVAGCKGYPIIGLDVWEHAYYLKYQNKRPDYIKAFWEVVNWDEAQKRFDSAN

SEQ ID NO: 3443 - protein, 816 aa, M.catarrhalis
FDLKNPAISAIVSFFYWGFIVSKSVPRSFWRHQSGLIVTGILLIVLFVMMAAFVLYAMHLNTAVVGKFENRKWDIPATLYSRPLVLHQGAALSAKDLESWLKLLRYSHDDTSQTGRYQKNGQVYTIYTRGFHYGDADKDPKQLIEVHFDRNTIKSLKSSAPNNSGILRLEPIKIGSIYPDNLEDRLLITQEQIPKPLVDALIATEDRNFYQHHGISMRGVARALFTNLTGGQVQQGGSTITQQLIKNFYLDSERTLKRKINEALMAVLLETHYSKDEILLAYMNEINLGQNGKQSVNGFGIAAQFYFDKPLGELSLEQYALLVGLAKGPSHYNPRKNPERALQRRNTVLNSMLATGKIDTATHQDAINRPLGVVKTPAIARLQFPDFFDAVQRELKTHYRSEDLKNRGLRIISTLDPLAQQVADTAMTNQLGKLRKKGGRTQKLQGALVSAHPATGELVALVGSGSDFTGFNRAIDAKRQVGSLLKPVIYLTAFQSGQYNLTTPVNDTQTSYTVNGRSWTPKNYGGQSHGSVPLLTALAKSYNQAAVNVGMQLGLDAFKAQLGNLSITTDIPPYPSAMLGAIDLSPMQMLGMYQIFANGGAYTPIHTIRTVIDDNGRVLQRSQPRHQFRAPPQAVYLLNRGLQEVIKSGTAKAADSINNHLGLAGKTGTTNDNRDAWFAGYSGNYVSVVWVGRDDNQPIGLTGGSGALPIWMDYMKRLNLTAVNLPLPTGVTWQWMDGRLGLPTMESCPDARWLPVIDLYRPSQMSPCASAILYQEQIYRQMLEYGSQGIADTGDVYIEDAPIYDEPAEDGDNPWW

SEQ ID NO: 3444 - protein, 388 aa, M.catarrhalis
NLMNYSVFTSESVSEGHPDKMADQISDALLDAILTQDKDARVACETLVKTGAVVLAGEISTHANIDVETIVRNTVNKIGYNHSDLGFDGSTCAVINMIGKQSPEIAQGVDRQRPEDQGAGDQGLMFGYATNETDVLMPAPIQLSHRLMERQAQLRKDGTLPWLRPDAKAQVTLRYDEHHQPLAVDALVLSTQHNPDISQKQLQEAVMEEIIKKVIPSQLLHKDTLYHINPTGKFVIGGPVGDAGLTGRKIIVDTYGGMARHGGGAFSGKDPSKVDRSAAYAGRYVAKNIVAAGLAERCEVQISYAIGVAEPTSISVNTFNTGKISNADIIKLIRTHFDLRPYGITGMLNLLQPMYEITASYGHFGRQGVDTAFTWEKTDKAQLLRSAL

SEQ ID NO: 3445 - protein, 175 aa, M.catarrhalis
YHYERKFMSQNLWTHIRTVSDFPKAGIEFYDISPLLNQHLNQLIDALIDALPSDILAATDALVAVESRGFVLASLLAARLDKGLILIRKTGKLPPPVHRESYGLEYGSDTLEISCDLDPANVLLVDDVLATGGTLVAADKLCKAAGLTALGSLVLLDLTELHGDLGLKYWCVLSK

SEQ ID NO: 3446 - protein, 115 aa, M.catarrhalis
KMSDNQEFNESEFQDQMHAFFERADAVITLANSQLSPSSHAGQVAASLNYAAARFAISAATIGFIKGSDLAKEKDDIIKFYTEKYQQMLAENLEQYIENFDQYTQLAKNNPNPSL

SEQ ID NO: 3447 - protein, 310 aa, M.catarrhalis
YLFCRPNLIFHLTLSDGIYMHLPDHLIQLLTQYLTEHTHQPIIIDPAVLAYRWVGGTSGNLEPIEISFGRSLVDLLGIDTQKTKLINNTKQFLAHLPANHVLMTGTRGAGKSSLVRALLQAYHSQGLRVIAVARDDLKHLGKIRHAIKESVNQGNTNRYLVYCDDLAFNAQDENYRTLKSILDGSLDSEHSQLLVYATSNRRHLLPQMMKDNISIYNGQTDEVNPYETIDETVSLSDRFGLWLSFQPMNQPLYLQIVEHELTKANIVFDDFAQSQALQWASSRGGRSGRIAYQFAQHWIGQTRLAQGVSG

SEQ ID NO: 3448 - protein, 298 aa, M.catarrhalis
FMQWRGRRQSNNIEDRRSGGVKKVGGVSIFGLIIAIILWQVFGISPETTLGVAQQIQGQATTAPTHETADMAESKAFVATILADTEDVWTPIFAQLGHHYQPPSLVLFSGAVQSACGSATSASGPFYCPADQKVYLDTQFFRDMRTQMGITGEKNHTELTRQDQAADFAQAYVIAHEVGHHVQTLLGISQQVRQAQIKANQTVANNLSVRLELQADCFAGLWARHNHERTQFLQQGDIEEALDAAEKIGDDYLQHKAHGHAVPDSFTHGTSAQRKNWFYKGFETGDVHQCDTFSADQI

SEQ ID NO: 3449 - protein, 317 aa, M.catarrhalis
RPGRLVLVGTLIPMAFLGVGTFGGHAIQPNELIKVGNQVVDVATFQAEVNAERNALIEQGVDASLINEHALQQLILKRLTDKALLENQASYLGMTVSDEMITQILQHYEVFHDNGQFSNDRFAAYLQQNGLTKDVLFAIERLRLSLRQLITGIVGTAIYPNSEVSKLIDLQLEAREVWVHRYHWQDYVDQVQISDAQIQAYFDEHQDKLIKPATVDLSYIELDPNVLSVGTPTEQEINAQYANYLRENGITDGRELAQILLTGPDAQNRAAKIQSKLNAGESFEALAKAHSDDPSGSNSGVIGSFNPSVFGEYAAWC

SEQ ID NO: 3450 - protein, 140 aa, M.catarrhalis
KTRRALVKKQKPKIKPKQDKLLANGLTSTIHATYEFIQQKMDLEEIAAKRSLAVSTIINHVASIGKMMGADAIEDYRPTDEVITDIKDAMRHLEAQGEFADGFKIKPIYDELREKYSYNEIRLALAYIDTSKMDADRDTK

SEQ ID NO: 3451 - protein, 60 aa, M.catarrhalis
SAFSILLINHFGTVDNDRLIGYISMIAKTTSWHAFDLIYHIHAINHLTKNSITPTLWCWA

SEQ ID NO: 3452 - protein, 229 aa, M.catarrhalis
IRISMATILHAKNISKVYDEGKIKTTVLSGLDLQVQAGERIAIVGSSGSGKSTMLHLLGGLDTPSTGEVWLKGQCLTHLNETKRGELRNRYLGFIYQFHHLLAEFNATENVALPLLMRRDVSIKQATDEANALLHRVGLGHRLHHRPSELSGGERQRVAIARALVTKPALVMADEPTGNLDDENAQAVFELLSELQVSFGMALLMVTHDRHLASQADKVLEMKSGQWAN

SEQ ID NO: 3453 - protein, 269 aa, M.catarrhalis
LINSMLNADYFFTTRPSDIQAVFVSDLHLSPMTPRLTKAFVHLLEDLKNLPNLNSLYLLGDWLDAWLGDDTYTRLSDDQKAIHWLYPVITALNALANNHIQILVMRGNRDFMIRQTLCDTFKGVLIQEPYPINTTKHRIRLEHGDALCTDDTSYQRYRAIINHPMTRMVLNQLPLALRKKLANNIQNHSHHQKSHKPPKIMNVNPSAVDAAMTDCDILLHGHTHRPNVHHDDRKIRIVLGDWRDDGRHIHAEIGLMIGEDLQLAQFKYG

SEQ ID NO: 3454 - protein, 71 aa, M.catarrhalis
WIFFDQNTHFISLSKRLVRFNIRLICHYQISLMHKLSDDSVGNKISHNSQLRLILLSGLGLSAPNHHSADF

SEQ ID NO: 3455 - protein, 248 aa, M.catarrhalis
QIFIEQGYIMANPIISRTTLATSAVAMSVRGVVSKTAFLLSLAAVSGFGVFFYALSINVSSSLLYAMALVSVFAGMGVGLASAMKPHLAKSLAIPYALIEGVLLGAFSLIMYRYYPSVPLSALSATFITAAVMLTLYATGIIKVTEKFRAIVTSAVIAIGILYLVQLGFHLFGSSLPLLFDGGMVAIGFSVFVILIASFSLLLDFDNVEKGVAFGVAQDYEWVYGIGILSTLVWMYIEFLRLIGYLQE

SEQ ID NO: 3456 - protein, 172 aa, M.catarrhalis
GYFMDMPVVEFDTTFGQIKIELNAEKAPITVANFLDYVESGHYDGLIFHRVIDGFMIQGGGMDAQMNEKRTGTPIKNEADNGLKNTIGSIAMARTSDPHSATAQFFINVKDNDFLNHSSPTPQGWGYTVFGQVIDGMDVVNQIKGVPTGRFGYHADVPNEPIIINSAKVINQ

SEQ ID NO: 3457 - protein, 328 aa, M.catarrhalis
VVIMSNQTIRYNYMHETSPTKVDLPHDENASHGDHWAILTNDITQDVPNWLQAMLDKATLPKGLCPQNSTNNAKLLLGMNEPCHIKQILTIKNGSPQAFINAFPAVNSPYGLTCQIERIIRCDTTSDAILCLKTPDGAVIYAFDQLYAVNRTEYRTPKKYFVNFSALAYHIKPSNQEETIVIEDQEAIRHHRAFNDIVAKNGGQIPDDIDEKIRQWQPTDHESGKPFAPVEINLGHMCAYLYGETFGQEDEAWCQGQVLGKSSTEFFGKPMTLFDVVILREPDADPFVVRIAAVSTEQTDAIQVHDYIQANIWLQAAIYEVNQKPHQK

SEQ ID NO: 3458 - protein, 943 aa, M.catarrhalis
GFVMPKYKLLSASIAFSLLMSHQAYAHDEAFDKLSTKIAGQSQSWYQHLDAQVVTPFPKKGTLEAEVDRKISWDMQNNTTAERLALAEEDKNQSFAHVSHEFRKSALKEFAPHITDEQFVNIFKNLVYLSANAIYSDDFNVGRMRAYDFILKDKYLRGRPYQVMDREGKYIEGYENLKTYIDSQGRERKNSSYPSGHTSNGFGQAVVMAMAFPERGQEIFSRALQYGESRVIVGAHFPTDTMTSRLARYYYMAQLLNDDEIAQGLVRHIKQARQPFEESCQNAPLKSCLEMLPQDLHEQYKASDYQIGYYGTLKSDEKASRLKPEEMPSTADALLRLRFNYLDGDARRQVLASTAYPKNSHAHMGDLDNKNHTWGLINLPKAYDGISHIYQDIETTTQDKHLDFAGFSLEDTWKNDISGTGRLILNHPGELTLSGNNTFAGATVKQGHLKFTGNNALADDSYINQGTMSVTGQFQSKVVLNHDAKMMIVGQSDQPTTVQEIELSAKDSWIYVAPKGVFQVNANSQENNTTTDSQISIQTLSGVGHVMVEDHSNLHIDKLSGETIFAINPSDAPVKINELKGRHGIGIPSHISKDKNHQSLLKVDNNQGSFYLIDTNNNVVDAAEQGAYAYQLVMRPNNTLQLSQFANDNSPIASSMTKTALNTGMGSLYTLSSQMNHLGSMNNRQSVWLNHRYQENNIKSHNTQFDLKLNQTTLGAGSKVGQTYLGAYINKSEGDVDHVFGGKNDLDATGFGVYLNRLLPNQQEIFLQGAWQNVRQKIHAKQANHDNLTASIKDNTWAIALGAQQQMKFHNVDFQPSFEIGHIQTNPKSFRYDQMPNLQINPKKASMTTVNIGTKISKNYGLLQPYLKAKMFYQDTKQDLNIIDMNNEVSWWSTDLSGFGFAGALGVTSQINSRFFISGEASAQYQEEVKTPIEAKLSLNYQF

SEQ ID NO: 3459 - protein, 2142 aa, M.catarrhalis
ITSIKSSLTKPQAHLWPWRNMPNPTARGGDSCATGQVSSVCTLSFARIAALAVLVIGATLSGSAYAKGDYAVQVADPINGLGSAQATKEASVAIGSLSKALGSQSIAIGGGKPNRNQPQDNNKVGPHAIGDESIAIGGDVTAQGDASIAIGSDDLYLQKIKDLSDQGQTPYTKIQEALEGHVELTKIQQDPKLHFRRTFAQGHASTAVGTMAQAVGHFSNAFGTRATAKGNFSLAVGLLANAEQGYAIAIGSNAQAKSYNSLALGVDTKVELGRGIALGYKSQINAGNHNNGVNQTYKPEGETLSTGAEVTKNGDQYDILSIGNNDLRRRIINVGAGSQDTDAVNVAQLKAVVSWAEKRKITFKGDDNSTGIERKLGEILTIKGGADTRELTDKNIGVVKDNGNGGGLQVKLAKNLSGLDAVNTKTLTATGKIQVNNNGNTAELQSDNLTFTTPQTGKTVYSIDGLKFTNDNNSIVTVGTTRITRDKIGFTGASGELDENLPYLDKEQLQVGKVIITKDSGIKAGDQEITEVKSAIADAANGQVDQSFINRLETANNSKSKYAATIKDLHGLSQVQLTFAGDTGTTAKKLGEILTIKGGADTRELTDKNIGVVKDNGNGGGLQVKLAKNLSGLDAVNTKTLTATGKIQVNNNGNTAQLLGGGLTFTQPNIGGQNSGKTVYGVDGVKFTDSSGNTPLAGTTYITKEKIGFAKQDGSLDESKPYLDKDKLKVGEVKITKDGINAGGKAITGLPSTLPNTTYTAPGVHTALHGSTISNDDKTRAASIADVLNAGFNLEGNGEAVDFVSTYDTVNFINGNATTAKVTYDNKTSKVAYDVNVDGTTIHLTGTNGKKNQIGVKTTTLTTTSAKGNTPINFNVKPGDDDALVKASDIKDNLNTLAGEIRTAKGTASTALQTFSITDEHGNHFTVGNPYSSYDTSKTFETVTFAGENGITTKVNKGKVKVGIDQTKGLTTPKLTVGSSNGKGIVIDSKDGQNTITGLSNTLTDATNATTGHVSEIQGLAQGANKTRAASIGDVLNAGFNLQGNGEAKDFVSTYDTVNFIDGNATTAKVTYDDTKQTSTVTYDVNVDNKTLEVTGDKKLGVKTTTLTKTSANGNATKFSAADGDALVKASDIATHLSTLAGDIQTAKGASQASSSASYVDADGNKVIYDSTDKKYYQVNEKGQVDKTKEVTKDKLVAQAQTPDGTLAQMNVKSVINKEQVNDANKKQGINEDNAFVKGLEKAASDNKTKNAAVTVGDLNAVAQTPLTFAGDTGTTAKKLGETLTIKGGQTDTNKLTDNNIGVVAGTDGFTVKLAKDLTNLNSVNAGGTRIDEKGISFVDANGQAKANTPVLSANGLNMGGKRISNIGAAVDDNDAVNFKQFNEVAKTVNNLNNQSNSGASLPFVVTDANGKPINGTDGKPQKAIKGADGKYYHANANGVPVDKDGNPITDADKLANLAAHGKPLDAGHQVVASLGGNSDAITLTNIKSTLPQIATPNTGNNTNAGQAQSLPSLSAAQQSNAASVKDVLNVGFNLQTNHNQVDFVKAYDTVNFVNGTGADITSVRSADGTMSNITVNTALAATDDDGNVLIKAKDGKFYKADDLMPNGSLKAGKSASDAKTPTGLSLVNPNADKGSTGDAVALNNLSKAVFKSKDGTTTTTVSSDGISIQGKDNSSITLSKDGLNVGGKVISNVGKGTKDTDAANVQQLNEVRNLLGLGNAGNDNADGNQVNIADIKKDPNSGSSSNRTVIKAGTVLGGKGNNDTEKLATGGVQVGVDKDGNANGDLSNVWVKTQKDGSKKALLATYNAAGQTNYLTNNPAEAIDRINEQGIRFFHVNDGNQEPVVQGRNGIDSSASGKHSVAIGFQAKADGEAAVAIGRQTQAGNQSIAIGDNAQATGDQSIAIGTGNVVAGKHSGAIGDPSTVKADNSYSVGNNNQFTDATQTDVFGVGNNITVTESNSVALGSNSAISAGTHAGTQAKKSDGTAGTTTTAGATGTVKGFAGQTAVGAVSVGASGAERRIQNVAAGEVSATSTDAVNGSQLYKATQSIANATNELDHRIHQNENKANAGISSAMAMASMPQAYIPGRSMVTGGIATHNGQGAVAVGLSKLSDNGQWVFKINGSADTQGHVGAAVGAGFHF

SEQ ID NO: 3460 - protein, 217 aa, M.catarrhalis
GTLMMIGVLSLAVGEKLVNTAIGLDPLIQSELKNLSGKTLRVMMRSPNLSVDVLFGDERVRLEPAFEPIFEPQGGIYPNPPECTLTVDNPKNLLTLLQNPTGNLPIQGDHQILMRTKYMLEQCHPDIWSWLERLIGQDAVSQLYFIGQEISPLSAPIINHIKQALASFVSHQASSNESDFIDQTLQDKKQTLLRLQSEIERSQAKLAEIQNTLNQNN

SEQ ID NO: 3461 - protein, 91 aa, M.catarrhalis
GNTMTIQPTDAQRRIIYQARRGLKELDFYIDYYVKSHYLSADADEQQAFETLLSYEDPDLLVFFLGQETPSEAGVAALIDKMKSLRHTGTV

SEQ ID NO: 3462 - protein, 452 aa, M.catarrhalis
NHLIPQRYHSLLATLKFIFNHGIKPQLSSGTLMTTQIKSHYLGRISKINWKAFGPGILMASAAIGASHLVSSTQAGALFGWQLAIVIILANVLKYPFFRFGIDYVYDTGDSLIAGYAKKSKVYLWVYFILSVISSIITLAAVGLMSAVILTFMFPSLGLTPLTASVIVLAISWVLLIAGRYNVLDGITKIIILALAITTVAAVFIAAGKPTVMAVDFVEPSPWNLASLSFIVVVVGWMPAPLEFSVITSMWTAKKIQTDHTTHEQGRLDFNVGFATSTILAVLFLALGVYVQYGSGQEIQTAGSAYVGQLIDMYTATIGEWSRLLVAFIAFMCMFSTTLTSGDGYGRANAECWRLIKGEHEISRGQLIFWISWAVFGGFIIIAFFEGQLSNMLKFAMSSAFVSAPVFAWLNYSLVRSEQKLSSGIQALSIIGLMFLLGFALLYVANTMGVFG

SEQ ID NO: 3463 - protein, 147 aa, M.catarrhalis
KNPIILKPMKTLKLRIKDKHTNQLNRLSGSVNFVWNYVNDLGYKYLQKTGKFFSAYDLNEYTKGNGELLGLHSQTIQAINETHAKSRKQFKKAKLNWRTNRPNAKHKSLGWIPFKKSAIKYLSTRQTGKKALKSTYSYRSLRVKSSS

SEQ ID NO: 3464 - protein, 453 aa, M.catarrhalis
SNTINQVDAMKQETALAILKTGQNVFLTGQAGAGKTYVLNQYIEYLRVRQIPVAVTASTGIASTHMNGMTVHAWSGIGIQNEFEKVNLQRLAARDEYLERIKNTKVLIIDEISMLHSKQVDTINQVLKYFRKNEMPFGGVQVIFSGDFFQLPPIGDKGETSKEKYAFMSQAWCECKFQICYLTEQHRQTGTDEKQRFGLSLNDILNQIRRQSVTQQAINILTSTQNHTIDLNRTRLYTHNADVDVINQTQLNELTAKTITYRAAKMGEKPLQESLSKSVRAPDELTVAIGAKVMFVKNLPLLGVYNGTMGEVVGFIGVSGKAYKATDADISETAYPLVRLNTGGEVAAEPEEWTVEDKDGTVLASYTQVPLCLAWAITVHKSQGMTLDAAEIDLSKTFEMGQGYVALSRLRSLDGLKLLGFNIKSLLLDEWVQRVDQPIIELSFEHAQSVLNV

SEQ ID NO: 3465 - protein, 356 aa, M.catarrhalis
GIVMTKILFLVTGMTPQIITETIWALACDPELPHQERFIPDEIHVLSTDDGLNQIRSRLFSEKQGSKFAQFQEEYPQLANINFDDSDDYLHVIKDRDGNILKDLKTPKDNELAADLICQGRFMDTPFDAHRHEDGKGIVIIVPYGRLYYAPHYFDEQTADAYLDYFLESQIGGKPINHRTHNWHHTDLNMVQFRHIHWQQDTIKMYGKVHKLPRISAWYGDNDCPYTYSGITLNPNPWTDRLLMLNDELGKICKRRFNSVLMNWYRSGEDYINWHKDDEKELGNNPLIASVNFGESRRFLLRLCDNHTLKLELLLHHGSILVMAGQLQHFWQHSIPKQKKILGSRVNLTFRNIIGN

SEQ ID NO: 3466 - protein, 425 aa, M.catarrhalis
TSTIVSFGTQLMFRPLALFIGLRYTKAKRKNGFISFISFISTIGLTLGVAVLITVLSVMNGFDREIKSRILGMVPQASVTSTEILTNWQELAEKIKMQNPEVQAVAPYIQLQGMLTAEGQVTGIVVSGIEPDYEKQVSIIDEHMTAGNLDDLHIGEFGIILGESIVSDMGLKLGDKVTLVLPEASPSSAGVIPRFKRFTLVGVYHISSEIDGMMGFVRMRDAGVMLRLPEGAQGLRMKLNDIFKAPQVANNAAGIDSLPLFPSDWTTTHGNLFSAIQMEKAMIGLLLFLIVVVAAFNIVSSLVMLVTDKKSDIAILKTFGASPKLIMQVFMVQGMIIGVIGTVVGTVLGVALALSINDILLFVSRIFGVSLFDGSVYAVDFLPSKIEIVDVVLITTASFLLSFLMTIYPALRASKIQPAQTLRYE

SEQ ID NO: 3467 - protein, 316 aa, M.catarrhalis
IFRMFIMSWQQLHLQCPKSAVELAEALFDEAGAVSILLEDAGDEPLFEPMPGEEPLWRDVVVTAIFDTNSDDSWAGTHFENLAAKIASEVNATRFWLTSLDDKDWTREWMSYYQPIQCAGNLWIVPEWLPAPDPAAINLILDPGLAFGTGYHATTRLCLDWLAAQELSDKLVIDYGCGSGILGVAALLLGARQVLAVDIDPQAVLATRQNAALNGVDDRLLAFLPAEFDAYRTQNPQLADVITANILAKPLIGFAPLFHDLLKTGGLIVLAGLTQNQTQAVIDAYSPYITLDVPFCYADAQDCHWQRLSGIKPTNP

SEQ ID NO: 3468 - protein, 75 aa, M.catarrhalis
SWLVTLNHAHSRTRKPNWHNQPMMQDGLNSNDNWNTNASMQVVVLKSSMRNTLPKLARVAVKLTATVRKVEQVCE

SEQ ID NO: 3469 - protein, 75 aa, M.catarrhalis
RLGVLNFNFIVHVLIFFLNFLFELAVNSLLALYHSHHNLAIIGQNFPTITVQPSFYTQKFVIIHDLIRITTNIHA

SEQ ID NO: 3470 - protein, 417 aa, M.catarrhalis
SPILKMRCVIWRLKANLPMGLKLSPFTMNFVKSIAIMKYAWLWRILIPQRWTLIVIPNNPHHRANVPKLRLAINGFGRIGRNVLRAYLQQLSTFGHIEIVAINDIADNQMLLHLLKFDSTHGRFDQGDHNAAQVSLTTNQDNSYLTITKGELLHQILLLSCDEPKYLPWADLNVDVVLECTGQFRSYADANRHRTAGAKQVIIGAAPFDRVDASIVIGVNDHKLHADLPIISGVSCTTQALVPLLSVLDDKFGIQSAMMTEIHAVTADQSVLDQAHRDFRRARASGHNIIPTTSSSINATERVLPLMRGKINGHSIRVPTINVAAIDLTVKFNKTVSLDQIKDALMTASQNQLLGIMDYCDEPLVSSDFIGNSHSLIIDGQQLMMAGELAKIYAWYDNEWGYANRLLDMCQKLADLR

SEQ ID NO: 3471 - protein, 147 aa, M.catarrhalis
LDFSILQLSNCMSNDLRCGRHVVYNLHVHLVFVAKYRRKVFTKEILDDMQGIFEEVCSKFEAQLVEFDGECDHVHLLVVYPPRVAISSLVNSLKGVSSRLIRKKQYPSISKQLRGGALWSPSYFAGSCGGAPIEIIRQYIEQQNTPH

SEQ ID NO: 3472 - protein, 813 aa, M.catarrhalis
DAAPFNRVVKTSAMTMAVMMVMSTHAQAADFMANDIAITGLQRVTIESLQSVLPFRLGQVVSEAQLADGVKALYATGNFSDVQVYHQEGRIIYQVTERPLIAEINFEGNRLIPKEGLQEGLKNAGLAVGQPLKQATVQMIETELTNQYISQGYYNTEITVKQTMLDGNRVKLDMTFAEGKPARVVDINIIGNQHFSDADLIDVLAIKDNKINPLSKADRYTQEKLVTSLENLRAKYLNAGFVRFEIKDAKLNINEDKNRIFVEISLHEGEQYRFGQTQFLGNLTYTQAELEALLKFKAQEGFSQAMLEQTTNNISTKFGDDGYYYAQIRPVTRINDESRTVDVEYYIDPGRPVYVRRINFTGNFKTQDEVLRREMRQLEGALASNQKIQLSRARLMRTGFFKHVTGDTRAVPNSPDQVEVNFVVEEQPSGSSTIAAGYSQSGGVTLQFDVYQNNCMGTGEHVNASLSRSETREVNSLSMTNPYFTVNGVWQSLNGYYRKAKFDNKNISNYVLDSYGGSLSYGYPLIENQRISFGLNADNTKLHGGRFMGISNVKQLMADGGKIQVDNNGIPDFKHDYTTYNAILGWNYSSLDRLVFPTQGMSHSVDLTVGFGDKTHQKVVYQGNIYRPFIKKSVLRGYAKLGYGNNLPFYENFYAGGYGSVRGYDQSSLGPRSQAYLTARRGQQTTLGEVVGGNALATFGSELILPLPFKGDWIDQVRPVIFIEGGQVFDTTGMDKQTIDLTQFKDPQATAEQNAKAANRPLLTQDKQLRYSAGVGATWYTPIGPLSISYAKPLNKKQNDQTDTVQFQIGSVF

SEQ ID NO: 3473 - protein, 185 aa, M.catarrhalis
SFIRLFIRKFMSVSNIDFDLLEAADIQALSDRGVTLPLHYNQIKHYLPHRYPFMLIDRVTACKPNEWITGYKNISINEELFNGHFPDNPIMPGVLQVEAMAQLSGILGFISAGQTADDGYLYLFAGVDKVRFKKVVTSGDQLVIRSKVLMNKRDIYKFECTAHVDGQLTCSAEIMIARQKVDGVK

SEQ ID NO: 3474 - protein, 67 aa, M.catarrhalis
IKEGECRRKRGGPQRIPIKTTLDKNLIELGNFRFKRLISLDENRFEQNWRKTSFVKRTPKNFKCTSS

SEQ ID NO: 3475 - protein, 185 aa, M.catarrhalis
EVTMTIHPTAIIDKSAMIADSAIIGPYCIVGKNSQIGAHTVLRSHVIIGENTKIGVHNDIYQFAGIGENPQDLKYAGEPTYLEIGDHNRIREAWTIHRGTGQDRGITRIGNQNLLMVNGHIAHDCVVGDDNVLANNVGDVGHAHIGNHGIIGGQSWGASILSDRMIIVWEAGARLELKKNFSALW

SEQ ID NO: 3476 - protein, 340 aa, M.catarrhalis
CLLMPSLHEMMTAIEKYQSVLNKDDIDGSIKITGVANLSAATKHQVAFLAKAKYLDELNQTNAGVVLLSEQFINEARTINPKCLYVLVKDAYLAYACVSTLFTPSCVTGIHRTAIVADSAVIGNQVSIGANAVIGEKVVLADGVVVGPGVIIGERTQIGAGSQIDAATVIHHDCIIGEQTRIHSHANIGSEGFGFAPVATKDGRQWQRIAQLGRVIIGNHVRIGSHTCIDRGAVDDTVISDDVIIDNLVQIAHNVHIGCGTAIAANCGIAGSTKIGKNCLIGGAVGISGHLTITDDVTITSMSMVIANIQKSGSYSSGTVAMPSLKWRRAAARFRQMGEK

SEQ ID NO: 3477 - protein, 379 aa, M.catarrhalis
ILRPLWLLNDDKLIISYQVFSTKFCPMMKTDDLMNTITRAEKDLYQTLFDLAQHHPMAYEWLKLLPDWLANIKNKDRYAHAPYYESIIDKLPDVTPNEINLNAACITSQIDFTHSDYRCSEALLKNLMPWRKGGFKFGQGDRLIHIDTEWRSDLKWDRILPYIGDLTGKRVLDVGGGSGYHGFRMVGAGASTVIVIDPSCLFYHQFMATRHFLGNIKNRYEQSPIHFIPVGLEELPQDNNQSGLFHSVFCMGVLYHRASPFDCLLQLKNQLTKGGELILETLVADGDENTVLVPKNRYAMMNNVYFLPSVSALQLWLDKIGFAQVRCVDINITTNDEQRTTEWMTYHSLDDFLDTKDPSKTAEGYPRPKRAVIIAKKPS

SEQ ID NO: 3478 - protein, 309 aa, M.catarrhalis
KGETMAGGSLLMLLDDIAAILDDVSVMTKVAAKKTAGVLGDDLALNAQQVTGVRADRELAVVWGVAKGSLINKLILVPAALLISAIAAWLITPLLMLGGAFLCYEGAEKVVHKFTPNLLPHEMDDEMAHTKRLKANADESIDLAAFEKDKIRGAIRTDFILSAEIVVISLGVMTAATFTTKAAALSAIAIMMTVGVYGLVALIVKLDDMGIYLVNQPSAYRQAMGRTILVFAPRLMKFLSFAGTLAMFLVGGGILVHGVGILHHQAQDLAALSGVFGGLTEALYNGMTGLIAGLMILVGVIGVKKFINQ

SEQ ID NO: 3479 - protein, 100 aa, M.catarrhalis
FWSKGMKIFAVTALAFVTLMLTACGHGHEKVHAIDRVEEAQAAALANAPKAEDMVFGDEGVSTMTTETAQADASADVTAQEDTQMADANATVEPTETQAN

SEQ ID NO: 3480 - protein, 85 aa, M.catarrhalis
IIIKVLGMSAMATLFLVSAETITTLGLYVLLPIFIGFLIFIMWDISKKSDAGRAGTFWIFVALGMGFFGFLAKLVIEFVLGKWVL

SEQ ID NO: 3481 - protein, 257 aa, M.catarrhalis
VMPNTNHDTHDTLFTTPLDKSARFSFDEEVVACFPDMIRRSVPGYGQVLAMLPILARRHCLLRQVSDRGARVSRVYDLGTSLGAVSFALADKFAPDELEIHAIDISAPMIERAKSVVGEYYPDHDIRFWLDDVCQMDLLPCDLIIINLTLQFLPPDQRLLLLQKCHHALAEGGILILTEKTHLTDEQDDAWRVERYYDFKRANGYSDMEISGKRNALENVLITDTLHKHHERLAQAGFERSLTWFMFLNFASIVAFK

SEQ ID NO: 3482 - protein, 62 aa, M.catarrhalis
LKKKPLPPVYACVIMVLTLCLSNSVLLPNNPNNPNNPNNPNNPNNPNNPNNPNNYHHFIMPK

SEQ ID NO: 3483 - protein, 251 aa, M.catarrhalis
PSLGLINAHLNLVFDYYPNVCIKTIQDILMAQRPQKQPSAVYKDEVHNQRVGLSSLLWIVVGLLVVAMLAVFLYVSPLFDGFGQSADPKPDALVKPITASEPEIEFEFYEVLPEQKFQSIPEGVSIQDREDNTLPKPSTDVIINHSTKASTDQPADISIVAENTADDEPNHQSQYILQIKSYEKAKDADLKRAEVLMAGVDAIVVRQDTKNGYVYQVISTPMTQKEASATSVRLRNNGIDSLLIEQRPTPK

SEQ ID NO: 3484 - protein, 73 aa, M.catarrhalis
KGVIIALIEDKNMKTILLGGGCFWCTESVFDSLKGINSVVSGYAGGAGDTANYQAVCTGETSSPRGWKDHGGQ

SEQ ID NO: 3485 - protein, 379 aa, M.catarrhalis
KEMIMPALRKDIDPEGLLEFSVVYTDRALNHMSVQFQQVMKDLSFELKSLFQADALAIVPGSGTAGMEAVARALATDQDAVIIRNGWFSYRWTQILEAIGVAKSSHVFKACLQEGKNGQFVPADINEVTAYIKEHRPGVVFAPHVETASGMMLSDDYIRALAEAVHLVGGLLVIDCIASGCIWLDMKALGIDVLLSAPQKGLSSTPCAGLVMLSQAAKEAVLSSTPSSFSLDLKAWLNIMMAYENGGHAYHATMPTDGLKQLRDTLLEAKQIGYDNLKQAQIKLGQEILATLHKKGVHSVADPSAQAYGVIVCHALSDEIHKGAAFAKAGVQIAAGTPLQVGEPSDYKSFRIGLFGLDKLTDIEGTIERFKHAADQVFV

SEQ ID NO: 3486 - protein, 442 aa, M.catarrhalis
RTGFVLMGFFDLFRKKSVNATPAPAWQTLIHEPYTGAWQKNDELKRTDLTHFHAVFACISLIAADIGKLRIQTKSSQNGVLLPTKSRTHAILKKPNRHQSWQQFIESWVSSKLLRGNAYVLKQRDIFGDVWQMYVLNPDRVKVLVSGDGEVFYQISTDKLYGLTDTTVPASEMIHDRMNCFYHPLVGLSPLTACGISVGLGLSIQHTSATLFGNNSRPSGILSVPSDISKETAQKVKSDWQANYSGIKRGGIAVLGSGAKYEPIAMSASDSQAIEQLKMSGETVCSVFHVPAFKVGMGEIKAGQKVSDLNEIYYSDCLQHYIEAIENLLDEHLDLEKGVECEADLSPLIRMDSTSQMAYLKEGTHSGILSPNEARATLGLPPVVGGESPLMQQQNYSLEALAKRDNSADPFGNAPTPSEPKKTAKAVKPRYRVYATIDKDKS

SEQ ID NO: 3487 - protein, 102 aa, M.catarrhalis
PSPSAMLRTQVSSIIVKLSLPMGTTIYEALTLVPWVHGEEFEDFWHWVQNNLDNSPNHKSWYVGIFSQKKRLDTILLAGDRIEIYRPLTINPMAKRKALSKK

SEQ ID NO: 3488 - protein, 95 aa, M.catarrhalis
IMTFATLDEVKHHLRYDDTDSDEILQIYLQSAQTAVKNYITDEINDDMLPALKVATLLLVGYLDDNRNGENGAEFGNFLPAPVRQMLAPYRTPTF

SEQ ID NO: 3489 - protein, 90 aa, M.catarrhalis
IGVFMTHYSDFITPADRAWQATYQKNKLDIQLTMPKEVSSLLDFFDVHFRANRGQRGITFMGVHIGYDELDGISQNIAGYLQSFGLKKGR

SEQ ID NO: 3490 - protein, 116 aa, M.catarrhalis
YRRPRKKLIADKSRLFLFKLAGHLGKTVGELERTMTAHEFAQWRAYDRLDPIGGYRGDIQSAVIACAMAGGKPSDYLIIDPNPMTDEEREAYELEQRKAQLQAQMERTLAMFSAIG

SEQ ID NO: 3491 - protein, 63 aa, M.catarrhalis
THSPTHPRTQTAKRRTTKLKKGHEAPACQSYITFYANLMMLLSMKSPISTKCTECLPELLFIY

SEQ ID NO: 3492 - protein, 152 aa, M.catarrhalis
FKPPTRRNLMAKVVENLADSFFTLHVSADGNEYQKIEHLSKCDHPSEEKVLDEVTATDDRRTVKAPIDFKEESEIEFEYALDPKDTTHQLLQTSFEGGKELHWQLKYVVATGESRQFKGIISKLTTDNSDQKKKIRKTGTITITGDVTKVTG

SEQ ID NO: 3493 - protein, 236 aa, M.catarrhalis
YPKPCFMKNIIIMLSLFSSIAYAQNLYQYKDNSGQIFLTNKSNNGNFSAFTQIDHAKDVDVSDFFNEKSETDFRGSKWTYRKTFNEVERTYLTLSMIKSTNAVNLGIGQGGNQNLQIIIKNSHDTGFYNDEIVIGHDSGLVEVCMNSCYMRARFDDDEARWYQLDYFNPHAYSIAPSENYSDVKMHKETKLKEDDYFLLKLYNSNSLVLNFPNFDGTNHTYRFNLKGLNQQKMGNK

SEQ ID NO: 3494 - protein, 413 aa, M.catarrhalis [sequence omitted]

SEQ ID NO: 3495 - protein, 192 aa, M.catarrhalis
ALKTGLFLEQKMSSIKHIQTQIGTTVDGVWGDKSRQALKSAINNGKIITITKNISLNELLASNTAKKYGIDNTPSQTILQNLIDASVNLYQPVREILGVPIIITSGYRSPALNKAVGGSKTSAHMSGFAIDFTAPKFGTPKLIVPHIVRKLKEKGIGFDQAIIEYPNSPRSWVHLGYKHPSGRQRGSSFVIG

SEQ ID NO: 3496 - protein, 468 aa, M.catarrhalis
VKGTWIMRALSIVDSLFLWLENTKQPMHVAGICVFELPNDQDEISFINVLANQIDSDAIPNFPFNQVLFHKFAWKTIRKFYIDRHCYRHSLQVGKMSEALAQISRLHEQQLDRTRPLWELHLFDNLEPETQNGTRRFLLYLKAHHAMIDGVAAMRLFQRSLSHSPDEKLSKPIWLRNIRRKESSFVMDKKPIVEHFKDQIVGLKPVYQELKSDYQLSQSTASQTPKTQFISSLQAPSSILNQRIGTSRHICVLTLKKARFVQVAKRLNVSTNDIILAVCSTAIRNYLLSQNALPDMPLIAFVPISLRKNDTALGNQISFIPTNLGTNNPDAIARLRLIHDSVQAGKMRAGRMTQAEFINYTAVHYAWAGINLAMRLYPAKQAFNLIISNIPGDSTPLYLNGAKLTAMYPASVLFDGQALNISFTNYQDCIDFGITACQTALPNIQSLPSLLTQALVEYEGNDYSSNQV

SEQ ID NO: 3497 - protein, 150 aa, M.catarrhalis
VRFAQRQSSQGFWYLSQTKSDKTSCTNPPKINLSLGQTRRKKMSNLLIINAVICSVGFFVGVHTFIKHLKAFSTEKTPVVEAWLVAVGMLAWSVLLYASFDEPIITRLEVFSRLLFLIYWVGGILKVQKQCIKIRRHLSKRKAQINLYKP

SEQ ID NO: 3498 - protein, 484 aa, M.catarrhalis
PNSATTNPNHNHKSNPQSWCGCFNFTYKRSETFMNYQAQLAQILATIQAKQKQIGEIMTKSVTSGHTPSDDDEVQITVLEGEIARLEKNAERLTKLIKSVETAPNPTEIGGENPEQAAASAKGEPIPQNPEQTKSVQVESNLPKGIGFALLVKASTVATTSKGGITTREVLQGWGAPDIVIRAATQKAVIGTTTDDKFGKELIDYANLTGEFIELVRQKTVVDKIAPLMRQVPFNVKIPMQTASGSVGWVGEGKMKPVGNPEFGSMTLSHAKIAGIVLLSDELIRFSNPKADTLVRDDLVATVAQFIDQQFFDPDKTEAAESPASVLNGVTAITATGTTADKIDTDTNTLIAQLVDAGISLEGAVWAMSETRAMQISGMRDALGRIYFEGMNLTGTRSLKGLPVHTSGSLGDKIVLIVPSQILLADDGGVDFSVSGEATINMGTDDAPKMVNLFQNNLTAIRAERFIRWKPRMTKAVGYIKYTG

SEQ ID NO: 3499 - protein, 60 aa, M.catarrhalis
RCKALWLISDTIPRVTVIAVCFSIKQRLQTADVADSVTMRRRIKARRLASDAIPCDRHGH

SEQ ID NO: 3500 - protein, 205 aa, M.catarrhalis
MTKAYSTLQIKSVTDTDDERLITGIATTPSTDRDDDILEPLGAKFTLPIPLLSHHNHSQPIGEVIQAEVTAGGILITAKIAKIDEEGKLKERIDEAWQSIKSGLIKGLSVGFKIKEYSYIENSWGLHIKEWEWWELSIVTIPANADSVITSVKQIKEAFSLPLQPTPNPPINPIQPLPTQTTITKATPSHGAVALILPTNGVKLL

SEQ ID NO: 3501 - protein, 124 aa, M.catarrhalis
FALYQITLVIVPKIPIIKADFIYENALMKMLIWSLMVLGLVVASNAYADIEKIYAQSCATCHDSGTFNAPKKGDVAIWHRLNQQKGQEALIKSIRQGMPQMPAMGLCQNCTDEDFAKLIDYMSR

SEQ ID NO: 3502 - protein, 65 aa, M.catarrhalis
CVYYIIKTYIIQALFYKNIQKVYKLLILIKIIMITQYVFHQSIKRFCFILQRLNDVSIFFIMKLQ

SEQ ID NO: 3503 - protein, 71 aa, M.catarrhalis
TQEYKMSKNKTPDYVLRANANYRKKHTTNKSLQLHNEKDADIIQALQNETKSFNALMKDILRNHYNLNQNQ

SEQ ID NO: 3504 - protein, 170 aa, M.catarrhalis
YTHQDKTSTIKGINMTTLYHGSHENTAPVIKIGFAAFLPADNVFDGIFANGDKNVARSHGDFIYAYEVDSIATNDDLDCDEAIQIIAKELYIDEETAAPIAEAVAYEESLAEFEEHIMPRSCGDCADFGWEMQRLRGVIARKLGFDAVECVDEHGVSHLIVNANIRGSIA

SEQ ID NO: 3505 - protein, 89 aa, M.catarrhalis
TKSQANGTKEMAMNSLNSNNLSELMNDVDKCKVLIELLENSYGDNDWKLAQTLSVIKDILTPVIAGLIDVVDDLMEQEDKDKPVLSKVA

SEQ ID NO: 3506 - protein, 257 aa, M.catarrhalis
SITQSKIGKFTFLIFLFGANMPLNSDFQKPTVDGLITLFELDASKLGAGILRFHGHNHEHNDGVIVFRGKAYNPQALNVTGLEMRSDGRASTPTLTLANNIAGVQGAVSAYCLQFNDFAGAKLTVITTLAKYLDPINFDNGNPTASDECKEQIWFVEQKTSENAQQVTFELANPIDLEGQKIPVREITNYCHWAVVGKYRGEECGYTGVAMFDEHDNPTDNPIMDKCGGRMKSCVCRFGRNKPLPFGGCPASSLIGS

(The sequence listing continues in the following parts.)

What is claimed is:

1. An isolated nucleic acid molecule encoding an *M. catarrhalis* polypeptide of SEQ ID NO: 2139.

2. A recombinant expression vector comprising the nucleic acid of claim 1 operably linked to a transcription regulatory element.

3. A cell comprising a recombinant expression vector of claim 2.

4. An isolated nucleic acid molecule selected from the group consisting of:
   (a) SEQ ID NO: 219;
   (b) an RNA of (a), wherein U is substituted for T.

5. A recombinant expression vector comprising the nucleic acid of claim 4 operably linked to a transcription regulatory element.

6. A cell comprising a recombinant expression vector of claim 5.

7. An isolated nucleic acid molecule of at least about 40 consecutive nucleotides in length, wherein the isolated nucleic acid molecule is selected from the group consisting of:
   (a) an isolated nucleic acid molecule fragment of SEQ ID NO: 219;
   (b) an RNA of (a), wherein U is substituted for T.

8. An isolated nucleic acid molecule of at least about 40 consecutive nucleotides in length, wherein the isolated nucleic acid molecule hybridizes under conditions of high stringency to an isolated nucleic acid having a nucleotide sequence selected from the group consisting of:
   (a) SEQ ID NO: 219;
   (b) an RNA of (a), wherein U is substituted for T.

9. An isolated nucleic acid comprising the sequence of SEQ ID NO: 219.

10. A recombinant expression vector comprising SEQ ID NO: 219 operably linked to a transcription regulatory element.

11. A cell comprising a recombinant expression vector, wherein the recombinant expression vector includes SEQ ID NO: 219 operably linked to a transcription regulatory element.

12. An isolated nucleic acid molecule that hybridizes under conditions of high stringency to SEQ ID NO: 219, wherein the isolated nucleic acid molecule is at least about 40 consecutive nucleotides in length.

13. A recombinant expression vector comprising an isolated nucleic acid operably linked to a transcription regulatory element, wherein the isolated nucleic acid hybridizes under conditions of high stringency to SEQ ID NO: 219 and is at least about 40 consecutive nucleotides in length.

14. A cell comprising a recombinant expression vector, wherein the recombinant expression vector includes an isolated nucleic acid operably linked to a transcription regulatory element, wherein the isolated nucleic acid hybridizes under conditions of high stringency to SEQ ID NO: 219 and is at least about 40 consecutive nucleotides in length.

* * * * *